United States Patent 9,061,059 (MODIFIED POLYNUCLEOTIDES FOR TREATING PROTEIN DEFICIENCY) - sequence listing, part 113

SEQ ID NO: 219712 - DNA, 3111 bp, Artificial Sequence
  Description of Artificial Sequence: Synthetic coding sequence
atgtatcttgtcgctggcgaccgcggactagctgggtgtgggcaccttctggtatcactgctgggcctgctcctcctcctggccagatctggaacacgagccttagtgtgtctgccatgcgacgagtccaagtgcgaggagccccgaaactgcccaggctccattgtccagggagtttgtggttgctgctatacctgcgcttcacagcgtaatgaaagttgtggcggtaccttcggcatttacggcacatgtgaccgaggactccgttgtgtcatccgcccacccttaaatggggatagtctgaccgagtatgaggccggagtgtgtgaagatgagaattggactgatgaccaactgctgggatttaagccttgtaacgagaacctcatagcagggtgtaatattataaacgggaagtgcgagtgtaatacaatacggacatgctcaaatccctttgaatttcccagtcaggatatgtgtctgagtgccctcaagaggatcgaagaagagaaaccagactgcagtaaggccagatgcgaggtccagttttccccaagatgccctgaggattcagttttaatagaaggttatgctcctcccggagaatgttgcccgttgccaagtagatgtgtttgtaatcccgctggctgcctgagaaaagtatgccaacccggaaatctgaatattctggtgtctaaggcatccgggaaacctggtgagtgctgcgatctttatgagtgcaagccagtattcggagtagattgtcgcacagtggagtgcccccctgtgcaacaaacggcttgtccaccagactcttacgagacacaggtacggcttacggcggacggatgctgcaccctgccaactcgatgcgagtgcctttccggcttatgcgggtttccagtgtgtgaggtgggatctacaccacggatcgtgagtcggggagatgggactcccggaaagtgctgcgacgtgttcgagtgcgtcaacgacaccaagccagcttgtgtttttaataacgtggagtactacgatggtgacatgttccgaatggataactgccgtttctgtagatgtcaaggtggagtagccatctgcttcaccgcccagtgtggagagataaactgcgaaaggtattacgtgccggagggcgagtgttgccctgtttgcgaagatccagtgtaccctttcaataacccggcaggatgctacgcaaatggcctaatcctggcccatggcgaccgctggagggaggatgattgtacattttgccagtgcgttaatggtgagagacactgcgtcgctacggtgtgtggtcagacttgcaccaaccccgtgaaagtgcccggagagtgttgccccgtctgtgaagagccaactatcatcactgtggacccacccgcatgtggggagctgtcgaactgcaccctgacaggcaaggattgcatcaacgggtttaagagagatcataatggctgcagaacatgccagtgtataaatactgaggaactgtgcagtgagagaaagcagggatgcaccctaaattgtccctttggcttcttgaccgacgctcagaactgcgaaatttgcgagtgtcggcctcggcctaagaagtgccggcctatcatttgtgataagtattgcccgctggggctcctgaaaaataagcacggatgcgatatttgtagatgcaagaaatgtcccgaactctcatgttctaaaatctgccccctgggatttcagcaggacagtcacggctgccttatttgcaagtgccgagaggcgtccgcatctgctggaccaccgatcctcagtggcacatgcctcactgtggacgggcaccaccataagaacgaggagtcatggcatgacggctgccgcgaatgctattgcctaaatgggcgagagatgtgtgcccttattacttgccctgtcccagcctgcggaaaccccactattcatcctgggcagtgctgtccaagctgtgctgatgactttgtggtccaaaagccagagctatctaccccttcaatttgtcacgcccctggcggagagtattttgtggagggcgagacctggaacatagacagttgtacgcagtgcacctgccactccggcagagtattatgcgaaaccgaagtgtgtcccccattgttgtgccagaatccaagtagaacacaggatagttgctgcccccagtgtaccgatcagcccttcagaccgtcactgtctaggaacaacagcgtcccaaactactgcaagaatgatgagggagacatcttcctggccgcagagtcctggaagcctgacgtgtgtacttcctgtatttgcatagacagtgtgatctcatgctttagcgaaagctgcccctcagttagctgtgaacgaccagtcttgagaaagggacagtgttgcccatattgcatcgaggacacaattcctaagaaggtagtatgccacttttcaggcaaagcgtacgccgacgaagagaggtgggatttagattcctgcactcactgttattgcctgcaaggccagaccttatgctccacagtcagttgtccaccgctcccctgtgtcgagccgataaatgtggagggaagctgctgtcccatgtgccccgagatgtatgtgccagagcctactaacattccgatcgagaaaacaaatcacagaggagaagtcgatctggaagtgcctctgtggccgacccctagcgaaaatgatatcgtgcatttgcctagggatatgggccacctgcaggtggattatcgggataaccgccttcacccctccgaagattcttcactggattctattgcaagcgtggtagtccctattatcatttgcttatccatcatcattgcctttctgttcattaatcaaaagaagcagtggattcctctgctgtgctggtatcgtacacccaccaagcccagcagtcttaataaccagctcgtctctgtggattgtaagaagggcactagggttcaggtggactcgtcacagcgaatgctgcgcattgccgagcccgatgccaggttcagcggtttctatagtatgcagaaacagaaccacctgcaagctgataacttctaccagacagtgtag

SEQ ID NO: 219713 - DNA, 498 bp, Artificial Sequence
  Description of Artificial Sequence: Synthetic coding sequence
atggctgattttgatgaaatatacgaggaagaggaagacgaagaacgggctctcgaggagcagctactgaaatattcaccagatcctgtggttgtgagaggttcaggccacgtgaccgtttttggtctgagcaacaaattcgaatccgagttccctagttctttgacagggaaggtggctcccgaggaatttaaagcttccattaaccgagttaattcctgcctaaagaagaatctgcccgtaaacgtgagatggctgctgtgcggctgcctctgctgctgctgcacactcggatgttccatgtggcccgtaatttgcctgtcgaaacgcacccggaggtctatcgaaaaactcttggaatgggaaaataataggctctatcacaagttgtgtcttcactggcgcctgagtaaaagaaagtgtgagacgaacaatatgatggaatacgtcatcctcatcgaattcctcccaaagactcctatttttaggcctgattag

SEQ ID NO: 219714 - DNA, 234 bp, Artificial Sequence
  Description of Artificial Sequence: Synthetic coding sequence
atgcccaaatgtccaaagtgtaataaggaggtatactttgccgaaagggtaactagcttaggcaaggactggcacaggccctgcttgaaatgcgagaagtgcgggaagacactcacgagcggaggccatgctgagcacgagggtaaaccatattgcaaccacccttgttacgccgctatgttcgggccaaaaggattcgggagaggaggagctgaaagccacacgttcaagtag

SEQ ID NO: 219715 - DNA, 234 bp, Artificial Sequence
  Description of Artificial Sequence: Synthetic coding sequence
atgcccaagtgcccaaaatgcaacaaagaagtgtactttgcggagcgcgtcaccagcctgggaaaagattggcacagaccatgcctcaagtgtgagaaatgcggcaagacactcactagtgggggacatgctgagcatgagggaaaaccttattgcaaccacccttgttacgcggctatgttcgggccaaaaggatttgggagaggaggcgcagaaagccataccttcaagtag

SEQ ID NO: 219716 - DNA, 234 bp, Artificial Sequence
  Description of Artificial Sequence: Synthetic coding sequence
atgccaaagtgccccaaatgtaacaaggaggtgtacttcgccgaacgtgtcacaagtctagggaaagactggcataggccttgtctgaagtgcgagaagtgcggaaagacacttacttcaggcggacatgccgaacatgagggtaaaccatattgtaatcacccatgctatgctgcgatgttcggccctaaggggttcgggagggggggtgctgaatcacacacattcaagtag

SEQ ID NO: 219717 - DNA, 627 bp, Artificial Sequence
  Description of Artificial Sequence: Synthetic coding sequence
atggcttcaaaatgccccaagtgcgataagacggtgtattttgccgagaaagtttcctctttaggcaaggactggcacaagttctgtctgaagtgcgagcgttgttcaaaaaccctgacgcctggaggccacgctgagcacgatggaaaaccattttgtcataaaccttgctacgccactttgtttggccctaagggggtgaatattggcggagccggtagctacatttatgagaagccactggcagaaggaccccaagtgactggcccaatagaggtcccggctgcgagagcagaagagcgaaaagcatctggccctcccaagggtccaagcagggcatccagcgtgactacatttaccggcgaacccaacacctgcccccgatgttctaaaaaagtttacttcgcagaaaaggtgaccagcctggggaaggactggcacaggccctgtctgaggtgtgagaggtgcggcaaaaccctgacgccaggcggacatgccgagcatgacggccaaccctactgccacaagccttgctacgggatacttttcggcccaaaaggcgtgaataccggcgctgtgggttcatatatttacgacagagaccctgaaggaaaggtccaaccgtag

SEQ ID NO: 219718 - DNA, 849 bp, Artificial Sequence
  Description of Artificial Sequence: Synthetic coding sequence
atgccaccgcaccatttgctgccctggctcgcccaggtgccaagcgccgaaggcgagttagtgagactggtgtcgcgcgcagggggtcgtggagcctgcttttggcctgcggtgactatggaaatggccgttgccgcaggatgcgtctgtaaaggaggcggatgttgccatcgcgaacccagccaggatcatcacgagagtcaagagcaccgcggtcccctggtgggtagtcaaacgtgtctggttcaccaggccgaaggaaccgcggagaaggtgagctcccttggcaaggactggcacaagttttgtctgaaatgcgaaagatgctcaaaaacattaacacctggcggtcatgccgagcacgacggtaagcctttctgccacaaaccttgttacgccaccctcttcggacctaaaggtgtgaatattgggggagcaggcagttatatctacgaaaaacccctggccgaaggaccgcaggtcactgggccaattgaggtgcctgccgctagagctgaagaacgcaaggctagcggtcccccaaagggaccctctcgagccagcagcgttacaacgtttacaggggaacccaacacttgtccccgttgcagtaaaaaggtgtattttgcagagaaagtcacctctctgggcaaagattggcatcggccatgtctgaggtgtgaacgctgcgggaaaaccttgactcctggaggtcatgcggaacacgatgggcagccctattgccacaagccttgctatgggatattgtttgggccaaagggcgtaaacaccggcgctgtcggcagttacatctacgacagggatcccgaagggaaggtgcaaccatag

SEQ ID NO: 219719 - DNA, 315 bp, Artificial Sequence
  Description of Artificial Sequence: Synthetic coding sequence
taaccgggaggggagcgagccgaaggcgctgggaggcctggcgcaccaacgatggcgagcaaatgccctaagtgcgataagacagtttacttcgccgaaaaggttacttcgctcggcaaggattggcatcgaccatgtttgcggtgcgagaggtgtgggaaaacactgacacccggtggccatgcagagcacgacggtcagccctactgccacaaaccatgttatggcatcctctttggacctaaaggcgtcaatacgggagcagttggaagctacatttatgatagagatcccgagggcaaggtacaaccctag

SEQ ID NO: 219720 - DNA, 537 bp, Artificial Sequence
  Description of Artificial Sequence: Synthetic coding sequence
atggaaataaaacatcttctctttctggtggccgcagcgtgtctcctgccgatgctcagcatgaaaaagaaatccgctcgcgaccagtttaataagctggtcacagatctgcccaacgtgcaggaagaaatcgtcaacatccataacgctcttcgcaggcgcgtagtgccgcctgcctccaacatgctgaagatgagttggtccgaagaggccgctcagaacgccaggattttctccaagtattgcgatatgacagaaagcaatcccttggagcgcagactccccaatacattctgcggtgaaaatatgcacatgacaagctaccccgtttcctggtcatctgtcatcggagtgtggtactccgaaagtacctcttttaagcatggagagtggacaactaccgatgacgacattaccacagatcactacacacaaatagtctgggcaacatcataccttattggttgtgctatcgcatcctgtcgtcagcaagggtcccctaggtacctgtacgtctgccactactgccatgactag

SEQ ID NO: 219721 - DNA, 750 bp, Artificial Sequence
  Description of Artificial Sequence: Synthetic coding sequence
atggagatcaaacatcttttattcctcgttgcagcagcctgcctattgcctatgctctccatgaagaagaaatccgcccgagatcagttcaataagctggttaccgacctgcccaacgtgcaggaggaaattgtcaacattcataacgctctgcgaagacgcgtggtgcctccggcatcaaacatgctgaagatgagttggagtgaagaagccgctcagaacgctagaatattttctaagtattgtgatatgacagagagtaaccctctggagcggagattacccaatacattttgcggtgagaacatgcacatgacatcctatccggtgtcttggtcaagtgttataggggtttggtatagcgaatctacttcctttaagcatggcgaatggaccacaaccgacgacgacattaccaccgaccactacacgcagattgtgtgggctacatcttatctcatcggctgtgccatcgcgtcttgcagacaacagggctctcctaggtacttatacgtgtgccattactgccacgagggaaatgacccagaaaccaaaaatgaaccgtataagactggtgtgccctgtgaagcctgtccctctaactgcgaagataagctgtgtacaaacccatgtatttactatgacgagtattttgactgtgatatccaggttcactatctcggatgtaatcattccaccactatcttattctgcaaggctacatgtctgtgtgatacagagattaagtag

SEQ ID NO: 219722 - DNA, 750 bp, Artificial Sequence
  Description of Artificial Sequence: Synthetic coding sequence
atggaaattaagcatctcctgtttctcgtggccgcagcctgcctgttgcctatgctcagtatgaagaagaaaagcgccagagatcagtttaacaagctggtcaccgatctgccgaacgtgcaagaggagatcgtgaatatccataacgcactgcgtcgcagggttgttcctcccgcaagcaacatgctgaaaatgtcctggtccgaggaggcagcacagaatgccaggatttttagtaagtattgtgacatgaccgagtcaaaccctttagagcgccgactgcccaacactttctgcggcgagaatatgcatatgacctcctaccccgtgagctggtcttccgtaatcggagtttggtatagcgagagtacatcgttcaaacacggcgagtggaccactactgatgatgatattacgaccgaccattacacacaaattgtgtgggctacatcatatctgatcggatgtgctatagcttcctgtcggcagcagggctctccacgctacctgtatgtgtgtcattattgccacgagggcaatgatcccgagaccaaaaatgagccctacaagacaggagtgccttgtgaggcatgcccctccaactgtgaagataagctctgtaccaatccatgcatttactacgatgaatatttcgattgtgacatccaagtccactacctgggttgtaatcatagcacgacaatcctgttctgtaaagctacatgcctctgcgacaccgagatcaagtag

SEQ ID NO: 219723 - DNA, 750 bp, Artificial Sequence
  Description of Artificial Sequence: Synthetic coding sequence
atggagatcaaacaccttctgttcttagtggcagccgcatgtctgctgccgatgctatccatgaaaaaaaagagcgcgcgagaccagttcaacaagctggtgacagatctgccgaacgtgcaggaggaaatagtcaatatacataacgctttacggcgtagagtcgtgccacccgcttccaacatgttaaagatgagttggtctgaagaagctgcccagaacgcgagaatattcagcaaatactgcgatatgaccgagtccaacccactcgaaaggcgtctgcccaataccttttgcggcgaaaatatgcatatgaccagctaccctgtctcatggagttctgtgatcggggtgtggtacagcgagtctacctctttcaagcatggagagtggaccaccaccgacgatgacattactactgatcattacacacagattgtttgggctacttcctatttgattggatgtgccattgccagttgcaggcagcaagggagccccagatatctgtacgtgtgccattactgccacgagggaaacgacccagagactaaaaacgagccttacaaaactggcgttccctgtgaagcctgccctagcaactgcgaagacaaattatgtaccaacccctgcatatactatgacgagtatttcgattgtgacattcaggtgcattatctggggtgcaatcacagcactactattctattctgtaaagcaacatgtctgtgcgacactgaaataaagtag

SEQ ID NO: 219724 - DNA, 537 bp, Artificial Sequence
  Description of Artificial Sequence: Synthetic coding sequence
atggaaatcaaacacctgctgtttctagtggccgcagcctgtctgctcccaatgctgtcaatgaaaaaaaagagcgcaagagatcaattcaataaacttgtgactgacctgccaaatgttcaggaggaaattgtgaacatacacaatgccctccgacgcagggtggtgcctccagcctctaacatgctgaaaatgtcctggagcgaagaggccgcacagaacgctcgcatattttccaaatactgcgacatgacggaatcaaaccctcttgagcggaggctgcccaataccttttgcggtgagaacatgcacatgacaagctaccccgtaagctggagctcagtgattggcgtctggtatagcgagtctacctcattcaagcatggagagtggacaaccacagacgacgacattactactgatcactacacacagatcgtgtgggcaacgagttatttaatcggctgcgccattgctagctgcaggcaacagggttctcctcgatacctgtacgtatgtcattactgtcacgattag

SEQ ID NO: 219725 - DNA, 537 bp, Artificial Sequence
  Description of Artificial Sequence: Synthetic coding sequence
atggaaatcaaacacctacttttcctggtggccgcagcgtgcttgctccccatgctgtcaatgaagaaaaaaagtgcaagagaccagtttaacaagttagtgacagaccttccaaacgttcaagaggagattgtgaatatccacaatgcactgagaaggcgtgtggtgccgcctgcttctaacatgctgaaaatgtcctggtcagaggaggcagcccagaacgcaagaattttctctaagtattgcgatatgacagagtctaatccactggagaggaggttgccaaataccttttgtggagaaaacatgcacatgacatcttatccagtaagttggtcttccgtcataggggtctggtactctgaatccacttcctttaaacatggcgagtggaccactaccgatgacgatataaccacggatcactacacccagatcgtgtgggcaactagttatttaatcggatgtgctattgcatcctgcagacaacagggtagtccacgctatctctacgtatgccattattgtcatgattag

SEQ ID NO: 219726 - DNA, 669 bp, Artificial Sequence
  Description of Artificial Sequence: Synthetic coding sequence
atggctgggaaaccaaagctacattacttcaacggacgcggtaggatggagccaattaggtggctgctggccgcagccggagtcgagtttgaggagaagtttattgggagtgctgaggacctggggaaactgcggaatgatggatcacttatgttccagcaggtgccaatggtcgagatcgatggcatgaagttggtccagacgagggccattctcaactatatagcttcaaaatacaacctgtacgggaaggacataaaggagagagcgctgattgatatgtatacagagggtatggctgatctcaacgagatgatcctgcttctgccgctttgccggcctgaggaaaaagatgcaaagatagccctcataaaagagaagaccaagtcaagatatttcccagcattcgaaaaggtacttcagagtcacggacaagactatctcgttggtaacaaactaagtagggccgacatcagcctcgtcgaactgctttactacgtagaagaactggacagctcattaatctccaattttccgctgctgaaagccctgaagacccgcatatcaaatctgcccactgttaagaaatttttacaacccggttcaccacggaaaccacccgctgatgcaaaggcactggaggaggcacgcaaaatcttccggttttag

SEQ ID NO: 219727 - DNA, 732 bp, Artificial Sequence
  Description of Artificial Sequence: Synthetic coding sequence
atggctttactgcccgtgcttttcctcgtcacagttcttcttcccagccttcctgcagaggggaaagaccccgcattcaccgccttacttaccactcagttgcaagtccaaagagaaattgtgaacaaacacaacgaacttcggaaagcagtctcgccgcctgcttccaatatgcttaagatggagtggagtcgcgaagttaccactaacgcccagcgttgggccaataagtgtacacttcaacactcagacccggaggaccgtaagaccagtacaaggtgcggagaaaacctctatatgtcttccgatccaaccagttggagcagcgcaatccagtcttggtatgatgagatactggattttgtctacggggtgggcccaaaatctcccaatgccgttgttggccactatacccaactcgtctggtattcaacataccaggttgggtgcggtattgcgtattgccctaaccaggactccctgaaatactactacgtgtgccaatactgtcctgccggtaacaacatgaataggaagaacaccccataccagcagggaacgccatgtgcaggctgccccgacgattgcgataagggcctgtgtactaactcttgccagtatcaggacctgctctccaattgcgatagtctgaaaaatacagcgggatgcgaacatgaactcctgaaagagaagtgtaaagctacatgtttgtgcgagaacaaaatctactag

SEQ ID NO: 219728 - DNA, 1494 bp, Artificial Sequence
  Description of Artificial Sequence: Synthetic coding sequence
atgtcctgtgttttaggaggggtcatcccactggggctgcttttcttggtatgcggaagtcaggggtatttgcttccgaacgtgactctgctcgaggaattactcagtaaataccagcacaatgaaagtcattcaagggtccgacgcgctattccacgggaagacaaagaggagattttaatgctgcataacaagctgagaggtcaagttcagcctcaggcttctaacatggagtacatgacctgggacgatgagctggaaaagtccgccgcagcatgggcatcccagtgcatttgggagcacgggccaacaagcctgctagtgagcataggccagaatctcggcgcacactgggggagatatcggtctcccggattccacgtgcaaagttggtacgatgaggttaaggattatacttacccctacccttcagagtgcaatccttggtgcccagaacgatgctcggggccaatgtgcacccactatacgcaaatagtatgggccactaccaataaaataggatgcgctgtgaacacttgcaggaaaatgactgtgtggggagaagtctgggaaaacgctgtctacttcgtgtgcaactattcacccaagggaaactggattggcgaagctccctacaaaaacgggaggccttgttcggagtgccctccctcctacgggggttcttgccgtaacaacctgtgctatagggaagagacatacacacccaagcccgagaccgacgagatgaacgaagtggagaccgcgcctatccccgaagagaatcacgtctggctgcagcccagagtgatgcgccctactaagccgaaaaagaccagcgccgtgaactacatgacgcaggtggtaagatgtgacaccaagatgaaggaccgatgtaaggggagtacttgcaaccgctatcagtgccctgcgggatgtctgaatcataaggccaaaatctttggaaccctcttttacgagtctagttcaagcatttgtcgggcagcgattcactacgggattctggacgataagggtgggctggtggacatcacaaggaatgggaaagtgccattctttgtcaaaagcgagagacacggcgtccagtctttgtctaagtataaacctagttctagctttatggtcagcaaagtgaaagtccaggacctcgattgttataccaccgtggcccagctctgcccttttgagaagccggctactcactgtccgcgtattcactgtccggctcattgtaaggacgaaccctcatattgggccccagtatttggaaccaacatctacgccgacacaagcagtatttgtaaaactgctgtccacgccggtgtaatctcgaacgaatccggtggagacgtggacgttatgcccgttgataagaagaagacatacgtggggagcctcaggaatggagtccagtccgaatctctgggcactccacgggatggcaaagctttccggatcttcgccgtgaggcagtag

SEQ ID NO: 219729 - DNA, 1269 bp, Artificial Sequence
  Description of Artificial Sequence: Synthetic coding sequence
atggctccctggcctccaaagggtcttgtgccggcaatgttgtggggcctcagtctgttcttgaaccttcccggtccgatctggctgcagccttcacctcctccccagtcctctccaccaccccagccacatccgtgccatacctgcaggggtctcgtggactcatttaacaaaggcctagaaagaaccattagagacaacttcggtggcggtaatacagcctgggaggaggaaaatctgagcaagtataaggacagcgagaccagactggtcgaggtcctcgaaggtgtgtgttcaaagagcgactttgagtgccacaggctcctagaactctccgaggagcttgtcgaaagctggtggttccacaagcagcaagaagctccagatctctttcaatggctttgctcagatagtctgaaactttgctgtcccgcagggaccttcggtccctcttgtcttccctgtcccggagggactgagagaccctgtggtgggtacggtcaatgtgaaggggaggggactaggggtggtagcggccactgcgactgtcaagccggttacgggggtgaagcctgtggtcagtgtgggctcgggtattttgaggccgagcgaaatgcctctcatctggtgtgcagcgcgtgctttggcccatgtgctcggtgctcaggcccagaggagagcaattgcctgcagtgcaagaagggatgggccctgcatcatctcaagtgtgtagatattgatgagtgcgggaccgagggcgctaactgcggagccgatcagttttgtgtgaacactgagggtagctatgaatgcagggattgcgctaaggcctgtctagggtgcatgggggcaggaccaggccgatgtaagaagtgttccccagggtatcagcaggttggctccaaatgcctggacgttgatgagtgtgagaccgaggtgtgtccaggtgagaacaagcagtgcgaaaatacagaagggggttatagatgtatatgtgcggagggatataagcagatggaggggatatgcgtgaaagagcagatcccaggcgcattcccaattttgaccgacctgactcctgaaaccaccagacgatggaaactgggctctcaccctcactccacctacgtgaaaatgaaaatgcagagagacgaggcaacttttcccggattatacggaaagcaggtggcgaaactaggcagccagtctaggcagagcgacagaggaactcgtctcattcactctcagcaagcctcatcgcagcggtag

SEQ ID NO: 219730 - DNA, 1263 bp, Artificial Sequence
  Description of Artificial Sequence: Synthetic coding sequence
atggcgccttggcctccaaaagggctggtgcccgcaatgttgtggggtttgtctctgtttctcaacttacctggcccaatttggctgcaaccaagcccacctccacaaagtagcccaccaccacagccccacccttgtcacacctgccgcggactcgttgattcatttaataaaggcctggagcggacaattcgtgacaatttcggtggaggaaacacagcctgggaggaggaaaacctctcaaagtacaaggactcagagactcggctggtggaggtgttagagggagtttgctcaaagagcgacttcgaatgtcaccgcctgttagaattgtcagaggagctggtcgaaagctggtggttccacaagcagcaggaggccccagatctcttccagtggctgtgtagtgacagcctgaagctctgttgccccgctggaaccttcggccctagttgccttccctgcccaggaggcacagaaaggccatgcggtgggtacggacagtgtgagggcgagggaacccggggaggatcaggacactgtgactgtcaggccggttacggtggagaagcctgtggacagtgtgggctgggctactttgaggcagagcgcaatgcgtcacatctggtctgttccgcttgctttggcccttgcgctaggtgtagtggacccgaggaatccaattgtctccagtgtaaaaaaggctgggcactgcatcatttaaagtgcgtcgatattgacgagtgcggcacagagggggcaaactgtggtgcggatcagttctgtgttaacaccgagggatcctacgagtgtagggactgtgctaaggcttgtctaggttgtatgggagccggacctggccgatgtaagaagtgttctcctggctatcagcaggtcgggtcaaaatgtctcgacgtagacgaatgcgagaccgaagtctgtcctggcgagaataagcagtgcgagaatactgaggggggataccgctgcatctgcgccgaaggttacaagcagatggagggcatttgcgtgaaagaacaaatccccgaaagcgctggattcttttccgagatgaccgaggacgagctggtggtcctccagcagatgttcttcggaattattatctgtgcactcgctaccttggcggcaaagggcgatttggtgtttacagctatatttatcggggctgtcgccgctatgactggctactggctttctgagagatccgacagagtcctggaaggcttcataaaaggtcggtag

SEQ ID NO: 219731 - DNA, 1263 bp, Artificial Sequence
  Description of Artificial Sequence: Synthetic coding sequence
atggccccttggcctcctaaagggttggtgcccgctatgctgtggggattgtctctgtttctaaatcttccaggccctatctggcttcagcccagcccccctcctcagagctcaccaccaccgcaaccccacccatgccatacctgccgcggactggtagatagcttcaataaggggttggaacgcacaatacgcgacaactttggcggaggcaatacagcttgggaggaggaaaacctatccaagtacaaggactccgagacacgcctggttgaggtgctcgaaggcgtttgttcaaagagcgactttgagtgtcataggctgttagagctgtctgaagagctggttgagagctggtggtttcataagcagcaggaggcacccgacctctttcagtggctgtgtagcgatagcctgaaactctgttgtcctgccggtacattcggcccttcctgcctcccttgtcccggtggtaccgaaagaccctgcgggggatatggacaatgcgaaggagaaggtacacgaggcggttccggccactgtgattgccaagcaggttatggcggagaggcttgcggacagtgtgggctcggctatttcgaggctgagcgcaacgcatcccatttggtgtgcagcgcttgctttgggccttgtgcgcgttgttctggtccagaggagtctaactgcctgcagtgcaagaagggttgggccttacatcacctcaagtgtgtcgatattgatgagtgtggcaccgagggcgcaaattgtggtgccgatcagttctgcgttaatacagaagggtcctatgagtgcagagactgtgccaaggcatgcctgggatgcatgggggcagggccaggtcgatgcaagaaatgttcccctggatatcaacaagtgggcagcaaatgcctggacgtggacgagtgcgaaacagaggtttgccccggagagaacaaacaatgcgagaacacagaagggggttaccgctgtatctgcgcagaaggttataagcagatggaagggatttgtgtaaaagagcagattccagaaagcgcgggtttcttttcagagatgaccgaagacgaacttgttgtgctccagcagatgttctttggcatcattatctgtgccctcgccacgttggctgctaaaggcgacttagtgtttacagcaatcttcataggcgcagtggcggcaatgaccggttactggctcagtgaaagaagcgaccgcgtgctggaaggcttcataaagggacgctag

SEQ ID NO: 219732 - DNA, 1263 bp, Artificial Sequence
  Description of Artificial Sequence: Synthetic coding sequence
atggcaccatggccgcctaagggactagttcccgctatgctctggggcttgagcctgtttttaaatctcccagggcctatttggctgcagccatctccaccgcctcagtctagccctccaccacagccccatccctgtcacacgtgtcgcggactggtggattctttcaacaagggccttgagcgtacgatccgagacaacttcggcggaggaaacacggcctgggaggaagagaatttatccaagtataaagacagcgaaactcggctggtggaagtgctggagggcgtttgcagtaaatccgacttcgagtgtcatagactacttgaactgtctgaagagttggtcgagagctggtggttccacaaacagcaggaggcgcctgacctgttccagtggctctgttctgactcactgaagctctgttgtcctgctggaacctttggcccaagctgtttaccctgtccaggcggaaccgaacggccttgtggcggatacgggcagtgtgagggcgaggggactcgcggtggatccggccactgtgactgtcaggctggatatgggggtgaagcatgcggtcaatgtggcctaggctactttgaggctgagagaaacgcttctcacctagtgtgttccgcgtgtttcggcccttgcgctaggtgtagcggccctgaggaatcaaattgcctccagtgcaagaaggggtgggctcttcatcacttgaaatgcgtcgatatagacgaatgtgggaccgagggtgccaattgtggcgcagatcaattttgcgtgaacaccgagggcagctatgaatgtagagactgcgctaaggcctgcctgggatgtatgggtgccggacctgggaggtgtaagaagtgttcccccggttaccaacaggtggggtcaaaatgcctagacgttgacgaatgtgaaacagaggtgtgccccggagaaaataaacagtgtgagaataccgaagggggatataggtgcatctgtgccgaggggtacaaacagatggaggggatctgtgttaaggagcaaatacccgaatctgcaggatttttttcagaaatgactgaagatgagttggtcgtgctgcagcagatgttctttggcatcatcatttgcgccctggctacactagctgccaagggcgacctggtgttcaccgctatctttatcggcgcagttgccgctatgacaggatattggctttcagaaagatccgaccgagttctggaaggattcatcaagggtcgttag

SEQ ID NO: 219733 - DNA, 1140 bp, Artificial Sequence
  Description of Artificial Sequence: Synthetic coding sequence
atgtcctctagaattgctagggccttggctctggttgtaacactgctgcacttaacgcgtctggcactttcaacctgcccggctgcctgccactgcccacttgaagcgccaaagtgcgccccaggagtgggtctggtgcgggatggctgcggatgctgtaaggtatgcgcgaaacagcttaacgaagattgttcgaagacacagccatgcgatcacaccaagggcctggaatgcaactttggtgcgagttccacagctcttaagggcatctgccgcgcacaatcagagggccgaccgtgtgaatacaactcccgaatctaccagaatggcgaatcttttcaacccaattgcaaacatcaatgcacgtgcatcgacggagcggtcggatgtattcctctgtgcccccaggagctgtctctgcctaatctgggctgccctaatccacgcctggtaaaagtgaccggccaatgctgcgaagagtgggtatgtgacgaagacagcatcaaagaccccatggaggatcaggatggcctgctggggaaagagctcgggtttgatgcaagcgaggtcgagctaacacgtaataatgagctcatcgctgtgggaaaaggatccagcctcaagcggctgccagtattcggcatggagcctcgcattctgtataaccctctgcaaggccagaagtgcatcgtgcaaaccacgtcttggagccaatgttctaaaacttgtggaacaggtatttcaactcgtgtcaccaatgacaatccagagtgtagactggtgaaagagacgcgcatttgtgaggtgcggccttgcggacagcctgtgtactcttcattaaaaaagggaaagaaatgctcaaaaaccaagaagagccctgaacccgttcggtttacatatgctggctgcttatctgtcaaaaagtatagacccaagtactgtggtagctgcgtggatggaagatgctgcacaccacagctgacgaggtgcgaagacgctgtgcccctcagacgctggggggacattttccaggagaggcatgacgacccagtcaagtgtaattacaattgtccacatgctaacgaggctgcctttcccttttatcggctgtttaatgatatccacaagttccgggactag

SEQ ID NO: 219734 - DNA, 1146 bp, Artificial Sequence
  Description of Artificial Sequence: Synthetic coding sequence
atgtcttctcgtatcgccagggcattggctcttgtggtgacactactccacctgactaggctggcattgtccacctgcccagctgcctgccactgtcccctagaagcccctaaatgcgcacccggtgtgggtttagtcagggacgggtgcggatgctgtaaagtgtgcgctaaacaacttaacgaggactgtagcaaaacacagccgtgtgaccataccaaaggccttgagtgcaatttcggggctagtagtaccgctctgaaagggatttgtagggcgcagagcgaaggcagaccatgcgagtacaacagccggatttatcagaatggggagtcttttcagcctaactgcaaacatcagtgcacttgtatagatggcgctgtaggctgcattccactgtgtccccaggagctgtccctgccaaatctaggctgccctaatcccaggttagtcaaggttaccggacagtgctgcgaggagtgggtgtgcgatgaagacagcatcaaagaccctatggaggaccaggacggcctgctggggaaagagctcggttttgacgcttccgaggtcgagctcacaagaaataatgagctcattgccgtcgggaaagggtcctccctcaagagactccccgtttttggcatggaacccaggatactgtacaacccccttcagggccagaaatgtatcgtgcagactactagttggagccaatgtagcaaaacatgtgggactgggatctctacgagggttacaaatgacaatcccgagtgtcgtctcgtgaaggagactaggatatgcgaggtgagaccctgtgggcagccggtctactcatctcttaagaaaggaaagaaatgctctaagactaaaaagagcccggaacctgtcagattcacatacgccggatgtctctcagtgaagaagtatcggcctaagtactgcgggagctgcgtagacgggagatgctgtactcctcagctcacacgcacagttaagatgcgcttccgctgtgaagacggagagaccttttcgaagaacgtaatgatgatacaaagctgtaaatgcaattataattgtccccacgcgaacgaggccgcttttccattctaccgactgtttaacgacatccacaagtttcgtgactag

SEQ ID NO: 219735 - DNA, 1074 bp, Artificial Sequence
  Description of Artificial Sequence: Synthetic coding sequence
atgtcttccagaatcgctagggccctcgccttagtggtgaccctgctacacttgactaggctcgccttgtcaacatgcggctgctgcaaggtatgcgccaagcagttgaacgaggattgttccaaaactcagccctgtgaccacactaagggactcgaatgtaactttggcgcaagcagtactgccttgaagggcatttgccgtgcacagagcgaaggccgaccatgtgagtacaattcacgcatctatcaaaacggcgaatcttttcaacccaactgtaagcatcagtgcacctgcatcgacggagcagtggggtgtataccactatgtccccaagagcttagcctgcctaacctgggatgtcctaatccaaggctcgtcaaggtgaccgggcagtgctgcgaagaatgggtctgtgacgaggatagcattaaagaccctatggaagatcaagacgggctgctcggaaaagaactgggatttgacgcctctgaagttgagctaacacggaataatgaactgatagccgtcggtaagggaagctctctcaagagactgcctgttttcggaatggagccgagaatcctgtacaaccccctgcaaggacagaagtgtatcgtacaaacaacgtcctggagccagtgctctaagacgtgcggcactggcattagtaccagagtcacaaatgacaatcctgagtgccgcttagtcaaagagaccagaatctgtgaggtgcgcccatgcgggcagcccgtttattccagcctcaagaaagggaagaaatgttcaaaaactaaaaagtcccccgagccggtacgctttacgtacgcgggttgtctgtcagtgaaaaaataccggccaaaatactgtgggagttgcgtcgatggtcgttgctgtacacctcagttgactagaaccgtgaagatgcgtttcaggtgtgaggacggtgagacattcagtaaaaacgttatgatgatccaaagttgcaagtgcaactataactgtccccacgctaacgaggctgcatttcctttttatcgtctgttcaatgatatccataagtttcgcgactag

SEQ ID NO: 219736 - DNA, 1014 bp, Artificial Sequence
  Description of Artificial Sequence: Synthetic coding sequence
atggatgagactgggaatctaaccgtgtcaagcgctacctgtcacgatactatcgatgactttcggaaccaagtgtactccaccctctactctatgatctccgttgttggtttctttggaaatggctttgtcctttacgtactcattaagacataccacaaaaaaagcgcattccaagtgtacatgatcaacctagccgtagccgatttgctgtgcgtgtgcacccttcccctccgagttgtctactacgtgcataaagggatttggctttttggagattttttgtgtcgtctctccacctacgccctgtatgtgaatctgtactgcagcattttcttcatgacggccatgtcattttttcgttgtatcgccatcgtgtttcctgtgcagaacattaatctagtgactcagaagaaggcgaggtttgtgtgcgtcggaatctggatcttcgtgattttaacaagctcaccttttctgatggcaaaacctcaaaaggatgagaaaaacaacactaaatgttttgaaccacctcaagacaatcagactaagaaccatgttctcgtgctgcattacgtgtcactgtttgtgggtttcattatccccttcgtcataatcatagtgtgttatactatgattatcctcacgcttcttaaaaaaagcatgaaaaagaacctgtcttctcataaaaaggcgatcggcatgattatggtggtgaccgcagcatttctcgtcagcttcatgccatatcatatacagcgaaccatccatctgcacttcctgcacaatgaaaccaagccctgcgactccgttctgaggatgcagaagtcagttgtgatcaccttgtcgctggctgcttccaactgttgttttgaccctttgctgtactttttcagcggaggcaactttcgcaaaagactgagcacttttagaaaacactccctctcgtccgttacctatgtcccacggaagaaggcctccctgcccgaaaaaggagaagaaatttgcaaagtgtag

SEQ ID NO: 219737 - DNA, 1041 bp, Artificial Sequence
  Description of Artificial Sequence: Synthetic coding sequence
atggaaagaaagtttatgagtttgcaacccagcatctccgtgtcagagatggagccaaacggcacctttagcaataataatagccgcaactgcacaatagagaattttaaaagggaatttttccctatagtgtatcttatcatctttttctggggcgtgttggggaatggactgtcaatatatgtcttcctccagccttacaagaagagtacgtcagtaaatgtgtttatgttgaatctcgccatcagtgatctgctcttcatatccaccttgccgtttcgtgctgattattacctgagaggctctaactggatcttcggagacttagcgtgcagaatcatgtcctattccctctacgtgaacatgtactcttccatctatttcctgacagtcttgtctgtagtgcggtttcttgccatggtgcacccttttcgtttgctgcacgtcacaagtatccgttccgcttggatcttatgtgggattatatggatcctcatcatggcctcttcgatcatgttactcgactctggatccgagcaaaatggcagcgtgaccagctgtctggagctaaatctttataaaattgccaagcttcagacgatgaactatattgccttggtcgtgggctgcctgctgcctttcttcacactctccatctgctatctgttgatcatacgtgtcttactcaaagtggaagttccagaatccggcctcagggtgagtcatcgtaaggccctgacaactatcatcatcacactaataattttttttctctgtttccttccttatcacacgctgcgtacagtgcacctgacaacctggaaggttggcctttgcaaagaccgcctgcacaaagccctggttattacactcgcactcgccgcagccaacgcctgtttcaatccgctgctctattacttcgccggagagaattttaaggaccggctgaaaagtgccctcagaaagggtcacccccaaaaagcgaagacaaagtgcgttttcccggttagcgtctggctgcgaaaagagacgcgcgtttag

SEQ ID NO: 219738 - DNA, 2181 bp, Artificial Sequence
  Description of Artificial Sequence: Synthetic coding sequence
atggcggactcctccggacaacaaggaaaaggcagaagggttcagccgcagtggtcacctccagctgggacccagccttgtcgtctacacttgtataattcgctgactagaaataaggaggtcttcattccacaagacggcaagaaggtcacatggtattgctgcggccctacagtgtacgatgctagccatatggggcacgcgagaagttatatttcttttgacatactccgacgagtgcttaaagactatttcaaatttgatgtcttctactgcatgaacataacggacattgacgacaaaattatcaaaagagcgaggcagaaccatctatttgagcagtatagagagaagcgaccagaggcggcacagctattagaggacgtgcaggcagctctcaagccttttagcgtcaaactgaacgaaaccaccgaccctgataaaaaacagatgctggaaaggattcagcacgccgtccaactagccaccgaaccgctcgagaaagctgttcaaagcaggcttacgggcgaagaagtaaattcatgtgtagaggtgttacttgaagaggccaaggacttattgagcgattggctggactctaccttgggatgcgatgtcacagacaactcaatcttttccaaactgccgaaattctgggaaggcgactttcatagggatatggaggcgctgaacgtcctccctcctgacgtccttacacgggtctcagaatatgttcccgaaattgtgaacttcgtgcagaagattgtcgacaacggatatggctatgtctcaaatggtagcgtctatttcgacacggcgaaatttgcttcgagcgaaaagcattcatacggcaaactcgtgcccgaggcagtgggtgaccagaaagccctgcaggagggtgagggcgatctgtccatctctgccgaccggctgtcggagaagcgcagccccaatgattttgcattgtggaaagcaagcaagccaggcgaaccttcttggccatgtccctggggcaagggcaggccaggatggcatatcgaatgcagcgccatggccggaacgctgctcggggcatccatggacattcacgggggtggcttcgatcttcgcttcccacaccatgacaatgagctggcccagtcggaggcctattttgagaacgattgctgggttagatattttctgcacaccgggcatctcaccatagctggatgcaaaatgagtaagtctttaaagaattttatcaccattaaggacgcccttaaaaagcattccgccagacaactgagactggcttttttgatgcatagctggaaggatacccttgattattcatcaaatacgatggagtcggcactgcagtacgaaaaatttctgaacgaattttttttgaacgtgaaagatatcctgcgggcaccagtggacatcactggccagtttgaaaagtggggtgaggaggaggcagaactcaacaaaaatttctatgataagaaaacagccatccacaaggcactctgcgacaatgtagacacccggaccgtaatggaagagatgagggcccttgtttcccagtgcaatctgtacatggcggcacgaaaagcagtgcgaaaaaggcctaatcaggctctgctggaaaatatcgccctttatctgacgcacatgctgaagatttttggcgctgttgaggaggactcatctctcgggttcccagtaggagggccaggcacctcccttagtcttgaggcgacggtgatgccttacctccaagtcctctccgaatttagagagggagtgcgcaagatagccagagaacaaaaggttcccgagatcttgcaactctcagacgctctgcgcgataatatcctcccagagctgggagtgcggtttgaagaccacgagggcctgcccaccgtagtcaagttagtggacaggaatactctgcttaaggagagggaggagaaaaggagagtagaggaggaaaagcgcaagaaaaaagaagaagccgcaaggcgaaagcaagagcaagaggccgctaaacttgcgaagatgaaaattccaccctccgagatgttcctatcagagacagataagtactccaagtttgacgaaaacgtgagcatggtatgccctcatatgacttggagagcaaaatcatccgccaaaggcaaaccacgctcgtag

SEQ ID NO: 219739 - DNA, 2496 bp, Artificial Sequence
  Description of Artificial Sequence: Synthetic coding sequence
atggcagattcttccggccagcaagcaccagactataggtctatcctttctatttctgacgaagccgcaagagcgcaagcgttgaatgagcacttgagcacccggtcctatgtccagggctactctctgtcacaggccgatgtggacgcgtttaggcaattgtcagcgcctcctgccgatccgcaactattccatgtagcgcgatggttccgacatatcgaggctctcctgggatccccctgcggaaagggtcagccctgccggctccaagcctcaaagggcaggagggtgcagccccagtggtctccaccagccggtacgcaaccatgtcggctccacctgtacaacagtctcacccgtaacaaagaagtgtttattccgcaggacggaaaaaaggttacctggtattgttgcgggcctaccgtttatgatgcctcacatatgggccacgctcggagttacatctctttcgacatcctgagaagagttctaaaagactacttcaagttcgacgtgttctactgtatgaacatcacagacatcgacgataagatcatcaaacgggctagacagaatcatctattcgaacagtatcgtgagaagcgccctgaggcagcacaactgttggaagacgtgcaagctgctcttaagccgttcagcgtgaagcttaatgagacaactgacccggataagaaacagatgctggagcgcattcagcatgctgttcagctggccacggaaccgctggagaaggcagtccagtcacggctgacaggcgaggaggtaaacagctgtgttgaagtgcttctggaggaagcaaaggacctgctcagcgattggctcgactctacattggggtgtgatgtcacagataatagcatattttctaaacttcccaagttctgggaaggagactttcatagggatatggaggccttgaacgtcttgcccccagacgtcttgactagagtgagcgaatacgtcccagagatcgtgaatttcgtgcagaagatcgtcgataacggatacggctacgtgtcaaatgggagtgtatattttgacacagccaagttcgcttcctccgaaaaacacagctatggaaagctggtccccgaggctgtaggcgaccagaaggcgctccaggagggcgagggggacctaagtatctctgccgatcggcttagtgagaaaagatccccgaatgatttcgctctctggaaggcaagcaagcccggagaaccttcctggccctgcccttggggaaaggggcgaccaggctggcatattgaatgtagcgcgatggcgggaacccttttaggggcttctatggatattcatgggggagggttcgacctcagattccctcaccacgataacgagttggcccagagcgaggcatacttcgagaacgattgctgggtgaggtattttctgcacacaggccacttaactattgcaggttgcaagatgagcaagagcctgaagaatttcataaccatcaaggacgctctgaaaaagcattccgcgaggcagctccggctggccttcctgatgcacagttggaaagatactctcgactactccagtaataccatggaaagcgctctccagtatgaaaaattcctaaacgagttctttctcaacgtgaaagacatactgcgggctccagtggacatcacgggccagtttgagaagtggggagaagaggaggccgagctgaacaaaaacttttacgacaagaaaactgccattcataaggccctgtgtgacaatgtagacacgagaacagttatggaggagatgcgcgcactggtctcacagtgcaacttatacatggccgctcgaaaagccgtacggaagaggcccaatcaagcccttctggagaacatcgccctgtacctcactcacatgctcaaaattttcggagcggtggaagaggacagttccctgggtttccccgtgggcggacccggtacgagcctcagtctcgaagcaaccgtcatgccatacttgcaggtgttaagcgagttccgcgagggcgtcagaaaaatcgccagagaacagaaagtacccgagattctccagctgagtgacgcccttagggacaacattctgcctgaactgggcgttcgattcgaagatcacgagggactgcctactgtggtgaaattggtggacagaaatacattgctaaaggagagagaagagaagcgccgtgtggaagaggagaagcggaaaaaaaaggaggaggctgcgagaaggaaacaggagcaagaagcagctaaattagctaagatgaagatccctccctcagagatgtttctctccgagacagacaagtattccaagtttgatgaaaatgggctccctacccacgacatggagggaaaggagctgtccaaaggacaggctaagaaactcaagaagctttttgaggcacaggaaaaactctacaaggagtaccttcaaatggctcagaacgggagttttcaatag

SEQ ID NO: 219740 - DNA, 2247 bp, Artificial Sequence
  Description of Artificial Sequence: Synthetic coding sequence
atggccgactcctcagggcagcaggggaaaggtcgaagagtccagccccagtggtctcctcccgctgggacacagccctgtcgcctccacctctacaacagcctgacacgcaacaaagaagtgtttatccctcaggatggcaagaaggtgacgtggtattgctgtggcccaacagtctacgacgcctcccacatgggacacgcgaggagttacatctccttcgatattcttcggagagtgctgaaagattactttaagtttgatgtattctactgtatgaatattacagatatcgatgataaaatcattaagcgggctagacagaatcatttatttgaacaatacagggagaagcggcctgaagccgcacagctgctggaggacgttcaggccgctctcaaaccattctcggtcaagcttaacgagaccacagaccctgataagaaacaaatgctcgagagaatacaacatgccgtgcagctggctactgagcccctcgagaaggcagtccagagccgcctcacaggcgaggaagtgaattcgtgtgttgaggttcttttggaagaagctaaagacctcctctccgattggcttgactccacactaggctgtgatgtcactgataattctattttctccaaactgccgaagttttgggaaggagacttccatagagacatggaagcgttgaacgtgctgccaccagacgtccttactagggtgtctgaatacgtgccggaaattgttaattttgttcagaaaatcgtggacaatggctacggctacgtgagcaacggctccgtctatttcgatactgcaaagttcgcaagctccgaaaaacattcttacggtaagttggttccggaagccgtcggagatcaaaaagctctgcaggaaggcgaaggtgacttatcaatctcagcagaccgattgtccgagaagcgttcccccaacgacttcgccctctggaaggcatccaaacccggagagccctcatggccttgcccatggggaaagggtcggcctgggtggcacatcgagtgctcagctatggctgggacacttctcggtgcctctatggacatccatggagggggattcgacttaaggttcccacaccacgacaatgaactggcccagtcggaagcttatttcgagaatgactgttgggttcggtattttttgcatacaggacacttaactatcgccggatgcaagatgagtaagtccttgaaaaattttatcactattaaggacgccttgaagaagcactcagccagacagctgagactggctttcctcatgcattcgtggaaagacacactcgactactcaagcaacacaatggaaagcgcgctgcagtatgagaagtttctgaacgagtttttcttgaatgtgaaagatatccttcgcgcaccagtggacataacgggccaattcgagaagtggggagaggaagaggctgaactaaacaagaacttctacgataaaaagacagctattcataaagccctgtgcgacaacgtcgacactcggaccgtcatggaggaaatgcgtgccctagtatcacaatgcaatttatacatggccgcaagaaaggccgtgcgcaaacgccctaaccaggccttgttggagaacatcgccctttacctgacgcatatgcttaagatctttggggctgtggaagaggactcgtccctcgggtttccagtggggggaccaggaaccagtctgtctctcgaggccaccgtgatgccatacttgcaggtgctctccgaattccgggagggtgtcagaaaaattgcgagggaacaaaaggtgcccgagatcctccaacttagtgacgccctgcgggataacattctcccagagctcggagtgcgcttcgaagaccacgagggactgcccaccgtcgtcaagcttgttgatcgaaacaccttgttgaaagaacgggaagaaaaaaggagagtcgaggaagagaagcggaaaaagaaggaggaggcagctcgtcgcaagcaagaacaggaggctgccaagttggctaagatgaagatcccaccttcagagatgtttctgagcgagacagataagtacagtaaattcgatgaaaatggtctgcccacccacgacatggaaggaaaggagctctccaagggccaggctaaaaaactcaagaaactgtttgaggcacaggagaagctgtacaaagagtatctacaaatggcccagaacggctcctttcagtag

SEQ ID NO: 219741 - DNA, 2217 bp, Artificial Sequence
  Description of Artificial Sequence: Synthetic coding sequence
atgcaaacgccgcctctgcagcaaccacaccaggagcaggtgttcctggcgtttttggttatcgtcattccgtctttcctgactaaagaagttttcataccccaggatggtaagaaagtgacatggtactgttgcggccctaccgtgtacgatgcgagccacatgggccacgctcgatcctatatatcttttgacatcctgagacgtgtgttgaaagactatttcaaatttgacgtgttttattgtatgaatattacggacattgacgataagataatcaaacgcgctcgacagaatcacctgttcgaacagtacagagagaaaaggcccgaagctgcccagctactggaggatgtccaggccgcactgaagcctttcagcgtgaagctcaacgagacgacggaccctgacaaaaaacagatgctggaacgcatccagcatgctgtgcagcttgctacagaacccctagagaaagccgtccagagtcgtctgacgggggaggaggtgaactcttgcgtggaagttttgctggaggaggccaaggacttgttgagcgattggctcgacagcacacttggctgtgacgttaccgataattctatatttagcaagctgccaaagttctgggagggtgactttcatcgagacatggaggccctgaacgtgttgcctccagatgtgctgacacgagtgtccgaatatgtgccggagattgttaactttgtccaaaaaatcgtggataacgggtatggatacgtgagcaacggatccgtgtacttcgacaccgctaagtttgcttcctcagagaagcacagctacggtaagttggtccccgaagcagtcggcgaccagaaagcattgcaagaaggggaaggcgatctgagcataagcgctgacaggctgtcagaaaagcgctcacctaatgacttcgctttgtggaaggcttccaagcctggtgagccgagctggccttgcccctggggcaaaggtcgcccaggatggcatatcgagtgcagcgccatggcaggcacccttctgggagcctctatggatattcacggaggagggtttgatctgcgttttccacaccatgataatgagcttgcccagtcagaagcttatttcgaaaatgattgttgggttagatatttcctgcatacaggccacctgacaatcgctggatgcaagatgtccaagtccctgaaaaactttataaccatcaaggacgctttgaaaaaacacagcgctagacagttgaggttggccttcctcatgcactcttggaaggacacactggattactcttctaatacaatggaaagcgctctgcaatatgaaaaatttctgaacgaattctttctcaatgtaaaggacatcctgcgggctccagtcgacattactggacaattcgagaaatggggagaggaagaggcagagctcaacaaaaacttttacgataagaaaacagccatccacaaagccttgtgcgataacgttgacactagaacagtcatggaggagatgcgcgctctggtgtctcagtgcaacttgtacatggcagcccgtaaggccgtgaggaagagacccaatcaggctcttctagagaatatcgccctatacctgactcatatgctgaagatctttggcgctgtcgaggaggattcatccctgggctttccagtgggtggcccagggacatccctcagtctggaagctacagtcatgccatatttgcaggtcctgtccgagttcagagagggagtgagaaaaatcgcacgtgagcagaaagttcctgagatcctccagctgagtgacgccctccgagataacattctcccggagttgggcgtgcggtttgaagaccatgaagggttgcccaccgtggttaagctggtggacagaaacactctcctaaaggaaagagaggaaaagcgcagggttgaggaggaaaaaaggaaaaagaaagaagaggcggcacgcagaaagcaggaacaggaggccgctaagctagccaagatgaagattcccccttctgaaatgtttttgagcgaaacggataagtattctaagtttgacgagaacggactccccacccacgatatggaaggtaaggagctgagcaaggggcaggctaagaagctgaagaaactcttcgaggcacaggagaaactctataaggagtacctccagatggcccagaatggatctttccagtag

SEQ ID NO: 219742 - DNA, 2220 bp, Artificial Sequence
  Description of Artificial Sequence: Synthetic coding sequence
atggaaccgacctcaggcccttttcgtaccgatctcggataccatttggtgggatgcagtagtggaaaagggcgaagggtccagccacaatggtccccaccagctggaacacagccttgcaggctgcacctgtataactcgctcactcgaaacaaggaagtatttattccacaggacgggaaaaaggtgacatggtactgctgtgggccaactgtgtacgacgctagtcatatgggtcatgcaagaagctatatttccttcgacatactgagacgcgttctgaaggactacttcaagttcgatgtgttctactgtatgaacataacagatatcgacgataagatcattaagcgtgcacgacagaatcacctgttcgagcagtaccgagagaagcggcctgaagccgctcagcttctagaagacgttcaggctgccctgaaaccattctccgtaaaactgaatgagactacagaccctgacaagaagcagatgctagaaagaatacagcacgcagtccagctcgccacggaacctctggaaaaagccgtgcaatcgcgcctgacaggagaggaggttaacagctgcgtggaggtattgctcgaagaagccaaggacctgctgtctgattggctcgacagcacactcggatgcgatgtaactgacaattccatcttttcaaaactgcccaaattctgggaaggcgactttcacagagacatggaagccctcaacgtgctgcctcccgatgtcctgaccagagtgtcagagtatgtgcccgagatagtcaacttcgtgcagaaaatcgtagataatgggtacggctacgtttccaacgggtcagtttacttcgacacagccaaattcgccagcagcgaaaagcactcctacggtaagttagtccctgaagctgtgggcgatcagaaggccttgcaggaaggcgaaggcgatcttagtatcagcgctgatcgattaagcgagaagcggtcacctaatgatttcgcactgtggaaggcgtcaaagcctggcgagccgtcctggccctgcccttggggcaagggaaggccgggatggcatattgagtgcagcgctatggcaggcactctgctaggcgcaagtatggatatccacggagggggattcgacctgcgattccctcaccacgataacgagctggcacagtccgaagcctactttgaaaatgactgttgggtgcgctacttcctccataccggccacttaaccatcgcaggttgcaagatgtctaagtccttaaagaactttattaccatcaaggatgctctgaaaaaacactcagctcgccagctaaggctagcatttctcatgcacagttggaaggacaccctcgactattcctccaacacaatggaatctgccctgcagtatgagaagtttctgaatgagttcttcctaaacgtcaaagacatcttgagggcccctgtggatataactggtcagttcgagaagtggggagaagaagaggctgagctgaacaagaacttttatgataaaaagaccgccatacacaaagcactgtgtgacaacgtggataccaggaccgtgatggaagagatgcgcgcattggtgtcgcaatgtaacctatatatggccgcacgcaaggccgttcgcaagagacctaaccaggcgctgctagaaaacattgcactttacctgacacacatgctgaaaattttcggtgcggtcgaggaggattcctctctcgggtttccagtgggcggtcctgggacttcactgtctcttgaagccaccgtgatgccatacttgcaagtgttgagtgagttccgtgagggggtgcggaaaattgctagggagcagaaggtccctgagattctgcagctgagcgacgctctgcgagacaacatcctgcccgagctgggcgtgcggtttgaggaccatgagggcttaccaaccgtagtgaagcttgtggaccgcaacacgcttctgaaggagagagaggagaagcggagagttgaggaagagaagcggaagaagaaggaagaagctgcccgaagaaaacaggagcaggaggctgccaagctggctaaaatgaagatccccccatcggagatgtttctatccgaaacagataaatactctaagttcgacgaaaacgtgagcatggtgtgccctcacatgacctggcgggctaaatcctccgcgaagggcaagcctcggtcctag

SEQ ID NO: 219743 - DNA, 1695 bp, Artificial Sequence
  Description of Artificial Sequence: Synthetic coding sequence
atgctacgaaccacccggggacctggcctaggcccacccctgttgcaggccgctctgggtttgggaagggcaggatggcactggccagcagggagggctgcatcaggcggtagaggacgcgcttggctgcagcctacaggcagagagacaggcgtccaggtgtacaactccctgaccggccgaaaagagcccctgattgttgcccacgcagaggctgccagctggtacagctgtggaccaactgtatacgaccacgcacatctagggcacgcttgctcatacgtcagattcgatattattcgcaggattctgaccaaggtttttggctgcagtatagtgatggtaatgggcataacggatgtggacgataaaattattaagagagccaacgaaatgaatatcagcccggcatcccttgccagcctctatgaggaggatttcaagcaggatatggccgctcttaaggtcctaccgccaacagtctacctcagagtgactgaaaacatcccgcagataattagtttcattgagggtatcattgccagggggaacgcgtattccaccgcaaagggcaacgtctacttcgacctcaagagccgcggtgacaagtatggaaagctggttggcgtcgtacccggacctgtcggggagccagcagattcagataaaagacacgcctccgacttcgctctgtggaaggctgcaaaacctcaggaggtgttttgggcaagtccctggggcccaggtcggccaggttggcacatcgagtgctccgcaatcgcctccatggtatttggcagccagctggatatccattctgggggtattgacctagcgttcccacatcatgagaacgaaatcgcccagtgcgaggtcttccaccagtgtgaacagtgggggaactattttctacactcagggcaccttcacgccaagggtaaggaggagaagatgtccaagtccctgaagaactatatcacaattaaggattttctcaaaacttttagcccagacgtgtttagattcttctgcctgcgcagttcctaccgaagtgcgatcgactattcagacagtgctatgctccaggctcagcagctgctactgggcttaggctctttccttgaggacgcccgagcttacatgaagggccagctggcctgtggctccgtgagggaggctatgctctgggaaagattatccagcaccaagagggcagtcaaagctgccctggcagatgatttcgacaccccgagggtggttgacgctatacttggtcttgcccaccacgggaacggacagttaagagcgtctttaaaggagcccgagggccctcggagccccgcagtgttcggggctattatcagctactttgagcagttttttgaaactgtaggaatatccctcgccaatcagcagtacgtctccggcgatggctctgaggcaactctgcatggtgtcgttgatgaacttgtccggttccggcagaaagtgcggcagttcgctctcgctatgccagaagccactggagatgctcgaaggcaacaacttctggagagacagcctcttttagaggcctgcgacactctacgccgtgggctgactgcccatggcatcaatattaaagaccgaagcagcactacgagcacttgggagcttttggatcaaaggacaaaggatcaaaaaagcgctggttag

SEQ ID NO: 219744 - DNA, 549 bp, Artificial Sequence
  Description of Artificial Sequence: Synthetic coding sequence
atggtgttcgggagccagcttgatatccactcaggcggaatcgacctcgcattcccccatcatgaaaacgagatcgcccagtgcgaggtcttccaccagtgtgagcagtggggtaactatttccttcacagcgggcacctccatgcaaagggaaaggaggaaaagatgtcgaagtctttaaagaactatattactattaaggatttcttgaagacttttagtcctgatgtttttagatttttttgtctgcgaagcagctacaggtcagcgattgattacagtgactcagctatgctgcaagcccagcagttactgctgggtctcggaagctttctcgaggatgcccgagcttatatgaagggtcaactggcttgcggttctgtccgggaagctatgctatgggagcggctgtccagcactaagagggcagtgaaggcagcacttgctgatgatttcgacacgcccagagttgtcgatgccatcttgggcctggctcaccacgggaacggacagctccgcgcatccctaaagaagcctgggagcgcctag

SEQ ID NO: 219745 - DNA, 441 bp, Artificial Sequence
  Description of Artificial Sequence: Synthetic coding sequence
atggcccaaaaacgacccgcttgcacactgaagcccgagtgtgtgcagcagctgcttgtttgcagccaagaggctaaaaagtcagcctactgtccatactctcattttcctgtcggggctgctctgcttacacaggaaggcagaatctttaaagggtgtaacattgagaacgcatgctatcctcttgggatttgtgcagaacggaccgcgatccaaaaggctgttagcgagggttacaaagactttagggccattgctatcgcctccgacatgcaggacgacttcatatccccctgcggcgcttgcaggcaggtgatgagggaatttggaaccaactggcctgtgtacatgaccaagcctgatggtacctatatcgtgatgacagttcaagaactgctcccaagctcgttcgggccagaggacctgcaaaaaacacaatag

SEQ ID NO: 219746 - DNA, 687 bp, Artificial Sequence
  Description of Artificial Sequence: Synthetic coding sequence
atgctgagcagatgtagaagcggactactacacgtcctggggctgtcattcttactccagaccagacggcctattcttctgtgttccccgcgattgatgaagcccttggttgtattcgtgttaggaggcccaggcgctggtaagggaacccaatgtgctaggatcgtggagaagtacgggtacacccatttatctgctggagagttgctacgtgatgagcgaaaaaaccctgactctcagtacggagagttgatcgagaaatatatcaaggaaggcaagattgtgccagtggagatcaccatctcactgctcaagagggaaatggatcagaccatggctgcaaatgcccagaagaataagtttctgatcgacggttttcccagaaaccaggataacctacagggttggaacaaaacaatggatggcaaagcagacgtgagtttcgtgttatttttcgattgcaacaacgaaatctgtatcgaacggtgtctggagcggggaaagagttccgggcgatccgacgataacagggagtccctggaaaaaagaatccagacatacctgcaaagcactaagcccattattgacctttacgaggagatgggcaaagtcaagaagatcgacgcctcaaagagcgtggacgaggtgttcgacgaggttgtccagattttcgacaaagagggctag

SEQ ID NO: 219747 - DNA, 540 bp, Artificial Sequence
  Description of Artificial Sequence: Synthetic coding sequence
atgctgagtcggtgtcgatccggtctcctccatgtattgggcctgtccttcttgctgcaaacccgccgtccaattttactgtgtagtccgaggctgatgaagcctctcgtagtgtttgtactgggcggtcccggtgccggaaaaggtacccagtgcgccagaatcgtggaagagatggaccaaaccatggcagccaacgctcagaaaaataaattcctgatcgacggattccctcggaatcaggataacttgcagggctggaataagaccatggatggtaaggccgatgtgagctttgtgctctttttcgactgtaacaacgaaatctgcatagaacgatgtctggaaaggggcaaaagtagtggtaggagtgatgataatcgcgagagtctcgaaaaacggatacagacctatctgcaaagcactaagcccataatcgatctgtacgaggagatggggaaagttaagaaaattgacgcctctaagtcggtggacgaggtgtttgacgaagtggttcagatcttcgataaggagggatag

SEQ ID NO: 219748 - DNA, 1230 bp, Artificial Sequence
  Description of Artificial Sequence: Synthetic coding sequence
atggctttcgcccgtcgcctgctgagggggccactgtctggcccacttctggggagacggggtgtttgtgccggagctatggcacctcccaggcgtttcgtcctggaacttccggactgcaccctcgctcacttcgccctgggagcagatgcacccggagatgccgatgccccagatccccgactcgccgctctgctgggaccccctgagcgctcatacagcctctgcgtgcctgtgacccctgacgctgggtgcggggctagagtccgcgcagcacgacttcaccagcgactgcttcaccaactacgaagaggtccattccagagatgtcagttgctgaggctgttgtgctactgccctgggggtcaggcgggaggtgctcagcaggggtttctattgagggatcccctggacgatcccgacacacgccaagctctgctcgagctgctgggtgcttgccaagaggcacctagacctcatttgggggaatttgaagcagacccacggggacagttgtggcagaggctgtgggaggtgcaagacgggagacgcttgcaggtcggttgcgcacaggttgtgcccgtgcccgaaccaccgttgcatccagtcgtgcctgacttgccaagctctgtcgtgttccctgacagagaagctgccagggccgtactggaggagtgtaccagttttatccccgaagccagggccgtcctggacttagtggaccagtgtccaaagcagatccagaagggtaagtttcaagttgtggccatcgagggactggacgctacgggcaagactacagtgacacagagcgtggccgatagcttaaaggcagtcctcctcaaaagtcccccttcctgtattgggcagtggcgtaagattttcgacgatgagcccaccattattcgtagagccttttactcgctcggcaactacatagtagcaagcgagattgctaaagagtccgccaagagccctgtgattgtggatagatattggcatagtacagccacatacgccattgccaccgaggtgtccggagggctccagcacctgccccctgcccaccatcccgtgtatcagtggccagaagatctccttaaacccgatctaatcttattgctgacggtgtctcccgaggagcggctgcagcggttgcagggcagaggcatggaaaaaacaagagaagaggccgaattagaagccaattccgtgtttcgccaaaagtag

SEQ ID NO: 219749 - DNA, 1350 bp, Artificial Sequence
  Description of Artificial Sequence: Synthetic coding sequence
atggcctttgctcgaaggctgctgcgaggccctctgagtgggcctctgctgggtcggaggggcgtctgtgccggagccatggccccacccagacgctttgtcttggagttaccagactgtacgctggctcatttcgccctgggtgccgacgcacccggtgatgcagacgctcccgaccctcggctagccgctttgctaggaccgcctgagcggtcgtactccctgtgtgtgccggtcacacccgacgccggatgcggcgctagagtgcgagcagcacgcctgcatcagcggctcctgcatcagcttcggaggggccctttccagagatgccagttactgaggctgttgtgttattgtcctggcggacaggccggtggagctcagcaaggcttcctcctgagagacccactggacgatcccgacactcgacaagcccttcttgagcttctgggtgcttgtcaggaagcgcctaggcctcacttgggcgagttcgaagccgatcctcgcggtcagctctggcagcgtctctgggaagtgcaggacggccgaagattacaggtcgggtgcgcccaggtggtgcctgtgcccgagcctcccctccaccccgtggtccccgacttgccgtcctctgttgtgtttcccgatcgagaggccgctagggcagtcctcgaggaatgcacaagcttcatccctgaggccagagccgttctcgatcttgtggatcagtgcccaaaacaaattcagaaggggaaatttcaggtagtggccattgaaggcttagacgccacaggcaagacaacggtgacccagagtgtagcggattccttgaaagccgttcttttaaagagcccccctagttgtatcggccagtggaggaaaatttttgacgacgagcccactatcatcaggagagctttttactcactgggcaattatattgttgccagcgaaatagcaaaggagtctgcaaagtctccagtgattgttgacaggtactggcacagtacagcaacatatgcgatcgcaaccgaggtctccggaggattacagcacttgcccccagctcaccacccggtgtatcaatggcctgaggatctgctgaagcccgacctgattctgttactgaccgtaagtcctgaggagcgcctgcagaggctgcagggtcgcggtatggaaaagacaagggaggaggctgaactggaggccaactcagtatttcggcaaaaggtcgagatgtcctatcagcgaatggagaatcctggctgccacgttgtggacgcttcgccatccagagaaaaggttttgcagaccgtcctgagtctgatccagaactctttctctgagccctag

SEQ ID NO: 219750 - DNA, 1101 bp, Artificial Sequence
  Description of Artificial Sequence: Synthetic coding sequence
atggccttcgctcgccgactgctgcgcggacctctttccgggccattgctgggcaggaggggagtgtgcgccggtgccatggcaccgccaagacggttcgtgctcgaactgcccgactgcacactggcccactttgccctgggcgcagacgcaccaggcgacgcagacgcccctgatccccgtcttgcagctctgttggggccacctgagcgtagctactcactgtgtgtgccagtaacaccagacgccggatgcggagcacgtgttagagcagcccgactgcatcagaggcttctgcaccagctgcggcgaggaccatttcagcgatgccagctgctacgtctcctttgttactgtccagggggtcaagcaggcggagcgcagcaggggtttttattacgggatccacttgatgatcccgacacaaggcaggcgttgctcgagctgttgggcgcatgtcaggaggcaccccgacctcacctgggggaatttgaagcagatcccagaggacagttgtggcagagattatgggaagtgcaagatgggcgtcgattacaagtcggatgtgctcaggtggttcctgtgccagagcctccactgcacccggtggtcccagatttgcctagttccgtcgtgtttccagatagagaggccgctcgtgcagtgctcgaggaatgcaccagctttatcccagaagcaagagctgtgctggacttggttgaccagtgcccaaaacagattcagaagggtaagtttcaggtcgtggcaattgagggcctggacgccaccggaaagacgacagtgacacaaagtgtggcagattctctgaaggccgtgctcctaaagtctcctccgagctgtattggtcagtggaggaagatttttgatgacgagcccacaatcatccggagagccttctacagcctgggtaactatatcgtggccagcgagattgccaaggagtcggcaaagagccccgttattgtggaccgaagtcagttgggaggtacactgtaccacccgagtttacacctacttggctctgaagtgtgtggcacaggaatactcgattcgagccattcctctcaggggctggaatag

SEQ ID NO: 219751 - DNA, 813 bp, Artificial Sequence
  Description of Artificial Sequence: Synthetic coding sequence
atggggaatacctctagtgagagggctgcattggaaaggcacggcggtcataaaacacctagaagagactcatctggcggaaccaaagacggggatagacctaagatcttaatggattcccctgaggacgctgacctcttccatagcgaagagattaaggcacctgagaaagaggaatttctcgcctggcagcatgacctcgaagtgaacgataaggcccctgcccaggctcgccctacagtctttcgctggacagggggtggcaaagaggtctacctctcgggttcattcaataattggagtaagctgcctcttacccgctcacacaataattttgttgcgatcctagatctgcctgaaggcgaacaccagtacaaatttttcgtggacggacagtggacgcatgatccaagtgagccaatcgtgacatcacagctcgggacagtgaacaacatcatccaggtcaagaagaccgattttgaggtgtttgacgcgttgatggttgactctcagaagtgcagcgacgtgtctgagttatcatcaagccctcccggaccttaccaccaggaaccatacgtgtgtaaacccgaagaacgatttcgggcaccaccaatcctaccaccacacctgctccaggtcatcctgaataaagacacaggaattagctgcgaccccgctcttctccctgagcctaaccacgtgatgctcaatcacctctacgctctctccatcaaggacggggtgatggttcttagcgccacacaccgctataagaagaagtatgttaccacactactgtacaaaccaatctag

SEQ ID NO: 219752 - DNA, 588 bp, Artificial Sequence
  Description of Artificial Sequence: Synthetic coding sequence
atgggccagattgaatgggctatgtgggcaaacgaacaagccctggcatccgggctcatcctgattaccgggggaattgtggctactgcaggtaggttcacccagtggtatttcggggcttactcaattgtcgcaggcgtgtttgtctgcttactggagtacccacgcggtaagcggaagaagggatccaccatggaaagatggggccagaagtacatgacagccgttgtcaaactgtttgggccttttacaaggaactattatgtgcgagctgtactccacctcttacttagtgtgccggcaggattcctcctggcaaccatcctagggaccgcctgcctagctatagcctcaggaatttatctgctcgcagcagtccgtggcgaacagtggacaccaattgaacccaaacctagagagcggcctcagatcggtggaaccatcaaacagcccccatccaatccccctcccaggccaccagccgaagcacggaagaagccgagtgaagaggaggccgcagtggccgcaggtggaccccctggaggaccccaagttaaccccatccctgtgaccgatgaggtggtgtag

SEQ ID NO: 219753 - DNA, 1713 bp, Artificial Sequence
  Description of Artificial Sequence: Synthetic coding sequence
atgggcaactgggctgttaacgaggggctctccatattcgtgattttggtgtggcttggacttaacgtgttcctgttcgtatggtactaccgagtatatgacattcccccaaagttcttttacactaggaaactcctgggaagcgctttggcgttggccagagcccctgccgcttgcctgaacttcaactgtatgctcatactgctcccggtctgccggaacctactctcctttctacggggaagcagcgcctgctgctccacgcgggtgcgcaggcagctggatcggaatctgacattccacaaaatggtcgcctggatgattgcactgcattctgctatccacaccatcgcgcacctctttaacgtcgagtggtgtgtaaacgcaagagtgaataatagtgacccctattcagtagcgctcagcgagttaggtgatcggcaaaacgagtcttaccttaattttgctaggaagcgaatcaagaaccctgaaggtggcctgtatcttgcagttacgttgctggccggtattacaggagtggtaattactttatgcctgattttgattattacgagcagcactaagacgattagacgttcttactttgaagtgttctggtacacgcaccacctgttcgttattttttttatcggtctggctatccatggcgctgagcgcatcgtgaggggacagaccgccgagtccctggcagttcacaatatcacagtgtgtgaacagaagatctccgagtgggggaagataaaggagtgccccattccccaatttgcaggcaatcctccaatgacgtggaagtggattgtaggacctatgttcctgtacctctgtgagagattagtgaggttttggagatcccagcaaaaagtggtgattacaaaagttgtaacgcatccatttaagactatcgaactccagatgaaaaagaaggggtttaagatggaggtggggcagtatatttttgtcaaatgcccaaaggtgtctaagctggagtggcacccctttacgcttaccagtgcacccgaggaagatttttttagtatccatattagaatcgtgggggattggaccgaaggccttttcaacgcatgcggctgtgacaagcaagagttccaggatgcatggaagcttcccaagatcgcggtggacgggcctttcggtacggccagcgaagatgtgttcagctacgaagtggtcatgcttgtaggcgctggtatcggagtgacaccctttgccagcatactgaagagcgtatggtataaatactgcaacaacgccaccaacctgaaactgaagaaaatctatttttactggctgtgtagggatacccatgcgttcgaatggtttgccgatctgctgcagctccttgaatctcagatgcaagaacgcaacaacgccggttttctttcgtacaatatctatcttaccggctgggatgaaagccaggctaatcacttcgcagtgcatcacgatgaagagaaagacgtgatcacgggtctgaagcagaagactctatatgggaggcccaactgggacaacgagttcaagacgattgcctctcaacaccctaatacccgaatcggcgtctttctctgtggtccagaagcgctggccgaaaccctgtccaaacagtctatctccaacagtgaatcaggaccgcgtggcgtacacttcatctttaacaaggaaaacttctag

SEQ ID NO: 219754 - DNA, 912 bp, Artificial Sequence
  Description of Artificial Sequence: Synthetic coding sequence
atgacttggaagtggattgtgggccctatgtttctgtatctttgcgaacgcctagtgagattctggagatcccagcagaaggtggtgatcaccaaggtggtgacacaccccttcaagacaattgaacttcagatgaagaagaaggggtttaagatggaggtcgggcagtacatttttgtgaagtgccctaaggtgtctaaactggaatggcatccatttacactcaccagcgcacctgaagaagattttttctctatccacatccgtattgtcggcgactggacagaaggcctgttcaatgcctgtggatgcgacaagcaggagtttcaagatgcgtggaaactgcccaaaatcgcggtggatggaccttttgggacagcttcagaggacgtgttctcctacgaggtggtaatgctcgtgggagccggaataggcgtgaccccctttgccagcatccttaagagcgtatggtataagtattgcaataatgcaactaaccttaaactcaagaagatctacttctattggctgtgccgcgatactcacgcattcgagtggttcgccgatctgctccaactgctggagtcacagatgcaggagagaaataatgccggttttttatcatataacatatacctgacgggctgggatgagagccaggctaatcactttgctgttcatcacgatgaagaaaaagatgtcattaccggcctgaaacagaagacattgtatggacggcctaactgggacaacgaatttaagacaatcgccagccagcaccccaacacaaggatcggagtgttcctttgcggtccggaagcactggcagaaactttaagcaaacaaagcatcagtaactcagagtcaggaccacgcggtgttcacttcatcttcaataaagagaacttttag

SEQ ID NO: 219755 - DNA, 1617 bp, Artificial Sequence
  Description of Artificial Sequence: Synthetic coding sequence
atgggtaactgggctgtgaacgagggactgagcatcttcgttataagcgctttggcgctggccagggctcccgcagcctgtttgaatttcaattgtatgttgattctcttacctgtctgccggaacctcctcagcttcctgcgtggtagctctgcttgctgcagcactcgggtcaggagacaactggatcgaaatctcaccttccataaaatggtggcttggatgattgccttgcactccgctatacacaccattgcgcaccttttcaatgtggaatggtgcgtgaacgcgcgtgttaacaacagtgacccctattccgttgccctgtcagaactcggtgatcggcagaatgaaagttatctgaactttgccaggaagcgcataaaaaaccctgagggcggactataccttgccgtgaccctgttagccggaatcacaggggttgtcataactctctgcctgatcctcattattacctcttctacaaagactatcagacgaagttactttgaggtcttttggtatacgcaccacctgtttgtaattttctttataggcctcgcaatccatggggcagaacggatcgtccgaggccagacggccgagtccctcgccgtgcataatataactgtctgtgagcagaaaatctctgaatggggcaaaattaaagagtgcccaataccccagtttgcgggtaaccctccgatgacctggaagtggatagtgggacccatgttcttgtacttgtgtgagcggctggtccggttttggaggagccagcagaaagtggtaattacaaaggtagtcacacacccattcaagacaattgagctccagatgaaaaagaaagggttcaagatggaagtgggtcagtatattttcgtcaagtgccctaaagtgtcaaagcttgagtggcacccctttacactaacctctgcacctgaagaggacttcttttcgattcacatccgcatcgtgggcgattggacagagggcctcttcaacgcctgtggctgtgataaacaagaattccaggacgcctggaagctgcccaagatcgccgttgacggcccattcggcactgcgtccgaggacgttttctcttatgaagttgtgatgttggtaggtgccggaatcggtgtgacgccctttgcgagcatcttgaagtccgtttggtataagtactgtaacaacgcgactaaccttaaactgaagaagatatacttctactggctctgcagagacacacatgcgtttgagtggttcgccgatcttctccagctcctcgaatcacagatgcaggaacgcaataatgccggtttcctttcatataacatctacctcactggatgggatgaaagccaggccaaccactttgcagtgcaccacgatgaagagaaagatgtcatcacaggattgaaacagaaaacactgtatggaagacccaactgggataatgaattcaaaaccattgccagccagcatccgaacacccggatcggagtgttcctatgtggacctgaagccctcgctgaaaccctcagcaaacaatcaatctcaaactccgagtctggccctaggggggtccatttcatctttaataaagagaatttctag

SEQ ID NO: 219756 - DNA, 714 bp, Artificial Sequence
  Description of Artificial Sequence: Synthetic coding sequence
atgaattccaggcgccgagagcccatcaccttgcaagatcccgaggccaaatatccgcttccgctcattgaaaaggaaaaaatcagtcacaacacccgaagatttaggtttggactaccctccccagatcatgtactgggtctacccgttggaaactatgtgcaactgctggcaaagatagataacgaactggtggtcagggcatacacacctgtgtcatccgatgatgatcgagggttcgtcgatctaataatcaagatctactttaaaaatgtgcatccgcagtatccagaaggaggaaaaatgacccagtacctcgagaatatgaagataggagaaactatcttctttaggggaccccgtggcaggctgttctatcacgggccaggcaatctgggaatcagacccgatcagactagcgagccaaagaagaccctcgccgaccacctggggatgatcgcagggggtaccgggattacgcctatgctccagttgatccggcatatcacaaaagacccgtctgataggacacgcatgagcttaatctttgctaaccaaaccgaagaagacatccttgtaagaaaagagctagaggagatcgcgcgtacccacccagatcagttcaacctgtggtacacactagatcgacctcccattggaccctggagtgccgagggcgctaccctgctgtctaactccgcacagttccactag

SEQ ID NO: 219757 - DNA, 831 bp, Artificial Sequence
  Description of Artificial Sequence: Synthetic coding sequence
atgaactcgcggagacgggagcctattactctgcaagaccccgaagccaaatacccgctgccgctaattgagaaagaaaaaatctcccacaacacccgcagatttcgatttggcttgccttctcccgatcatgtccttggtctaccagtcggcaactatgtgcagctgcttgcgaagatagataatgagctggtggtgcgcgcttacacgcccgtgtccagcgacgatgatcgtggcttcgtggacctcatcataaagatatactttaagaatgtccatcctcagtatccagaagggggtaagatgactcagtacctggagaacatgaaaatcggtgaaaccatcttcttccgcggtcctcggggaaggttgttctatcatgggcctggcaaccttggaatccgcccagatcagacatccgagcctaaaaagaccctagctgaccacctcgggatgatagcaggtggcaccggcattactccgatgctacagcttatcaggcatatcacgaaagatccttcagaccgaaccaggatgagccttatcttcgctaaccagaccgaggaggacatcctggtgcgcaaagagttagaagaaatcgctcggacccacccagatcagttcaatctctggtacactctcgatcgtccacccattggttggaaatactccagcggctttgtcaccgctgatatgattaaagagcacttgcctcctcctgccaagtcgacactgatactggtgtgcggaccaccaccacttatacagaccgccgcacaccctaacttggaaaaacttggatatacacaggacatgattttcacgtattag

SEQ ID NO: 219758 - DNA, 351 bp, Artificial Sequence
  Description of Artificial Sequence: Synthetic coding sequence
atgaattctcgcaggagagagcctataaccctgcaggatcctgaggccaaatatcccctgccactcattgagaaggagaaaatatcacataacactcgcaggttccgttttggactgccctcacctgaccatgtcctcgggctacctgtaggcaattacgtccagctcttagccaagatagacaacgagctggtggtgcgtgcatatacgccggtctcaagtgacgatgaccgcggatttgttgacctgatcattaagatatacttcaagaacgtacacccccagtatcccgagggaggtaaaatgacacagtatctagagaatatgaaaattggtgagacaatcttttag

SEQ ID NO: 219759 - DNA, 714 bp, Artificial Sequence
  Description of Artificial Sequence: Synthetic coding sequence
atgaatagcaggaggagggaacctatcaccttacaggatcccgaggctaagtatcccctgccactcatagagaaggaaaagatatcccataatactcgacgcttcaggtttggtctcccttctccggaccatgtgctcggcctgcccgtaggaaattatgtacaacttctcgccaaaattgataacgaattggtggtaagagcctatactcccgtttctagcgatgacgacagaggattcgtggacttgatcatcaagatctattttaagaatgttcacccccagtatcccgagggaggcaagatgacccagtacctggaaaacatgaagatcggagaaacaatattctttcgcggtccccgtggtcgcctattttaccacggtcctggcaatctcggaattaggcccgatcagacctcggaacccaaaaaaaccctcgccgatcatctcggaatgatcgccggtggaacaggcatcactccaatgctgcagctgattaggcatattacaaaagatcctagtgatcggacgcggatgtcactcatctttgcgaaccagaccgaggaagacatcctggtccgcaaagaattggaagaaattgctcggacacatcccgatcagtttaacctgtggtacacactagaccgacctcctatcggaccatggtccgccgagggagccacccttctcagcaactctgcacagttccattag

SEQ ID NO: 219760 - DNA, 441 bp, Artificial Sequence
  Description of Artificial Sequence: Synthetic coding sequence
atgaatagcagacgtcgggaacccattacactgcaggaccctgaggcaaagtacccgctgcccttaatcgaaaaggaaaaaattagccataacacccgccgtttccggttcgggctgccctctcccgatcatgtcctgggactccctgtcggaaactacgtgcagctacttgcaaagatcgacaatgagctggtcgtcagggcgtacacacccgtgagctctgacgatgatagaggctttgttgacttgattatcaaaatatacttcaagaacgtacaccctcaatatccagaaggtgggaagatgacccagtatctggagaacatgaaaattggtgaaacaatcttcttccggggtccccgaggcaggctcttctatcacggacctggcaatcttggaattcgccctgaccagactagtgagccaaagaaaacattatag

SEQ ID NO: 219761 - DNA, 516 bp, Artificial Sequence
  Description of Artificial Sequence: Synthetic coding sequence
atgaattctcgcaggagagagccaataactctgcaggacccggaggccaagtatcccctgccactcatagaaaaggaaaaaatatctcataacacaagaaggttccggtttggcctgccttctccagatcatgtgttaggattgcccgtcggaaactatgtgcagctgctcgctaagatagacaatgagctggtagtgcgcgcatacacccccgttagctccgatgacgaccgtggcttcgttgacttgatcatcaaaatttatttcaaaaatgttcatccacaataccctgagggcggaaagatgacccaataccttgagaacatgaagatcggagaaactatctttttcagaggccctagaggtaggttattttatcatgggccagggaatctcggcattagacctgatcagacgtccgaaccaaagaaaacccttgccgatcaccttgggatgattgccggtgggacaggcatcacacccatgttgcagctcatccgacatataactaaatag

SEQ ID NO: 219762 - DNA, 831 bp, Artificial Sequence
  Description of Artificial Sequence: Synthetic coding sequence
atgaactcgcgtcgacgcgagcctatcaccctgcaagacccagaagccaaataccccttaccgctgatcgaaaaggaaaaaataagtcataacactagacggttcagattcggactgccaagtcctgatcacgtacttggcctgcccgtcgggaattacgtgcagttactagccaagatcgataacgagctggtcgtgcgggcatatactcctgtcagcagtgacgatgacaggggcttcgtggatctgattatcaagatctatttcaagaatgtccaccctcaatatcccgaagggggaaaaatgactcaatacttagaaaatatgaagattggggagacgatatttttcagaggtccccgtgggagactgttctatcacgggcctggtaaccttggtattcggccagaccagacttcagaacccaagaaaaccctagctgaccatctggggatgattgcaggcggaaccggaatcacaccaatgctgcagttaatccgacacatcactaaggatccctcagacaggacaaggatgtcccttattttcgctaaccagacagaggaggatatcctggtcagaaaggaactggaagaaattgcacgtacccatccggatcagttcaacttatggtacactctcgacagacccccaattggttggaagtattctagcgggtttgtgactgccgacatgatcaaagagcaccttcccccacctgccaagtcaaccctgatcctggtatgcggcccaccccctcttatacagacagccgctcatcctaatcttgagaaactggggtacacccaggatatgatctttacctattag

SEQ ID NO: 219763 - DNA, 906 bp, Artificial Sequence
  Description of Artificial Sequence: Synthetic coding sequence
atgggcgcacagctgtcaaccctgggccacatggtcctcttccccgtctggttcctctattctcttctcatgaagctctttcagcggagcacccccgcaatcacactggaatcccctgacatcaaataccctctgaggctgattgaccgagagataatcagccatgacaccaggagattccggtttgccctaccgagcccccagcatatcctgggactgccagtgggacagcacatctatctgagcgccaggattgatgggaatctcgtcgtgaggccttatactcccataagttccgatgatgacaaagggtttgtggacctggtgattaaggtatacttcaaggacacacaccccaaattccccgctgggggaaaaatgtctcagtaccttgagagtatgcagattggcgacacaatagagttcaggggaccaagcggattgctcgtgtaccagggaaagggaaagtttgcgataagacctgacaaaaagagcaatcccatcattaggaccgtgaaatccgtaggaatgatcgccggtgggacaggcataacgcctatgctacaggtcatcagagctataatgaaagatcccgatgatcacactgtgtgtcacttgctgtttgcgaatcaaacggagaaggatattctcttacgccctgagctggaggagttgagaaacaagcatagtgcccgatttaagctgtggtacacactggatagagcaccagaggcctgggattatgggcagggatttgtaaacgaggaaatgatcagggatcacctgccaccccctgaggaggagccactcgtgctgatgtgcgggccacccccaatgattcagtacgcctgcctgcccaacctcgatcacgttggccacccaactgaacgatgcttcgttttctag

SEQ ID NO: 219764 - DNA, 1005 bp, Artificial Sequence
  Description of Artificial Sequence: Synthetic coding sequence
atgaacagaagtttgctggtgggatgcatgcagtcaaaagatatctgggggcgtgaagagtccatttgcgagcggttgaagcaagacggcctggatgtggagagggccgaatcctgggagctgggccacatggttctgtttccagtctggttcctgtactcactcctcatgaaactgttccagcggagcacacctgctattacgctcgagagtcccgacattaagtatccattgcggttaatagatagggagataatctctcacgacacaagaagatttcgattcgcattgccgtcaccccaacacattctgggccttccagtggggcaacacatctacctcagcgccaggatcgatgggaatttagtggtaagaccatataccccaatctcatccgacgatgacaaaggcttcgtcgatctggtaattaaagtgtactttaaggatacacacccaaaatttcctgccggaggaaaaatgagtcaatatttagaaagtatgcagataggcgacaccattgagtttaggggaccaagcggcctcctcgtgtatcagggtaagggcaagtttgccatccggccagacaaaaagagcaatccaattatccggaccgttaaatctgtgggcatgattgccggtggcacaggcatcaccccgatgctgcaggtgattagagcaatcatgaaggatccagacgaccacacagtgtgtcatctgcttttcgccaaccagactgaaaaagatatcctcctcagaccagagctggaggagctcagaaacaagcatagcgcccgtttcaagctgtggtacacacttgatcgggcaccggaagcctgggactatggccaaggttttgtgaatgaggagatgataagggaccatctcccccctcctgaggaggaacccctcgtattgatgtgcggcccaccaccaatgatacagtacgcctgcctacctaaccttgaccatgttggccaccctactgaaagatgttttgtgttttag

SEQ ID NO: 219765 - DNA, 837 bp, Artificial Sequence
  Description of Artificial Sequence: Synthetic coding sequence
atgaagctttttcaacgctccacccctgcgattacgctggaatctcccgacattaagtacccattacgcctgattgacagggagatcatttcgcacgataccaggcggttcagattcgcgctccccagtccccagcatattttgggccttccagttggtcagcacatctatctgtcggctaggattgatggtaacctggtagtgcgtccctacacaccgatcagcagcgatgatgataaaggtttcgtggacttggtcatcaaagtgtactttaaagatacccaccctaagtttcctgccggtggaaaaatgagccagtatctggaaagcatgcagataggggataccattgagttcagaggcccatctgggcttctagtgtatcagggcaagggaaagttcgccattaggccagataaaaagagcaatcccataatccggactgtgaagagcgtaggcatgattgccggaggcacggggattacccctatgctgcaagtgattagagcaattatgaaagaccctgacgatcacacagtgtgtcatctgctttttgctaatcaaaccgagaaggacattcttctcaggccagaactggaggagctaaggaataagcacagcgctcgcttcaaattgtggtacactctggacagagcccctgaagcctgggattatgggcaaggatttgtcaacgaagagatgattcgcgaccaccttcccccacccgaagaggagcccttagtcctaatgtgcggcccaccacccatgattcagtatgcctgcctgcctaacctcgatcatgtgggccatcccaccgagcggtgctttgtgttctag

SEQ ID NO: 219766 - DNA, 837 bp, Artificial Sequence
  Description of Artificial Sequence: Synthetic coding sequence
atgaagttgttccagcggtctactcctgccatcaccttggagtcacctgacattaaatatccacttcggcttattgatcgtgaaattattagccacgatactagaagatttcgatttgctctgccctcacctcagcacatccttggcctgcctgttggccagcatatctatctcagtgcaagaatcgacggaaatctagtggtcagaccctacacacccattagttctgatgatgacaaaggtttcgtggacttagtaatcaaggtgtatttcaaagacacacatccgaaatttcccgctgggggaaaaatgtcacagtatcttgagtctatgcaaattggcgacacaattgagttccgtggcccttctggcctcctggtgtatcagggcaagggaaagttcgcgatcagacccgataaaaaaagtaaccccatcattaggacagtgaagagtgtcggcatgatcgcaggaggcacaggaatcacgcctatgctccaggttatcagggcaatcatgaaggaccccgatgatcatacagtttgccacctgctgtttgctaaccagacggaaaaggatatcctgctgcgccctgagctagaagaactgcggaataagcattccgccagatttaaactgtggtatactcttgatagagcgccagaagcctgggattatggtcaaggatttgtgaatgaagagatgatcagggatcaccttcctcccccagaagaggagccacttgtgctaatgtgtggccctcctcccatgatacaatacgcttgtctgcctaatctggatcacgttggccaccccaccgagaggtgcttcgtattctag

SEQ ID NO: 219767 - DNA, 837 bp, Artificial Sequence
  Description of Artificial Sequence: Synthetic coding sequence
atgaaactgttccagcggtccacccctgctattactcttgagagcccagatatcaaataccccctcaggctgatagatcgcgagatcatatcccatgacactcggagattcagatttgcactccctagtccacagcacatcctagggcttccagtaggccagcatatctatctttcagctagaattgatggcaatctggtggtgcgaccatacaccccaatttcctctgatgacgataaagggttcgtggacttagttataaaagtctactttaaggacactcatccgaagttccccgcagggggaaaaatgtctcaatatctcgagtcaatgcagattggggatacgatcgaattccggggaccgagtgggttactggtatatcaggggaaggggaaatttgctatccggccagacaagaagtctaacccaattattcgaaccgtgaagagcgtgggaatgatcgctggtgggacgggaattacccccatgctacaggtgatcagggccattatgaaagatcccgacgatcatacggtttgtcacctgctgttcgcaaatcaaaccgagaaagacatcctgctacgacccgagctggaagagctccgcaacaagcactccgcgcgtttcaaattgtggtacacacttgacagagccccagaggcttgggactatggccaagggttcgtgaacgaggaaatgatccgagaccacttacctcccccagaggaggaaccgctcgtgctgatgtgcggcccaccaccaatgattcagtacgcctgtctgccaaatctcgatcacgtgggacacccaaccgagaggtgtttcgtattctag

SEQ ID NO: 219768 - DNA, 837 bp, Artificial Sequence
  Description of Artificial Sequence: Synthetic coding sequence
atgaagctgttccaacgctctaccccggctataacgctcgaatcaccggatattaagtaccctctgcgtctgatcgaccgcgagatcatatcacacgacacaaggcggtttcgattcgccctgccttccccccagcacatcttgggtctgccagtggggcagcacatctacctgtccgccagaatcgatggaaatctggttgttagaccgtatacgcctatcagttccgacgacgacaaagggttcgtcgatctggtgatcaaggtgtatttcaaagacactcaccccaagtttccagctgggggaaagatgtctcaatatcttgagtccatgcagattggcgataccattgagttcaggggcccaagcgggctcctcgtgtaccaaggcaaaggaaagttcgccatacggcctgacaagaagtccaatccaatcatcaggacagttaaatccgtgggcatgattgctggcggaaccgggatcacaccaatgctgcaggtaattcgggctatcatgaaagatcccgacgaccatactgtgtgtcacttgctgtttgcaaaccaaactgagaaggatatcttgctgcgaccagagctggaggaactcagaaataagcattcagcccgtttcaagctgtggtatacccttgaccgagctcctgaagcatgggattacggccagggttttgtgaatgaagaaatgattagagatcatctgccgcctcctgaagaagaacctctggtgttaatgtgcggtccccctccaatgatccagtatgcctgcttaccgaatctggatcatgtgggacaccccactgagaggtgctttgtgttttag

SEQ ID NO: 219769 - DNA, 444 bp, Artificial Sequence
  Description of Artificial Sequence: Synthetic coding sequence
atgaaattgtttcaacggagtacccccgctatcacgctggagtcacctgacattaagtacccactgagactcatcgaccgggaaatcatcagccacgacacccggaggttcaggtttgccctgccttcacctcagcatattctcggacttccggtcgggcagcacatatatttaagcgccagaatcgacggaaatctggtcgtgagaccttatacccccattagcagtgacgatgacaaaggctttgttgacctggtgataaaggtgtatttcaaggatactcatccaaagtttcctgctggaggcaaaatgtctcagtacttagaaagcatgcagatcggggacaccatcgaatttagagggcctagtgggctcttggtgtatcaggggaagggtaaattcgcaatacgtcccgataaaaaaagcaatccaattattcggtag

SEQ ID NO: 219770 - DNA, 330 bp, Artificial Sequence
  Description of Artificial Sequence: Synthetic coding sequence
atggactggatccggttaaccaagagcgggaaggacctcaccgggctgaagggcagacttattgaggtcacagaagaggaactaaagaagcataacaaaaaggacgactgctggatctgtatccggggatttgtgtataacgtgagcccatatatggagtatcaccctgggggagaggacgaactgatgagggcagccggaagcgacggcaccgagttgttcgaccaggtacacaggtgggtcaattacgagtccatgctgaaagagtgtctggttggtcgtatggccatcaagcctgcagtgcttaagggaaaactctggcacctgtag

SEQ ID NO: 219771 - DNA, 1566 bp, Artificial Sequence
  Description of Artificial Sequence: Synthetic coding sequence
atgctgaatgtcccctcgcagtcctttcctgcaccaagatcacagcagagggtggccagtggtggcagaagcaaagtaccactaaagcagggccgtagtctcatggattggataagactgaccaaaagtggaaaggatttgaccgggctgaaaggtaggctgatcgaagtgaccgaagaagaattgaagaaacataataagaaagacgactgctggatttgtatccggggttttgtctacaacgtgagcccctacatggaatatcatccaggtggcgaggacgaactgatgagggcagccggatcagacggaaccgagctgtttgaccaggtccacagatgggtgaattacgaatctatgctcaaggagtgtctggttggccgtatggcaatcaagccagctgtgcttaaggactatcgggaggaggagaagaaggttctgaatgggatgctgccaaagtctcaggtgactgatacactggctaaagaggggccttcttatcccagctatgattggttccagactgacagcttggtaaccatagcgatctacactaaacagaaagacatcaatttggacagcattatagtagatcatcaaaacgattcgttccgcgctgagactatcattaaagactgcctatacctgatccacatagggctgtcacatgaagtgcaggaggatttctctgttcgagttgtagaaagcgtaggcaagatcgaaattgttctccagaagaaggagaatacaagttgggatttcttgggccatccattaaagaaccataactccttaattcctcgtaaggacaccggcctgtactaccgaaaatgccagctgattagcaaagaagatgtgacacatgacacaagattgttctgcctcatgctcccaccctcaacccacttgcaggttcccattgggcaacacgtctaccttaaacttccaattacgggaaccgaaatagtgaagccctatactccagtcagcggctcactgctgtccgaatttaaggagccagtcctgcctaataataagtatatatacttcctcataaagatttatcctacaggtctgttcacccctgaactggaccggctgcaaattggcgactttgtgtcagtaagttccccagagggcaactttaagatctccaaattccaggaactagaagacttatttctcctcgctgctggcactggattcacccccatggtgaaaatcttgaattatgctctgactgacatcccatctctcaggaaggttaagctgatgttctttaataaaacagaggacgatattatctggcggtcccagctagagaaactggctttcaaagacaaacgcctggatgtcgagtttgtgttgagtgctcctataagtgaatggaacgggaagcagggacacatttcccccgctctgctctctgaatttctgaagaggaacctggacaagtccaaggtcctggtttgcatttgcggaccagttccatttacagagcagggtgtccggctactgcatgacttaaacttctccaagaacgagatacacagtttcaccgcttag

SEQ ID NO: 219772 - DNA, 297 bp, Artificial Sequence
  Description of Artificial Sequence: Synthetic coding sequence
atggctgagcagtcggacgaggctgtgaagtattacacactagaggagatccagaaacacaatcacagcaagtcaacatggctcatcctccatcataaagtctacgacctgactaaatttctggaggagcatcccggaggcgaagaggtactcagagaacaggcgggaggcgacgcaactgagaattttgaggatgtggggcatagcactgatgcccgtgaaatgtcaaagaccttcatcattggagagctgcatcccgacgaccgcccaaagctgaataaacctccaaagccctag

SEQ ID NO: 219773 - DNA, 405 bp, Artificial Sequence
  Description of Artificial Sequence: Synthetic coding sequence
atggcggaacagtccgatgaagccgtgaaatattacacattggaggaaatacagaagcacaatcactccaaaagtacctggcttattctgcaccacaaggtctacgatctgactaagttcctcgaggaacacccaggcggagaggaggtgttgcgcgaacaagccggaggggatgccactgagaacttcgaggacgtgggtcatagtacagatgcaagggaaatgtctaagacctttattatcggtgagttgcaccctgatgatcggccaaagctgaataagccacccgagacgctgatcacaaccatcgactcatcctcatcctggtggacaaattgggtgatacccgcaatcagtgcagttgcagtggccctgatgtaccggctatacatggccgaggactag

SEQ ID NO: 219774 - DNA, 375 bp, Artificial Sequence
  Description of Artificial Sequence: Synthetic coding sequence
atggcagaacagtccgatgaagctgtgaaatattatacccttgaagagatacagaaacacaatcatagtaaaagcacatggctcattctccaccataaagtgtacgacctgaccaagtttttagaagaacaccctggtggcgaagaagttctgcgggagcaagcaggcggtgatgcgactgaaaactttgaagatgttgggcatagcaccgacgcacgagagatgagcaaaacatttatcattggagagctgcaccccgaaaccctgatcactactatcgactcaagctcctcttggtggacaaactgggtgatcccagccattagtgccgtagccgtcgcactgatgtatcggctgtacatggccgaggattag

SEQ ID NO: 219775 - DNA, 297 bp, Artificial Sequence
  Description of Artificial Sequence: Synthetic coding sequence
atggctgaacaaagtgatgaagccgttaagtattatactcttgaggaaatccagaagcacaatcatagcaagtctacctggcttatcctgcatcacaaggtctatgatctgacaaagtttctggaagaacaccccggaggggaggaggtccttagggagcaagcgggaggcgatgcaacagagaacttcgaggacgtgggacactccaccgatgcccgtgaaatgtctaaaaccttcattatcggagaattacaccccgacgaccgcccaaagctgaataagcccccagagccatag

SEQ ID NO: 219776 - DNA, 453 bp, Artificial Sequence
  Description of Artificial Sequence: Synthetic coding sequence
atgtctggctccatggccaccgcagaggctagtggctccgatggaaagggacaggaagtggagacatctgtgacatattaccgactcgaggaggttgcaaagcggaatagccttaaagaactctggctggtaattcacggccgtgtctacgacgtgacacgctttcttaatgaacaccccggaggggaagaagtgcttctggagcaggccggtgtcgacgcttccgagagtttcgaagatgtggggcactcatctgacgcaagagagatgctcaagcaatactacatcggggacattcatcctagtgatttaaagccggagtccggcagtaaagatccttcaaaaaatgatacctgtaaatcttgctgggcttactggatactgccaatcattggggcagtcctccttggctttctctatagatattatacatcagagagcaaatcttcctag

SEQ ID NO: 219777 - DNA, 441 bp, Artificial Sequence
  Description of Artificial Sequence: Synthetic coding sequence
atggctaccgctgaggcctcaggcagcgacgggaagggacaggaagtcgaaacttcagtgacctattatcgtctggaggaagtcgccaagcgaaactcgctcaaggagctgtggctggtaatacatggtcgagtttatgatgtgacacgattcttgaatgaacaccctgggggagaggaggtcttactcgaacaagctggcgtcgatgcctctgaaagcttcgaggacgtgggtcactctagtgatgcccgagagatgctcaaacagtattatattggcgacatccacccaagtgatctgaaaccagagtccggcagcaaggacccatcaaaaaatgacacttgcaagagttgctgggcgtattggatcctgccgatcattggcgcagtgcttctcggattcctctacagatattatacttcagagagcaaatcttcctag

SEQ ID NO: 219778 - DNA, 756 bp, Artificial Sequence
  Description of Artificial Sequence: Synthetic coding sequence
atggagggcggagctgcagcagccacccctaccgctttgccttattatgtcgctttttcacaactgctgggccttacacttgtagcaatgacaggtgcctggttaggactctatagaggaggaatcgcatgggaaagcgacctgcaatttaatgcgcacccactctgcatggtgatcggtctgattttccttcaagggaacgccctgctggtttatagagtctttagaaatgaagccaagagaaccaccaaggtcctgcacgggttactgcacatcttcgcgttggtcatagcactggtgggactggttgctgtctttgattaccaccgcaagaaaggttatgcggatctgtatagcttgcactcttggtgcggcatcctggtgttcgttttgtattttgttcagtggctggtgggatttagcttttttcttttccccggagcctcattctccctgagatcacgctatcgccctcaacatatcttcttcggagccacaatattccttctctctgttggtaccgcactgctgggtctgaaagaggctctcctttttaaccttgggggaaaatactctgcctttgagccagagggtgtactcgccaacgtgctgggcctgctcctggcgtgtttcgggggtgccgtgttatacattttgaccagggcagattggaagcggccttcacaggctgaggaacaggcactcagcatggactttaagaccctcactgagggggattcccctggtagccagtag

SEQ ID NO: 219779 - DNA, 756 bp, Artificial Sequence
  Description of Artificial Sequence: Synthetic coding sequence
atggaaggcggagcggcagctgccacgccaacagcattgccatactatgtcgccttcagtcagctcttagggctcactctagtcgctatgaccggcgcatggctcggcctatataggggtggcattgcatgggaatcagatctgcaattcaacgctcacccgctatgtatggtcatcgggttgatatttctgcagggcaacgctctgttagtgtatcgtgtgtttagaaacgaagctaagagaactacaaaggtactgcatggcctgttgcacatcttcgcgttggtcatcgccctggtcggactagttgccgtttttgattatcacaggaaaaagggctacgccgatctttacagcctgcactcttggtgcggcattctcgtgtttgtcctctattttgtgcaatggctcgtgggtttcagtttttttctatttccaggagcatctttcagtcttagatctcgttaccgccctcagcacattttttttggcgctaccatatttctgctgtctgtcggcacagcactgctggggctgaaggaggcactgctgtttaacctgggcggaaagtacagtgcttttgagccagagggagtgcttgcaaacgtcttgggactactattagcctgttttggtggggctgtgttgtacatactgaccagagctgactggaaaagacccagccaggcagaggagcaggccttgtcaatggactttaaaaccttgaccgagggagattctccaggatctcagtag

SEQ ID NO: 219780 - DNA, 756 bp, Artificial Sequence
  Description of Artificial Sequence: Synthetic coding sequence
atggaaggcggagctgcggcagcaactcctacagctttaccttactatgtggccttttctcagttactggggctcacactggtggctatgaccggtgcctggttgggcttgtatcgcggtggcattgcttgggaatcagatttgcagttcaatgcccatcctctctgcatggttatcggccttatctttcttcagggcaacgcacttcttgtgtaccgcgtgtttagaaacgaggccaagcgcacaacaaaggtgctgcacggcctacttcatatattcgctttggttattgctttagtgggcctggtcgccgtgttcgactaccaccgcaagaaaggatacgctgacctatattctctgcactcgtggtgtggcattctggtcttcgtgttgtactttgtccagtggctcgtcggcttttcctttttcctcttccctggagcatctttctctttgcggagccgttaccgaccgcagcatattttctttggagcaacaatattcctcctgtctgtggggaccgctttgctaggcttaaaagaggcacttctattcaatctaggcggtaagtactcagcattcgagcccgagggcgttctggccaacgtgctcggattgctgttggcatgtttcgggggtgcagtactctatattctgacccgggctgattggaagaggccctcccaggctgaggagcaggccttatcaatggatttcaagacattaactgaaggagattctccagggtcccaatag

SEQ ID NO: 219781 - DNA, 417 bp, Artificial Sequence
  Description of Artificial Sequence: Synthetic coding sequence
atggaggggggtgcggctgctgcaacccctacagctttaccttactacgtggccttcagccagctcctgggactaacactagtggctatgactggcgcttggttgggtctgtatcgcggaggtatagcttgggaatccgatctccagttcaatgcccacccactgtgtatggtcattggccttatttttcttcagggaaatgcattgctggtctatagagtcttccgaaacgaagcgaagaggactactaaggtattgcacggtctgcttcatatttttgctcttgtaatagccctggtgggccttgtagcagttttcgattaccaccgtaaaaagggatacgctgatctgtactcgctgcacagctggtgcggcattcttgtttttgttctgtatttcgtgcaagggcaggtctag

SEQ ID NO: 219782 - DNA, 957 bp, Artificial Sequence
  Description of Artificial Sequence: Synthetic coding sequence
atgaagcaaaagaccaagccgggaaccggacctctgtcatccctcgaattcggcgttagtttcttagcaccgtcccctcacatggagcttttggcatcttgtcctcgcagtcggttgtctccttggggtggatgggcacctccaccctcacatagtcgcgacttgcgcccacttcctcaggatgatggggtctgcctgtcaatggagggaggcgctgcagcagcgacgcccacggccctgccttattatgtggctttctctcagcttttaggcctgacgttagtggctatgacaggagcatggctagggctatacaggggaggcatcgcatgggaatcggatctgcagttcaatgcacatcctttgtgcatggtgatcggcctgattttccttcaaggcaatgcactcctagtctacagagtatttcgcaatgaggctaagcggaccactaaagtacttcatgggcttttgcatattttcgccttggtgattgccctcgtgggcctagtggcagtgtttgactaccaccgcaaaaaaggctacgcagacctgtacagcctgcactcatggtgcgggattctggtgtttgtgttatattttgtacagtggctcgtaggttttagcttctttctcttccccggagcaagttttagccttcgctcccgctacagaccacagcacatttttttcggtgccactattttcttgttgagtgtcggcactgctctgcttggactgaaggaggctcttctgtttaacctcggcggaaagtatagtgcctttgaacctgagggggttctggctaacgttctaggtcttcttcttgcctgcttcggaggtgcagtgctctacattttgacccgggcagattggaagagaccaagccaggctgaggaacaagccctttccatggacttcaaaactttaaccgagggagattctcccggttcacagtag

SEQ ID NO: 219783 - DNA, 1143 bp, Artificial Sequence
  Description of Artificial Sequence: Synthetic coding sequence
atgggttccggctgccggatcgaatgcatttttttctcagaattccatccgacactgggccctaagatcacttaccaagtgccagaggacttcatctcccgagagctgtttgacactgtgcaggtgtatattatcacgaagcccgaactccaaaacaagcttataaccgttaccgctatggagaaaaaactcattggttgtccagtatgtatcgagcataagaagtacagtagaaatgctctccttttcaatttgggattcgtatgtgacgcccaggcaaaaacttgtgccttagaacccatcgtcaagaagctcgctggctaccttactacactagagctggaatcctcgtttgtgtcaatggaggagtccaagcagaagctggtgccaataatgaccattctgttagaggaattgaacgcgtccgggagatgcaccctccctatcgacgagtccaacacaattcatctcaaagtcatcgaacaaagaccagaccctcccgtcgcgcaggagtacgatgtgcccgtgtttaccaaagacaaggaggactttttcaattctcaatgggacctgacgacacaacaaatcttaccatatattgacggctttagacatatccagaagatttccgcagaggccgacgtggaacttaatttggtacgtattgcgattcagaatctgctttattatggggtcgttactctcgtgagcatactacagtacagtaatgtgtattgccccaccccaaaggtccaggatttggttgatgataagtctttgcaggaagcctgcctgtcttatgtgacgaaacaggggcataaacgtgccagccttagggacgttttccagctttactgcagtttgtctcccggaacgactgttagagacctgattggtcgccatccccagcagttgcagcacgtggatgagcggaagctgatacagtttggcctgatgaagaacctcatcagaagacttcagaaataccctgtaagggtgactagagaggagcaaagccatccagcgaggctttacactggctgtcattcatatgacgaaatttgctgcaagactggtatgagctatcatgagctcgatgagcggctagagaacgaccctaacataataatctgctggaagtag

SEQ ID NO: 219784 - DNA, 669 bp, Artificial Sequence
  Description of Artificial Sequence: Synthetic coding sequence
atggccctttcagccgagaccgagagccacatttaccgagctctgcggaccgctagcggggcagctgcacaccttgtcgctctggggttcactattttcgtagccgtgctggcccgaccagggagtagcctgttctcgtggcatccggtcctgatgtctctggcattcagcttcctcatgaccgaggccttgcttgtttttagtcccgaaagctcactcctgcactccctatctcgaaagggccgtgccagatgtcactgggtcctacaattgttggccctcctgtgcgccctcctcggtctcggactagttatcctgcacaaggaacagctgggtaaggctcatttggttacaagacatggccaggctgggctgctggctgtactgtgggcaggtctgcaatgcagcgggggagtcgggctcctctacccaaaattactgccgaggtggcctttggctaaactgaaattgtatcacgccacatcaggactggtcggctacttgctgggctccgcaagtctgctccttggaatgtgctccctctggtttactgcgtccgtgactggtgccgcttggtatcttgcggtgctgtgtccggtgttaactagtctggtgattatgaatcaagtcagtaatgcctatttgtacaggaagcggattcagccatag

SEQ ID NO: 219785 - DNA, 669 bp, Artificial Sequence
  Description of Artificial Sequence: Synthetic coding sequence
atggctcttagtgccgaaacagagtcccacatctaccgcgctttaaggacggcctccggagccgctgctcacctggtggctcttggattcaccatttttgtggccgtacttgcacgtcccggttcttctctgttttcctggcatccagtgctaatgtccctggccttttctttcctcatgactgaggctctgctggtgttttcgccggagtcttcgctcttacactcattgtcgcgcaagggccgtgctcggtgtcattgggtcctccagcttctggctctactgtgcgcactgcttggccttgggctcgtaatcctgcataaagagcagctcggcaaagcgcaccttgtaacacgccatgggcaagccggtttgctggcggtgctatgggcgggtctgcaatgttctggtggcgtgggattactgtacccaaagctcttgccacggtggcccctggccaaactgaagctttaccacgctaccagcgggctggtaggatacctgctggggtctgccagcctgctgctcggcatgtgtagcctgtggtttaccgcttcagttaccggtgctgcctggtatttggcagtcttgtgtccagtgctgaccagcctggtcataatgaaccaggtgtcaaatgcttatctgtaccggaagcgcattcaaccatag

SEQ ID NO: 219786 - DNA, 669 bp, Artificial Sequence
  Description of Artificial Sequence: Synthetic coding sequence
atggcgctaagcgccgaaaccgagtcacatatctaccgggctctgcgcactgctagcggcgctgcagcccacctggttgctctcggcttcacaatcttcgttgccgttctcgccagacctggctctagcttattctcatggcacccggtgctgatgagcctcgcgttttcgttcctgatgaccgaagctctcctggttttctcaccagaatcaagcctgctccacagcttatcacgcaaagggcgagcaaggtgtcactgggtactacagctgctggctttgctgtgcgcacttctgggcctgggtctagtgatcttgcacaaagaacagctcggaaaagcccacttggtgactcgccatgggcaagctgggctcttggccgtcctatgggctggtctgcaatgttctggcggagtcggcttactttatccaaagcttcttccacgttggcccctcgctaaactgaagctctaccacgcaacgtctggcctcgttggctatctgttggggagtgcttccctgctgcttggaatgtgcagtctatggtttaccgccagcgtaacgggagctgcgtggtatttggccgtcctctgccctgtcctgacatctctggtcatcatgaaccaggttagtaatgcttatctgtaccgcaagcgaatccagccatag

SEQ ID NO: 219787 - DNA, 696 bp, Artificial Sequence
  Description of Artificial Sequence: Synthetic coding sequence
atgggcggactgtggagaccagggtggcggtgtgtgcctttctgtggatggagatggatccacccagggagccctacgcgcgcagccgagagggtggagcctttcctaaggcccgagtggtccggaactgggggtgccgagcgcggactacgttggcttggaacctggaaacgttgttccttgcgtgctagacatcctgccctgcagccccctcgccgacctaagtcctcaaacccctttactcgggcacaggaggaggagcgcagacgacaaaacaaaactaccctgacatacgtggccgcagttgctgtggggatgctgggcgcttcgtatgccgctgttcccttatacaggttgtactgccagacaacagggctggggggaagtgcggtggcagggcacgccagtgacaaaattgagaacatggtaccagtgaaagacagaatcatcaaaatcagcttcaacgctgacgtccacgcaagcctccaatggaatttccgaccccagcagaccgagatctacgttgtcccaggagagactgcccttgcattttaccgggcaaaaaacccaaccgataagcccgtcatcgggatatccacctacaatatcgtcccattcgaggcaggtcaatattttaacaagattcaggcctcaaagctgcaccgcgtgtacgttctggaatcatggcacctttag

SEQ ID NO: 219788 - DNA, 510 bp, Artificial Sequence
  Description of Artificial Sequence: Synthetic coding sequence
atgctggctactagggtgttctctctggtgggaaagcgcgctattagcacttcagtttgtgtccgggcacatgagagcgttgtaaaaagcgaggacttttcacttccagcttatatggacaggagagaccaccccctgcctgaagtcgcccatgtcaaacacctgagcgcctctcagaaggccttgaaggaaaaagaaaaggccagttggtcgtccctaagcatggacgagaaggtagagttataccgcattaagtttaaggagagctttgcagagatgaataggggctccaatgagtggaagactgtggtcggcggagccatgttcttcattggctttactgcgcttgtgataatgtggcagaaacactacgtctacggcccacttccgcaaagtttcgacaaggagtgggtggccaagcagacaaaacgcatgctggacatgaaggttaaccccatccagggactcgctagcaaatgggactacgagaagaacgagtggaaaaaatag

SEQ ID NO: 219789 - DNA, 516 bp, Artificial Sequence
  Description of Artificial Sequence: Synthetic coding sequence
atgctacccagagcggcttggtcccttgtgctgcgcaagggaggagggggtaggcggggaatgcactcatccgagggaacaacacgaggcggaggaaagatgtccccctacactaattgttatgcccagaggtattatcccatgcctgaggagcccttttgcacagaactgaatgctgaggaacaggccctaaaggagaaggagaagggcagctggacccagctaacccatgccgaaaaggttgccctgtaccgcttacagtttaacgagacgtttgccgaaatgaaccgccgatccaacgaatggaagaccgttatgggttgcgtgtttttctttatcggctttgcggcactcgtgatctggtggcaacgagtctacgtgtttccaccgaagccaattacccttaccgacgaaagaaaagcccagcaattgcagaggatgctggacatgaaggttaaccccgtccaagggctcgcctcccgctgggattatgaaaaaaagcagtggaaaaagtag

SEQ ID NO: 219790 - DNA, 390 bp, Artificial Sequence
  Description of Artificial Sequence: Synthetic coding sequence
atggcgtcccgtctgctgaggggcgctggtacactggctgctcaggctcttagagcaagaggtccttcaggagccgcagcgatgcgctctatggcgtctggcggtggggttcctactgatgaggaacaggccactggcctggagcgggagattatgctagccgcaaagaaagggttggatccttataatgttcttgcgcctaagggcgcttccggcacaagagaagatccaaaccttgtcccctccatttccaacaaaaggatcgtcgggtgcatttgtgaagaggataataccagcgtggtctggttttggttgcataagggcgaggcccaacgttgcccaaggtgcggggcacactataaactagttccccagcagctagcccactag

SEQ ID NO: 219791 - DNA, 606 bp, Artificial Sequence
  Description of Artificial Sequence: Synthetic coding sequence
atggcccgagattacgatcacctgttcaagttactcatcatcggggatagtggagtggggaagagtagtctgttactcaggtttgctgataacacatttagcggcagttatataaccactatcggggtggatttcaaaatccgcacagtggagatcaatggggagaaggttaaacttcaaatctgggataccgctggacaggagcggtttcgaaccataactagtacatactatcgcggtacacacggcgtcatcgtcgtctatgacgtcaccagtgctgaatcgttcgtgaatgtaaagagatggttgcacgaaatcaaccaaaattgtgacgatgtgtgtcggatcctggttggcaataagaatgacgacccggagcggaaagtggttgagacagaggacgcctataaatttgctgggcagatgggaatccagctgttcgaaacctccgctaaggaaaatgtgaacgtggaagagatgtttaattgtataaccgaactggtgctgagggccaagaaggacaatctagccaaacagcagcaacagcagcagaacgacgttgttaaacttacgaagaattcgaagagaaaaaagcgctgttgctag

SEQ ID NO: 219792 - DNA, 261 bp, Artificial Sequence
  Description of Artificial Sequence: Synthetic coding sequence
atggctgaggacatggagacaaaaatcaagaactataagacagcaccttttgacagtcggttcccgaaccaaaaccagactcgtaattgctggcaaaactacctggattttcataggtgtcagaaagccatgactgcgaaaggtggagatatctcagtgtgcgagtggtatcagagagtgtaccaatcgctgtgtcccacttcatgggttacagactgggacgagcagagggcagaaggaactttcccaggaaagatctag

SEQ ID NO: 219793 - DNA, 312 bp, Artificial Sequence
  Description of Artificial Sequence: Synthetic coding sequence
atgcatcctcatcctcaaatccccggtcgagacttagcaggctttagcactatggccgaagatatggaaaccaaaatcaagaactataaaaccgccccattcgacagcaggtttcccaaccagaaccagaccagaaactgctggcaaaactacctggacttccaccgatgccaaaaggccatgaccgctaagggtggagacatcagcgtttgcgaatggtatcagcgggtttatcagagcctgtgtcctacatcttgggttactgactgggatgagcaaagggctgaaggcactttccccggtaaaatctag

SEQ ID NO: 219794 - DNA, 228 bp, Artificial Sequence
  Description of Artificial Sequence: Synthetic coding sequence
atggcgccagaagttctccccaagcccagaatgcggggtctgctcgcccgaaggcttcggaatcatatggccgtcgcatttgttttgtccttaggagtcgccgcattatataaatttcgggtagccgaccagcgaaaaaaggcgtatgcggatttttacaggaactacgatgtgatgaaagacttcgaagagatgcgaaaagcgggtatcttccagtctgttaaatag

SEQ ID NO: 219795 - DNA, 228 bp, Artificial Sequence
  Description of Artificial Sequence: Synthetic coding sequence
atggcgcctgaagtcctgcccaagccacgcatgcgcggtttactcgccagaaggctacggaatcacatggcagtagcgtttgtgttgtcactaggagtggcagcattgtacaagtttcgtgttgcagaccagcggaaaaaagcttacgctgacttctaccgcaactatgacgttatgaaggatttcgaggagatgcgtaaagccggaattttccaatccgtcaagtag

SEQ ID NO: 219796 - DNA, 228 bp, Artificial Sequence
  Description of Artificial Sequence: Synthetic coding sequence
atggccccagaagtactgccgaaacctcggatgcgaggactccttgctcggcgactgagaaatcatatggctgtcgccttcgtgctctcgcttggcgtggcggcattgtacaagtttcgcgtcgccgatcagagaaaaaaggcctatgccgatttttatcgtaattacgacgttatgaaagattttgaagagatgcggaaagccggaatatttcagagtgtcaagtag

SEQ ID NO: 219797 - DNA, 228 bp, Artificial Sequence
  Description of Artificial Sequence: Synthetic coding sequence
atggctccagaagtgctacccaagcctcgcatgcggggactcctggccaggaggttgcgaaatcatatggcagtcgcttttgtgctttcattgggggtagccgctctatacaaattccgggttgccgaccagaggaagaaggcctacgccgacttctaccgcaattacgatgtgatgaaggacttcgaagaaatgagaaaagcaggaatcttccagagtgtaaagtag

SEQ ID NO: 219798 - DNA, 228 bp, Artificial Sequence
  Description of Artificial Sequence: Synthetic coding sequence
atggccccagaggttcttccgaaacctaggatgagaggcttgctggctcggagattacggaaccatatggctgtcgcattcgtccttagccttggtgtggcggctctgtacaagtttcgcgtggcagaccaacggaagaaagcttatgccgacttctaccgcaactacgatgtaatgaaagattttgaagagatgcgtaaagctggaattttccaaagcgtcaaatag

SEQ ID NO: 219799 - DNA, 228 bp, Artificial Sequence
  Description of Artificial Sequence: Synthetic coding sequence
atggctccagaggtgctcccaaaaccgcgtatgaggggtctcctggccagacgactccgtaaccatatggctgtagcattcgtcctgtccttgggagtcgccgctctgtacaagttccgggtggccgaccaacggaagaaggcttacgcagatttctataggaactatgatgtcatgaaggatttcgaagagatgcgcaaagccggaatatttcagagtgtgaaatag

SEQ ID NO: 219800 - DNA, 228 bp, Artificial Sequence
  Description of Artificial Sequence: Synthetic coding sequence
atggccccagaggtcctccctaaaccaagaatgcgcggactgctggccagacggttgagaaaccatatggcagtggcctttgtgcttagtctcggcgtagctgccctgtataaatttagggtggctgatcagaggaagaaggcatacgccgatttctatcggaactacgacgtgatgaaagacttcgaggagatgagaaaggccggtatcttccagtctgtgaaatag

SEQ ID NO: 219801 - DNA, 228 bp, Artificial Sequence
  Description of Artificial Sequence: Synthetic coding sequence
atggcaccagaagtgctcccaaagcctcggatgcgcggattgctcgccagacggcttagaaaccacatggccgtggccttcgtgctgtctctcggcgtggccgctctgtataaatttcgggtggcagatcagcggaaaaaagcctacgccgacttctacaggaactacgacgttatgaaggactttgaggagatgcggaaagccggaattttccaatctgttaaatag

SEQ ID NO: 219802 - DNA, 228 bp, Artificial Sequence
  Description of Artificial Sequence: Synthetic coding sequence
atggcccctgaggtgctacctaagcccaggatgagaggtctgctcgctcggagactaagaaatcatatggcagttgcctttgtcctgtcgttgggcgtggccgcactttacaaattccgcgtagccgaccagcgcaaaaaagcctatgcggacttctatcgcaactacgacgtcatgaaggacttcgaggaaatgcgcaaagctggaatcttccagtccgtgaaatag

SEQ ID NO: 219803 - DNA, 228 bp, Artificial Sequence
  Description of Artificial Sequence: Synthetic coding sequence
atggcccctgaggtgttgcccaaacccaggatgcgcggactactggcacggagacttcggaatcacatggctgtggcatttgtgcttagtctaggagtagccgctttatacaaatttcgtgtggcagatcagcggaagaaagcatacgctgatttctataggaactacgatgtcatgaaggatttcgaggagatgcggaaagctggtatcttccagagcgttaagtag

SEQ ID NO: 219804 - DNA, 240 bp, Artificial Sequence
  Description of Artificial Sequence: Synthetic coding sequence
atgcaagcgctgagggtgtcgcaggccctaatccggagtttctcgtccaccgcgcgaaaccgatttcagaatcgagtccgagaaaagcagaagctctttcaggaggataacgatatcccattgtacttgaaaggcggaatagttgataatattctgtacagagtgactatgacactctgcctgggtggaactgtctactccctgtacagtttagggtgggcttccttccccaggaattag

SEQ ID NO: 219805 - DNA, 330 bp, Artificial Sequence
  Description of Artificial Sequence: Synthetic coding sequence
tgatccttttgggttctgtctttgcccggtccaagcagacagcctggccacccgcaggcaaggttacagggcgagtcaccgcctaacccagcgggaagctcccgcgtgtcgcaggctctaatcaggtctttcagctcaacggccaggaatagattccagaatagggtgagagagaaacaaaagctcttccaggaagacaacgacatccctctttacctcaaaggtgggatagtggacaatattctgtaccgagtaaccatgacactgtgtttaggcggaactgtgtactcactctactccctcggctgggcttcttttcctcggaactag

SEQ ID NO: 219806 - DNA, 2775 bp, Artificial Sequence
  Description of Artificial Sequence: Synthetic coding sequence
atgagtcgctctaggcaacctcccctcgtgactggaatcagcccgaacgagggcattccttggactaaggttacaattagaggcgagaacctgggcaccggtcctactgatctgattggcctgacgatttgcgggcacaattgcttgcttacagcagagtggatgagcgctagcaaaatagtttgtcgcgtaggccaggctaagaatgataaaggagacatcattgttactaccaagagcggagggagggggacaagcacggtgagcttcaagctgctgaaacctgagaaaatcggaatcctcgatcagagcgcagtttgggtggatgagatgaattactacgatatgaggacagaccggaacaaaggtattccaccactgtcgctgaggcccgctaatcctttaggtatcgagatcgagaaatccaagttttcccagaaggatctcgagatgttgtttcacggcatgagcgctgacttcacttccgaaaatttcagcgctgcatggtacctgatagagaatcactcaaatactagttttgagcagctgaagatggcagtgaccaacttgaaacggcaagccaacaaaaagtcagaggggtctcttgcttatgtcaaaggagggctcagtactttcttcgaggctcaggacgcactcagtgctatacaccagaaacttgaagcagacggcacagaaaaagtggaaggaagcatgacccagaagctggagaacgtgctgaatcgagcaagtaatactgccgacacgttgttccaggaagtgctgggccgaaaagacaaagctgactccaccagaaatgcccttaacgtgttgcagcgcttcaagttcctgttcaaccttcctctgaatatcgagcgaaatattcagaagggtgactatgatgttgttattaacgattacgagaaggccaagagcctattcggcaagactgaggtccaggtctttaaaaagtattacgcagaagtggagaccagaattgaagcactgagggaactgcttcttgataagttgttggaaaccccctccacgttacacgatcagaagagatacatcaggtacctctcagacctgcacgcttctggcgaccccgcttggcaatgcattggcgcacagcacaagtggatcttgcaactcatgcacagttgcaaggagggttacgtgaaggacttaaagggaaatccaggactccactcccccatgctggacctcgacaacgataccagaccttcagtcctgggtcacttgtcccagacagcctccctcaagcgcggatcctctttccagagcggccgagatgacacctggcggtacaagaccccccatagagtggctttcgtggaaaagctcacaaagctggtgttatctcagctccccaatttctggaagctatggatcagctacgtgaacggctcgttatttagtgagaccgccgagaaaagcgggcagattgagcggtcgaaaaatgtccgccagagacaaaacgatttcaagaagatgattcaggaggtgatgcattctctcgtcaaactgacccgaggcgctctgctccccttgtccataagagatggtgaggcaaagcaatatggcggatgggaagtgaagtgcgaattatctggacagtggctggcccacgccatccagaccgtacggctgactcacgagtctttgaccgcccttgaaatacctaacgatctgctgcagactatccaggatctcattctcgatctgagggtgagatgtgtcatggccacgctgcagcatacagcagaggaaatcaaaagactagccgaaaaggaggattggatcgtcgacaacgagggactgaccagtctgccatgtcagttcgagcagtgtattgtgtgttctctgcagtccctaaaaggggtactggaatgcaaacctggcgaagcctctgtgttccagcagcctaaaactcaggaagaggtgtgtcagctatccattaatattatgcaggtattcatctactgtctagaacaactgtctactaagccagacgctgacatcgacactacccacctttcagtcgacgtgtcctctcctgacctgtttgggagtattcatgaagacttctccttgacctctgagcagcggctcctcatcgttttgtccaattgttgctatctggaaaggcacacttttctcaatattgcagaacattttgagaaacacaactttcagggaattgagaagattacccaggtcagcatggcatcactgaaagaactggatcagagactctttgaaaattacattgagctgaaggccgaccctatcgtcggaagccttgagccaggcatttatgccggatattttgattggaaggactgtcttcccccaacgggcgttaggaactatctcaaagaagccctcgtgaatattatcgccgtccatgcagaggtttttaccatttctaaggagctggtgccacgagtgctgtccaaggtgattgaagccgtgtccgaggaactgagtagattgatgcaatgtgtctccagctttagtaagaacggggctcttcaggctagactcgaaatctgcgcactgcgggatacagtggccgtgtacctcacaccagagtctaaaagctcattcaaacaggcgctggaagccctgccccagctgagctccggagctgacaagaaacttctagaagaactgctcaacaaattcaaatcatctatgcacctccagctgacctgtttccaggcggctagtagcaccatgatgaagacctag

SEQ ID NO: 219807 - DNA, 348 bp, Artificial Sequence
  Description of Artificial Sequence: Synthetic coding sequence
atgcacacccaagattcggaagtagtgccagtgcctgcgtggcctttctctcttgttgtgttctcctgcggaggctgctggtccgtcacagctaagatgctccgcaatctcctcgccctccggcagattggtcaaagaaccatctcgaccgcctccagaaggcacttcaaaaacaaggtgcctgagaagcagaagttgttccaggaggacgatgaaatccctctctacctgaaggggggtgtggcagatgccctgctgtatagagcaacaatgatacttacagttggcggaaccgcgtacgcaatctacgaattagccgttgcctcctttccaaagaaacaagagtag

SEQ ID NO: 219808 - DNA, 348 bp, Artificial Sequence
  Description of Artificial Sequence: Synthetic coding sequence
atgcacacccaggacagcgaggtggtcccagttccagcgtggccatttagcctggtggtgttctcctgtgggggttgctggagcgtcacagccaagatgctcaggaatttgctggctctccgccagattggccagaggacaattagtacagccagtagacgccatttcaaaaacaaggtgcctgaaaagcagaagctctttcaggaagacgacgaaatccccctctacctcaaggggggtgtggccgacgctctgctctacagggcaaccatgattcttactgtaggaggaactgcttatgccatttacgagctggctgtcgctagctttccaaaaaagcaggaatag

SEQ ID NO: 219809 - DNA, 1734 bp, Artificial Sequence
  Description of Artificial Sequence: Synthetic coding sequence
atgagtaaacctgagctgaaagaagataaaatgctcgaagtacatttcgtaggtgatgatgacgtgctcaatcacatactcgaccgcgaagggggagcaaaactcaagaaagagagagctcaactgctcgtcaaccccaagaagatcattaagaagcccgagtatgatctagaggaggacgatcaggaagttttgaaggatcagaattacgttgaaatcatgggtcgggacgtccaggagagtctgaagaacggctcggcaacaggaggcggaaataaagtgtactcatttcaaaacaggaagcatagcgagaagatggccaagctcgccagcgagctggcaaagaccccgcagaaatcagtgtcgtttagcttgaagaatgatccagagatcaccatcaacgtgccacagtcgtccaagggacacagcgcttcagataaagtccagccaaaaaacaacgataaatccgagtttctttccaccgctccaagatccctgaggaagcgacttatcgtgcctcgaagtcactccgactccgaatcagagtactcagccagtaattcagaggatgacgaaggggtcgcgcaggaacacgaagaggacaccaacgcagtgatcttttctcagaaaattcaagctcagaatcgggtggtctctgcccctgtgggcaaggaaactccatcaaagagaatgaagagggacaaaactagcgacctggtcgaggaatacttcgaagcacattcatcatcaaaggtgctgaccagtgatcggacattgcaaaagctcaagcgagcgaagttggatcagcaaactctgcgcaatctgctgtccaaggtgagcccttcattttctgccgaacttaaacagctgaatcaacagtatgaaaagctgtttcataaatggatgttgcagctccacctggggttcaacattgtgctatacggtctcggaagcaaaagggacctgctagaacggttcagaaccaccatgttacaagactctatccacgtcgtaattaacggattctttccaggcatttcagtaaagagtgtcctgaacagtatcaccgaagaggtcctagaccatatgggtaccttccggagcatactggaccagctggactggatcgtgaacaagtttaaggaagactcgtcacttgaattgttcttgttaatccataacttagactcacagatgctaagaggagagaagagccagcaaatcattgggcagctatcttctcttcacaatatttacctgatcgcctcaatagaccacttaaatgcacctcttatgtgggaccacgcaaagcagtcactcttcaattggctgtggtacgaaactaccacatacagcccctacactgaggagacttcctacgaaaattctctcctcgtgaaacaaagcggatctttgcccctgtcttctctgacccatgtgttgaggtccctcacacccaatgctagaggtattttcaggttgctgattaagtaccagttggacaaccaggataacccctcttatatcggcttgtccttccaggacttctaccaacagtgcagggaggcctttctggtgaattcagacctgaccttaagagcccagctgacagagtttagagatcacaagctcattaggacaaagaaagggacggatggagtggaatatctattgatccccgtagataacgggactctaactgactttctggaaaaggaagaagaggaagcatag

SEQ ID NO: 219810 - DNA, 345 bp, Artificial Sequence
  Description of Artificial Sequence: Synthetic coding sequence
atgtactacaaatttagtgggttcacgcaaaagctcgctggggcttgggcctctgaagcttattctccacagggcctgaaacctgttgtcagtactgaagcgcctcccatcatcttcgctactcctacgaaactcacatccgactcaactgtgtacgactacgcagggaaaaacaaagtgccagagctgcagaagttttttcagaaggccgacggggtgcctgtgtacttgaagagagggcttccagatcagatgctgtatcgcaccacaatggctttgacagtgggaggtacgatctattgcctcatcgccttatacatggcgtctcagccgaaaaacaagtag

SEQ ID NO: 219811 - DNA, 246 bp, Artificial Sequence
  Description of Artificial Sequence: Synthetic coding sequence
atgatgttccctctggcacgcaacgcgctctcgagcctgaaaattcaatccatactccagtccatggccaggcattctcacgtaaaacacagcccggattttcatgacaagtacggaaacgcggttctcgcttcaggcaccgcgttctgtgttgcaacttgggtctttactgctactcagattggcatcgaatggaacctgtcacccgtgggcagagtgacccccaaagaatggaagcaccaatag

SEQ ID NO: 219812 - DNA, 246 bp, Artificial Sequence
  Description of Artificial Sequence: Synthetic coding sequence
atgatgtttccgctggccagaaacgccctatccagtctgaaaattcaatcaatactgcaatcaatggcccgacactcacacgtgaagcactctcctgactttcatgataagtacggcaatgccgtgttggcttccgggactgccttttgcgtggctacatgggttttcaccgcgacccaaattgggatcgagtggaacctatccccagtggggcgtgtcacgcccaaggaatggaagcatcagtag

SEQ ID NO: 219813 - DNA, 246 bp, Artificial Sequence
  Description of Artificial Sequence: Synthetic coding sequence
atgatgtttcctctggcaagaaacgccttatccagcctcaagatccaatcaattcttcagagtatggctaggcactcacacgtgaaacactctccggacttccacgacaagtatgggaacgcagttctggcatcaggcactgctttctgcgtggctacctgggtcttcaccgctactcagattggaatcgagtggaatctcagcccagtgggacgcgtgacgccaaaggaatggaaacaccagtag

SEQ ID NO: 219814 - DNA, 99 bp, Artificial Sequence
  Description of Artificial Sequence: Synthetic coding sequence
atgatgtttcccctggccaggaatgccctgtcctcgctgaagattcagtcaatcctgcaatccatggctcgccatagtcacgtaaagcacagtccttag

SEQ ID NO: 219815 - DNA, 243 bp, Artificial Sequence
  Description of Artificial Sequence: Synthetic coding sequence
atgttcccgcttgccagaaatgcactatcatcattaaagatccaatccatcctccaaagtatggccaggcacagtcacgtgaaacactctccagactttcacgacaagtatgggaatgccgttctggccagtggtacagccttttgtgttgctacttgggtcttcactgcgactcagatcggaattgaatggaatctctcaccagtaggtcgagtgacccctaaggagtggaagcaccagtag

SEQ ID NO: 219816 - DNA, 192 bp, Artificial Sequence
  Description of Artificial Sequence: Synthetic coding sequence
atgttggggcagagcattcggaggttcaccacaagcgtcgtaaggaggtcccattatgaggaaggccctggaaagaatctaccattctccgttgagaacaagtggtccctcctcgctaagatgtgcttgtattttggctcagctttcgctacccccttcctggtggtgcgtcatcagctattgaagacctag

SEQ ID NO: 219817 - DNA, 192 bp, Artificial Sequence
  Description of Artificial Sequence: Synthetic coding sequence
atgttggggcagagcatccgaaggtttacgacaagtgtagtgcggaggagccattatgaggaaggaccaggcaaaaatctgcctttcagcgtggagaacaagtggtccctgctggctaagatgtgcctctatttcggatctgcattcgccacccccttcctggttgttaggcaccagcttctcaaaacctag

SEQ ID NO: 219818 - DNA, 978 bp, Artificial Sequence
  Description of Artificial Sequence: Synthetic coding sequence
atggctgccgcagctgcttccttgcggggagtagtgctgggtccaaggggcgcaggactgcccggagcacgcgctcggggactgctttgtagcgctagaccgggacagctacctctgaggacacctcaggccgtggctctctcgtccaagtcaggactttcccgaggtaggaaagtaatgctgagcgctcttggaatgctcgctgccggaggagcgggactggcaatggccctacattccgccgtcagcgcatcggacctggagctgcatcctccatcttacccctggtcccatagaggtctcttgtcaagtctggatcacacttcaattcgccgaggatttcaggtatacaagcaggtgtgcgcgtcctgtcatagtatggacttcgtggcatacaggcaccttgtcggcgtatgctacacagaggacgaggcaaaggaactggccgctgaagtagaggtgcaggatggtccaaatgaggatggggagatgtttatgcgaccaggtaaactctttgattacttccctaaaccttacccaaacagcgaagccgcaagagcagccaataacggagccctgccacctgatctcagctatattgtgagggccaggcatggtggcgaagattatgtgttctcgttactgacaggctactgcgagcctcctacaggcgtgtcactccgcgaaggcctgtactttaacccgtacttccccggacaggcaatagctatggcaccccctatatacacagacgtcttggagttcgacgatggcacaccggcaacgatgagccaaattgcaaaggacgtgtgcacattcctgcgctgggccagcgagccagagcacgatcacagaaagcgtatgggactcaagatgctgatgatgatggccctcctggtccccctggtgtatacaatcaagaggcataaatggtccgtcctgaaatctaggaagttggcctacagaccgccaaagtag

SEQ ID NO: 219819 - DNA, 252 bp, Artificial Sequence
  Description of Artificial Sequence: Synthetic coding sequence
atggagcccttcgtggtcctggtactatgcctcagttttatgctgctttttagtctgtggagacagtcgtgtcgaagaagaaagttgcctcctgggccaacgccgctgccaatcataggcaatatgcttcagattgatgtcaaagacatttgtaaaagctttaccaatgtgagtttaccatacgttccccctgccaactgcaagggcagccagaaatccatggtgctctgcagtccttgtattctggcctag

SEQ ID NO: 219820 - DNA, 219 bp, Artificial Sequence
  Description of Artificial Sequence: Synthetic coding sequence
atggaaccctttgtggttctggtgctctgtctgagcttcatgttgctgttttccctatggaggcaatcctgtcggcgacgcaagctaccgccaggaccaaccccactgcccatcataggcaatatgctccaaatagacgtgaaggacatctgcaagagctttaccaacgttagtctgccctacgtgcctcccgctaattgcaaaggcgtgctgctttag

SEQ ID NO: 219821 - DNA, 423 bp, Artificial Sequence
  Description of Artificial Sequence: Synthetic coding sequence
atggacttaatccccaacttggcagtggaaacctggcttcttttggctgtgtcccttgttctactctacttatacggaactcggactcatggattgtttaaacgcctcggaatccccggacctaccccactcccactcctgggtaatgtcttgtcctatcgccagggactgtggaagtttgataccgaatgctacaagaagtacggaaagatgtggggtacatacgagggccagttgcccgtcttggcaatcacagacccggacgtcatacggactgttttggtaaaagagtgctactctgtcttcacaaatagaagaatctgtgcaacaacctcaaccatcaaaatgcagacgcactccgtgacaatgtggctcccccctgctgtgttgcagtcccagcacggggtttgcctctttctgtag

SEQ ID NO: 219822 - DNA, 1563 bp, Artificial Sequence
  Description of Artificial Sequence: Synthetic coding sequence
atgcctcagctgtccctgtcaagcctcggtctctggcctatggcggcttccccttggcttctgctgctgttggttggggcttcatggctgctggcaagaatcttggcgtggacatacactttttatgataactgttgccggctcagatgttttccacagcccccaaagcgcaattggttcctgggacacctgggactagtgacgccaacggagcagggaatgagagttttaacccagctagtggcaacatacccacaggggttcaaggtgtggatgggtcctattttccctgtcatccgtttttgccatcccaatattatacgatccgttatcaacgctagcgcggcaatcgtgcccaaggacaaggtcttctattcttttctcaagccgtggttgggcgacgggttgctgctttcggccggagagaagtggagtcgtcaccggaggatgttgacaccagcctttcacttcaatattctaaagccatacatgaagatctttaatgagtccgtcaacatcatgcacgcaaaatggcagctgctggccagtgaggggtcggccaggctcgatatgtttgagcatattagcttgatgacactcgattctctacagaagtgtgtgttctctttcgactcccattgccaagagaagccgagcgagtacatagctgccatcctcgagttgagcgccctcgttaccaagcggcaccagcaaattctgttatacatcgacttcttatattaccttaccccggacggacaacgatttcggcgagcatgtaggctggttcatgattttaccgacgcagtgatccaggagagacgaagaaccctgccatcccagggcgtggatgatttcctgcaggccaaggccaaaagtaagaccctggattttatagacgtgttgctcctgtctaaggacgaagacgggaaaaagctctccgacgaggatatcagggctgaagctgataccttcatgtttgagggacacgacaccaccgcctcaggactgtcctgggtgctgtatcacctcgcaaagcatcctgagtatcaggagcgctgccgccaggaagtccaggagcttctgaaggaccgagagcctaaggaaattgaatgggacgacctggcccagctgcccttcctgacaatgtgcataaaagagtccctgaggctgcatcccccagtccctgccgtctcacgctgttgcacccaagatatcgtgctgcctgatggacgggtgatcccaaaggggatcatttgtctgatatccgtgttcggcacccaccacaaccctgccgtgtggcccgatccagaagtctatgatccttttagattcgaccccaagaacatcaaggagcgttcccccctagcttttattcctttctccgccggaccccgtaattgtatcggacaggcctttgccatggcggagatgaaggtggtgcttggactgactctcctgagattcagagtgcttcctgaccacacagaaccgcgacgaaagccagagctggtgttaagagcagaagggggtctgtggttgcgcgtggaaccgttgtcatag

SEQ ID NO: 219823 - DNA, 1455 bp, Artificial Sequence
  Description of Artificial Sequence: Synthetic coding sequence
atgttgtttcccataagtatgtctgctactgagtttttactagcaagcgttatcttctgtctggtattttgggttataagggcctctagaccacaagtgcctaagggtctgaaaaaccccccagggccttgggggtggcctctgatcgggcatatgctcactctcgggaagaacccgcatctcgccctgtctagaatgtctcaacagtacggggacgtacttcagattaggatcgggtcaactcctgtcgtagtgctcagcggtttagacaccattcggcaggccctggtgcggcaaggagacgacttcaaaggcagacctgacctgtacacttttacacttatttctaatggtcaatcaatgtccttcagccctgatagcggacctgtctgggccgcacgacggaggctggctcagaatggtctgaaatccttctctatcgcaagcgatcctgctagctccacatcgtgctacctggaagagcacgtgagtaaggaggctgaagtgctgattagcacgttgcaagagttaatggccggaccagggcacttcaatccctaccgttatgtggtggtctccgtgactaatgtcatttgtgccatctgttttgggaggaggtacgaccataaccatcaggaactcctgagcttggtcaatctcaatgcctttaaggatctgaacgaaaagttttacagctttatgcaaaagatggtgaaggaacactataagacgttcgaaaagggacacattagagacatcacagatagtctgattgagcattgtcaggagaagcaactggacgagaatgcaaacgtgcagcttagtgatgaaaaaattatcaacatcgtgctggatctgttcggggcaggctttgataccgtcaccacagccatttcatggtccctcatgtatttggtgatgaatccaagggtgcagcgaaagatccaggaagagctggacactgtcattggtaggagccgtagacccagactcagtgaccgcagtcatcttccctatatggaagcctttatcctggaaacctttaggcactcctccttcgtgccgttcactatccctcactccacgaccagagatacctctttgaaaggtttttatataccaaagggacgttgcgtattcgtcaaccagtggcagattaaccatgaccagaagctgtgggtgaacccttcagagtttctgcccgaaaggtttttgactccggacggggctattgataaggtcctctctgaaaaggtgatcatctttgggatgggcaaacgaaaatgtattggtgaaacaatcgctaggtgggaagtgttcctcttccttgccatcttgttgcaaagagttgagttctccgtgcccctcggagtaaaggttgatatgacaccaatctatgggctgaccatgaaacatgcatgttgcgagcacttccagatgcaactgcgcagctag

SEQ ID NO: 219824 - DNA, 1539 bp, Artificial Sequence
  Description of Artificial Sequence: Synthetic coding sequence
atgctcttcccaatctcaatgtccgctactgaatttttgctggcatcagtcattttctgcctcgtattttgggtgatcagggctagccgcccacaggtgcctaaggggctgaaaaatccccctggtccctggggatggccgctgattggccatatgttgacactgggcaagaatccccacctagctctctctcggatgtcgcagcagtacggtgatgttcttcaaatccgaatcggctctactcctgtggtggttctcagcgggctggacaccatacgtcaggccctggtccgtcagggtgatgatttcaagggcagacccgacctgtacactttcaccctgatctccaacggtcagtctatgtctttctccccagactccgggccagtttgggcagcacgaagacgactggctcagaacggcctaaagtctttttcaatcgcgtcagatcccgcatcctccacctcctgttacctggaggaacacgtgtcaaaggaggccgaagtgctcatttccaccctacaagagctcatggctgggccaggtcactttaatccctatcggtacgttgtggtatcagtgactaacgtcatctgtgccatctgttttgggaggcgctacgaccataatcaccaggagctcttgtcgctggttaatctcaacaataacttcggtgaggtagttgggagtggaaatccagcagacttcattcccatcttacggtatctgcccaatccttctcttaacgcattcaaagacctcaatgagaagttttactcgttcatgcaaaagatggtgaaggaacactacaagaccttcgaaaagggccacatccgggacataaccgactcactcatcgaacactgtcaggagaaacaattagacgagaatgcaaatgtacaactatcagacgagaagataattaacatagttctggatttgttcggcgcaggctttgacacggttaccaccgcaattagttggtccttaatgtatcttgtgatgaatcctcgggtccaacgaaagattcaagaggagctggatactgtgatcggcagaagtagacgaccaaggctcagcgacaggtcccatcttccctatatggaggcttttatattggaaacattcaggcattcatctttcgtgccctttacaattcctcattccaccactcgggatacaagcctaaaaggcttctatattcccaaaggcagatgcgtttttgtgaatcagtggcagatcaaccatgaccaaaagctgtgggtcaatcctagcgagtttctgcccgaacgttttttgacgcccgacggtgccatcgataaagttcttagcgaaaaagttatcatattcggaatgggcaaaaggaagtgtattggcgagacaatcgcacggtgggaggtttttctcttccttgcaatcttgctccagagggtcgagttttctgtgcctcttggtgtcaaggtggacatgacaccaatttatgggttgacaatgaaacacgcctgctgcgagcatttccagatgcagctcaggtcatag

SEQ ID NO: 219825 - DNA, 1539 bp, Artificial Sequence
  Description of Artificial Sequence: Synthetic coding sequence
atgcttttccccatcagcatgagcgctaccgagttcctgctggcaagcgtaattttttgtctggtgttctgggttatccgagcttccaggccacaggttcccaagggtctgaagaatccaccagggccatggggatggccactgataggtcacatgcttacactcggcaaaaacccccacctagccctgtcaaggatgtctcagcagtatggagatgttctccagatccgcataggatctacccccgttgtggtgctctccgggttagacacgatccggcaagcccttgtacggcaaggggacgactttaaaggtaggccagatctctatacctttaccttgatctcaaatggacagtctatgagcttctctccggacagtggcccagtatgggcagctaggcgaagactggcccagaatggtctgaagtccttttccatagcttctgatcctgcctcttcaacaagttgctacctggaggaacatgtgtctaaagaggctgaagtgttgataagtactctccaggagttgatggcgggaccaggtcacttcaatccatatagatacgtcgttgtctcggtgactaatgtgatctgtgccatttgcttcgggagacgctatgatcacaaccaccaagaactcctgagtctcgttaatcttaataacaacttcggtgaggtcgtgggctctggaaacccagcggacttcatccccatcctgcgctacctgcctaatcccagcctgaacgccttcaaggacctgaatgagaagttttattcgttcatgcagaaaatggtcaaagagcattacaaaacctttgaaaagggtcacatccgcgacattaccgactcgttaatagagcactgccaggagaaacaattagacgagaatgcaaacgttcagctgtccgacgaaaagatcattaatattgtactggatcttttcggcgctggttttgataccgtcactacagctatatcctggagcctaatgtacctcgtgatgaatcctcgggtccagcggaaaatccaggaggagctcgacaccgtgatcggaaggtcccgccgtccccgtctgtcggacaggtctcatttgccatacatggaggccttcatacttgagacttttaggcactcatcctttgtcccatttactatccctcacagtacaacacgtgatacctctttgaaggggttctatatccctaagggcagatgtgttttcgtgaaccagtggcagatcaaccacgatcaaaagttgtgggtcaacccttcagaatttctgcctgaacgctttctgacgcccgatggcgctatcgacaaagtccttagcgaaaaggtaattattttcgggatgggcaaacgcaagtgcatcggcgagacaatagcaaggtgggaggtgtttttgttccttgcaattcttctccagagagtggagttctcagtccctctgggcgttaaggtagacatgacacctatttatgggcttacgatgaagcatgcttgctgtgagcacttccagatgcagctgcggtcctag

SEQ ID NO: 219826 - DNA, 1452 bp, Artificial Sequence
  Description of Artificial Sequence: Synthetic coding sequence
atgttgttccctatatctatgagtgcgaccgagttcctgttagcttcagtgattttctgtctagtgttctgggttatcagggcaagccgtccacaggtgccaaaagggttgaagaaccctccgggaccgtggggctggcctttaatcgggcatatgttaacactcggaaaaaatccacacctggccttgagtcgaatgtcccaacagtacggagatgtgctccagatccggattggtagcacccctgtagtggttctgtccggactcgacacgatcaggcaggcgctcgtgcggcagggagatgattttaagggacgcccagacctctacactttcacccttatctcaaatgggcaatccatgtctttcagcccagatagcggccctgtctgggccgctagacggcgactggctcaaaacggtctgaagtcctttagtatcgctagtgatccagcgtctagtacctcctgttacctcgaggagcacgtgtccaaagaggccgaggtcttaatctccacactgcaggaacttatggccggacccggtcacttcaacccctatcgctacgtcgtagttagcgtgacaaatgttatttgcgctatctgcttcggcaggcgctatgaccataatcatcaggagctgctaagtcttgtaaatttgaataacaactttggagaagtcgtcgggtccggcaaccctgcggatttcatacccatcctcagatacttgcccaatcccagcctgaatgcgttcaaggatctgaacgagaagttctattccttcatgcagaagatggtcaaggaacactacaagacattcgagaaggggcacattagagatatcacggattcacttatagaacactgtcaggagaaacaactggacgaaaatgcaaacgtacagcttagtgatgaaaagattattaatattgtgcttgacctgttcggggctggattcgatacggttacgaccgccatcagttggagtctgatgtacctagtgatgaatcccagagtgcagcggaagatccaggaggagctagacaccgtaataggcaggtcccgtcggccacggctctccgatcgaagccacttaccgtatatggaggcttttattttggagacctttaggcattcatccttcgtgccattcacgataccccacaggaagttgtgggtgaacccctcggaattcctgcctgagagatttcttaccccagacggcgctatcgataaggtcttatctgaaaaggtgatcatctttgggatgggcaagcgcaagtgcattggtgaaaccatcgctcggtgggaggtgtttctcttcttagctatacttctgcaacgggtcgaattctcggtcccgttgggggtaaaggtcgatatgacccctatttatgggctcacaatgaagcacgcatgctgcgagcactttcaaatgcagctgcggtcctag

SEQ ID NO: 219827 - DNA, 1551 bp, Artificial Sequence
  Description of Artificial Sequence: Synthetic coding sequence
atggccctgagccagagcgttccattcagcgcaacggagctgctcctggcttcggctattttctgtctggtgttttgggttttgaaaggactgcggcctagagttccaaagggcctcaaaagtcctcctgagccctggggctggcctctgttaggccatgtactgacattgggcaaaaacccccacctagccttgtcccgtatgtctcagaggtacggagatgtgctgcagattagaattggctcgacgccagtgctggtgctgagccgactcgatactatcaggcaggcattggtgaggcagggcgacgattttaaaggcagaccggatctttacacgtccactttaatcaccgacgggcaatcgctcaccttcagcaccgattctggccctgtctgggctgcacgacgcagactggctcaaaacgccctgaacactttttctattgccagcgacccagcttcttcttcttcgtgctaccttgaggagcatgtctccaaggaggcgaaggctctgataagtaggttacaggagttgatggccggacccggtcatttcgacccctacaaccaggtcgtggtgtcggtggctaatgtaataggagccatgtgctttgggcagcattttccagaatcgagcgatgaaatgctatctttggtgaaaaacactcatgagttcgtggagacagcctcctcaggaaacccgctcgatttcttcccgattctgaggtacttaccaaacccggcactacagcgatttaaggcattcaatcagcgcttcctgtggtttctacagaagacagtgcaggagcattatcaagattttgataaaaactccgtcagggatataaccggcgcactcttcaaacattcaaagaaaggtcccagggcctccgggaacttgattccccaggaaaaaatcgtgaatttggtgaacgacattttcggagccggattcgatacagtgacaacggccatatcatggagtctgatgtacctcgtcactaagcctgaaattcaacgcaaaatccaaaaagagttagacaccgtgattgggagagagcgacggcctcggcttagcgatcgccctcagctgccatatctcgaggcatttatcttggagacctttcgtcacagcagtttcttaccattcacaatcccccacagcacaacccgcgacacaacactaaatggattctatatcccaaagaaatgctgtgtgttcgtgaaccagtggcaggtaaaccacgatccggagctttgggaagaccccagcgagtttcgtccagagagatttctgactgctgacggaactgcaatcaacaagcccctgagcgagaaaatgatgctcttcggaatgggcaagagacgttgtattggagaagtacttgctaaatgggagatctttctgttccttgccattctcctgcagcaactcgagttctccgtacctcccggagtcaaagtggatctgaccccaatttacggcctgactatgaagcacgctagatgtgaacatgtccaagcacgactgaggttcagcattaattag

SEQ ID NO: 219828 - DNA, 1512 bp, Artificial Sequence
  Description of Artificial Sequence: Synthetic coding sequence
atggccctgcgggcaaaagctgaagtatgcatggccgtcccatggctctctttacaacgcgcacaggccctaggcacaagagcggcacgtgtacctagaacagtactgccttttgaagccatgcccagacgacccggaaaccgatggttacggctcttacagatatggcgtgagcagggttacgaggacttacacctcgaggtgcatcaaacattccaggaacttggacccatctttaggtacgatctcggaggggctggcatggtgtgtgtcatgctgcctgaagatgtggagaaattgcagcaggtagatagcctgcacccacaccggatgtcactggagccatgggtcgcctaccgtcagcaccgcggtcataagtgtggagtgttcctcctgaacggccctgaatggcggtttaaccggctgcgtttaaatcccgaagttctgagtcctaatgccgttcagcgcttccttccgatggtggacgccgtggccagagacttctcccaggctctgaaaaagaaggtcctccagaacgctcgcggatctctgaccctggacgtgcagccgtctatcttccactacaccatagaggcttcaaacctggccttgtttggtgagaggctaggccttgtcgggcattccccttcttcagctagtttgaacttcctccacgccctcgaggtaatgttcaaatccacagtgcagctaatgttcatgccaaggagtttgagcagatggaccagtccgaaggtgtggaaggaacattttgaggcttgggattgtatcttccaatacggcgacaactgcatccagaagatctatcaggaactggcgtttagccgtcctcaacaatatacctccatcgtggcagagttgctgttgaacgctgagctttctcccgacgctattaaggccaactctatggagctgaccgctggcagcgttgacacaaccgtgttcccactgctaatgaccctgttcgaactcgctcgtaaccctaatgttcagcaggctttgagacaggaatccctagccgcagctgcttccatttcagagcaccctcagaaggccacaacagagctgccactactacgggcagctttgaaggagaccttgcgactgtaccctgtgggtctgtttttagagcgcgtcgctagttcagatctggtcctgcagaactatcacattcctgccggaacgctggttagagtatttttgtattctctcggtaggaatcccgctctctttccacggcctgagcggtacaatccccagcggtggctggatattagaggaagcggtaggaatttttaccacgtgccattcggttttgggatgcgacagtgtctcggaagacgcctggctgaggctgaaatgttgctccttttacatcatgtgttaaaacaccttcaggtggagactctgacgcaggaggacatcaaaatggtgtattctttcatactccgtccgtcgatgtttccattgttaacctttcgcgctattaattag

SEQ ID NO: 219829 - DNA, 1314 bp, Artificial Sequence
  Description of Artificial Sequence: Synthetic coding sequence
atggccctgcgcgctaaggccgaggtatgtatggcagttccctggttgagcctgcagcgagctcaggccctcgggaccagagccgcacgggtaccgaggaccgtgctgccttttgaggccatgccccgtaggccaggcaatcgatggctgcgattgttgcaaatctggcgcgagcagggttacgaagatttgcacctcgaggtgcaccagacgtttcaggaactgggtccgatttttaggtacgacctaggtggagccggtatggtttgcgtgatgctgcctgaagacgtcgagaaactccagcaggtggactccttgcacccacacaggatgagtctggagccctgggtcgcgtacaggcagcacagaggacacaaatgcggcgtgttcttgctcaatggtcccgagtggcgctttaataggctccggttgaaccctgaagtactctcgccaaacgcggtgcaacggttccttccaatggtcgacgcggtggcccgagacttctcccaggcactcaaaaaaaaggtgcttcagaacgctagggggtcactgactcttgatgtgcaaccctctatcttccactataccatcgaggcctctaacctggccttgttcggggaacgcttgggtctcgtgggccacagccccagctcggcctctttgaactttctgcacgcccttgaggtgatgtttaagagcactgtgcagctgatgtttatgcccaggagtttgtccaggtggaccagccctaaagtgtggaaggagcattttgaagcttgggactgcatcttccaatatggcgataactgtatccagaagatttaccaggagttagccttttcacgcccacaacaatacacctccatcgtcgcggaactgctgctgaacgcagagctctcgccggatgccatcaaagcaaacagcatggaactcaccgcaggatcagttgataccaccgtcttccccctcttgatgacactgtttgagttggccaggaatcccaacgtccaacaggccctgcgccaggaaagtctggccgcagctgcctctatttccgaacacccccaaaaagccacaaccgaattacctctccttagagcagccttaaaagagaccctcagattgtacccagtcggtctcttcttggagcgcgtggcttcctctgatctggtcttgcagaattatcatatccccgctggcgttctcaaacatctccaggtggagaccctgacgcaggaagatattaagatggtgtactcgtttatcctgcggccatctatgtttcctttgctgacatttagagctatcaactag

SEQ ID NO: 219830 - DNA, 1512 bp, Artificial Sequence
  Description of Artificial Sequence: Synthetic coding sequence
atggcattgcgcgcaaaggctgaagtgtgcgtagcggcaccctggctctctctgcagcgggctagggctctgggcacaagagccgctcgtgcccctagaacagtgcttcccttcgaggccatgccgcagcaccctgggaacagatggctacggctgctgcagatctggagagagcagggttatgaacacctccacttagagatgcaccagaccttccaggaactgggaccgattttcagatataatctggggggacctcgaatggtctgcgtaatgctgccagaggacgttgagaaactacaacaggtagactcgctccacccgtgcaggatgattttggagccgtgggttgcctaccgacagcaccggggtcataagtgtggcgtctttctcctcaacggcccagagtggagattcaatcggttgagattaaatcctgatgttctaagtcctaaggctgttcagaggtttctaccaatggtggacgcagtggctagggacttcagtcaggcactgaaaaaaaaggttctgcagaacgcccgaggctcactgacactcgatgttcaaccatccatcttccattacactatcgaggcctccaacctggccttgttcggggaacgcctgggcctggtcggacacagtcctagctccgcttccttgaatttcctccacgcactcgaggtcatgtttaagagcactgtgcagcttatgtttatgcctagatccctgtctcgttggattagccctaaggtctggaaggaacatttcgaggcatgggactgcatctttcaatacggagacaactgtatccaaaagatataccaggagctggccttcaatcgcccacagcattacaccggcatcgtggccgaactgcttcttaaagctgaactctctctggaagctatcaaagccaattccatggagcttaccgccggatcagtggatactactgcctttccactcctgatgaccctcttcgagctggctcgcaaccccgacgtgcagcagatattacgccaggagagcctggccgcagccgcatctatcagcgagcatcctcagaaagctactacagagttgcctctgttgagggctgccttaaaggagacgctcagactgtacccagttggcctctttctggaaagggtcgtgagctccgatctcgtactgcaaaattaccacataccagcaggcactctggtccaagtttttctctactcattgggccgtaatgccgctttgtttccgagacctgagcgctataatcctcagagatggttggatattaggggctccgggagaaattttcatcacgtcccgttcggcttcggcatgcggcaatgcttagggagaagactcgcagaagctgagatgttgttgctgctgcaccatgtgttgaagcactttctcgtagagacactcacccaagaggacatcaagatggtgtactcttttatactgcggcctggcacttcccctctgctgactttccgcgcaatcaactag

SEQ ID NO: 219831 - DNA, 1527 bp, Artificial Sequence
  Description of Artificial Sequence: Synthetic coding sequence
atgtgggaattggtagcgctgctcttgctgacgcttgcctaccttttctggccaaagcgcaggtgtcctggggctaagtatcccaaatcgctgctgagtctccccctggtgggttccctgcccttcttacctaggcacggacacatgcataacaactttttcaagttacaaaagaaatacggtcctatttacagtgtacgtatggggacgaaaacgaccgtcatcgtggggcaccaccaattagccaaagaggttctgatcaagaaaggcaaggatttctctggtaggccacagatggccactctggatattgcttcaaacaacaggaaagggatcgctttcgccgattcgggcgcacactggcagctgcacaggcgtctagcgatggccaccttcgctttattcaaagacggtgatcagaagctagagaaaatcatatgtcaggagatttcgacactgtgcgatatgttggcgactcacaacggacaaagcattgacatttctttccctgtcttcgttgctgtcaccaacgtcatctcactgatatgttttaatacaagctataagaacggagaccctgaactgaatgtgattcagaattataacgaggggatcatagataatctgtccaaagacagtttggtcgatctggtgccctggctgaagatatttcctaacaaaactctcgaaaagttaaaaagtcacgtgaaaatccgtaacgatcttttaaacaagatccttgagaactataaggaaaaatttagaagcgacagcattaccaacatgttggacacacttatgcaagctaagatgaatagtgacaacgggaacgccggtccggaccaggattccgagctcctgtctgacaatcacattctcacaactatcggggatatctttggcgctggggtggaaaccaccacctctgttgtgaagtggacactcgccttcttgctccataatccgcaggtgaagaaaaaactttatgaggagattgaccagaatgttggttttagcaggacaccaaccatttcagatagaaataggctcctattactggaagccactattagggaggtgctcagactgcggcctgtggccccaatgctcattcctcataaagcaaacgtggacagctcgatcggggagttcgcagtggacaagggaactgaggtcatcattaacctgtgggcgctgcaccacaacgagaaggagtggcatcagccagatcagtttatgcccgaacgattcctcaatcctgccggaacacaactcatatctccatccgtgtcatatctccccttcggcgcaggaccgcgatcctgtataggtgaaatcctggccagacaggaactgttcctcattatggcatggttgctgcagaggttcgatttagaggtaccggacgatggccagctcccttctttggaaggaatccccaaagtcgtgtttctcatcgactcctttaaagtgaagatcaaagtgcgccaggcttggagggaggcccaagcagaagggtctacctag

SEQ ID NO: 219832 - DNA, 1512 bp, Artificial Sequence
  Description of Artificial Sequence: Synthetic coding sequence
atggtgctcgagatgctcaaccccatccactacaacattaccagtatcgtacccgaagcaatgcctgccgctaccatgccggttctgcttttgaccgggctttttcttctggtctggaattacgaaggaacctcctctatacccggaccgggttactgcatgggtataggtcctcttatttctcatggtaggttcctgtggatgggtattggatccgcctgcaactattacaacagagtgtatggtgaattcatgagggtgtggataagtggcgaagagaccctgatcatctccaaatcaagttcaatgttccatatcatgaagcacaatcattacagtagtcgatttggcagcaaactcggtctgcaatgcataggtatgcatgaaaagggtatcatcttcaataacaatccagaattatggaagacaacccggccattctttatgaaggctctctccggtcctggactggtgcgcatggtcacagtctgcgctgagagcctgaaaactcacctggatcgcctggaagaggttactaacgaaagtgggtacgtggacgtgctgaccctcctgcggagggttatgctggatacgagcaacacactctttttaaggatcccactggacgagtccgccatcgtcgtgaaaatccagggctactttgacgcatggcaggccctgcttataaaacctgacattttttttaagatcagctggttgtataagaaatacgaaaagtcagtgaaggacttgaaagacgccattgaggtgctcatcgccgagaaacgaagaaggatttcaactgaagaaaagctagaagagtgcatggacttcgccacagaacttattctcgccgagaagagaggggatcttaccagggagaacgtcaatcaatgcattctggagatgctgatcgctgccccagacactatgagcgtctccctgtttttcatgctgtttctcatcgctaaacaccctaatgtggaagaggccataatcaaagagattcaaaccgtgatcggcgagcgggacataaagatcgacgacatccaaaaactgaaagtcatggaaaatttcatctatgagtctatgcgctatcagcccgtggtcgacctcgtgatgcgaaaggctctcgaggacgacgttattgacggctacccagtgaagaaagggacaaatatcatattaaatattggtaggatgcatcggctagagttctttccaaagccaaacgaattcacactggaaaacttcgccaagaatgtcccctaccgctatttccagcccttcgggttcgggcctcggggttgcgcagggaagtatattgcaatggtgatgatgaaggccatcttggttacactcctgcggaggtttcatgtgaagactctgcaaggccagtgcgtggagtctatccagaaaattcacgacctatccctacaccccgacgaaacaaagaatatgctcgagatgatcttcactcccagaaattctgacaggtgtctagagcactag

SEQ ID NO: 219833 - DNA, 1512 bp, Artificial Sequence
  Description of Artificial Sequence: Synthetic coding sequence
atggttcttgaaatgctcaaccctatccattacaatatcacaagcatagtgcccgaagccatgccagctgccacaatgccagtgctactactcaccggtctgttccttctggtttggaattacgaaggtacgtcctcaattcccggtcccggatactgtatggggatcgggcctctcatctctcacggtcgcttcctgtggatgggcataggcagcgcctgcaattactataacagagtctacggagagtttatgagagtgtggataagcggggaagagaccttgattatcagtaaatcatccagcatgtttcatataatgaaacataaccactattcaagccggttcgggagtaagctcggtctgcagtgtattgggatgcacgagaagggcattatattcaacaataatccggaactttggaagacaacgcgacctttcttcatgaaggccctgagcggtccaggactggtccgcatggtcacggtgtgtgccgagtccctgaaaacacatttggatcgcctcgaggaagtgacgaatgaaagcgggtacgtggatgtactgaccctccttagacgtgtgatgcttgatactagcaatacactgttcctgcggattcctctggacgagagcgctatcgtggtcaaaatccagggatacttcgacgcttggcaggcgctcctgattaagcctgacatctttttcaagatttcttggttgtacaagaagtatgagaagtcagtgaaggatctcaaagatgctatcgaagtccttattgccgaaaagcgcaggaggattagtactgaagagaagctggaggaatgcatggacttcgccacagagcttatactcgctgaaaaaaggggagatctgaccagggaaaatgtgaaccagtgtatccttgaaatgctcatcgccgcaccagataccatgagcgtgagcttattctttatgctgttcctgatagcaaagcatccgaatgtcgaggaggcgattatcaaggaaatccaaaccgtcatcggagaaagagacatcaagattgatgacattcagaagctgaaggtcatggagaacttcatctatgaatcgatgcggtaccaacccgtcgtcgatctagtgatgcggaaggcacttgaggatgatgtaatcgacggttacccagtgaaaaaaggtacaaacattatactaaatatcgggcgaatgcacaggttggagttctttcctaagcccaatgaattcacacttgaaaactttgcgaagaacgtaccttaccggtactttcagccctttgggtttgggcctcgcggatgcgcaggcaagtacattgcaatggtgatgatgaaggctattctggtcaccctgctgcgaagattccatgtgaagactctgcaggggcaatgtgttgaatctatccagaagatccatgacctgagcctgcaccccgatgaaacgaaaaatatgttggagatgattttcacacctcgtaacagcgacaggtgtctcgaacattag

SEQ ID NO: 219834 - DNA, 1512 bp, Artificial Sequence
  Description of Artificial Sequence: Synthetic coding sequence
atggtcctggaaatgctaaaccccatccattataacatcacaagtatagtgccagaggctatgccggctgctacaatgccagtgctcttgctgacgggtctgttcctgttggtttggaactatgagggcacctctagcattcctgggccaggttactgcatggggattggacctttgatctcccacggacgtttcctgtggatgggaattgggtctgcctgcaactactataacagagtgtatggcgaattcatgcgggtgtggatctccggtgaggagaccttaatcatctccaagtcatcgagcatgttccacattatgaagcacaaccactactcctcacggtttggctcaaaactgggcctgcaatgcatcggtatgcatgagaaaggcatcattttcaacaacaaccctgagctgtggaaaacgacacgccctttctttatgaaggccctgagtgggccaggtttggtgcgtatggtgacagtgtgtgcggagtccctgaaaacgcacttagaccgtctggaagaggtgaccaatgagagcggctatgttgacgtcctcacattgctccggcgagtaatgctggatacgtccaatacactgtttctccggatacctttggatgaaagcgcgattgtagtaaagattcaggggtatttcgatgcctggcaagcacttctcattaagcctgatatctttttcaaaataagctggctctataaaaagtatgagaaaagcgtgaaagacctcaaggatgccattgaggtactgattgcagagaaacgcagaagaatttccaccgaggaaaaactagaggagtgcatggacttcgcaaccgagttaatcttggccgagaagcgcggagatttgacgagagaaaatgtaaaccagtgtatccttgagatgctgatcgcagccccagatactatgagtgtgtcactatttttcatgttatttctgatagcgaaacatccaaatgtggaggaagccataattaaggagattcaaaccgtgatcggcgaacgcgacatcaaaatagacgacatccagaagcttaaggtaatggagaactttatatatgagtccatgcggtatcagcctgtggttgacctggtgatgcgtaaggctctcgaggacgacgttatcgatggatacccagtcaagaaaggaaccaacatcattctgaatatcgggagaatgcacaggctcgagttcttcccaaaaccaaacgaatttactctagagaattttgcaaaaaacgtgccatataggtattttcaaccattcggattcggcccacgtggatgtgccggaaaatacattgctatggttatgatgaaagctatcctcgtcacactacttcggcgtttccacgtcaaaactcttcagggccagtgtgtggagtctattcagaaaattcacgatttgagtctccaccctgatgagacaaaaaacatgctggagatgatttttacgcctcgaaattctgatcgctgtctcgaacactag

SEQ ID NO: 219835 - DNA, 501 bp, Artificial Sequence
  Description of Artificial Sequence: Synthetic coding sequence
atggttcttgaaatgctcaaccctattcattataatattaccagtatcgttcctgaagccatgccggcagctactatgcctgttctcttgttgactgggctcttcctcctagtatggaactatgagggcacaagttccataccaggtccaggatactgtatggggattgggcctttaatatcccacggaaggttcctgtggatgggcattgggagtgcttgcaattactataaccgggtgtacggagagttcatgagggtgtggatttcaggcgaggaaaccctaataatctctaagtccagctccatgttccatataatgaagcataaccattattcttccagattcggttcaaagctcggcttgcaatgcatcggtatgcatgaaaaaggcatcattttcaataacaatcccgagctgtggaagactacccgccctttctttatgaaggccttgagtgggcctggcctggtgcggatggttactgtctgtgctgagtag

SEQ ID NO: 219836 - DNA, 657 bp, Artificial Sequence
  Description of Artificial Sequence: Synthetic coding sequence
atggtcctggaaatgctgaatccaattcattacaacattacaagtatagtaccggaggcaatgcccgcagctaccatgccagtccttctgcttactggcctgtttctgctagtgtggaactatgaaggtacatcaagcatcccgggaccaggctactgtatgggcattggacctctcatcagtcacggccgatttctttggatgggtattggctcggcatgtaactactataatagagtgtacggcgaattcatgagggtctggatcagcggcgaggaaacactgatcatcagcaaaagctccagtatgtttcatatcatgaagcataaccattatagctcacgattcggctcaaagcttggactgcaatgtatcgggatgcatgaaaaaggcataatcttcaacaataaccccgagctgtggaagacaactcggccattttttatgaaggccctgtcaggtccaggcctggttcggatggttactgtctgtgcggagtcacttaagacacatttggatcgcttggaagaggtcaccaacgagtctggttatgtcgatgttttaaccctgcttagacgagtgatgctcgatacatctaataccctttttctgcgcataccgttagacggcactgagatcttcaccctcacatcttag

SEQ ID NO: 219837 - DNA, 1080 bp, Artificial Sequence
  Description of Artificial Sequence: Synthetic coding sequence
atggtactagagatgctgaatcctatccactataatattacttcaatcgtccccgaagctatgccggcagcaacaatgccagttttgctcctcaccggactcttcctgttagtgtggaactacgaagggacaagttccatcccaggccctgggtactgtatggggattggtcctctgattagtcatggtaggtttctgtggatggggattgggtctgcatgtaactactataacagagtgtacggtgagttcatgcgggtctggatttctggtgaagaaacattgatcatcagtaagtcttcctcaatgttccacatcatgaagcataaccactatagtagccgatttgggagtaagctcgggctgcaatgcatcgggatgcacgaaaagggtattattttcaataataaccctgagttatggaaaactacacggccattttttatgaaagctttaagcggtcctgggctggtgcgcatggtgactgtgtgcgccgagagtctcaagactcacttggacagacttgaggaggttacgaatgaatccggatatgtcgatgtcctcactctgctcaggcgcgttatgctggatacgtcaaatacgctctttctgagaattccgctagacgagtccgcgatcgttgtgaaaatacagggctactttgacgcctggcaagcccttctaatcaagccagatatattcttcaaaatctcctggctgtataagaaatatgagaagagcgtgaaagatctgaaggacgcgattgaggttctgattgccgaaaagcgtagacgcatttccacagaggaaaagctggaagagtgcatggatttcgcaaccgagctgatccttgctgagaaacgaggagaccttacccgggaaaacgtgaaccaatgcatcctggaaatgttaatagccgcaccagacactatgtctgtctctttattctttatgctcttcctgatcgctaagcatcctaacgttgaggaagctatcatcaaagagattcaaaccgtgattggggagagagacataaagatcgatgatattcagaagctgaaaaagcacgacgcaaaatag

SEQ ID NO: 219838 - DNA, 1059 bp, Artificial Sequence
  Description of Artificial Sequence: Synthetic coding sequence
atggttctcgaaatgctcaatccaatccattataacatcacaagcatcgtgcctgaggcgatgcccgctgccaccatgcccgtgcttttactgacgggactttttttgctggtgtggaactatgagggaacctcaagtatacctggaccaggttattgtatggggattggtcccctcatcagccacggtagattcctgtggatggggattgggtccgcatgcaactactataacagggtgtatggcgagtttatgagggtgtggatctctggagaggagactttaatcatttcgaaatccagttccatgtttcatatcatgaagcataatcattatagttccagattcggttccaaactggggttgcagtgcataggcatgcatgagaagggcattatttttaataacaatccagaactgtggaagaccactcgaccctttttcatgaaagcactgtccgggcctgggctcgtccggatggtgacagtttgtgctgaatcccttaagacacatttagaccgattagaggaggtcacaaacgagtccggatacgtagatgtgcttaccctcttgcgcagagtgatgctagacactagtaatacacttttcctcaggattccgctcgacgaaagtgctattgtcgttaagatccaggggtacttcgatgcctggcaggccctgctgatcaaaccagatatttttttcaagatctcttggctctataaaaagtacgagaaaagcgtgaaggatctgaaagacgctatcgaggtgctcatcgccgaaaagaggagacggatcagcacagaagaaaaactggaggagtgtatggatttcgcgaccgagctgattttagcggaaaaacgcggtgacctgactagagaaaacgtgaaccagtgtattcttgagatgcttatcgccgcacccgacaccatgagtgtatccctgtttttcatgctattcttaattgccaaacatcctaacgtcgaggaggcaatcatcaaggagatccagacagtgataggagaacgggatatcaagattgatgacatacagaagtag

SEQ ID NO: 219839 - DNA, 729 bp, Artificial Sequence
  Description of Artificial Sequence: Synthetic coding sequence
atggtgctggagatgctgaaccccatacactataatatcacctcgattgtgcctgaggccatgcccgctgccaccatgcctgtgctgctgcttactgggctgtttctgctggtctggaattacgaaggcacctccagcattccaggccctggctactgtatgggcattggccctcttatttcacacggccgattcctgtggatgggtatcggctcagcctgtaattactataacagggtctacggggagttcatgcgggtatggatcagcggggaagagaccttaattatcagtaagagtagctccatgtttcacatcatgaagcacaatcactacagctcccgcttcggcagtaaactcggccttcagtgtatcggaatgcatgaaaaaggtattatctttaacaataatccagagctctggaaaacgaccaggccattctttatgaaggcacttagcgggccaggccttgttcgtatggtcacagtgtgtgccgagtctctcaagacgcatctcgatagactggaagaagtaaccaatgagtctggctacgtggacgtattgacactgctgcgaagagttatgcttgatacctcaaacacactgtttttacgcataccactggacgagtccgccatcgtggtaaagatccagggatacttcgacgcctggcaagccctgttgattaaaccagacatatttttcaagatttcgtggctttacaagtag

SEQ ID NO: 219840 - DNA, 546 bp, Artificial Sequence
  Description of Artificial Sequence: Synthetic coding sequence
atggtgctcgaaatgttaaatccaatacactataacatcacatcaatcgtcccggaagccatgcctgctgcaactatgccggtccttctgctgactggcctcttcctactggtgtggaattacgaaggcacctcttcaatccccggaccgggatactgtatgggtatagggccactgattagtcatggaaggttcttgtggatgggaataggctcggcgtgcaactactataaccgggtgtatggcgaatttatgcgcgtatggatcagtggggaggaaacactgattatctcaaagtcaagcagtatgttccacattatgaaacataaccactacagtagtagattcggatccaaattggggctgcagtgtattggaatgcatgagaagggcatcatttttaacaataaccctgagctttggaaaacaacacgcccatttttcatgaaagctctgtcggggcctggactggtccgaatggtgacagtatgtgccgagagccttaagacgcacctactcctatttacaccagcaagcgttaactag

SEQ ID NO: 219841 - DNA, 657 bp, Artificial Sequence
  Description of Artificial Sequence: Synthetic coding sequence
atggtcttggaaatgctcaaccctatccattacaatataaccagtatagttccagaggccatgcccgcagcaacaatgcctgtgctactgctcacaggcctgttcctgcttgtttggaactacgagggcaccagtagtatccccggtcccggttattgtatggggataggcccactaatatctcacgggaggttcctgtggatggggatcgggtcagcatgcaactactataatcgggtgtatggggaatttatgcgggtgtggatttccggagaagaaactctgataatctcaaagagtagttccatgttccacattatgaagcataatcattactccagcaggttcggatcaaagctgggactgcagtgcattggaatgcatgagaaaggtattatcttcaacaacaaccccgaactgtggaagacgacgcgaccattctttatgaaagccctgtctggcccaggcctcgtccgcatggtcaccgtgtgtgctgaatcgctgaaaactcatttggaccggctggaagaggtgaccaatgagagcgggtatgtcgatgtactgaccctcctgcgacgagtcatgctggatactagcaatacgctgtttttacgtataccgttggatgggaccgagatttttactcttacgagctag

SEQ ID NO: 219842 - DNA, 1059 bp, Artificial Sequence
  Description of Artificial Sequence: Synthetic coding sequence
atggtcctcgagatgctaaacccaattcactataatattacaagcattgttccggaggcaatgcctgccgctactatgccagtccttttgctaactggcctgttcctcctcgtctggaattatgaggggactagctccatccccggtcctggctattgcatgggcattggacccctgatttcccatggtcggtttttgtggatgggaatcggcagcgcctgcaattattataatagggtgtacggcgagttcatgcgggtgtggattagtggtgaggagacactaatcatcagtaaatccagctctatgttccatatcatgaaacacaaccactattcaagcagatttggctctaagctggggctgcagtgtattggaatgcatgagaagggcatcatcttcaataacaatcccgagctgtggaaaaccacgagaccattcttcatgaaagcactttccgggcctggattagtgcgaatggtgaccgtgtgcgcggaaagcctaaagacccatctggatcggctagaagaggttacaaatgaatccgggtatgtggacgtcctgactctcctcaggcgagtaatgcttgatacatctaacactctgttcctccgaattcccttagatgaatctgccatcgttgttaaaatccagggatacttcgatgcttggcaagccttgctaataaagccagatatattttttaaaatctcctggctttataaaaagtacgaaaagtccgtgaaggatctgaaggatgctattgaagtgttgatagctgagaagaggcgcaggatcagtacagaagagaaactggaagagtgtatggacttcgctacggaactgatactcgcggaaaagcgaggcgacctaacacgcgagaacgtcaatcagtgcatcttagaaatgctgatcgctgcccctgacacaatgtccgtctcgctgtttttcatgttatttcttatcgcgaaacacccgaatgtggaagaggctatcatcaaggagatccagaccgtgattggcgaacgcgatataaagatagacgacattcagaaatag

SEQ ID NO: 219843 - DNA, 852 bp, Artificial Sequence
  Description of Artificial Sequence: Synthetic coding sequence
atggtgttagaaatgctcaacccgatacactataacataacatctatcgtgcctgaggcaatgcccgcagcaactatgcccgtgctgctcttaaccgggttgtttctcttggtctggaactacgaggggacctcaagcatccccggtccgggatactgcatgggcataggacccctgatcagtcacgggcgtttcctatggatgggaatcgggtccgcctgcaattattacaatcgagtatacggtgagttcatgcgtgtgtggatctctggcgaggagactttgataatttccaaatcatcatcgatgtttcacattatgaaacacaatcattacagctcacgcttcggaagtaagcttggcctccagtgcatcggtatgcacgagaagggtatcatctttaataacaaccccgaactctggaagacgacacgcccattcttcatgaaagctctctctggtccgggtctagtgagaatggtgaccgtatgcgcagagagtctgaagactcatctggaccgacttgaggaggtcacaaatgagtccgggtacgtggacgtgctgactcttctcagaagagtgatgctcgacacatcaaatacgttattcctgaggattccactggacgagtcggctatcgtagtgaaaatccaggggtatttcgatgcctggcaggctctgcttatcaaaccggacatcttctttaagattagctggctttacaagaagtacgagaagtccgtaaaggatctgaaggatgccattgaggtcctgatcgctgagaaaaggcgccgtatctccacggaggaaaagctcgaggagtgtatggatttcgcaacagagctgatttag

SEQ ID NO: 219844 - DNA, 498 bp, Artificial Sequence
  Description of Artificial Sequence: Synthetic coding sequence
atggtgctcgaaatgcttaatcccatccattacaatatcacctcaatcgtgccagaagcaatgccagcagcgaccatgccagttcttttgctgactggactgttcctgttagtatggaattacgagggaacaagctcaatacccggtccagggtactgtatgggcatcggacccctgatttctcacggccgatttctttggatggggattgggagtgcatgcaactactataaccgggtgtatggggaattcatgcgcgtgtggatctcgggggaggagacattgatcattagtaagagcagttccatgtttcatatcatgaaacataaccactacagcagtagattcggctccaagctggggttacaatgcataggaatgcatgagaagggcatcatcttcaacaacaaccctgaactgtggaagacgactaggcccttcttcatgaaggctctctctggtcccggactggtcagaatggtcactgtgtgtgcctag

SEQ ID NO: 219845 - DNA, 1512 bp, Artificial Sequence
  Description of Artificial Sequence: Synthetic coding sequence
atggtgttagaaatgctcaatccaatccattacaacattaccagcatcgttcctgaagctatgcccgcagccacaatgcctgttctgctcctgactggcttgtttcttctcgtctggaattatgagggcacttcttcaatcccaggccctggatactgcatggggatcgggccactgattagccacgggcgattcctttggatgggcatcggcagcgcgtgtaattattataatcgcgtctatggggagttcatgcgcgtctggatctccggagaagagaccctcattatctccaaatcctccagcatgtttcacatcatgaaacacaaccattactccagccgattcggctcaaaactgggactgcaatgtattggtatgcacgagaaagggatcattttcaataataatccagagttgtggaagaccaccaggcctttttttatgaaggctctgtctggtcccggactcgttagaatggtcaccgtatgcgccgaatcactcaagacccatctggaccgcctggaggaggtcacaaacgaatccggctacgtagacgtgctcaccctcctccgtcgtgtgatgttagatacgagtaataccctcttcctacgcatcccccttgacgaatctgcgatcgtggttaaaatccagggttactttgacgcctggcaagccctgctcattaaaccagacatcttttttaagatttcttggctttacaaaaagtacgagaaatctgttaaggatctgaaggacgccattgaggtgttgattgccgagaagaggcggaggatctctacagaggagaaactggaggaatgcatggacttcgctacagagcttatcctcgcggagaagagaggggacctgactcgtgagaacgtgaatcaatgtatcctagaaatgttgatcgccgcacctgataccatgtctgtgtcactttttttcatgctgtttctgattgccaaacaccctaacgtggaggaggccatcatcaaagagattcagacggtgattggggagcgagacatcaagatcgacgacatccagaaattgaaggtgatggagaatttcatctacgagagcatgcgctatcaacctgtggtcgacctcgtgatgcggaaggcacttgaggacgacgtgattgatggttatccggtgaaaaagggtactaatattatcctgaatattggccgtatgcaccggctggaatttttccccaagccaaacgagttcactctcgaaaactttgctaaaaacgtgccctaccggtattttcagcccttcggatttggaccaaggggctgtgccggaaagtatatagctatggtgatgatgaaagccatcctggtgaccctgctccgaagatttcatgtcaagacactgcagggccagtgcgtggaatccatccagaaaatccatgatctgagcttacaccccgacgagaccaaaaacatgcttgaaatgatattcacccccaggaatagcgaccgatgtttagaacattag

SEQ ID NO: 219846 - DNA, 519 bp, Artificial Sequence
  Description of Artificial Sequence: Synthetic coding sequence
atggtcctcgagatgctgaaccccatccactacaatatcactagcattgtgccagaggctatgccagcagctaccatgcctgttctgctgttaaccggactgttcctgctggtttggaactacgaggggacgagcagtatccctgggcctggctattgtatgggcatagggcctctgattagccacggcagattcctctggatgggaattggatcggcatgcaattactacaacagggtgtatggcgaatttatgagagtgtggattagcggtgaagagaccctcatcatttcgaagagctcatccatgttccacatcatgaagcacaatcactactcatcacggttcggtagcaagttagggctgcagtgcatcggaatgcacgagaaaggaattattttcaacaataaccccgaactttggaagacaaccagaccttttttcatgaaagctttgagcggacctggcttagttaggatggtgaccgtgtgtgctgaaagcctgaagacccacttgtag

SEQ ID NO: 219847 - DNA, 735 bp, Artificial Sequence
  Description of Artificial Sequence: Synthetic coding sequence
atggtacttgaaatgctgaatccaatccactacaatatcacgtccatcgtgccggaagccatgccagctgctactatgccggtgcttcttctcacgggactattcctcttagtttggaactacgaaggcacttcctcaatccctggtcctgggtattgcatgggtattgggcctctcatttcgcatgggagattcctgtggatgggcattggtagcgcttgcaattactacaaccgggtgtatggcgagtttatgcgcgtatggatttcgggagaagagacactgatcatctctaagtccagctcaatgttccacatcatgaagcataaccactactcctccagatttggttctaaactgggcctgcaatgcatcggaatgcacgagaagggaattatctttaacaataatcctgaactctggaaaacaacacgcccttttttcatgaaagagtccgcaatcgtggtcaagattcagggctattttgatgcctggcaggcactcctaattaaacctgacatcttttttaagatcagttggctgtacaagaagtatgagaaatctgtgaaggaccttaaagacgcgatagaggtcttgatcgcagagaagcgcaggcgcatctccaccgaagaaaaacttgaggagtgtatggatttcgccactgaacttatcctggcagagaagcgtggagacttgacacgtgaaaatgtcaaccagtgcatcctggagatgtag

SEQ ID NO: 219848 - DNA, 1485 bp, Artificial Sequence
  Description of Artificial Sequence: Synthetic coding sequence
atgctcgcctcaggcctcctcctggtgacgttactcgcctgtctcactgtgatggtgctcatgtccgtctggcggcagcggaaatcccgcggaaaacttcccccaggacccacccctcttccctttatcggtaactatctacagcttaacactgagcaaatgtataatagcctgatgaaaattagcgagcggtatggtcctgtgtttaccattcacttgggccctcggagggtcgtggtcctatgtggccacgatgccgtaaaggaggcactggtggatcaggctgaggaattttccggtaggggggagcaggcaactttcgactggctgtttaaaggttatggggtggctttcagtaacggcgagagagcaaagcaacttcgaagattctcaattgctaccttgagggggttcggagtcggcaaaaggggcattgaagagcggattcaagaggaggcaggtttcttaatcgacgcactgagagggacccacggtgctaacatagaccccactttctttctctctaggactgtttcaaatgtgataagcagcatcgtgtttggtgaccgctttgactatgaggataaggaattcttgtcacttctgcggatgatgctcggctcgttccagtttacagctacgtcaacaggtcagctctatgagatgttcagcagtgtcatgaagcatctcccaggccctcagcagcaagcctttaaagagctgcagggtctggaagacttcattgcaaaaaaagtggagcataatcagcgaactcttgaccctaactcccccagggattttatagatagctttttgattagaatgcaggaggaagagaaaaatcccaatacagagttttaccttaagaacttagtgatgaccacgctaaacctgttcttcgctggaacggagaccgtctcaaccaccctacggtatgggttcctgcttctaatgaagcacccagaggttgaggcaaaagtgcatgaggagattgaccgcgtgatcggcaagaacagacaaccgaaatttgaggatagagccaagatgccatacactgaagccgtaattcatgaaattcaacggtttggagatatgctgcctatgggactcgcccaccgggtgaacaaggatacaaaatttcgagacttcttcctgcccaaaggtactgaggtgttcccgatgttaggctccgtgctgcgggaccctagatttttctcaaatccaagagattttaatccccagcattttctcgataagaaagggcagttcaagaaaagcgatgctttcgtcccattctccataggcaagcggtattgttttggagagggcctggctcggatggaactgtttctcttttttacgactatcatgcagaacttccgctttaagagtcctcagtctcctaaagacattgacgtctctcccaagcacgtggggttcgcgacgatacccaggaactatactatgtcattcctgccccgttag

SEQ ID NO: 219849 - DNA, 1485 bp, Artificial Sequence
  Description of Artificial Sequence: Synthetic coding sequence
atgctggcttctggcatgctgctggttgcattactcgtgtgtctgacagtgatggtgctaatgtctgtctggcagcagcgaaagtcaaagggcaagttaccgccaggacctaccccactaccttttatcggaaactatctgcagctcaacactgaacagatgtacaacagcctgatgaagattagcgaacgctacggcccagtctttactatccaccttggcccaaggagagtggtggtgctgtgcggacacgacgctgttcgtgaagccctggtggaccaagctgaggaattctccggacgtggcgagcaggccaccttcgattgggtgttcaaggggtacggagtggtctttagcaatggcgaacgggctaagcaactacgtcgcttttctattgcaaccttgagagatttcggggtgggaaaacgcggtatcgaggaacggatccaggaggaagcaggttttctcatcgacgccctgagggggacaggcggtgcaaacattgatccaaccttctttctgtcacgaaccgtgagcaacgtcattagcagtatcgtgttcggtgaccggtttgactacaaggacaaagagttcctttcacttcttaggatgatgttagggatttttcaatttacatccacctcaaccggccagttatacgaaatgttctcttcggtgatgaaacatctgccaggaccacagcaacaggcatttcagctccttcaaggcctcgaagacttcatcgccaagaaagttgagcacaatcagagaacccttgacccaaatagcccgcgtgattttatcgactcattcttgatcaggatgcaggaggaagagaagaacccgaacactgagttctacctgaagaatctggtcatgactactctcaacttgtttatcgggggtacggaaaccgtttccactactctgagatacgggttcttgcttctgatgaagcatcctgaagtggaggccaaggtccacgaggaaatagatagggtaataggcaagaaccgccagcctaagttcgaagaccgggctaaaatgccatacatggaggcagtgattcatgagatccaaaggtttggcgatgtgatacctatgagtctagccagacgcgtgaaaaaagacaccaagttcagggatttcttcctgccaaagggaactgaagtgtttcctatgctgggaagcgtgctgagagatccatcttttttctccaacccacaagacttcaatccacagcacttcctgaacgagaaaggccagttcaaaaaatcagatgcctttgtcccattctctatcggcaagcgtaattgtttcggggaagggctagcgaggatggagttgtttctgttctttactaccgtgatgcagaattttagactcaaaagttcacagagtccaaaagacattgatgtgagtccaaaacacgttgggttcgccacgatccccagaaattacactatgtcattcctccccagatag

SEQ ID NO: 219850 - DNA, 1332 bp, Artificial Sequence
  Description of Artificial Sequence: Synthetic coding sequence
atgctcgcatccggcctgcttctggtggccttacttgcctgtcttacagttatggtgctaatgtcagtttggcaacagcgcaagtcccggggaaagctgcctcccggtcccacccctctcccctttattgggaactatcttcagttaaatacagagcacatctgtgactcaatcatgaaggtcagtcagggcgtggcattctccaatggagaacgggctaagcagcttctgcgatttgcaattgcaacactgagagatttcggggtgggcaagagaggtatagaggaaaggatccaggaggaaagtgggttccttatcgaagcgatccgctccacacacggagcgaatatcgatccaactttctttctgtcacgaaccgtcagcaatgtaatctcctctattgtgtttggagacagattcgactatgaagataaggagttccttagtctgctgtccatgatgctgggcatatttcagttcacatcaacatctactgggcaactctatgagatgttttcctccgtgatgaaacacctgccaggccctcagcaacaggcattcaaactccttcagggcctggaagattttatcgcgaagaaagtcgagcataaccaacggacactcgaccccaatagtccccaagactttatcgactcgttcctgatccacatgcaggaggaggagaaaaatcccaataccgaattttacctcaaaaacctcatgatgtctacgctgaatttatttatcgccggtacagaaaccgtaagcacaaccctgcggtacggctttctcttgctgatgaagcatccggaggtggaagcaaaggtccacgaagagatcgacagagtaattgggaagaatcgccagccaaagttcgaggatagaaccaagatgccctacatggaagctgtgattcatgaaattcaacgcttcggcgacgtgattcctatgtcactggctcggagagtcaagaaggacactaaatttagagatttcttcctgcccaagggaaccgaagtattccctatgctgggtagcgtcctaagagatccgagttttttctcaaacccacaggatttcaatccgcagcacttccttgacgataaaggacagtttaagaaatctgatgctttcgttccattttccatcggaaagcggaactgctttggtgaaggcttggctagaatggaactctttctgtttttcacaaccgtgatgcagaattttcgcctgaagagctcccagtcccccaaagacatcgatgtatcacctaagcacgtggtctttgccaccattcccaggaactacactatgagctttctgcccagatag

SEQ ID NO: 219851 - DNA, 1485 bp, Artificial Sequence
  Description of Artificial Sequence: Synthetic coding sequence
atgctggcctctggtctcctgttggtcgccctgctggcttgtttgacggtgatggtgctgatgtctgtgtggcagcaacggaagtcgcgcggtaagcttccacccggacccacacccctgcctttcatcggtaattacttacagctgaataccgagcacatctgcgactcaattatgaagtttagtgaatgttacggaccagtcttcaccatccatctgggaccgcgtcgcgtagtcgtgttgtgcggccacgacgccgttcgcgaggccctagtcgatcaagccgaagaattttccgggaggggtgaacaggcaacgttcgattgggtgtttaaaggatacggggtggcattcagcaatggggagagggctaaacaactcctgcgcttcgcaattgcaacccttcgggacttcggcgtcggtaaacggggaatcgaagaacgcattcaggaggaatcaggattcctcatagaggctattaggagtacccatggtgccaacatcgacccgacttttttcctttctcgcacagtgagcaacgtgatctcctctattgttttcggggacaggttcgattacgaggacaaggagtttctgagtttactgtcaatgatgttgggtattttccagttcacgagtacttctaccggccagctttatgaaatgttttcatccgtcatgaagcacttgccgggaccacaacagcaggcattcaagctgcttcaggggctggaagattttatcgccaagaaagtcgaacacaatcagagaactctagaccctaacagccctcaggacttcatagattcctttttaattcatatgcaggaggaggagaaaaaccctaacaccgaattctatctcaagaatctcatgatgtccacacttaatctcttcatagctggaaccgaaaccgtgtccaccacacttaggtacggctttctgctacttatgaaacatccagaggttgaggcaaaggtgcatgaagaaattgatcgggtgatcgggaaaaatcgacagccgaaattcgaggatcgcacaaagatgccctatatggaggccgtgatacacgaaattcagcgatttggcgacgtcattcctatgtcccttgcacgacgggtcaaaaaggacacaaagtttagagatttttttctgcccaagggaaccgaagtgtttcctatgctaggttctgtcctgagggacccatcattcttctccaaccctcaggatttcaacccgcagcacttccttgacgataaagggcagtttaaaaaaagcgacgctttcgtgccctttagtatcggcaagcgtaactgtttcggtgaggggctggccagaatggaactgtttctgttttttactacagtaatgcagaatttcaggctgaagtccagtcagtcacccaaagacatcgatgtgagtcccaagcacgtggtcttcgccacgatccctcggaactatacaatgtcctttctacctcgctag

SEQ ID NO: 219852 - DNA, 1476 bp, Artificial Sequence
  Description of Artificial Sequence: Synthetic coding sequence
atggagctcagtgttctgctatttctggccctgctgacagggcttctgctgttgttggtacaacgtcacccaaatacacacgatcgactgcctcccggtccccgtcctctgcccttactgggcaatttgttgcagatggatagacggggtctccttaagtccttcctgcgctttcgcgagaagtacggggatgtgttcacagtgcacctgggccctagaccggtggttatgttatgtggtgtggaggcaatccgcgaggccctcgtggacaaagctgaggccttctccggtcggggaaagatcgctatggtggatccgttttttcgaggctacggtgtgatctttgcaaatgggaaccgatggaaggtgcttcgcagattttccgttacaacgatgcgcgactttggcatgggcaagagatccgtggaggagaggattcaggaggaagcacagtgtctgatcgaagaattgaggaagagtaaaggagcattgatggaccctactttcttattccagagcattaccgctaatattatctgcagtatcgtgttcggcaaacggttccactatcaggatcaagagttcttaaaaatgctgaatttattctaccagacattcagtctgataagcagcgtgttcggtcagctgtttgagctcttctcagggttcctaaagtattttcctggtgcacataggcaggtatacaaaaatctgcaggagatcaacgcatacatcgggcatagtgttgagaaacacagagagacactagacccgtccgccccaaaggaccttatcgacacctatttactacacatggaaaaggagaagtctaatgcccattccgaatttagccaccagaacctcaatcttaacacactttccctatttttcgcaggcacagaaacaacctcaactacactgaggtatggattcctcctgatgttgaagtatccacacgtggcagagagggtctaccgggagattgaacaggtcataggtccacacaggccgcctgagctccacgaccgcgctaaaatgccatacaccgaagccgtcatctacgagatacagagattttctgacctgctgccgatgggcgtgcctcacattgtcacacagcataccagcttccggggatatataattcctaaggataccgaggtctttctgattctgagcaccgctcttcatgatccccactacttcgaaaagccagatgcatttaatccggaccattttcttgacgcaaatggagccctgaagaagaccgaggccttcataccattctctctgggcaaacgcatatgccttggggaggggatcgctcgcgctgaattgttcctgtttttcacaaccattctgcagaacttttccatggctagcccggttgcaccagaagatatcgatctcactccacaggagtgtggtgtcggtaagattcctccgacatatcagattagattcctgcctcggtag

SEQ ID NO: 219853 - DNA, 876 bp, Artificial Sequence
  Description of Artificial Sequence: Synthetic coding sequence
atgagatgtatgcttaccaattcccacccttggtgcggttgcgactggcagttcagagaaaagtacggcgacgtttttacagtgcacctgggtcctcgtccagtggtcatgttgtgtggcgtggaggctatacgagaagcgctggtggacaaggctgaggccttctctggtcgcggaaagatcgcaatggtcgacccctttttccgcggatatggcgttatctttgccaatgggaaccggtggaaagtgctccgcaggttttcagtgaccaccatgagagattttggtatggggaaacggagcgtggaagagcgaatccaggaggaagctcagtgcctcattgaagaacttaggaagagcaaggaacgcgtgtacagagagattgaacaggtgatcgggccacatcggcctccagagctgcacgaccgtgctaagatgccctataccgaagccgtgatttacgagatacagcgatttagcgatcttctgcccatgggggtgccacatatagtcacacagcacacttcttttcggggatatatcatccctaaagacactgaggtgttcttgatactttctactgccctgcatgacccacactattttgagaagcccgacgcctttaacccagatcactttctggatgccaatggagctttgaaaaaaactgaagcattcatcccattttcgcttggcaaaagaatttgcctgggcgaaggcattgctagggcggagctgttcctgtttttcaccacaatcctgcagaatttctccatggcaagccccgttgctccagaggacattgatctgacgccgcaggagtgcggagtaggcaaaattcctccaacataccagattcgtttcttacctagatag

SEQ ID NO: 219854 - DNA, 1473 bp, Artificial Sequence
  Description of Artificial Sequence: Synthetic coding sequence
atggatccgtttgtagttctggtattgtgcctgtcctgcctcctgctcctgagcatttggcgccaaagctccggtcggggtaagctgcccccaggcccaactcccttgccagtgattggtaatattctgcagattgatattaaggatgtaagcaagtctttgaccaacctctcaaagatatacggtcccgttttcacgctctattttggcctagaacgcatggttgtccttcatggatacgaggtggtcaaagaggctctgatcgatttgggcgaggaattttccgggcgtggtcactttccattagcagagcgcgctaaccgcggtttcggtatcgtattctcaaacggcaagcggtggaaggaaattcgtcgtttctctctgatgactctgcggaattttggaatgggcaagaggagcatagaggaccgggtgcaagaggaggcgaggtgtctggtggaggaacttcggaaaaccaaagcctcaccttgcgacccgacctttatcttagggtgtgccccatgtaacgtgatctgtagcattatctttcaaaaacggttcgattataaagaccagcagtttctaaatttaatggagaagctgaatgagaatataaggatcgtttccaccccatggattcaaatctgtaacaattttccaactattatcgactacttccctggcacacataataagctactgaaaaatctggctttcatggaaagcgatatactggaaaaggtgaaagagcaccaggagagcatggacatcaacaacccgagagattttattgattgtttcctgatcaagatggaaaaagagaaacagaatcagcaatctgaattcactattgaaaacctggttattacagcagcagacttgctgggtgcaggaactgaaacaacttctacgaccctgaggtatgccctattgctgctcctgaaacaccctgaggtcacggccaaggtgcaggaagaaatagaaagggttgttggacgcaacagatcaccctgcatgcaagatcgaggccacatgccttacactgatgccgtggtacacgaggtacagcggtatatagaccttatccctacctcccttccccatgcagtaacgtgcgacgtgaagtttaggaactacttgatccctaagggcaccacaatattaacctccttgacgtccgtgctgcacgacaataaagaattcccaaaccccgagatgttcgaccctaggcactttttagacgagggcggaaatttcaagaagtccaattacttcatgccatttagtgctggcaaacgcatttgcgtgggggaaggcttagctcgtatggaactgtttctgtttctgacattcatcctgcagaactttaatcttaagtctttgatcgaccccaaagaccttgacaccacgccagtggttaacgggttcgcttccgtgccccctttttaccaactgtgtttcattcccgtatag

SEQ ID NO: 219855 - DNA, 1473 bp, Artificial Sequence
  Description of Artificial Sequence: Synthetic coding sequence
atggagccattcgtggtcctggtactgtgtctgtcatttatgttattattttctctctggaggcagtcatgccgacggaggaagctgcctcctggaccaacgccactgcctatcatcggaaacatgttgcagatcgacgtgaaggacatatgtaagtcatttacgaacttttctaaagtctacggcccagtgttcacagtctatttcggcatgaatcctatagtcgtgtttcatgggtatgaggccgtgaaggaggccttgattgataatggtgaagaattttctggcagaggtaacagcccgatcagtcagaggatcaccaaggggctggggatcatctcaagcaacgggaaaagatggaaagaaatcaggaggttctcgctgaccactctccgaaacttcggcatgggtaagcgatccatcgaggaccgggtccaggaggaagctcattgcttggtggaggagcttcgcaaaacaaaggccagtccgtgcgaccccacatttattttgggctgcgccccatgtaatgtgatttgtagtgtggttttccaaaaacggttcgattacaaggaccagaattttttgactctgatgaaacgattcaatgagaactttcgcattctcaactcaccctggatccaagtgtgcaataattttcctcttctgatagactgtttccccggaactcataacaaggtcctgaagaacgtggctctgacccggtcttacattcgcgaaaaggtgaaagaacaccaggcctccctggacgtcaataatccgagagactttatcgattgtttcttgattaaaatggaacaagagaaagataaccagaagtccgagtttaatattgagaatcttgtgggcacagtggccgatctcttcgttgccggtacagaaactacctcgacaactttgcgatacgggttgcttcttctcctcaagcatcccgaggtaactgctaaagtgcaggaggaaatcgaccacgtgatcggccgacaccgctccccatgcatgcaggaccgaagtcatatgccctacaccgatgcagtggtacatgaaattcagcggtactccgatctagtgccaactggagtgccgcatgctgtcacaacagacacaaagtttcgaaactaccttatcccaaaggggactactatcatggcactgcttacctctgtgttgcatgatgataaagagtttcccaaccctaacatctttgaccccggacactttctcgacaagaacgggaatttcaagaagtctgattattttatgcccttctcggccggaaagcggatttgtgctggcgaaggattggcgcgtatggaactttttctatttttaacgactatactccagaacttcaacctcaaaagcgtggacgatcttaagaacttaaataccacagccgtgactaaggggatcgtgagtctgcccccttcttaccagatctgttttattccggtgtag

SEQ ID NO: 219856 - DNA, 1374 bp, Artificial Sequence
  Description of Artificial Sequence: Synthetic coding sequence
atggagcgttccttcctggaagaagcaattcctcagtatttaaaagagctcctcaaagatctcgtgggtgcccatattagcgtgtccgcccttgtcactggggtgcgcggaatggaaaaccgcgctctcaagagcttcagcgctgaactcagcctatccgcctggctgccgagcgtggccgcacttagttctttagcggtaaactccccatccttctgtccgttcttcctcggtattatcagctccaatggcaagaggtggaaagagatacggaggttcagtctgaccaccctcaggaatttcggaatgggcaagcgctccattgaggaccgcgtgcaggaggaagctcactgtttggtggaagagctgagaaagaccaaggccagcccatgtgacccaacttttatattggggtgcgcaccctgcaacgttatctgctcagttgttttccagaaacgcttcgactataaagatcagaactttttaaccctcatgaaaaggttcaatgagaactttaggatcctcaatagtccttggattcaagtctgcaacaattttccccttttaatcgactgtttccctggcacccacaataaagtgctcaaaaacgttgctttgactaggagctatattagggaaaaagttaaagaacaccaagcctctctggacgtaaacaaccctagagatttcatcgactgtttcctgatcaagatggagcaggaaaaggataatcaaaaaagcgagttcaacattgaaaatctggtgggcaccgtggccgatttgtttgtggcgggtacagaaacaactagtacaaccctgagatatggactgctgttgttgctcaagcatcctgaagtgactgccaaggtgcaggaagagatcgatcatgtgattgggagacatcggagtccctgtatgcaggataggtctcacatgccctacaccgacgcagtcgtgcatgaaattcagaggtactcggatttggtgcctactggagtgccccatgctgtgactaccgataccaaatttagaaactatctaattccgaagggaactactatcatggctttgctgacaagtgtgctccatgatgataaagaattcccaaaccccaatatctttgaccctgggcactttctggataagaacgggaacttcaagaagtctgactatttcatgccgttctccgccggtaagaggatttgtgcaggcgaaggactggcaaggatggagctgttcctgtttctgacgacaatcctgcagaacttcaacttaaagtccgtggatgatctgaaaaatcttaacacgaccgctgttacaaaagggatcgtctccctccctcccagctatcagatctgtttcatccctgtgtag

SEQ ID NO: 219857 - DNA, 1167 bp, Artificial Sequence
  Description of Artificial Sequence: Synthetic coding sequence
atgttcttgcagccgatcgccaaggggataatctcatcgaatgggaaaaggtggaaagagataaggaggttctctctaaccaccttgagaaactttggaatggggaagcgctctatcgaagatcgtgttcaggaggaagcccattgtctggttgaggagttacggaagaccaaagcttccccttgtgaccccacattcatcctcggctgtgccccatgcaacgtgatttgcagcgtggtgttccaaaaacgtttcgattataaggaccaaaacttcctgacattaatgaaacggttcaacgaaaacttcaggattctcaactcaccatggatccaggtatgtaataacttccccttgctcatagattgtttccctggaactcacaataaagttctgaagaatgtggccctgacaagaagttacatcagagagaaagtgaaagaacaccaggcatctttggacgtgaataaccccagagacttcattgactgctttttaattaagatggagcaggaaaaagacaaccaaaagtctgagttcaatatcgagaatctggtgggtactgtcgcagacctgttcgtagctggcaccgagacaacctccacaacgctacgatacgggttactgctgctgctgaaacacccagaggttactgcaaaagtccaggaggagatcgaccatgtgatagggaggcaccgatccccttgcatgcaggaccgttcacacatgccctacacagatgctgtcgtacatgaaattcagagatacagcgacctggtgcccacaggagtgcctcacgctgtgacaaccgatactaagttcagaaattacctgatccccaaaggaaccactattatggccctgctcacttctgtcctccatgatgacaaggaatttccaaaccccaatatcttcgatccgggacatttcttagataaaaacggaaatttcaaaaagtccgactacttcatgcccttttccgccggaaagaggatctgtgccggtgaaggtcttgccagaatggagttgtttcttttccttactacgattctccagaatttcaacctgaagagcgtcgatgacctgaaaaatctgaacaccaccgctgtgacaaaaggcatagtgagcctgcctccaagctatcagatttgttttattcctgtgtag

SEQ ID NO: 219858 - DNA, 924 bp, Artificial Sequence
  Description of Artificial Sequence: Synthetic coding sequence
atggccgcaaaatgctgcagcaccttcttcttaggttgtgaattcagtcagttcctgcctctttttctccttggaatcatcagctccaatggcaagagatggaaagagattcgacggttcagcctcacgacactccggaattttggcatgggaaagagatccatcgaagacagagtgcaggaggaagctcactgtctggttgaagagctccggaagacaaaggcaagtccttgcgatccaaccttcatcctggggtgcgccccatgtaatgtgatctgctcagtcgtttttcagaagcggtttgattacaaggaccagaatttccttaccttgatgaagcggtttaacgagaactttcggattctcaacagcccatggattcaggtgtgcaacaattttcctctgttaatcgattgcttccctggcacacataacaaggtcctgaaaaacgtggcactgacccggtcctacattcgtgagaaggtgaaagagcaccaggcctcactggacgtgaacaaccccagagacttcattgattgctttctgattaagatggagcaggagaaggacaatcagaaaagcgaattcaacatcgagaacctggtcggaaccgtggccgacctgttcgttgccggtaccgaaaccacttctacgaccctgaggtacggactgctcctgctgctgaagcatcctgaggtcacagctaaggtccaggaggaaatcgatcatgtgatcggtagacatcggtctccgtgcatgcaggatcgttcccatatgccctatacggacgctgtcgtgcatgaaattcaacgttactccgacctggtgcctacaggggtgccacatgcggtgaccacggacaccaaatttagaaattatttaatacccaaatcttttgacaataagattatgttggccgcatag

SEQ ID NO: 219859 - DNA, 1473 bp, Artificial Sequence
  Description of Artificial Sequence: Synthetic coding sequence
atggatagcctggtggtactggtcctgtgtctgtcttgccttctccttttgagtctgtggagacagagctcaggccgaggcaagctgcccccaggtccaacacctctacctgtgattggcaatatcctgcaaatcggaattaaggacatttctaaatctctaacaaacctaagtaaggtgtatggaccagtgtttacactttacttcggactgaagccgatagtggttctccacggttatgaagctgtgaaagaggcgctcatcgatctgggagaagaatttagtgggcgaggcatcttcccacttgccgaacgtgccaaccgcggatttgggatcgtgttttccaatgggaagaaatggaaagaaattagacgattttccttaatgaccctccggaactttggaatgggcaagcgcagcatcgaggacagagtacaggaagaggccagatgcctcgtcgaggagctgaggaaaactaaggcaagcccttgcgaccccacattcatcctgggctgcgccccatgcaatgtgatctgctcaatcatctttcataagaggttcgactacaaggatcagcagtttctgaacctgatggagaagctcaacgaaaatatcaaaatcctctccagcccttggatacagatctgtaataattttagccctatcattgactatttccccggaacgcataacaaactattgaagaacgtggcatttatgaagagctatattttggagaaggttaaggaacatcaggagtctatggacatgaacaatccccaggattttattgactgcttcttaatgaagatggaaaaagagaaacacaaccagccaagcgagtttacaatagagtctctagagaatacggcagtcgacttattcggggcaggaaccgaaaccactagcacgaccctgagatacgccttactgttattactgaagcatcctgaagtgacagcaaaagtccaggaagaaatagagcgggtcatcggaagaaatcgctccccatgtatgcaggatcgaagccacatgccctacacagatgccgtggtccacgaggtgcagaggtatattgacctcttgcctaccagcctcccccatgctgtcacctgtgacataaagttccgaaactacctgatacccaagggcacaaccatcctgatctcactgacgtcagtcctgcatgataataaggagttcccaaatcctgagatgtttgacccccaccatttcctggatgaaggaggcaatttcaagaaatcgaaatacttcatgcccttcagcgcgggtaagaggatatgtgtgggcgaagctctcgccggtatggaactctttttgttcctcacatccatactgcagaacttcaacctcaaaagtctcgttgatccgaaaaatctggacactacccccgtggtcaatggcttcgcctccgtgccccctttttaccagttgtgtttcatcccagtgtag

SEQ ID NO: 219860 - DNA, 1362 bp, Artificial Sequence
  Description of Artificial Sequence: Synthetic coding sequence
atggactcactcgtggttctcgtgttgtgcctatcctgcctgctcctgctcagcctctggcgacagtcaagcggcagaggtaagttacctcccggtccgactccattgcctgtgatcggaaatatcctgcagattggaattaaggatattagtaagtctcttacgaatttatcgaaggtgtacggcccagtctttaccctgtattttggcctgaaaccaattgtggtactacacggctacgaggcagtcaaggaggctctcattgacctgggcgaagaattctcaggaagggggatattccccttagctgaacgggcaaaccgcggattcgggatcgtgttcagcaatggcaagaagtggaaagagatccggaggttctcccttatgactttgagaaacttcggcatggggaagcgctccattgaagaccgagtgcaggaagaagctcgctgtctggtcgaggagcttaggaaaaccaaggcaagtccttgtgatcctacttttatcctgggctgtgcgccttgcaatgtaatttgttccattatttttcacaagaggtttgattataaggatcagcagtttctgaatcttatggaaaagctgaacgagaacatcaagatcctttcatcgccctggattcagatctgcaacaacttttcacctataatagattatttccctgggacccacaataaattgctgaagaatgtcgcattcatgaagtcttacatcctggagaaagtaaaagagcatcaggagagcatggatatgaataatccacaggatttcatcgattgttttctgatgaaaatggagaaggagaaacacaatcagccttctgaattcactattgaaagcctggaaaatacagctgtggacctgttcggggcaggaactgaaactaccagcaccacgctgcggtatgccctgctgctgctgctgaaacatcctgaagttaccgccaaagtccaggaagaaatcgagagagtgattggtaggaacaggagtccctgtatgcaggaccgaagccacatgccctataccgatgccgtggtccacgaagtgcagaggtacatcgaccttctgccaacatccctgccacatgcagtaacctgcgacatcaagtttaggaattacttaataccaaagggtaccacaatactgattagtctgacatccgtactgcatgacaacaaggagttccctaatcccgaaatgtttgacccgcaccattttttggatgagggcggtaacttcaaaaagtccaagtacttcatgctggtgctgaagatgatcaggacagagcggaccaaaaggaaaagggtcggcaaactgttttgggtatccgtgagagtaacatag

SEQ ID NO: 219861 - DNA, 1341 bp, Artificial Sequence
  Description of Artificial Sequence: Synthetic coding sequence
atgggtttggaggctttagtacctttagctgtgattgtggcaatttttctactgctagtggacctgatgcatcgacggcagcgatgggcggctaggtacccaccaggccctctgcctcttcctggcctcggcaatctactacacgtcgatttccagaataccccctactgttttgaccagctccgaagaagattcggcgacgtattctctctgcagctcgcctggactcccgtggttgtgttaaacggacttgccgcagtgcgagaggcgcttgtcacacatggcgaggatacagcagatcggcctcccgtgccaatcactcagatccttggattcggacctaggagccagggcagaccctttcgtcctaatgggctgctagacaaggctgtgagtaacgtgattgcctcactaacctgtggacgtcggtttgaatacgacgatcctcgcttcctgcgtcttctggacctggcacaggaagggttgaaagaagagtcagggttcctgcgcgaagttctcaatgcagtgcctgtgctcctgcacatcccagcgctggcgggaaaagtgctgcgattccagaaagccttcctgacccagctggacgaactactgacagagcacaggatgacgtgggatccagcccagcctcctagggacctgacggaagcctttctggctgagatggagaaggctaagggaaatcccgaatcatcctttaatgatgagaatctctgtatagtggtagccgatctcttttcagctggcatggtcaccacgtccaccaccctggcgtggggactgttgctgatgatcctccatccggatgtacaaagacgcgtgcagcaagagatcgatgatgtcattggtcaggttaggcggcctgagatgggcgaccaggctcacatgccttatacaaccgctgtgatccatgaagtacagcggttcggagatattgtgccactgggagtcacacacatgacatcccgtgacatcgaagtgcaagggtttagaatcccgaagggcacgaccttgatcaccaatctctcatcagtgcttaaggacgaggcagtgtgggaaaagccttttcgattccacccggaacatttcctcgacgcacagggtcacttcgtgaaaccagaggctttcctgcctttttcggccggaaggcgcgcatgcctcggcgaaccactggccaggatggagctcttcctatttttcacctcactattgcagcatttttcgttctctgtgcctacaggtcagccccgtccttcgcaccacggggtgttcgccttcttggttaccccaagtccctatgaactctgtgccgttcccagatag

SEQ ID NO: 219862 - DNA, 1494 bp, Artificial Sequence
  Description of Artificial Sequence: Synthetic coding sequence
atgggactggaggccctggtacccctggcagttatcgtcgccatttttttattactagtcgatctgatgcacagacggcagcgatgggccgctcgttacccacctggccctctccctctgcctggtctaggcaacctactgcacgtggatttccaaaataccccatattgttttgaccagctgagaagaaggtttggagatgtgtttagcctgcaattggcctggacaccagttgtcgtgcttaacgggctggccgcagtaagggaagcactagtcacccatggtgaagataccgccgatagacccccagttccaattacccagatattgggctttggccctcggagtcaaggagtgttcctggctcggtatggccctgcttggcgcgaacaacgccgtttttccgtgtcaactttacggaatctagggttgggcaaaaagtcactggagcagtgggtcacggaagaagccgcatgtctgtgtgctgccttcgcaaaccacagtggcagacctttccgcccaaatggcctgctggacaaagccgtgtcgaacgtaattgctagtcttacctgcgggagaaggttcgaatacgacgaccccaggtttctcagactgttagatctcgcacaggaaggcttgaaagaagaatctgggttcctcagggaggtacttaacgctgtccccgtcttgctgcacatcccagcactggcgggaaaagtccttcgctttcaaaaggcttttctaacacaattggatgagttgttaacagagcaccggatgacttgggacccagcccagccaccacgggaccttaccgaagcatttctcgcagaaatggagaaggcaaaaggaaatccagaatcaagtttcaacgatgagaatttgtgcatcgtggtagctgatttgttcagcgcgggaatggttaccacctctacaactctggcgtgggggctgctgctcatgatcctacaccccgacgtccagagacgagtacagcaggaaatcgacgatgttattgggcaggttcgtcgcccagagatgggggatcaggcacatatgccctacacgacagcagtgatacatgaagtccaacgcttcggggatattgtaccactgggcgtgacgcatatgacttccagggatattgaggttcagggtttccgtattcctaagggtaccaccctgataactaacctcagtagtgtgctgaaggatgaggctgtgtgggaaaaaccgttccgtttccacccagagcattttctcgatgcgcagggccacttcgtgaagccagaggctttcctccctttcagcgctggaagaagagcttgtttgggtgaaccactggcccgaatggaacttttcctttttttcacgtctcttctgcagcacttttcattctccgtgcccacaggacagcccaggccctcccaccacggtgtgttcgcttttctggtcacaccctccccctatgaactctgtgcagtgccccgatag

SEQ ID NO: 219863 - DNA, 1494 bp, Artificial Sequence
  Description of Artificial Sequence: Synthetic coding sequence
atgggcctggaggccttggttccactggccgttattgtggcaatcttcctccttctcgtagatcttatgcacagaaggcagagatgggcagccagatacccaccaggaccattgcccttacccggtcttggaaacctcctccatgtagatttccagaatacgccctactgctttgaccagctgcggcgacgttttggtgacgtgttcagtctccaactggcatggacacccgtggtggtgttgaacggtttagccgcagtgagggaggccctggtgacacacggagaggatacagccgataggccacccgtgcctattacgcaaattctggggtttggaccccgagggcagggcgtgttcctcgctcgctatggcccagcttggcgggagcagcggaggttttcggtgagcacccttagaaatctgggtctgggaaaaaagtctctagagcagtgggtgaccgaggaagcggcatgcctgtgtgctgctttcgctaaccatagtggcagaccgtttaggccaaacgggctgttggacaaggcagttagtaatgtgatagcatctctaacctgcggtagaagattcgagtatgatgatcctcgctttcttagactattagacttggcccaggaaggcttaaaagaggaatctgggtttctgcgggaggtgctgaacgccgtcccagttcttctccacatacccgcactagcagggaaggtgctgcggtttcagaaggcctttctgacacagctggacgaactgctgacagagcaccgcatgacgtgggaccctgcacagccaccgcgtgatctgacagaagctttcttagccgagatggagaaggccaagggaaaccccgagtcttccttcaacgacgagaacctgtgtattgtggtagctgatttattcagcgcgggaatggttaccacgtctaccacgctcgcgtgggggctgcttctgatgattctccatcccgacgtgcaacgaagagtgcagcaggagatcgacgacgtgattggtcaggtgcgcagacctgagatgggggatcaggctcacatgccatacaccaccgcagtgatccatgaagtacagaggttcggcgacattgtaccactaggcgtcacacatatgacctcgcgggatatagaggtccagggattccgtatacctaaagggacaaccttgattaccaacctgagcagcgtgcttaaggatgaggcagtttgggagaagcccttcaggttccatccggagcatttcctggatgctcagggccatttcgtgaaacccgaggccttcttgccattctcagctggcaggcgggcttgcctgggggagccactcgctaggatggagttgttcctgttttttacatctctgttacagcatttctccttcagcgtccccactggacaaccgcgacccagccatcacggagtgtttgcctttttagtcaccccctcaccatacgagttgtgtgctgtccccaggtag

SEQ ID NO: 219864 - DNA, 1332 bp, Artificial Sequence
  Description of Artificial Sequence: Synthetic coding sequence
caggaggccctgacacttccactgcaattaaggcgccgttttggggacgtattttctctgcaactggcctggacccctgtagtggtcctgaacggccttgcagccgtgcgggaagcactagtgacacatggtgaagacacagccgatagaccacctgtgccaatcacccagattctggggttcggccctcgcggacagggcgtattcctcgcccgatacggccctgcttggagagagcagcgcaggtttagcgttagtacactgcggaacctaggcctcgggaagaagtccctcgagcaatgggtaacagaggaggcagcttgcctatgcgcggctttcgccaatcacgatgccccatttgcgccaactgtgagctggacgaaacctaatgtgattgcctctttgacttgtggcagaagattcgagtatgatgacccaagattcctgaggttgctcgacttagctcaggaagggctgaaagaggaaagtggttttctcagagaagttttaaacgccgtccccgtcctgctgcacattccggcactagctggtaaggttctgcgtttccagaaagcattcctaactcagctggatgagctgctcacagaacaccgcatgacctgggaccctgcacaaccccctagagacttaactgaggcttttctggccgagatggagaaggctaaaggaaatcccgaatcaagcttcaatgacgaaaacctctgcattgtggttgcggacctcttttcagcagggatggtcaccacaagcacaacactggcctggggtctccttctgatgatattgcatcctgatgtacaacgcagagtgcagcaggagattgacgacgtaatagggcaggtcagacgacctgagatgggtgatcaggcccatatgccgtacacaaccgccgtgattcacgaggtgcaacgctttggcgacattgtgcctctgggagtgactcatatgacctcaagggacatagaagtccagggatttcgcatccctaaggggacaacattgattacgaaccttagtagcgtccttaaggacgaagcggtttgggaaaaaccattcagattccatcctgaacactttctggacgcacaaggccacttcgtgaagcccgaggcttttttgccattttcagctgggaggcgggcatgtctgggcgagcctctggcacgcatggaactttttctgtttttcacttctctgctccaacatttcagcttcagcgttcctaccggtcagccaagaccatcccatcacggcgtctttgcttttttagtgacccccagtccttatgagctgtgcgccgtcccaagatag

SEQ ID NO: 219865 - DNA, 1341 bp, Artificial Sequence
  Description of Artificial Sequence: Synthetic coding sequence
atgggtttggaagctctcgttcccttagccatgatcgtagccattttcttgctgctggtagatttaatgcatcggaggcagagatgggcagctcgctatcctccaggccctttgccactccccggactggggaacctactgcacgtggacttccaaaatacgccctactgtttcgaccagctgagaagacgtttcggggacgtctttagtctgcagctcgcttggacaccagtcgtcgtactgaatggcttggcagccgtgagagaggctctggtgacccacggcgaggataccgcagacagaccccctgtgcctattacccaaattctcggctttggtcctcggagtcagggtaggccttttcgaccaaacgggctactcgacaaggccgtctctaatgtgattgccagtctgacttgtggacgaaggttcgaatacgatgatcccagattcctgcgcttgctcgacctggcacaggaaggcctgaaggaggagtccggatttcttagagaggttttgaatgcagtcccagtgctgcttcatatccccgcactcgctggaaaggtccttaggttccagaaggctttcttgacccagcttgatgaactgctcacagaacatcggatgacctgggacccagcccagccacctcgcgatctcaccgaagcttttctggcggagatggagaaggctaagggaaacccggagtccagtttcaatgacgaaaatttgtgcatcgtagtggcggacctgttctccgccggaatggtaacaacctctacgaccctggcttgggggcttctgcttatgatactccaccctgatgtccagcgcagagtgcagcaagagatagacgacgtcatcggacaggttagaaggcccgaaatgggggaccaggcccacatgccgtataccactgccgttatccatgaggtccagcggttcggagacattgtacctctgggggttacccacatgacatcaagggatatagaggtacaggggtttcgcatcccaaaggggacaaccctgattaccaatctgtcaagcgttctcaaggacgaagctgtgtgggagaagcctttccgattccaccccgaacactttctggatgcgcaaggacacttcgtgaaacccgaagcctttcttcctttctctgcgggacggagggcatgtctgggtgagccactggccagaatggagcttttcctgttctttactagcctcctgcagcatttctcgttctccgtacccaccggccaacccagacccagtcatcatggcgtgttcgcgtttcttgttactccctccccctatgagctgtgtgcggtgcccaggtag

SEQ ID NO: 219866 - DNA, 1482 bp, Artificial Sequence
  Description of Artificial Sequence: Synthetic coding sequence
atgtctgcgctcggcgtaacagttgctttattggtgtgggctgcctttctgctgctggtaagtatgtggaggcaggtacatagcagctggaacttgcccccaggcccatttccgcttcctattatcggcaacctttttcagctagagctcaagaacatacctaaatccttcacacggttggcacaacggtttggccctgtgtttaccctttacgtagggtcacagcggatggtcgtgatgcacggctataaggcagttaaagaggcactccttgattacaaggatgaattttccggtcgaggggacctgcctgcattccacgctcatcgggataggggaatcattttcaataatggaccaacttggaaagacatacggaggttttcgctaacaacattgcgaaattacggaatgggtaagcaagggaacgaaagccggatccagcgcgaagcccacttcctcctggaagccctgcgtaaaacccaagggcaaccttttgaccccacatttttgatcgggtgcgccccatgcaatgtcatcgccgatattctttttaggaaacattttgactataacgacgagaaattcctgcgtttaatgtatctcttcaatgaaaatttccaccttttgagcactccctggctgcagctttacaacaactttccatccttcttacactaccttcctgggtctcatcgtaaagtgataaagaacgtggccgaggtgaaagagtatgtgtcggagagggtcaaggaacatcatcagtctttggatccgaactgtcccagggatctgacggattgtctgctggtggagatggaaaaggagaagcattctgcagagcgcctatacacgatggacggtattactgtaacggtggcggatcttttctttgcagggactgaaaccacatccactacactcaggtacggactgctgattctcatgaagtaccccgagattgaagaaaagttgcatgaagagatcgacagagtgattggacctagtcgtatcccagctatcaaagacaggcaggaaatgccatacatggacgctgtagtgcacgagatccagcgattcattactctggtgccatcaaacctgccccacgaagccactagggatactattttccgcggatatcttatacctaagggaaccgttgtagtacctacacttgattctgtgctgtacgataaccaggagttcccagaccctgaaaaattcaagcccgaacattttcttaatgagaacgggaaatttaagtattcagactactttaagccctttagcacaggcaaaagggtgtgtgctggggaaggtctggccagaatggaactattcctactcctatgtgccatcctgcagcactttaacctgaagcccttagtggatcccaaggacatcgatttgtctcccatccacatcggattcggctgcattccaccccgatataagctctgcgtgatccctcgatcttag

SEQ ID NO: 219867 - DNA, 1482 bp, Artificial Sequence
  Description of Artificial Sequence: Synthetic coding sequence
atgagcgctctgggtgttactgtggctcttcttgtgtgggcagcctttctgttattagttagcatgtggagacaggtgcactcttcttggaacctccctcctgggcctttcccactgcctataataggaaacctgtttcagttggagctcaagaatatccctaagagcttcactaggctggcccagagattcggacccgtgttcacgctgtacgttgggagtcagaggatggtcgtaatgcatgggtacaaagccgttaaagaggcacttctggattataaggatgaattttcaggccgtggggacctgccggcatttcacgcccacagggaccgagggatcatcttcaataatggcccaacatggaaagatatcaggaggttcagcctgaccaccctccgtaactacggtatggggaagcaaggcaatgaatccaggatccagagggaggcccactttctgctggaagccctgagaaaaacccaggggcagcctttcgacccaacttttttgatcggctgtgcaccctgcaacgtcattgccgacatcctctttaggaaacactttgactacaatgacgagaagtttcttcggctcatgtatctcttcaatgagaattttcaccttttaagcactccatggcttcagttgtacaacaattttcctagcttcttacattatcttcccggaagccaccgcaaggtgattaaaaacgtcgctgaggtcaaagagtatgtatctgagcgtgtgaaggagcatcaccagagcctggaccccaactgccctcgcgacctgactgattgccttctggtggaaatggagaaggagaagcacagtgccgaacggttgtatacaatggacggaataacggtcactgtggcagacttgttctttgccggtactgaaacaacttcaaccaccctgcggtacggattgttgatacttatgaagtatcccgaaattgaggagaagctccacgaagaaattgatagggtgattggcccttccaggattcccgcaattaaggaccgacaggagatgccttatatggatgctgttgtacatgagatacaaaggttcatcacactggtgccgtcaaatctgcctcatgaggcgactagggacactatctttaggggctatctgattccaaagggcacagtggtagtaccgaccctggattctgtcctctatgacaaccaggaattccccgaccctgaaaagtttaagcccgaacacttcctcaatgagaatggaaagttcaaatatagtgactatttcaagcccttttccaccgggaagagggtttgtgccggagaaggcctggccaggatggaactatttttactgctctgtgcaatccttcagcatttcaacctcaaaccactggtcgacccaaaggacatagaccttagccccattcatattggctttggctgtatcccaccaagatataaactttgcgtgatccccaggtcgtag

SEQ ID NO: 219868 - DNA, 261 bp, Artificial Sequence
  Description of Artificial Sequence: Synthetic coding sequence
atgtctgccctgggcgtgacggttgcattgctggtgtgggcggctttccttctccttgtgtccatgtggaggcaggtgcactctagctggaatcttcccccaggcccttttcctcttcctattattgggaatctgtttcaattggagctgaagaatattccgaaatcattcacacgtctggcccaacggttcggccctgtgtttacactgtacgtgggaagtcagcggatggttgtgatgcacggttataaagctgtgtag

SEQ ID NO: 219869 - DNA, 1476 bp, Artificial Sequence
  Description of Artificial Sequence: Synthetic coding sequence
atggattctataagtaccgctatccttttgctgctgctagcactggtatgtctgcttctaacgctgtccagccgagacaagggaaaacttccccctgggccacggccactaagcatcctgggtaatctcctcctcttgtgttctcaagacatgctcactagtttgaccaagctgtcaaaggagtatggcagcatgtataccgtacaccttggacccaggagggttgtagtactaagcgggtatcaggccgtgaaggaggcactcgtggaccagggagaagagttcagcggaagaggcgactacccagccttctttaatttcaccaagggaaatggcatcgccttttcaagcggcgatcggtggaaagtgctgcgccagttcagcatccagatcctaaggaattttgggatggggaagagatcgatcgaggagcggatcctggaagaaggcagctttctgctcgcagagctcagaaaaaccgagggagagccatttgatcctactttcgtgctctcgcgatctgtttcgaacattatttgctctgtattgttcggatcgcgctttgactatgatgatgaaagactcctgacgattatccggcttataaacgataactttcagatcatgtcctctccctggggtgagctctacgacatttttccctccctgctggactgggtgcccggaccacaccagaggatttttcagaacttcaagtgtctgcgggatttgatcgcacacagtgtgcatgatcaccaagcaagcctggaccctagatcaccacgagacttcatccagtgcttccttacaaaaatggccgaggaaaaagaagaccccctcagtcacttccacatggataccctgttgatgactacccataaccttcttttcggtgggaccaaaactgtttctacaacccttcaccacgcttttcttgccttaatgaaataccccaaagtgcaggcgagagtgcaggaggagatcgatcttgtagtaggaagagcacggctacctgctttgaaggaccgggctgctatgccatatacggacgctgtcatccacgaagtacagagatttgccgatataatccccatgaatctgccccacagggtaactcgagacacagctttcagaggcttcctcatacccaaaggcacagatgtgatcactctgctgaataccgtgcactatgacccaagccaattcttgactcctcaggagttcaatccagaacactttttagatgccaatcagtcttttaagaagtcacccgcttttatgcccttctccgccggtagacgactctgtctcggcgagagcctggctcgtatggagcttttcctatacctgacagcgattttgcagtccttctcactgcagcctttgggagcccctgaggacatcgacctgaccccgctgtcaagcggactgggcaatttacctagacctttccagctatgcctacgaccaaggtag

SEQ ID NO: 219870 - DNA, 1509 bp, Artificial Sequence
  Description of Artificial Sequence: Synthetic coding sequence
atgctggcagcaatgggctcactggcagccgctctatgggccgtggtccatcctcggactcttttacttggcactgttgcttttctcctagccgctgatttcctcaaacggagacggccaaagaattacccacctggaccatggcgtttgcctttcctgggaaacttcttcctggtcgatttcgagcagtcacatctggaggtacaattattcgtcaagaaatatgggaatctgttcagcttggagcttggagatatcagcgctgtcctgattactggacttcccctcattaaggaagcactgattcatatggatcaaaactttggcaatcggccagttacccctatgagggagcacatattcaaaaagaacggcctcatcatgagttcaggtcaggcttggaaggaacagaggagattcacactgacagctctccggaatttcgggctgggcaagaagagtcttgaagagaggattcaggaggaagctcaacacctgactgaggcgatcaaggaggagaatgggcagccatttgatcctcatttcaagattaacaacgccgtgagtaatataatctgcagtattaccttcggagaaaggttcgagtatcaggactcgtggttccaacagttattaaagcttctggatgaggtcacctacctggaagcttccaagacctgtcagttgtacaatgtctttccttggatcatgaagttcctgccaggcccacaccagaccctgttctctaattggaaaaagcttaagctgttcgtcagccacatgattgacaagcataggaaagactggaatcctgctgaaactcgcgattttattgacgcttacctcaaggaaatgagcaaacacaccggtaacccaacttcctcctttcatgaggagaacttgatatgttctactctggacctgttcttcgcgggtactgagacgacgagcactaccctccggtgggcactgctgtatatggccctgtacccagagattcaggagaaagttcaagcagagatcgaccgggtgatcggtcagggacagcagccatcaacagctgcgcgtgaatcgatgccatacacgaatgcagtgatacacgaggttcaacgaatggggaacattatccctttaaatgtgcccagggaagtcacggtggacaccactcttgctggctaccacctgccgaaaggcacgatgattttgactaaccttactgccttacaccgtgatcccaccgaatgggccacccccgacacgttcaaccccgatcattttctcgagaacggccagttcaagaaacgagaggcattcatgccatttagcataggaaagagggcttgtttaggcgaacagcttgcgaggactgagctttttattttttttacatctctgatgcagaaattcaccttccgccctcccaacaacgagaagctcagcctcaagtttcgcatggggattaccatttcacccgtgagtcataggctgtgcgccgtgccccaggtctag

SEQ ID NO: 219871 - DNA, 1506 bp, Artificial Sequence
  Description of Artificial Sequence: Synthetic coding sequence
atgtggaagctttggcgtgccgaagaaggggctgccgctctcggcggtgcccttttcctgctcctctttgctctgggagtaagacagttgttaaaacaacgaagacccatggggttcccacctggacccccaggactgccatttattgggaatatatactccctggctgcgtcttcagaactgccacacgtttatatgaggaaacagtcacaggtatacggggagatcttttccttagacctggggggtatctctacagtggttctgaatggctacgacgtggtgaaagaatgtctggtacaccagtccgagatatttgccgaccggccatgtctgcctctcttcatgaagatgacgaagatgggtgggcttctcaatagccgttatgggaggggatgggtggaccatagacgactcgctgtcaactctttccgctacttcggatacgggcaaaagagcttcgagtctaagatacttgaagagacaaagttcttcaacgacgccatagagacctacaaaggtcgcccatttgattttaaacagcttattactaacgcagtgagtaatattaccaatttaataatcttcggcgagcgatttacttatgaggacaccgacttccagcacatgatcgagctgtttagcgaaaatgtcgagttagctgcatcggcgtctgtctttctttataatgccttcccatggattggcattctccccttcgggaaacaccaacaactgttccgtaacgcagccgtagtgtacgattttctgtcgcgccttattgaaaaagcttcagtcaatcgaaagccacagctgcctcagcacttcgtcgacgcatatctggacgaaatggaccaggggaagaacgacccgagcagcacatttagcaaagagaacctgatcttctcagttggagagctcattatcgccggaacagagacaaccactaacgttctgagatgggccatccttttcatggccctctacccaaacatccagggacaagtgcagaaggagattgatctgattatgggacccaacggtaaaccgagctgggacgacaagtgcaaaatgccctatacggaggccgtgctccacgaggtattaaggttctgcaacattgtccccttaggcatatttcacgcgacaagcgaggatgcagtagtgcgcggatactctataccaaagggtacaaccgtcatcacgaatctgtattcagtgcatttcgacgagaaatactggcgcgatccagaggtcttccatccagagagattcctggattcgtcaggatatttcgccaagaaggaggctctcgttccattttccctgggacggaggcattgccttggagagcacttggccagaatggaaatgttcttattctttacagctctgctccagcgcttccacctgcattttccccatgaactggtgccagatctcaaacctcgcctcggaatgaccctgcagccccaaccctatctgatttgcgccgagaggcggtag

SEQ ID NO: 219872 - DNA, 1695 bp, Artificial Sequence
  Description of Artificial Sequence: Synthetic coding sequence
atggaagctaccggcacgtgggcgctgctgctggctctcgcactcctcctgttactgacactcgccctgagtgggacccgcgcacggggacatctgccccctggacccacacccctacctctgcttggaaacctgctgcagctccggcctggggcactgtactctgggctgatgagactatcaaaaaagtacggaccggttttcactatatacctgggcccttggcggccagtggtcgtgttggtggggcaggaagcagtgcgggaagcccttgggggacaggcagaagagtttagtgggaggggtacagttgccatgctggaaggcaccttcgacggccatggagtgttcttcagtaacggagagcggtggcgacagctacggaagtttacgatgctggcactgagggatctcgggatgggcaagagagagggtgaggagctgatacaggctgaggccagatgcttggtcgaaaccttccaaggcaccgagggacgaccctttgacccaagcctgctgttggcccaagccaccagcaatgtcgtgtgcagtctgttatttggcttaagattctcttacgaagacaaggagttccaggccgtggtgcgggctgccggagggacactgctgggtgtgtcctcccaagggggacagacttacgagatgttctcttggtttttgagaccactccctggcccacataagcagctgctgcatcatgtgagtacccttgccgctttcacagtgagacaggtccagcagcaccaggggaatttggatgcttccgggcctgccagggatctggtcgacgcctttctgctcaagatggctcaggaggaacaaaatcctggaacggagtttaccaataagaatatgctgatgaccgtgatttacctcttgttcgctgggacgatgactgtgtcaactaccgtaggttacaccctgctgctgctgatgaaataccctcacgtgcagaaatgggtgagagaggagcttaaccgggagctgggtgcagggcaagcgcctagtctgggggaccgtaccaggcttccatataccgacgctgtcctgcatgaagcccagagactgctggccctcgttcccatgggaatcccccgtactttaatgcgcactacccggtttcgaggatacacccttccccaaggcaccgaagtctttccactgcttgggtcaattctccacgatcctaatatttttaagcaccctgaagaatttaacccggacagatttctcgatgcggacggacgctttcggaagcacgaggcattccttccctttagtctgggaaagcgcgtttgtctgggggaaggactagccaaagccgaattattccttttttttaccacgatacttcaagcattttcactcgagtctccgtgcccacccgacactttaagcctcaaacccacagtgtcaggactctttaatattccacccgcttccacagtgggaatggacagagtcaatgtaagcagggtgtatactgccggatcacatatctataccccagccgtagtgtttcggtccctcagccatgggcctcacgcccacctgactcacgccgctaagatgcacaaccgaacaccaattcataattacaagggccacaaagcaaccgccggactcgcctttcatcgacataagtactcacccagtgcgattacctccacatag

SEQ ID NO: 219873 - DNA, 1515 bp, Artificial Sequence
  Description of Artificial Sequence: Synthetic coding sequence
atggaagctacaggaacatgggctctcctcctcgcactagctctgctactgctgctcaccctcgcccttagcgggaccagagctagaggccatctgcccccaggcccaactccacttcccctgctaggtaacctgctgcagctcaggccaggcgctctgtacagcggtcttatgcgcctcagcaaaaaatacgggcctgtttttactatataccttgggccatggcgcccagtcgtggtcctggtgggacaagaggcggtacgagaggctttgggcggtcaggcagaggagtttagtgggcgaggaacagtagccatgctggagggtacctttgacgggcacggcgtgtttttttctaacggcgaaagatggcgccagcttcggaagtttacaatgctggcgctgcgtgatctcgggatgggaaaacgtgagggggaggagctcatccaagctgaagctcgatgcttagtcgaaacctttcagggcaccgaaggaaggccatttgacccgagcctgctcttggcccaagccacaagtaatgttgtctgctccctcttatttggcctgcggttcagctatgaggataaggaattccaggccgtcgtccgcgctgctgggggaactctgctgggggtgagctcacagggtggtcagacatacgaaatgttcagttggtttctgagacccttacctggcccacacaaacagctattacaccacgtttccaccctggcggctttcactgtacggcaggtgcagcaacaccaagggaatctggacgctagcggtccggctcgcgatctcgtagacgccttcctgttgaaaatggcacaagaagaacagaaccctggtactgagttcacaaacaaaaacatgctgatgaccgtgatttaccttttattcgctgggactatgacagtttctaccacggtaggctataccctgctactactgatgaagtacccgcacgtacagaaatgggtacgggaagagttgaatcgcgaacttggcgctggacaggccccttccttgggggaccggacaaggctcccgtataccgatgctgtgctacacgaggcccagaggctcctggctctcgtccctatgggcattcctcgaacactgatgaggactacaaggtttagaggctacactctgccacagggtactgaggtgtttcctctcctcggcagcattctgcacgatccgaacatcttcaagcaccccgaagagtttaaccctgaccggttcctggatgcagatggcagatttagaaagcacgaagcctttctcccgttttcactgggtaagcgagtgtgcctcggcgagggcttggcaaaggctgagctgttcctgttctttacgacaatcctgcaagccttcagcttagaatcaccatgtccgccagatacactcagcctgaaacctacagtgagtggattgtttaacatccctccagcctttcagctccaggttaggcctaccgatctgcacagcacaacccagacaagatag

SEQ ID NO: 219874 - DNA, 690 bp, Artificial Sequence
  Description of Artificial Sequence: Synthetic coding sequence
atggctatggaagaacagaacccagggacagagtttacaaataagaacatgttaatgaccgtaatctatctgctcttcgccggaacaatgactgtgagcacaaccgttggctacacacttttgctgcttatgaagtatcctcacgtccagaaatgggtgcgcgaagaactcaaccgtgagctgggggcaggccaggcccctagtcttggtgacagaacacggttaccatataccgacgcagtcctgcacgaagcacagaggttgttggcgctggttccgatggggatcccaagaacgctcatgcgaaccaccagattcagaggatacactctgcctcaaggcacagaagtgttcccccttctcggaagcattctacatgatccaaatattttcaagcatcctgaagagtttaatcccgaccggttcctcgacgcggacggaaggttccgaaagcatgaggcctttcttccattctcactgggtaaacgcgtgtgtctgggcgagggcttagctaaggcagagctgtttctgttttttactactatcctacaggctttctccctggaatccccttgtccacctgatacattgagtttgaagcctactgtgtcgggcctcttcaatatcccaccagctttccagttgcaggtgagaccaactgatctccattccacgacccagacccgttag

SEQ ID NO: 219875 - DNA, 1635 bp, Artificial Sequence
  Description of Artificial Sequence: Synthetic coding sequence
atgtctagcccgggacccagtcaaccgcctgccgaggacccaccctggcctgcccgacttctgcgggctcctttggggctcctgcgcctcgacccatcaggcggagccttgctcctttgtggcctggtagcattactaggatggagctggctgcgccgacgcagagctcggggtatcccgcctggaccaactccatggccactcgtaggcaattttggccatgtattgctccctccctttctccggagaagatcttggctttcttctcggactcgtgctgccggaatcgacccatccgtgatcggtccgcaggtacttctggctcacctcgctagggtgtatgggtctattttttccttcttcatcggacactacctggttgttgtattgtccgattttcactcagtgagagaggcattagtgcaacaagcagaggtcttctctgatcgtccacgagttccactgatcagtattgtgacaaaggagaaaggcgtggtgtttgcccattacgggcctgtgtggcggcaacagaggaagttctctcactctaccctgcggcacttcggcctcgggaagctgagcctggagcctaagataatcgaggaatttaaatacgtcaaggctgagatgcagaagcatggtgaggatcctttctgtccattctcaattatctctaacgccgtgtccaacatcatttgctccctttgttttggccagcgcttcgattacaccaactctgagttcaaaaaaatgcttggcttcatgtcacgcggattagagatctgtctgaattctcaggtcctgcttgtcaacatctgcccatggctttattacctgcctttcgggcctttcaaagagctgaggcagattgaaaaggacattacgagctttctgaaaaagatcatcaaggaccaccaagaaagcttggaccgtgaaaacccacaggattttattgacatgtatttgctgcacatggaggaggagcgcaagaacaacagtaacagcagctttgacgaagaatatctgttctatattatcggagatctctttatcgccggaaccgacaccacaactaactcactgctgtggtgtctgctttatatgtcactgaaccccgacgtacaggaaaaagtccacgaggagatcgagagagtgattggagccaaccgggctccaagcctgaccgataaagctcaaatgccatatacggaagccacgataatggaggtgcaacgcttaaccgtcgttgtacccctggctatcccacatatgacctccgagaatactgtgctgcaaggttataccatccctaaaggcacgttgattctgccaaatctgtggtctgtgcaccgagatcctgcgatctgggagaaacccgaagacttctaccctaaccggttcctggacgaccaaggccagctcattaagaaggaaacatttatccccttcggaataggcaagcgtgtatgcatgggggaacagcttgcaaaaatggagttgttcctgatgtttgtgagtttaatgcagagctttgcatttgccctccctgaagacagcaagaagcccttgttaacgggcaggttcgggctgaccctggcacctcatccctttaacatcactatttctcgcaggtag

SEQ ID NO: 219876 - DNA, 1506 bp, Artificial Sequence
  Description of Artificial Sequence: Synthetic coding sequence
atgagctcacctggcccatctcaaccccctgcagaggatcccccttggccagctagactgctccgtgctcctctagtgggtaatttcgggcatgtgctactgcctccattccttagaaggcgctcatggcttagctcacggacaagagcagctggaatcgaccccagcgtgatcggtccccaggtgttactggctcatctcgcgagagtttacggctctattttcagtttcttcattggtcattacttggtggttgtgctgtcagatttccatagcgttagagaagctctcgtccagcaagctgaggttttcagcgaccgccctagagtgccactgatcagtattgtgacgaaagaaaagggtgtcgtctttgcccactacggcccagtgtggagacaacagcggaagttttctcattccacccttcggcacttcgggctgggcaagcttagcctggagcccaagatcatcgaggaatttaagtatgtaaaagccgaaatgcagaagcatggggaggatcctttttgccccttttccataataagtaacgctgtgtcgaatattatatgcagcctgtgtttcggccagcggttcgattacacgaattccgagttcaagaagatgctcggttttatgagccgagggctagagatctgtcttaattctcaggtattactcgtaaacatctgtccatggctctactacctgccctttggcccttttaaggaactgaggcaaattgagaaagacattacctcgttcttgaagaagatcattaaagatcaccaggagagtctggaccgagagaatcctcaggactttattgacatgtacctgctgcatatggaggaggagcgaaaaaacaatagtaatagcagcttcgacgaagagtacctcttttatatcataggcgatcttttcatagccggaactgataccaccacaaattcactgctctggtgcctcctttacatgagtcttaatccggatgtgcaggagaaagtgcacgaagaaattgagcgggtgatcggtgcaaaccgagccccaagcttgacagataaggcccagatgccttatacagaagccaccattatggaagtgcaaaggcttaccgtcgtcgtgccccttgcaatacctcacatgacttctgagaataccgtgctgcagggctacaccattcctaaagggacactgatcctgcctaacctgtggtccgtgcatagggaccctgcaatctgggaaaagcctgaagacttctaccctaatcggttcctggacgaccaagggcagctgattaagaaagaaacctttatcccctttgggatcggcaaaagggtgtgcatgggggagcagttagcaaaaatggagttgtttctgatgttcgtaagtttgatgcagagtttcgcctttgccctgcctgaagattcaaagaagccactgctcaccgggaggtttggacttaccctcgctccccacccatttaacattactatttctcggaggtag

SEQ ID NO: 219877 - DNA, 1398 bp, Artificial Sequence
  Description of Artificial Sequence: Synthetic coding sequence
atgctcctgctgggccttctgttgcttctacctctgttagccggagctaggctcttgtggaactggtggaaacttcgtagcctgcacttgccaccactggcccctggttttttacatctgttacagccagacttgccgatctacttacttggtttgacacaaaaattcggcccaatctatagactgcatctcggactgcaggacaaactggttagtaggaattatccagatctctccctaggcgactattctctcttatggaaagcccacaagaagctgacgagaagtgcgctgctgctgggaattcgggatagcatggagcccgtggtagagcagctgacacaggagttttgcgagcggatgcgcgctcaacccggaacccccgtagcaatcgaggaggaattcagtctgctgacatgcagtatcatctgctatctgactttcggagataagattaaggacgataacctcatgcccgcttattataagtgcatccaagaggtgctgaagacctggagccactggtcgatccaaattgtcgatgtgataccattcttgcggtttttcccaaatccagggctgcgtaggctcaaacaggctattgaaaaacgggatcacatcgtggagatgcagctccgccagcataaggagtccctggtcgctggtcagtggcgagatatgatggactatatgctccaaggggtggctcaaccttcaatggaggaaggcagcggccagctgctagagggacacgtacatatggctgccgtggatctgctaatcgggggtactgagactactgcaaacaccttgtcttgggccgtagtatttcttttacaccacccagagattcagcaacggctccaggaggagctggaccacgagctgggcccaggggcttcctcatctagagtgccctataaagaccgagcacgccttccgctgctcaatgctacaatcgccgaggttctacggcttcggcctgtcgtgccactggcgctgccacacagaactactaggcctagctctattagcggctatgacattccggaagggaccgttatcataccgaatctacagggggcacaccttgacgaaactgtatgggaaagacctcacgaattttggccggataggttcttggaacccggaaaaaacagtagagctctggcttttgggtgcggtgcacgggtgtgtctcggcgagcccctagcaaggctggagctgtttgtggtactcacccgactcctgcaagctttcaccctccttccatctggggacgctttaccctctctccagccgcttccccactgctccgtaatcctgaagatgcagccatttcaggttcgccttcaaccaagaggcatgggtgcccacagccccggtcagagtcaatag

SEQ ID NO: 219878 - DNA, 1488 bp, Artificial Sequence
  Description of Artificial Sequence: Synthetic coding sequence
atgctcctgctgggactgctgcttttgctgcccctcctcgctggcgctcgactcctttggaattggtggaaactgcgatctctgcacctgccccctctggcccctggctttctgcatttactccagccagacctccctatctacctcttgggcttaacccagaaattcggccctatctaccgactccatctcggccttcaggatgtggtggtgttaaacagtaagaggaccatcgaagaggccatggtgaagaaatgggcggactttgcgggaaggcctgaaccactgacgtacaagctggtgagccggaactatccggacctctctctgggggactacagtctgctctggaaagcccacaaaaagctgacccggtctgcattacttcttggtatccgtgactcaatggaacccgtggtggaacagctaacccaggaattctgtgaaagaatgcgggcacagccgggaacacctgtggccatcgaggaagagttctctttgttaacatgttccataatctgctatttaaccttcggggacaaaatcaaggacgacaatctgatgcccgcatattacaagtgcattcaggaggtgctaaaaacttggtctcactggtctatccagattgtggacgtgataccttttctgcgcttcttccccaaccctggtctccggagacttaagcaggcaatcgaaaaacgcgatcatattgtggagatgcaattgagacagcataaggagtccctggtcgccggacagtggagggacatgatggattatatgttgcagggagtggcacagccctccatggaagagggaagtggccagttactggaagggcacgtgcatatggcagccgtggacttgctaatcggaggaacagagactacagctaatacactgtcttgggcagtcgtttttcttctccatcatcccgaaatacagcagcggcttcaggaggagttggatcacgagctgggccctggagcctccagttcgcgagttccatataaggaccgtgctcgcctgccattgctcaatgctaccattgccgaggttctaagactcaggccagttgtccccctggccctcccccatagaacaactcggccttcttctataagtggctacgacatcccggagggcaccgtgattattcccaacctgcagggggcacatctcgacgagactgtgtgggagaggcctcacgagttttggcctgacaggtttctcgaaccaggaaagaactctcgcgcactagcgtttggctgcggcgcacgggtgtgcctgggcgagcctttggccagactagaactgttcgtcgtcttgactcggttgcttcaagccttcacattgctcccatccggggatgctcttccgtccttgcaacccttgcctcactgttccgtcatcctgaagatgcagcccttccaagtgcgattacagccaagaggtatgggcgctcattccccagggcaaagccagtag

SEQ ID NO: 219879 - DNA, 1488 bp, Artificial Sequence
  Description of Artificial Sequence: Synthetic coding sequence
atgttgttgctgggactccttctgctgctgcccttgttagccggtgctcgtctgctttggaattggtggaagctgcgatccttgcatctgcctccactggccccaggattccttcacttgctccagcctgaccttccaatctacctgctgggattaacccagaagttcgggcctatctatcgattgcacctcggcttgcaagacgttgtagttctaaacagcaaaaggaccatcgaggaggccatggtgaagaaatgggcggacttcgcagggagaccagagcctttaacctataagctggtgtcccgaaactatcccgacctcagcctgggggactatagtttgctctggaaagcccacaaaaagctgactcggagcgcattgctgttgggaatcagggattccatggaacctgtagtggagcagctcacccaggagttttgcgagagaatgcgcgcacagcctggcacaccagttgctatcgaggaagaattttccctgctgacctgttccattatctgttacctcactttcggcgataaaatcaaagacgataatctcatgcctgcttactacaaatgcattcaggaggtgttgaagacttggtcacactggagcatccagatagtagatgtgatccccttcttaaggtttttcccaaatccgggacttcgaaggctcaagcaggctatcgagaaacgagaccacattgttgaaatgcagctgagacagcacaaggagtccctggttgctggccaatggagggatatgatggactacatgttgcagggcgtcgcgcagcctagtatggaggagggctcaggacaactccttgaaggccacgtgcacatggctgccgtggatctcctgattggtggtactgaaaccaccgctaacactctatcctgggccgtcgtcttcctgctgcaccatccagagatacagcaacggttacaggaagagctcgaccacgagctgggaccaggcgctagcagctcccgggtcccctacaaagatagagcgagactgcctctcttgaatgccacgatcgctgaggtgctgagactgcgtccagtggttcccttggcccttccacacaggactactcggcctagttccattagcgggtacgacatccccgagggaacggtgataattcctaatctgcagggagcacacttggacgagacagtgtgggagcgaccccacgaattctggcccgaccggttcctggagcccggaaaaaactccagagccctggcgttcgggtgcggtgcccgagtgtgtctgggcgagcctttggcaaggctggaacttttcgtggtccttacaaggctgctgcaagccttcactcttctgccctctggagatgcgctgccttccctccagccactaccccattgttcagtaattttgaaaatgcagcccttccaggtgcgcctgcagcccaggggcatgggtgcccattctccaggacagtctcagtag

SEQ ID NO: 219880 - DNA, 1398 bp, Artificial Sequence
  Description of Artificial Sequence: Synthetic coding sequence
atgttactcctaggactgctgctgttgcttccactgctggccggagccaggctgctgtggaactggtggaagttgcgatctctccatctcccccctctggcccctgggtttctccatctcttgcagccagacctgcctatctatctgttaggcctcacccagaagtttggcccaatataccgtctccacctggggctccaggataagctggttagtcgaaattacccggacctgtccctaggcgactatagtctgctttggaaggcacataagaagttaacacggagcgccctgctgttaggtatccgggatagcatggaaccggttgtggagcaactgacccaggagttttgcgaacgcatgcgtgcccagcccggtacacccgtcgccatagaagaagagtttagtttgttaacctgtagcatcatttgctacctgacattcggggataagattaaggatgacaatctgatgcccgcttactacaaatgcatacaagaggtcctgaaaacgtggtcgcactggagcatccaaattgtcgacgtcataccgtttctgcggttctttcctaatcccggactgcgacgacttaagcaggctatcgaaaagcgcgaccacattgtggaaatgcaactgcggcagcataaagaatccctggttgctggccagtggagagacatgatggattacatgctgcagggggtggcccagcctagcatggaggagggtagtggccagttgctcgaagggcacgtgcatatggcagcagttgatctactgatcgggggaaccgagaccacagccaatactctgagctgggccgtggtgtttctactgcaccaccccgagatccagcagcgactgcaagaagagctggaccacgagttaggtccaggagcgtctagtagcagagttccttacaaggacagggctagattacccctcttgaatgcaaccatcgcggaagtgttacgcctgcggccagtcgtgcctctggcactgcctcacaggacgactaggccgtcgagtatatccggttacgacataccagaggggaccgtgattattcctaacctccaaggcgctcatttagacgagactgtgtgggaacggccacacgaattctggcctgaccgttttttggagccaggcaagaactcccgtgcactagcttttggatgtggagcccgagtgtgtctcggagagccattggcacgcctggaattgtttgtggtgctaactcggcttcttcaggcgttcactctccttcccagcggagacgccttgccttctctgcagcctcttcctcattgcagtgtcattctgaagatgcagcctttccaggttcgcctgcaacccagaggcatgggagctcacagcccgggacagagccagtag

SEQ ID NO: 219881 - DNA, 1398 bp, Artificial Sequence
  Description of Artificial Sequence: Synthetic coding sequence
atgttgttgctgggtctgctgctactgctgccccttttggccggtgctcgtttactctggaattggtggaagctgcgctcgctgcatttgccccctctcgctcccggattcttacatctgctgcagcctgacttaccaatctatctcctggggctaacacaaaaatttggccctatatacaggctccatttgggtctgcaggacaaactcgtcagccgcaactaccccgatctcagcctgggagattacagccttctttggaaggcacacaagaaactcacccgctcagccctattgcttgggatcagagatagcatggagcccgtggtcgaacagctgacacaagagttttgcgagcggatgagggctcagccaggaacacctgtggccatcgaagaagagttctctttactgacctgttcaataatatgctacttgactttcggcgataaaattaaggacgacaacctgatgcccgcttattacaaatgtattcaagaggtcctgaagacatggagtcactggtcgatacagatcgtcgacgtcattccgttcctccggttttttccaaaccccggtcttcgaaggctgaagcaagctatcgaaaagagggatcacatcgtggagatgcagctaagacaacacaaggaaagtctggtagcagggcagtggcgggacatgatggattacatgttgcagggtgtggcacagccgtctatggaggaggggagcggccagttactggaggggcacgtgcacatggccgcagtggacctcctcatcggcggaaccgagaccacagccaacacactcagttgggctgtcgtgttcctgctgcaccatcccgagatccagcaaagactccaagaggaactcgatcacgagcttggcccaggcgcttcttcctctcgcgtgccgtacaaagaccgcgctcgtcttccactcctgaacgcaacaatcgccgaagttctgcgcctgagacccgtggtgcctctggcacttccacatcgcacaacaaggccctccagcattagcgggtatgacatccccgaggggaccgtcataatccctaacctgcagggggctcacctggacgagacagtctgggaacgaccccacgagttttggccggacagatttcttgaacctggaaaaaactctcgcgcactggccttcgggtgcggcgcacgggtctgccttggtgaaccccttgcacggctcgaactttttgtggtgttaacccggctgttgcaggcatttacattgctgcccagcggggatgccttaccatccctacaacccctgccacactgtagcgtgattctcaagatgcagccattccaggtccgcctacaacctagaggaatgggagcacacagccctggccaatcccaatag

SEQ ID NO: 219882 - DNA, 1485 bp, Artificial Sequence
  Description of Artificial Sequence: Synthetic coding sequence
atgctcctcctcggcttgctgctgcttccactcttggctggcgcaaggcttttatggaattggtggaagctgcgctccttacacctgccgcctctggctccagggttcctccatctccttcaaccagatctgcctatttacctcctgggcctcactcaaaagttcggcccaatctatagactccacttaggcctgcaggacgtagtggtgctgaattccaaaagaaccattgaggaggcaatggtgaagaaatgggcagacttcgccggtagaccggaacctctaacatacaagttagtgtctaagaactatcccgatctgagtctcggagattatagcttactgtggaaagcccataagaagttaaccaggtccgccctgctactcggcattagggacagcatggaacctgtggtagagcagttgacccaggaattttgtgaacgaatgcgggctcaaccaggaacccctgtggcaatcgaagaggaattctccctcttaacctgctctatcatttgctacctgacctttggggacaagatcaaagatgataatttgatgcctgcctactacaagtgtatacaagaggtgcttaaaacttggtcacattggagtattcagatcgttgatgtaattccatttctgcgattttttccaaatcctggattgcgtaggctcaagcaagccatagagaaacgcgaccatatcgtggagatgcaattgcgccagcacaaggagtccctggtggcgggtcagtggcgggatatgatggattacatgttgcaaggggtcgcccaacctagtatggaggaaggatcgggccaattactggagggccatgtccacatggccgcagtggatctcttgataggagggactgaaacaacagctaacactctgagctgggctgtggtcttcctccttcaccatccagaaatccagcagagactgcaggaagagctggatcacgagctgggaccaggcgctagctcatccagggtgccttataaggatcgcgcacgtttaccacttttaaacgccactattgctgaagtgcttaggctaaggcccgtggtcccactcgcactccctcaccggacaacccgtccgtcctctataagcggatatgacattcccgagggaaccgtgataatccccaatctgcaaggcgctcaccttgacgagacagtctgggaacggccacacgaattctggccagacaggttcctggagcccggtaaaaactcccgcgcactggccttcggctgtggggcaagggtgtgcctaggcgaaccactggccagactggagttgttcgtcgtgttaacgcgactcctccaggctttcacgctgcttccgagcggcgacgcactgcccagtctccagccacttcctcactgctctgttatcctcaagatgcaaccctttcaggtgcgcttacagccaagaggaatgggggctcatagtcctggacagaaccaatag

SEQ ID NO: 219883 - DNA, 1485 bp, Artificial Sequence
  Description of Artificial Sequence: Synthetic coding sequence
atgctgctgctgggcctgctgctattgccactgcttgctggggcacggctgctatggaactggtggaagttacgctccctccatctgccacctctggccccaggatttctacatcttctccagccagatcttccaatctatctgctgggcttaacacaaaagttcggcccaatctaccgcttacacttgggcctccaggatgtcgtcgttctcaatagtaagagaaccatcgaggaagctatggttaaaaagtgggctgatttcgcgggacgcccagagccattgacctataagcttgtcagcaaaaattaccctgatttgagcttgggcgactactcactgctgtggaaggcacataaaaaactgacaagaagcgcgctgctgctggggattcgggactctatggaaccagttgtggaacagcttacccaggagttttgcgaacggatgcgggctcagccgggaacacccgttgctattgaggaggagtttagcctgctgacctgttccatcatctgctacctgacctttggggataagataaaagacgacaatctcatgcctgcatactacaaatgcattcaagaggttctgaaaacttggagccactggagtatacagatcgtggatgtcatcccttttctgcgctttttccctaatccagggttgcggaggctaaagcaggcgatagagaaaagagaccacatcgtcgaaatgcagcttaggcagcataaggagtcactggtggcgggacagtggcgcgacatgatggactacatgctacagggggtggcccagccttctatggaggaaggatcagggcagctcctggaaggccatgtccacatggctgcagtggatttgctgatcggcggaacagagacaactgcaaacacacttagctgggccgtcgtgttcttgctgcatcaccccgaaattcagcagagactacaggaggagctggatcacgaattagggccaggtgcatcctctagtagggttccttataaggaccgcgcaagactccccctgctcaatgcaaccattgccgaggtgctgcgcctgaggcccgtggttcctctggcgctgccacatagaactacccgcccttcatctatttcgggttatgatataccagaggggacggttatcatccccaacctgcaaggggctcacttagatgagacagtgtgggagcgaccccatgagttctggcccgacagatttcttgagcctggaaagaattcacgggctcttgccttcggctgtggcgcacgagtctgtctgggagagcctctcgccagactcgaactgtttgtcgttctgactcgactactgcaagcttttaccttgctcccttcaggggacgctctgcctagcttgcagcccctaccccactgctcagtgattctgaaaatgcagccttttcaggttagactgcagccaagaggcatgggtgcccattcacccggtcaaaatcagtag

SEQ ID NO: 219884 - DNA, 1488 bp, Artificial Sequence
  Description of Artificial Sequence: Synthetic coding sequence
atgttgttattaggtttactgcttttgctgccactgctagccggagcccgattgttgtggaattggtggaagcttcggtcactgcatctccccccattagccccaggtttcctgcatctactgcaacctgaccttcccatatacctgctagggctgacccagaagtttgggccaatttaccggctccatttgggactccaggacgtggtggtcttaaacagtaagcggacaatcgaagaagccatggtgaagaagtgggctgacttcgccggaagacccgagcctctcacatataagctcgtcagtcgcaattaccccgacctgagcctgggggactattcccttctgtggaaggctcacaaaaagctcacccggagcgccctgctgttgggaatccgggattccatggagccagtggtcgagcaactgacgcaagagttctgcgaacgaatgagagctcaacctggcaccccagtggccatcgaggaagaattctctctgctgacctgttcaattatctgctatcttacatttggcgacaagattaaggatgacaatctgatgcccgcttactataaatgcatacaggaggttttgaagacctggagtcactggtcgatccagattgtggacgtgatcccctttctgcgcttcttccccaatcccggactccggagattgaagcaggcgatcgagaagcgcgatcacatagtggagatgcagctcaggcagcataaagaaagccttgtcgcgggacagtggcgcgatatgatggattacatgctgcagggcgtggcacaaccgagtatggaggagggctctggccagttgctcgaggggcacgttcatatggctgctgtggatctactgatcgggggaaccgaaacgacagcaaacacactgtcgtgggctgtcgtgttcctgttgcatcatccagaaattcaacagaggctacaggaggaactcgaccacgagttgggccctggagcaagctcgagcagagtcccttataaggacagagcaagacttcctctgctgaacgctacgatcgccgaagttcttcggctgaggcctgttgtccccctggcattgccacaccgcaccactaggccatccagcatctcaggctacgatattcccgagggcaccgttattatccccaaccttcaaggcgctcacctcgacgaaactgtttgggaacgaccccacgagttctggcccgaccggtttctcgaacccggaaagaacagcagagccttagcttttggatgtggagctcgcgtatgcttgggagaaccactagctagacttgaactctttgtggttcttactagactgttgcaggcttttactcttctgccaagtggggacgctctgccttctttgcagccactgccacactgctctgtcattctgaaaatgcaacctttccaagtgcggttacaacctcgtggaatgggagcgcatagcccaggacaaagccagtag

SEQ ID NO: 219885 - DNA, 1395 bp, Artificial Sequence
  Description of Artificial Sequence: Synthetic coding sequence
atgcttctcctgggccttctactgttgcccctgctggctggagccagactcttatggaattggtggaagctccggagcctgcacctcccaccacttgccccaggcttcctgcacctgctccaacctgatctgcccatctacctgttgggactaactcagaaattcgggcctatctatcgacttcacctgggcctgcaggacaaactggtttctaagaactacccagacctgagtctgggagattatagcctgctgtggaaggctcacaagaagttaacccgatccgccctgctgcttggtatccgcgattcaatggaacccgtggtagaacaactcacccaggagttctgcgagcggatgagagcccagccaggaacgccggtggcaattgaagaggagttcagcttgctgacctgctcgatcatctgctatctgaccttcggggacaaaataaaggacgacaacctgatgcctgcctattataagtgtatccaagaagtgctgaagacctggagccactggtctattcagattgtggatgtgattccttttttaagattttttcctaaccctggtttgcgcaggctgaaacaggcgattgagaagcgggaccatatcgtggagatgcagctgagacagcacaaagagagtctggtagccggacagtggcgcgacatgatggattatatgctgcagggggttgctcagcctagcatggaggaggggagcggccagctgcttgaggggcacgtacacatggcagctgtagatctcctgattggcggtacagagacaaccgccaatactttgtcctgggccgtggtgttcttactgcatcacccagagatacaacagaggctgcaggaagaactggaccacgaactgggccctggcgcatcctccagcagggtgccttataaggaccgagctcggctacccctgctgaatgcaactatcgccgaggttttgcgcctcagaccggtggtccccctcgcccttccacatcgaactacccgccctagcagtatttccggctatgacatacccgaaggcacggtgatcattcccaatctccaaggcgctcacttagacgagacagtgtgggaacggccacatgagttctggcctgatcggtttctagagccaggtaagaacagccgagctctggcatttggttgtggagccagagtgtgtctgggcgagcccctggcgagactcgaactttttgtcgttttaaccaggttactgcaagcattcaccttactccctagcggggacgccttaccctctcttcaaccactaccacattgctctgtgattctcaaaatgcagcctttccaggttagactgcaacctcggggtatgggggctcatagtcctggacagaatcagtag

SEQ ID NO: 219886 - DNA, 1398 bp, Artificial Sequence
  Description of Artificial Sequence: Synthetic coding sequence
atgctattgctgggacttctgttgcttttgccactgctggccggagccagactgctctggaactggtggaaactgaggtctctgcacttaccacctctggctcctgggttcctgcatcttttgcagccagacctccctatctacctcctgggacttacacagaaattcgggcctatttatcgattacacctggggttgcaggacaaactcgtgagcaggaactatccagatttgagcttgggagattattccctgctctggaaggcacacaagaaactgactcggagtgctctgctcctcggcatccgggacagcatggaaccagtggtggaacagcttactcaggagttctgtgagcggatgcgagcccaaccaggcactccggttgcaatagaggaagagttcagccttctcacctgcagcattatctgctacctgaccttcggagacaaaattaaagatgataacctgatgcccgcatattacaaatgcatccaggaagtgctgaagacctggtcgcattggagcatccagattgtcgacgtcattcctttcctgagattctttcctaatccgggtctgagacggctgaaacaagctatcgagaagcgcgaccatattgtggaaatgcagttgcgccaacataaggaatccctggtcgctggccaatggcgcgacatgatggattatatgctgcagggcgttgcacaaccctcaatggaggagggctccggacaacttttggagggacacgtgcacatggccgctgttgatcttctgattgggggaactgagacaactgccaatacattgtcctgggctgtggtatttctgttgcaccatccagagatccaacagcggctgcaggaggagctagaccacgaactagggccaggtgccagctctagccgggtgccttacaaggacagagctcgactacccttactgaacgcaactattgctgaggtacttcgattgcgtccagtggtgcccttagcactgccccataggaccacaagaccgagtagtataagtggctacgatatcccagaagggactgtaattatcccaaacctacagggcgctcatctcgacgaaacagtctgggaacggccacatgagttctggcccgaccgcttcctcgagcccggaaaaaattcccgtgcactggcctttggctgtggggcacgcgtctgtttaggagagcctttagctagattggagctgtttgtggtgttgacacggctgttgcaagcatttacactgctcccgagtggggacgctctgccttccctccaaccgctgcctcattgttcggtgattttaaagatgcaacccttccaggttcggctccagccaaggggaatgggcgcacatagtccaggtcagtcccagtag

SEQ ID NO: 219887 - DNA, 1395 bp, Artificial Sequence
  Description of Artificial Sequence: Synthetic coding sequence
atgctgctgttgggactgctcctgctgccactgctggccggagcgaggctgctgtggaattggtggaaactacgttctctccacttgccaccactggcacctgggttcttacacctcctgcaaccagatctgccgatctatctgttaggcttgactcagaaattcggtcctatctacagactgcatttgggtctccaggataaactggtctctaaaaactacccagatctctccctgggcgactatagcctgctttggaaagcccataagaagttaacccggtcagctctgctgcttggcattagggattccatggagcccgtggtcgagcagttgacccaggagttctgtgagcgaatgcgggctcagcctggcactccagtagccattgaggaagagttcagtctgctgacatgtagtattatttgctacctgacctttggggacaagattaaggatgacaatctgatgcccgcatattataagtgtattcaggaagtgcttaaaacatggagccactggagcatacagattgtggacgtgataccttttctgcgcttcttcccaaaccccggactgcgcagactgaaacaggctatcgagaagcgggaccatatagtagaaatgcagttacggcagcataaagaatcccttgtagccggacagtggagagacatgatggattacatgctgcagggagtggctcagcctagcatggaagaagggtccggtcaattgctggagggccatgtccacatggccgctgtggacctgctgatcggcggtaccgaaaccacagccaacaccctaagctgggctgtggtatttctgcttcatcatcctgaaattcagcagagactgcaggaagagctagatcatgagctgggacctggagcctcctcgtcccgcgtgccatacaaagaccgggcaagactgccattgctcaacgccactattgcagaagtgctgagactgagacctgttgtgcctctggccctcccccaccgaactacccggccttcaagtatcagtgggtacgacatccctgaggggacagtgatcattcctaatttgcagggcgcacatctggacgaaacagtgtgggagcggcctcacgagttctggccggaccgattcttggagccagggaaaaattcaagagcactggctttcggatgtggagccagagtgtgcctcggtgaaccacttgccagactcgaactgttcgttgtgctcacgcgcctgctgcaggccttcaccctgctcccatctggagacgcgctaccatccctccaacctcttccccattgctcagtgatcctcaagatgcagccattccaggttagattacagcccaggggcatgggtgcacattcacccggacagaaccagtag

SEQ ID NO: 219888 - DNA, 1488 bp, Artificial Sequence
  Description of Artificial Sequence: Synthetic coding sequence
atgctactgcttgggctcctactcctcctgcctctcctggccggtgccaggctgttgtggaattggtggaaattgaggagcttgcatttgctgcctctggctcccggtttcctgcatttgctacagccagacctgccaatttacctgctcggtttgacgcaaaaattcggtcctatttaccgtctgcacctgggtctgcaggacgtggttgtcctaaattctaagcgtacaatcgaggaggccatggttaagaagtgggcagacttcgccggaagacctgaaccattgacttataaacttgtgtccaaaaattatccggatctctccctcggcgactatagcctgctgtggaaagcgcacaagaagttaacacgctccgccctgctgttaggaatccgggattcaatggagcctgttgtagaacagctgacccaggagttctgcgagcgcatgcgcgcacaacctgggacacccgtcgctattgaagaggaattttccttgttaacctgcagcatcatttgttatttgacctttggggataagattaaagacgataacttaatgcccgcatactacaagtgcatccaggaagttcttaagacctggtcccattggtctatccagattgttgacgtcatcccgttcctgaggttctttccaaaccccggtctccggaggttgaagcaggcgatagaaaagcgagatcacattgtcgaaatgcaactgagacagcataaggagtcactggtcgcaggtcagtggcgggatatgatggattatatgctacagggcgtcgcccagccttcaatggaggagggttcaggccagctgttggagggtcacgtccatatggccgctgtcgacctgctcatcgggggaacagagactaccgctaacacgctgagttgggctgtagtttttctgctgcatcaccctgaaattcaacagcgtctgcaggaggaattggaccacgaactggggccaggggcttcatccagccgggtcccctataaagatagggcccgactccctcttttaaatgccacaatagcagaggtcctccggctccgacctgttgtacctctcgccctcccacacaggacaacacggccttccagtatcagcggatacgacatccccgagggcaccgtgatcattcctaatcttcagggcgctcatctggacgaaacagtctgggagcgccctcatgaattttggcccgatcgcttcctggaaccaggtaagaacagtagggcactggccttcgggtgtggtgcccgtgtgtgtctgggagagccccttgcccgattagagctctttgtggtattgacacgcctcctgcaggccttcacgctgctgccctcaggagatgctctgccgtccttgcagcctctgccacattgttccgtgatcttgaagatgcaaccattccaggtaagactccagcccaggggaatgggagcccatagcccaggtcagaaccagtag

SEQ ID NO: 219889 - DNA, 1488 bp, Artificial Sequence
  Description of Artificial Sequence: Synthetic coding sequence
atgctcctcctcggcttacttctcctgttgcctttgctcgctggggctcgcctcctgtggaactggtggaagctgcgcagtctgcatttacccccactcgctccaggattcttacacctgctgcaacccgacttgccaatctatctgctcggtctgacacaaaaatttggcccaatttatagactgcacttgggccttcaggacgttgttgtgctgaattctaaaagaacaattgaggaagctatggtcaagaagtgggccgactttgctggcaggcctgagccacttacctacaagctggtgtcaaaaaactaccctgatctctccctgggagactatagtctcctgtggaaggcccataagaaactgacccgaagcgcccttctactgggcataagagacagcatggaacccgtggttgaacagcttacacaggaattttgcgaaaggatgagagcacagcctggaactcccgtcgcaatcgaggaggagttctcactgctgacatgctctatcatatgttaccttacattcggcgacaaaattaaggacgacaacctcatgccggcttactacaagtgtatccaggaggtgctcaaaacatggtcacactggtccatccaaatcgtcgatgtcattcccttcctgaggttcttcccaaatccgggtctccggagactgaagcaggctatagagaagcgggatcatattgttgaaatgcagctgcggcagcacaaggaaagtttggtggcagggcagtggagagatatgatggactatatgctacagggtgtggcccagccatcaatggaggaaggctcaggccagctgctagagggacacgttcatatggccgcagtggacctccttatagggggaactgagacgacggcgaacacactgagctgggccgtggtctttcttcttcatcatccggaaatccagcagagattacaggaggagctagatcacgaactcggtcctggagcttcttcctcccgggtcccatacaaagatcgggctcgccttccattactgaacgccactattgcagaggtgctgcgcctgcgccctgttgtccctcttgcgctgcctcataggactacccgccctagctctatctcaggttacgacattccggaggggaccgttatcattcccaatcttcagggcgctcaccttgacgagactgtttgggaacgtccccacgaattttggcccgaccggttcctggagccaggtaagaattcccgtgcactggctttcggttgtggcgcaagagtgtgtttaggggaaccactggcgaggcttgaacttttcgtcgtcctcacccgtctgcttcaagcttttacgcttctgccgagtggcgatgccctgccctctctgcagccactgccccattgctctgtcatcctgaaaatgcaaccatttcaggtccggctccagccacggggaatgggtgctcattcgccgggacagaaccagtag

SEQ ID NO: 219890 - DNA, 1398 bp, Artificial Sequence
  Description of Artificial Sequence: Synthetic coding sequence
atgctcctgctgggattactattgctgctgcccctcctcgccggtgccaggcttttatggaactggtggaagctgcgatctctgcatcttctgcccctggcacccggatttcttcatcttcttcagcccgacctgcccatctaccttttgggcttgacccaaaagttcgggcctatttacagactgcatctcggtctgcaggataagctggtgagtaagaattatccagatctctcacttggagactacagcctcttatggaaggctcataagaagctgacgcgctcggcattgttgctggggatacgtgactctatggagcccgtagtagagcaactgacacaggaattctgcgagcgcatgcgcgcacagcccggtaccccagtcgctatcgaggaagagttttccctcctgacctgctctataatctgctatttgacttttggagacaagattaaagatgacaacttgatgcctgcatattataaatgcatccaggaagtgctaaagacttggtcacactggtctatccaaatcgtggatgtcatcccctttctgcggttcttcccaaatcccggactgagaaggcttaagcaggctatcgagaaacgagaccatatcgtggaaatgcaactcagacagcacaaggagtctttggttgctggtcagtggagagatatgatggattatatgcttcagggggtggcccagcctagtatggaggaaggctccggacagttgctggagggtcatgtgcacatggctgcagtcgacctactgatcgggggtaccgaaaccaccgcaaatactctatcttgggcagttgtcttcctgctgcaccaccccgagatccagcagaggctccaggaggagctggatcatgagctcgggccaggcgcatcctcaagtcgagtgccctacaaggatcgggcaagactgcccctgctgaatgcgaccattgcagaggttctgcgcttgaggccagtagtgccgctggcactcccacaccgcactacaaggccttcttctatctccggatatgacatccccgaaggaacggtgatcatacctaacctacagggagcacacctcgacgaaacggtgtgggagagaccacacgagttttggcccgaccgtttcctggaacccggtaaaaactcacgggctctggcctttggatgcggtgccagggtctgtttgggcgagccgttagcaaggcttgaactcttcgttgtcctgacaaggctgctgcaggccttcacactgctgccatccggtgacgcactgcctagcttgcagcctctgccacactgttcagtaatcctcaaaatgcagccatttcaggtgcgcttacagcccagaggaatgggtgcgcacagtccgggacagaatcaatag

SEQ ID NO: 219891 - DNA, 1704 bp, Artificial Sequence
  Description of Artificial Sequence: Synthetic coding sequence
atgcatggccgactcaaggtcaagacatccgaagagcaagccgaagccaagcgccttgagagggagcagaaactaaaactatatcagtcagccacacaggccgtgttccagaagcgccaggcaggggaactcgacgaatctgtgctcgaactgacctctcaaatactaggagctaatcccgatttcgcgactttgtggaactgtcgacgagaggtgctgcagcagctggaaacccaaaagtctccagaagagctggccgctctggttaaagctgaactgggatttctggaatcctgtctgcgcgttaatcccaagtcctacggcacatggcatcaccggtgctggctgctaggacgccttcccgagcctaactggacaagggagctcgagctctgcgcacgtttccttgaagtggatgagcggaacttccattgttgggactaccgcaggttcgtcgcaacccaggccgctgtcccccctgccgaagaactggccttcacagacagtttgattacacggaatttttcaaattatagctcctggcattacaggagttgcctgctccctcagttgcatcctcagcctgattcaggaccgcaaggtcggcttccggaggacgtattattgaaagaactcgagctagtgcagaatgccttcttcaccgatcccaatgatcagagtgcatggttctatcataggtggttactgggtagagccgacccccaggacgcgttgagatgtttgcacgtgtctagagacgaggcatgtttgactgtatcattctcccgccctctactggtgggctcacgaatggagattcttctcctaatggtggacgattccccattaattgtcgagtggagaactcccgacggcagaaataggccaagtcacgtgtggctctgtgatctgcccgcagccagtctcaatgatcaactgccgcagcatacgtttcgggttatctggactgccggtgatgtgcagaaagaatgcgtattgctcaaggggagacaagagggatggtgtcgagattcaacaacggatgagcaactgtttaggtgtgaactatccgtcgaaaaaagcactgtgctgcagtccgagttggaatcatgtaaagaactccaagaactggagccagaaaacaaatggtgccttctcacaattatcctcttaatgcgcgcactcgatcccctgttgtacgaaaaagagactctgcagtatttccagaccctgaaagcggtggatcctatgagagctacttaccttgacgacttgaggagtaagtttttactcgagaactccgtgctgaaaatggagtatgctgaagtaagggtattacacctggcccataaggatctgaccgtcctctgtcatttggaacagctactgctggttacacatctcgatttgtcccacaatcgattgaggacgctgccgcctgctttggccgcactacgctgcctcgaggtgctccaggcttccgacaacgccattgagagcttggacggcgttacgaacctgcctagattgcaagagctccttctctgcaacaacagactgcagcagccagcggtgctgcaaccactggcaagctgcccccgtctagtgttgctaaacctgcaaggcaaccccctgtgtcaggctgtcggtatcctggagcagctggctgagctcttaccgagtgtgagctcggtgctcacttag

SEQ ID NO: 219892 - DNA, 1347 bp, Artificial Sequence
  Description of Artificial Sequence: Synthetic coding sequence
atgagctctcctataagcaagtcccggagcttagccgctttcttgcaacaattgcgttccccaagacagccacctaggctcgttactagcaccgcctacacaagccctcagcctagagaagtgcctgtctgccccctgacggctggcggagagactcagaatgctgcagccctcccgggtccaacatcgtggccactcctcgggtctttgctgcagatcttatggaaaggcggtcttaagaagcagcacgatacacttgtggagtaccataagaagtacggcaaaatcttcaggatgaagctgggatcatttgaatctgtccatttggggagcccctgcctgttggaagccctgtatagaaccgaatcagcgtatcctcagaggttggagatcaagccttggaaggcctacagggactaccgaaaggagggctacggactcctcatcctcgagggtgaagattggcagagggtcaggtccgccttccagaagaagctcatgaagcctggggaggtaatgaaattggacaacaaaattaatgaggtgctggctgatttcatgggcagaattgacgaactgtgtgatgagagaggtcacgtggaagatttgtactcggagctgaataaatggagctttgagagcatctgccttgtactctacgagaagcgctttggcctcctgcagaaaaacgctggggacgaagctgtgaattttatcatggccatcaagaccatgatgtccacatttgggagaatgatggttacaccagtcgaactgcacaaaagcctgaacaccaaggtttggcaggatcatacccttgcttgggacacaattttcaagtcagtgaaggcttgtattgacaacagacttgagaagtattcacagcagccatccgccgactttctgtgcgatatttatcaccagaatcggttgagcaagaaagaactatacgctgccgtcaccgaattgcagctggctgccgttgagactacagccaacagcctgatgtggatactgtacaatctgtccagaaatccccaggttcagcagaaactccttaaggagatacaatcagttctccctgaaaaccaagtgccgagagccgaggatctgagaaacatgccctatctgaaagcttgcctaaaggagtccatgcgactcacccccagtgtcccctttacgacaagaactctggataaagccactgtcctgggggagtacgccctgccaaaaggcatagtaaggaaatacgacattcaggctacagataatgaacccgttgagatgctgcactcaggcacactcgtccctagccgggagctacccatcgcgttctgccaacggtag

SEQ ID NO: 219893 - DNA, 1371 bp, Artificial Sequence
  Description of Artificial Sequence: Synthetic coding sequence
atggataagttgaataaaataactgtgcctgcgagccaaaagcttcgacaactgcagaagatggtacacgacataaaaaataacgagggcggaataatgaataaaataaaaaagttaaaggttaaggcgcctccctccgttcccaggcgcgattatgcctcagagtcccccgctgacgaggaagaacagtggtccgacgatttcgactctgattacgaaaatcctgacgaacattcagattctgaaatgtatgtgatgcctgctgaggagaacgctgatgacagctacgaaccccctccagtcgagcaggagacacgccctgtgcatcctgctctgccattcgccaggggggaatacatcgacaaccggagcagccaacggcattctcccccattctctaagacgcttcccagcaagccttcttggccatcagagaaagctagactgacctctacgttaccggcactgacagcacttcaaaaaccgcaagtgcctcctaagccaaaggggctgctagaggatgaagctgactacgtagtaccagtcgaagataacgatgaaaactacattcaccccactgagagctcgagtccacccccagagaaagccccaatggtgaataggtctactaagccaaacagttcgaccccagcctctccaccgggaaccgcttctgggaggaacagcggagcctgggaaacaaagagcccccctcctgctgctccatctccactgcccagagctggcaagaaaccaacgacacccctgaaaactacacctgtggcttcccaacagaacgcctcctcggtgtgcgaagaaaaaccgattcccgctgagcggcacagaggcagctcacacaggcaagaagccgtgcagagccctgtctttccacccgcacagaagcagattcatcagaagcctatccccttgcccagattcacagagggcggtaatcccactgtggacggacctttgccatccttcagtagcaattcgaccatttcagagcaagaggccggtgtgctgtgtaagccatggtacgctggagcatgcgatcgcaagagtgccgaggaggccttgcaccgctcaaataaagatggctccttccttattcggaagtctagtggacatgactctaagcaaccttatactctggtggttttctttaataagcgggtgtacaatatccctgttcggttcatcgaagctacgaagcagtacgccctcggtcgaaaaaaaaacggcgaagaatatttcggaagtgtggcggagatcataaggaatcatcagcattctcctttagtgctaattgactcccaaaataacaccaaagattccacacggctcaagtatgctgtcaaggtgtcctag

SEQ ID NO: 219894 - DNA, 1287 bp, Artificial Sequence
  Description of Artificial Sequence: Synthetic coding sequence
atgaagaggagaaaatacgggtttatctataaaacccatttgtttgggagaccaacagtccgtgtaatgggggcagataacgtgcgaaggatccttcttggagaacacaggttagtctctgttcactggcccgcaagtgtgagaacaattctgggatccggttgcctgagtaacctgcatgactcatctcataaacagcgaaagaaagtcataatgagagcgttctcccgtgaagccctcgaatgctacgttccggtcatcactgaggaggtgggatcttcactcgagcaatggctgagctgcggggagcgagggctcttggtgtaccccgaggtaaaacgactcatgtttcggatcgccatgaggattctgcttggctgtgaaccacagctagcaggcgacggagattctgaacagcaattagtggaggcattcgaagaaatgactcgcaaccttttttctttgccaattgacgtgccattctcaggcctctaccgcggtatgaaggcgagaaacttaattcatgctcgcatcgaacagaacatacgtgcgaaaatctgcggacttcgagctagtgaagcaggtcagggctgcaaagacgccctccagttgcttatcgaacactcttgggaaaggggtgaaaggctggacatgcaggccctcaagcagagctctacggagcttctcttcggcggtcacgagactacagcctctgccgcaacttcacttatcacatatttgggcctttaccctcatgtacttcaaaaggtgcgggaggagctgaagagcaaaggcctgttatgcaaatccaaccaagacaacaaactagatatggaaatcctcgaacagcttaaatatattggctgtgtgattaaggagacactgcgtttaaacccaccagttccgggaggctttagggtggctcttaaaactttcgagcttaacggctaccagataccaaagggctggaatgtgatttacagtatatgtgacacccacgatgttgcggagatctttacaaataaggaagagttcaatcctgaccgctttatgctgccccacccagaggacgccagcaggttttccttcatccctttcggtgggggtttgcggagctgtgtggggaaagagtttgccaagattctgttgaagatctttaccgtcgaactcgcccgacattgcgactggcagctgctcaacggaccccctactatgaaaacctctcctactgtgtatccagtggataatctgcccgctcggttcacacactttcacggtgagatatag

SEQ ID NO: 219895 - DNA, 1287 bp, Artificial Sequence
  Description of Artificial Sequence: Synthetic coding sequence
atgaaaagaaggaaatacgggtttatatacaagacccatctgttcgggcgacccacagtcagggtaatgggtgcagataacgtgcggcgtatccttttaggcgaacaccggttggtctccgtgcactggccagcatccgtgagaaccatcctgggcagtggctgcctgtccaacctccatgactctagtcataagcaaaggaagaaagtgatcatgagggctttttccagggaagctctggagtgctacgttcccgttattacagaagaggtcggctccagcctcgaacagtggctctcctgtggcgaacgcggactgcttgtgtaccccgaggtaaaaagactgatgtttcggatcgcgatgcgaatactgctcggatgcgagccacagttggctggcgatggcgactctgagcagcaacttgtggaggccttcgaggagatgacacgaaatcttttctccctcccaattgatgtcccattttccgggctttacaggggaatgaaggcacgtaacctgattcacgcccgaatcgagcagaatattcgtgcaaagatctgcggactgcgtgcttcagaggcgggtcagggatgtaaagacgctctgcagttacttatcgagcattcttgggagcgaggggaacggttggatatgcaagctctgaagcagtcttcaacagaactcttattcggtggtcacgaaacaactgcttccgctgcaactagtctgataacctatctggggctgtacccccacgtgttgcagaaagtacgggaagaactgaaatccaagggcctcttatgcaaatccaaccaagacaataagctagacatggagatattggagcagctgaaatatatcgggtgcgtgattaaggagactttaagactgaatccaccagttcctgggggatttagagttgccctaaaaacatttgagctgaatggataccagatccccaaagggtggaatgtcatctattctatttgcgacactcacgacgtggccgagatattcaccaacaaggaggaattcaacccagatcggttcatgcttccccacccagaagatgcctccaggttctcgttcatccccttcggcggaggactccggagctgcgttggaaaagaatttgcgaagattctcttgaagatatttacagtcgagctggccagacactgcgactggcagctactcaacgggccacctaccatgaagacttcccccactgtgtatcccgtggacaatttgccagccaggttcacccacttccatggcgaaatatag

SEQ ID NO: 219896 - DNA, 1569 bp, Artificial Sequence
  Description of Artificial Sequence: Synthetic coding sequence
atgttcccctgggggctgagctgcctgagtgttttgggcgctgcgggaacagccctactgtgcgcaggtcttctcctttctctcgcgcagcatctgtggactctgagatggatgctaagcagagacagagcttccacacttccattgccaaaaggaagcatgggctggccattcttcggagaaacactgcactggcttgtgcagggcagcagatttcatagcagtcgccgagaaagatacggaaccgtcttcaagactcatctgctcggaagaccggtgattagagtttcaggtgctgagaacgtgcgaactatcctactcggtgaacaccggttagttcggtctcagtggccccagagtgctcatattctgctaggaagccatacgcttctgggcgcagttggtgagccacaccgcaggcgaagaaaagtactggctcgcgtcttctccagagccgctcttgagcgatatgtgccacgcctgcaaggagccctgcgccacgaggtgcgcagctggtgtgctgcaggaggtccagtaagcgtctacgatgcatcgaaagcactcacatttcgcatggctgcccgtatcttgttggggctcaggctcgatgaagcgcaatgtgctacccttgctcgtacatttgagcagctggtggagaatctcttctcccttcctctggatgtgcctttcagtgggctgagaaaaggcattagagcgcgagatcagctacataggcacctggaaggtgccatcagcgaaaagctgcatgaggataaggcagcagaaccgggagacgccctggatctcattattcactcagccagagaattaggtcatgagccttccatgcaagagctgaaggaaagcgctgtcgagctcctgtttgccgcttttttcaccacagctagcgcctcgacctcactagtgctgctccttctgcagcatcctgctgcaattgccaagattcgggaagagctggtagcacagggactgggaagggcctgtgggtgcgcccctggcgctgctggcggttccgagggccctcccccagactgtggttgtgagcccgacctctctctggctgccttaggacgattaagatatgtggattgcgtggttaaggaggttcttagactgcttccacccgtgagtggcggatacagaaccgcattgcgcacttttgaactggacggctaccagataccaaaaggctggtctgttatgtatagcatcagggacacccatgagacagccgctgtttaccgatcccctcctgaggggtttgacccggagcggtttggggcagctagagaggatagcaggggtgcgagctcacggtttcattatatcccgttcggcggtggggcaaggtcttgtctgggacaggagctcgcccaggcagtcttgcaactgctggccgtagagttagtgagaaccgccaggtgggaactagccaccccagcctttcctgctatgcagaccgtcccgatcgtgcaccctgttgatggactgagactgttttttcaccccctcacgccgtccgttgccggtaatggcttgtgtttatag

SEQ ID NO: 219897 - DNA, 1596 bp, Artificial Sequence
  Description of Artificial Sequence: Synthetic coding sequence
atggccgcactgggctgcgcaagactgcgctgggcccttagaggtgcagggcgtgggctctgcccacacggcgcaagggctaaggctgccatccctgccgcactgccgagcgataaggcgactggcgcacccggtgccggacccggtgtacgccgtagacagaggtcattggaggagatcccacgcctagggcagcttagattcttttttcagctctttgtccagggatacgcactgcagctgcatcaacttcaagtcttgtataaggctaagtatggtccaatgtggatgtcttatcttgggcctcaaatgcatgtcaatctggcatctgcgcctctgctagagcaggtgatgcgacaggaggggaaatatccggtgcgcaacgatatggagctgtggaaagagcatagagatcagcacgacctgacctacggcccatttacaacggaaggtcaccactggtaccaactcaggcaggccctgaatcaacggcttctgaaaccagccgaggctgccttatacacggacgccttcaatgaggttatagatgacttcatgactcggctggaccaattacgcgcagagagtgcttcaggcaaccaggtctcagatatggcacaacttttttactacttcgcgttagaagcaatctgctacattctattcgagaaacgcatcgggtgtctgcagagatctattccagaggacaccgttacttttgtacgctcgattggactcatgttccaaaactctctgtacgcaacttttctgcctaagtggactcgtccagtgctgcctttctggaaaagatacctggatgggtggaatgccatctttagtttcggaaagaagcttatcgacgagaaattggaggatatggaagcacaattgcaagccgcaggaccagacgggatacaggtctctgggtatttacacttcttgctggcttccggtcaacttagtcccagagaagccatgggctcactcccggagctgctgatggccggagtggatactacatcgaataccctgacttgggctctttaccatctgtcaaaagaccctgagattcaggaagccctccacgaagaggtcgtcggggttgtcccggctggccaggtgcctcaacacaaggattttgcccacatgcccctgctgaaagccgtcctcaaggaaaccctcagattatatcctgtggttcctacaaattccagaattatcgagaaagagattgaagtggatggctttctgttcccaaaaaatacccagtttgtcttttgccactacgtagtgtctcgtgacccaacggccttctcggaacccgaaagctttcagcctcacagatggctgcgcaatagtcagcctgcgacccctaggattcagcatccgttcgggagtgtgccattcgggtacggtgtgagagcctgtctgggccgacgaattgcggaactggagatgcagttgctgctggcaaggctgatccagaagtacaaggttgtgctggctcctgagaccggtgagttgaaatcagtggcccgaatagtgttagtaccaaacaagaaggtcggccttcagtttctgcagcgtcaatgctag

SEQ ID NO: 219898 - DNA, 1572 bp, Artificial Sequence
  Description of Artificial Sequence: Synthetic coding sequence
atgagtttccataaagaggacggcgtaaatagtctctgtcagaaagctctacatatcgtcactgagctgtgcttcgcaggtcaggtggagtgggagaagtgcagcggaatattcccccgagataggggatcacaagggggatcaagtaccgacatcagcgttagtctgctagccgtggtagtgagcttttgcggtttggccttgctcgtggttagtcttttcgtgttttggaaattgtgctggccctgctggaaatcaaaaccggtgacctcaaacattaccactctcccacagtctatctcgtctgcgccaactgaggtcttcgagaccgaggaaaagaaggagattaaggagaacgaaaaacctgcagtaaaagccatcgagccagccatcaagatctcgcacacttcacccgacatcccggctgaggtacagacagcactaaaagagcacctgattaagcacgcccgagtgcaaaggcaaattaccgaacccacgtcatccacaaggcattccagctttagaaggcacctgcccagacagatgcaggtcagcagcgtcgattttagcatgggcacggagccggtcctgcagcggggtgagacaaccacttcaattggtcggatcaagcctgagttgtataagcaaaaaagcgtggacagtgaaggaaatcagaacgaggacgtcaaaatctgcggaaaactgaatttcaccctgcagtacgactacgaaaatgaactgctcgtcgtcaaaatcattaaagctctggacctacctgccaaagactttacagggacttctgatccatacgtgaaaatgtacttgctgcctgaccggaagaaaaaattccaaactcgagtccatcgcaagactctgaatccccttttcgacgaaacattccagttccccgttgcttatgatcagctctccaaccgcaagctgcacttttccgtttacgattttgaccgattctcaaggcatgatatgatcggagaagtgattctggacaacctatttgaggtcagcgatcttagcagagaggcgaccgtgtggaaggacattcactgtgccacaaccgagtccattgaccttggagagataatgttctccttgtgctacctgcctacagccggacgcatgacactcaccgtcatcaagtgtaggaacttgaaggcaatggacatcactgggagtagtgacccctatgttaaggtctcccttatgtgcgagggaagacggctgaagaaaagaaagactacgaccaaaaaaaacaccctgaacccagtttacaatgaagctatcattttcgacattccccctgagaatgttgatcaagtcagtctatccattgctgtcatggactatgatcgggttggacacaacgaagtgattggcgtgtgcaggacaggcctggacgcagagggtctaggaagggaccattggaacgaaatgcttgcttatcatcgaaagcctatcacccactggcatccactgctcgagctgcctggccgagcgacaagttttgactcccaggggagttgtccatctccaaaacctccaagcacaccctag

SEQ ID NO: 219899 - DNA, 1512 bp, Artificial Sequence
  Description of Artificial Sequence: Synthetic coding sequence
atggcccttatacctgatctggctatggaaacctggctgctgctggccgtgtctttagtgctgctgtatctctacggcactcattcacacgggctgtttaagaagctcggtataccaggacccactcccctaccatttctgggcaacattctctcctaccacaaaggattctgtatgttcgatatggaatgtcacaagaagtacggcaaggtttgggggttttacgatggtcagcaacctgtgctggcaattactgacccggacatgatcaaaaccgtgctcgtgaaggagtgctattccgttttcaccaatcgcaggccatttggaccggttggcttcatgaagtcagccatcagcatcgccgaagacgaggagtggaaaaggctgcggagtctgctgtcccccactttcacaagcggaaaactgaaagaaatggttccgataatcgcccagtatggcgacgtattggtgaggaatctgcgacgagaggcagagacggggaagcctgttaccctcaaggatgtgtttggagcctacagcatggacgtcatcaccagcacgtctttcggggtgaatatcgattcactgaacaacccacaggatcccttcgtcgagaacaccaaaaagttgctgagatttgatttcttggatccatttttcctttccataaccgtgttcccctttttgataccaattctggaggtactcaatatttgcgtcttcccaagggaggtgactaatttccttaggaaaagcgtgaaacggatgaaagagtctagactggaagacacacaaaagcatcgggtcgacttcctccagcttatgattgactctcagaactccaaagagactgagtctcataaggctctctctgacctggaactagtggctcaatctattatattcatctttgccggttatgaaactacttcttcagtcctgtctttcatcatgtatgaactggcaacccatcctgacgtgcagcagaaactgcaggaggagatcgatgccgtgctgcccaacaaggcaccccctacatacgatactgttctgcagatggaatatctggacatggtggtaaacgaaactcttcgactgttcccaatcgctatgcgcctcgagagagtgtgtaagaaagacgtcgagattaacggtatgtttatccctaagggcgtggttgtaatgattcctagctacgctctgcaccgcgaccctaagtactggaccgaacccgagaaattcctacctgaacgcttcagtaagaagaataaagacaatatcgacccttatatttataccccatttggatccggccctagaaactgtatcggcatgaggttcgcactgatgaacatgaagctggctctcatcagggtgcttcaaaacttcagcttcaaaccgtgtaaggagacccaaatccctctgaagttgagcctcggtggcctgctgcagccagaaaagcccgtcgttctcaaggtggaatcgcgggatggcaccgtgtccggcgcttag

SEQ ID NO: 219900 - DNA, 1062 bp, Artificial Sequence
  Description of Artificial Sequence: Synthetic coding sequence
atggccttaatccccgatctcgctatggaaacatggttactgctggctgtaagcttagtgttgctgtatttagtgtttggcgcatactccatggatgtgattacctctacttctttcggcgtgaatatagatagcctgaataatccccaggacccctttgtcgagaacacgaagaaacttctccgctttgacttccttgatcccttttttttgtctattactgttttcccattccttatcccaatcttagaagttctcaatatctgcgtttttcctcgtgaggtcaccaactttctgcgaaaatccgtaaagagaatgaaggagagcaggctagaggacacccagaaacaccgggtggattttttgcagttgatgatcgattcacaaaactcaaaggagactgagagtcacaaggcactgtccgatctggagctcgtggcccagtccatcattttcatattcgccggttacgaaacaaccagctctgtactgagttttattatgtatgaactggcaacacacccagacgtccagcagaagctgcaggaggagattgatgctgtgctcccaaacaaagcgcctcccacttacgacaccgtgttgcagatggagtatttggatatggtggttaatgaaacgctcagattattcccgatcgctatgcggctggaaagagtgtgcaagaaagacgtggagatcaacgggatgttcattcccaaaggagtagtagtaatgatccccagctacgcgctccacagagatccaaagtactggacagaacctgagaagtttttaccagaaagatttagtaagaagaataaggacaacattgatccctatatatatacaccttttggaagcggcccacggaactgtattgggatgaggtttgcactgatgaacatgaaactcgccctgatacgggtcctgcagaactttagcttcaaaccttgtaaagaaacacagatcccactcaaattatcgttaggagggctgcttcaaccagagaagccagtggtgctgaaagtggaaagtagggacggcactgtaagtggtgcatag

SEQ ID NO: 219901 - DNA, 240 bp, Artificial Sequence
  Description of Artificial Sequence: Synthetic coding sequence
atggtgcctataatcgcgcagtatggagatgtacttgtccgcaacttgcggagggaggccgaaactggaaagcccgttacccttaaagacgtgtttggggcatattccatggacgtcatcactagtacctccttcggggtgaacattgacagtctgaacaacccacaagaccccttcgtcgagaataccaaaaagctgctgagattcgactttctggaccctttttttctcagtatctag

SEQ ID NO: 219902 - DNA, 1068 bp, Artificial Sequence
  Description of Artificial Sequence: Synthetic coding sequence
atggctaagcttattgccttaaccttactaggcatgggacttgcgcttttccggaaccatcagtcatcctaccagacacgactgaacgcactaagagaggtacagcctgtggagttgcctaactgcaacctggtcaaggggatagagactggctctgaggacctggagatccttcccaacggtctggcctttattagcagcggacttaaatatccaggaattaagtccttcaatccgaatagtccgggtaaaatcctcctcatggacctgaatgaggaagaccccaccgtgctcgagctcggcattactggtagcaagttcgacgtgagttcgtttaacccacacgggatctcaacgttcacagatgaagataatgccatgtaccttttggtagtgaaccaccccgacgctaaatcaactgtggagctttttaagtttcaggaggaggagaagagcctgttgcacctgaagactatccggcacaagttgctccctaacctgaatgacatagtcgcagttggccctgagcatttttacggcaccaacgatcactacttcctggacccttaccttcagtcttgggagatgtacttgggtttagcatggtcatatgtggtttactacagtcctagtgaggtgcgggttgtcgcagagggtttcgacttcgctaacggaataaatatttcccctgatgggaagtatgtctacatcgccgagctgctggctcacaaaatccatgtgtatgagaagcacgcgaattggaccctgaccccactcaaatctctggattttaatacgttagtggataatatctccgtggatccggagacaggtgacctgtgggtggggtgccaccccaacggcatgaagatttttttttatgactctgagaatccccctgcctctgaggttctgcgaatacagaatatactgaccgaggagccgaaagtcacacaggtgtacgccgaaaatgggaccgtattacagggcagcacagtggcttccgtatataaagggaagctgttaattggcaccgtctttcacaaggcgctttactgtgaactctag

SEQ ID NO: 219903 - DNA, 1263 bp, Artificial Sequence
  Description of Artificial Sequence: Synthetic coding sequence
atggaccttattcctaattttgcaatggaaacttgggtgctggtggccaccagcctagtgctcctctacatttacggcacgcactcccacaaattgttcaagaagttaggcatacctggaccaacccctctgccattcctgggcaccatcctcttctatttgcggggactgtggaactttgatagagagtgcaatgagaaatacggagaaatgtggggcctctatgagggccagcagcctatgctagtcattatggatcctgatatgatcaaaacagtcctggtaaaggagtgctatagcgtgtttacaaaccagatgcccttggggccaatgggttttctaaaatctgcactgagctttgccgaggacgaggagtggaagcggatccgcacattactcagccccgcatttacctccgtgaaattcaaagagatggtgccaattatctctcagtgcggcgatatgcttgttcgtagcctcaggcaggaggccgaaaacagcaagagcataaacttgaaagactttttcggcgcttacacaatggatgtgattacagggacattattcggtgttaatctggacagcctgaacaatccccaagaccccttcctgaagaatatgaaaaagttgttgaaattggacttcctcgatccgttcctgcttctgatctccttatttccgttcctgacgcccgtctttgaggcactcaacattggattgtttcctaaagatgtgacacactttctgaagaattctattgaacgaatgaaggagtctaggctgaaggataagcagaagcacagggtcgactttttccaacaaatgatagattcccagaatagcaaggagacaaagagccataaggcgttgtccgaccttgaactcgtagcacagagcattatcatcatattcgcagcctatgacaccacttctactaccttgccctttattatgtacgagctggcaacccatcctgacgtccaacagaaactccaagaggagattgacgcagttctcccgaacaaggcacccgtgacctacgacgctctggtgcagatggagtatctagatatggttgttaatgagactcttcgcctgtttccagtcgtcagcagggtgaccagagtttgtaagaaagacatagaaatcaatggcgttttcattcctaaaggcctcgcagtgatggttcccatctacgctttgcaccacgatcctaagtattggacggagccagagaagttctgccccgaaagaagtcattag

SEQ ID NO: 219904 - DNA, 843 bp, Artificial Sequence
  Description of Artificial Sequence: Synthetic coding sequence
atgaatctggagaccggtaatgggccacaccacttcccgatgtggcgctatgtaggagagaagcctgaggccggatctagggaacaacaagtgcaccaactcgagagatttctgtggggcctgcatcacggctgcaaccattggcatatcatctggagcgaactcggtttttctcagcagagcacgcgatctttgtcagagaagtacgaagaggcttttaagattgggttcttcggatcattgttcaccttaaatatacagtcattggcagtgctcccacgacctgaatgtatggtgcggtcagggctcaccgagaccagcacatcttgggtgcgcgttattttgttacctcagcccccagaggagctcgggcttcagcaccgagttgatttctttcagcagatgatcgactcccagaattcaaaggaaaccaaaagccataaagccctaagcgatctagaattggtggctcagtccattattattattttcgccgcttacgataccacatcgacaaccttgccatttataatgtatgaactcgcaacacatccggatgtacagcagaaactgcaagaggagatcgacgcagtgttgccaaacaaagcgccagtgacttacgatgcactggtgcagatggagtaccttgatatggtcgtgaacgaaaccctacgcctcttcccagtggttagccgagtgacaagggtctgcaaaaaagacatagaaattaacggagtgttcattccaaaagggctggctgttatggtgcctatctacgcactccatcatgatccaaagtactggacagagccagagaaattctgtccagagagatctcactag

SEQ ID NO: 219905 - DNA, 1512 bp, Artificial Sequence
  Description of Artificial Sequence: Synthetic coding sequence
atggatcttatcccaaactttgcgatggaaacttgggtcttggtcgctactagcctggttctgctttatatatacggcacccactcacataagctatttaagaagttgggtatccccggaccaacaccactacctttcctcggcacaattctgttctatcttcgcggtttgtggaattttgaccgtgagtgcaatgaaaaatacggagaaatgtgggggctctacgaggggcagcagcccatgctggtgatcatggaccctgacatgataaagacggtcctggttaaggaatgctattccgtatttactaaccagatgccactggggcctatgggcttcctgaagtcagcattgagcttcgcggaggatgaagagtggaagcgaatccgaactctcttgtcacctgcatttaccagcgtaaaattcaaagagatggtgccaattatctcacagtgcggtgatatgctggtccgatccctgcggcaggaagctgaaaacagcaagtctatcaatctcaaggatttttttggcgcttataccatggacgtgattacaggcaccttgtttggcgtgaatctggacagcttgaacaatccacaggacccatttctgaaaaacatgaaaaaacttctaaagctggacttcttagacccgttcctgctgcttatatccttgttcccttttctgactcccgtattcgaagccctcaatatcggcctcttccctaaagatgtcactcatttcttaaagaatagcatcgagcgaatgaaagagtctagactgaaggacaaacaaaaacatcgcgtggactttttccagcagatgatagatagccagaacagcaaggagacaaaatcccataaggctctgagtgatttagagttagtggcccagtcaattatcataatcttcgctgcatatgacactacgtccactactttgcccttcatcatgtatgagcttgccactcacccagacgtccagcaaaaactgcaggaggagatcgacgctgttctccccaacaaagcacctgttacatacgatgcacttgttcagatggagtatctcgacatggtggtcaacgagactctgaggctcttccccgtggtgagtcgggtgaccagagtttgtaagaaggatattgaaattaacggggtgttcatcccaaagggccttgctgtcatggttcctatctacgctcttcatcatgacccgaagtattggactgagccagagaaattctgccctgagcgtttctccaagaagaacaaggacagcatcgatctatatcgctacatacccttcggggcaggccctcggaactgcattggtatgaggtttgcactgaccaatatcaagttggcagtcatccgggcactccaaaatttcagctttaaaccgtgtaaggagacccaaattcccctgaaacttgataatctccctattctgcaacctgagaaacccatcgtgctgaaggtgcacctgcgagacgggattacatccggcccttag

SEQ ID NO: 219906 - DNA, 381 bp, Artificial Sequence
  Description of Artificial Sequence: Synthetic coding sequence
atggatctcatccccaactttgcgatggagacctgggtcttggtggctacctccctcgtattgctgtatatctatggtacacactcacacaagctttttaagaaactgggaattcccggacctaccccactccccttcctagggactattctgttctatttaagaggcctctggaattttgaccgggaatgtaacgagaagttcttatggggactacaccacggctgtaatcactggcacatcatctggtcagaactgggatttagtcagcaatcaactcgttctctgagtgaaaagtacgaggaggccttcaagattggatttttcggctccctgtttaccctcaacatcaccttgtcaatcagctaccccagtttttag

SEQ ID NO: 219907 - DNA, 225 bp, Artificial Sequence
  Description of Artificial Sequence: Synthetic coding sequence
atggacctgatccctaattttgctatggagacctgggtcctcgtggccacgtctcttgtgcttctctacatctatgggacacatagtcacaagctgttcaaaaagttggggatccccggaccaactccacttcctttcctgggtacaatcctgttctatctgcgaggtttatggaactttgatagggagtgcaacgagaaatacggagaaatgtgggggccttag

SEQ ID NO: 219908 - DNA, 435 bp, Artificial Sequence
  Description of Artificial Sequence: Synthetic coding sequence
atgcctaaagtgaagcgctcccggaaagcacccccagatggctgggagttaattgaacctaccctggatgagttagatcagaaaatgagggaggccgagacagagccccacgagggaaagaggaaggtggagtctctgtggccaattttcagaatccaccatcagaaaacccgatatatcttcgatttgttctataagcggaaggctatcagcagggagctatatgagtactgcataaaagaaggatatgctgacaaaaacctcatcgcaaagtggaagaagcagggatatgaaaatctctgctgcttgaggtgcatccaaactagggacacaaacttcggtactaattgcatttgtagggttcctaaaagcaagctggaggtcgggagaattatcgagtgtacacactgcggatgcagaggctgttctggctag

SEQ ID NO: 219909 - DNA, 120 bp, Artificial Sequence
  Description of Artificial Sequence: Synthetic coding sequence
atggatctcatacctaacctcgctgtcgagacctggttgcttctagccgtgtcactcgtgctgctctacttgatgcgggtccccaaaagcgctaaaagccctctgactaagcaaacttag

SEQ ID NO: 219910 - DNA, 1479 bp, Artificial Sequence
  Description of Artificial Sequence: Synthetic coding sequence
atgcaactgctgatgctcgaactgttgctgttgttcattgtgtacgggacgcggacccacgggctgttcaaacgcctggggatcccagggcctacacctctccctctgctgggaaacgtcttgagctacagacaaggactctggaaattcgataccgaatgctacaaaaagtacggcaaaatgtgggggacctacgaggggcaactccccgtgttggccatcaccgaccctgacgttatccgcactgtactggtaaaggagtgctatagcgtcttcactaataggcggtccctggggcctgtgggttttatgaagtctgcaataagcctggcagaggatgaagagtggaagaggattcgatcactgctctcccccacgtttacttctgggaagttgaaagagatgttccctataattgctcagtatggggacgtcttggtcaggaacttgagacgcgaggccgagaaggggaagcccgtgaccctgaaagatatctttggcgcatactcaatggatgttattaccggcacctcgtttggggtcaatatagatagccttaataacccccaggatcccttcgtcgaaagtacaaagaagtttctgaagtttggtttcctcgaccctttatttcttagtatcattcttttcccgtttttgaccccggtattcgaagcattaaacgtgtctctgttccccaaagacaccatcaactttctcagcaagagcgtgaatagaatgaagaagagtcgtcttaatgataagcagaagcatcggctggatttcctccagttaatgattgatagccagaattccaaagaaactgagagccacaaggccttaagtgacttggagctggctgcccaaagtatcatattcattttcgcaggttatgagaccacctcatcagtcctgtcatttacgctgtacgagcttgccacgcatcccgacgtccagcagaagttacagaaggagattgatgcagttctgcccaacaaggcaccgccaacctatgatgcagtcgtccagatggaatatctggatatggtggttaacgagaccttgaggttattcccagtggcgatacgactggagcggacgtgcaagaaggatgtggagatcaatggggtttttattcccaagggaagcatggtggttattccaacatacgccttgcatcatgaccccaaatattggactgagccggaggagttccgaccagaacggttctccaagaaaaaggactccatagacccctatatctatactcctttcgggaccggcccaagaaactgcattgggatgcgttttgcacttatgaacatgaaactcgctttgattcgcgtattgcagaacttcagctttaagccctgcaaagagacgcaaattcctctgaagctggatacacaaggcctgcttcagccagaaaaacctatcgttctgaaagtcgattccagggacggcactctttctggggaatag

SEQ ID NO: 219911 - DNA, 1602 bp, Artificial Sequence
  Description of Artificial Sequence: Synthetic coding sequence
atggatcttataccgaatctcgccgtggagacgtggttgctcctcgccgtgtcactcattctgttatacttatatggtacgcggacacatgggctgtttaaaaagctgggaattccaggtcccacccccttgccgttcttaggcaacgcgctgtcattccggaagggttactggacatttgacatggagtgctataagaaataccgcaaggtgtgggggatttacgactgccagcaacctatgctagccatcaccgacccagatatgattaaaactgtcttggtgaaggagtgctactcggtcttcaccaaccgtagaccttttgggcctgtggggtttatgaagaacgcaatatccatcgctgaggacgaggagtggaaacggatcagatctttgctgtctcctaccttcacctccggcaaattgaaagaaatggtgcccattattgcacagtacggtgatgtccttgtgaggaatcttcgaagagaagctgagaccgggaagcccgtgaccctgaagcacgttttcggagcatactcaatggatgtcataactagtactagttttggtgtgtccattgactcccttaataacccccaagacccgttcgtagaaaatacaaagaaactccttagatttaacccactggatccctttgtactgtcaataaaagttttcccgttcctaacaccaatcctggaagccttgaatattacagtttttcccagaaaagtgatcagttttctgaccaagtctgtgaaacagattaaagagggaagactcaaggagacacaaaagcacagggtcgactttctgcaacttatgatcgattcccagaattccaaagacagcgagacccacaaagctctctccgacctggagctgatggcacagtctatcatctttatctttgcgggttatgaaacaacttcctcagtgctgtccttcatcatctacgagctggcgacccacccggatgtgcagcagaaggtgcagaaagaaattgataccgttctcccgaataaggcccctcccacatacgatacagtgctccagctggagtacttggacatggtcgtgaatgagacactgcgcctctttccagtcgccatgcggctggaacgggtttgtaagaaggatgtggaaattaatggcatgtttatccctaagggggtggtggtgatgatcccttcctatgtgctgcatcatgaccccaagtattggcgagaacccgaaaaatttctgcccgaaagattttcgaagaagaacaaggacaatatcgatccttacatctatactccattcggcagtggtcctagaaattgcattggtatgcggtttgcgctggtgaatatgaaactggcactggtccgtgtgctgcagaactttagttttaaaccttgcaaagaaacccagatccccctgaagctaagattcgggggtttgctacttacagaaaaaccgatcgtacttaaggccgagtctcgggacgagacctttgtagatatggaaccgatccacatggattttttgcggtctcttgcctttcaggggcctcacctttgtttcttctgggagctcctgtgcccaaccatcaggtag

SEQ ID NO: 219912 - DNA, 1512 bp, Artificial Sequence
  Description of Artificial Sequence: Synthetic coding sequence
atggaccttattcccaatctggccgtcgaaacctggctgctgttagccgtgagcctcattttgttgtatctctatggcaccagaacccacgggctgtttaaaaagctgggcatcccaggccctactcccctgccctttctgggtaacgctctgtcctttcgtaagggttactggacttttgacatggaatgttataaaaagtaccggaaggtgtggggcatttatgactgtcagcagcctatgttggcaattaccgacccagatatgatcaaaacagtgctggttaaggagtgctactccgtcttcactaaccggcgtccttttggcccagttggatttatgaaaaacgcaatatctattgcagaggatgaagaatggaagcggatcaggagtctgctgtcccctactttcacttctggcaagctgaaagagatggtgccaatcatcgcacagtatggagacgtcctggtaaggaacctgcggcgtgaggccgagacaggcaaacctgttaccttaaaacatgtgttcggtgcttacagtatggacgtcattacgtctacctcatttggtgtgtctatcgactctctgaacaatccccaggatccttttgtggaaaacacaaaaaaactgttgagattcaacccattagacccatttgtgttgtctatcaaggtgttccctttccttaccccgattcttgaggccctgaatataaccgtgttcccaaggaaagtgatctcatttctcaccaaatccgtaaagcagatcaaagagggcagactgaaggagacccagaaacatcgggtggactttctgcagctcatgattgactcgcagaactctaaggattcagagactcacaaggcactgtctgatctggaacttatggcccagtccataattttcatcttcgcgggttacgaaaccacctcctctgtgctgtctttcattatctacgagctggcaactcaccctgatgtgcagcaaaaggtgcagaaagagatcgacaccgtgctaccaaacaaggcacctccaacctacgacaccgtcctccagctggaatacctagatatggtggttaacgaaaccttgaggttatttccggttgccatgaggctggagagagtttgcaagaaagacgtcgagatcaacgggatgtttattcccaagggagtggtggtgatgatccccagctacgttcttcaccatgatcccaaatactggcgggagcctgagaaatttttgcccgaacggttcagcaagaaaaacaaggacaacattgatccatacatatatacccctttcggatccggccctcgcaactgcatcgggatgcggtttgcacttgtgaacatgaagcttgcactggtgcgcgttctgcagaatttttctttcaaaccttgcaaggaaactcagatccctctgaaattgcgatttggtggtctgctactgactgagaagcctatcgtcctgaaagctgagagccgagatgaaaccgttagtggggcatag

SEQ ID NO: 219913 - DNA, 1410 bp, Artificial Sequence
  Description of Artificial Sequence: Synthetic coding sequence
atggaacttatctccccaaccgttattatcatcttgggctgcctcgccctgtttctgcttctccagcgaaagaacctccgtcgccctccgtgcataaagggttggattccttggattggcgttggattcgaattcggcaaagcccctttggagttcattgaaaaggccagaataaagtacggccctatctttacagtatttgcaatgggaaacaggatgaccttcgtgacagaagaagaaggcattaacgtttttttaaagagtaagaaggttgatttcgagctggcagtgcagaatattgtgtaccggaccgcaagcattccaaaaaatgtgttcctggccctgcatgagaaattgtatatcatgctaaagggcaaaatggggaccgtgaatctgcaccagttcaccggccagctgactgaggagctacatgaacagctcgaaaatctgggcacccatgggacaatggacctcaataatctcgtgaggcacctgctgtatcctgtcacagtgaatatgctgttcaataagtcactgttcagcaccaacaaaaagaaaatcaaggaattccatcaatacttccaggtgtacgatgaggattttgagtatggcagccagcttccggaatgtcttctgcggaactggagcaaatccaagaagtggttcctggaacttttcgagaagaacattccagatatcaaggcgtgtaagagcgcaaaagataattctatgaccttgctgcaagccaccctggacattgtggaaacagagacttcaaaagagaatagccctaactacggtctgttgctgctctgggcatccctctccaatgcagtgccggtcgcgttttggacgcttgcgtatgttcttagtcatcctgacattcataaagctatcatggagggtatctcttctgtgttcggaaaggcgggtaaagataagatcaaggtgagtgaggacgatctagaaaatctgcttctgatcaaatggtgcgtgcttgagactatcaggctaaaagctcccggagtgatcactaggaaggtcgtgaagccagtagagatcttgaattacattatcccatcgggagatttacttatgctttcccctttctggttgcatcggaatcccaaatacttccctgagcccgaactgttcaagccggagagatggaagaaggctaacctcgaaaagcatagcttcctcgactgctttatggcttttgggtcaggaaaattccagtgcccggcacggtggttcgctctgctggaggttcagatgtgtatcatcctgatactgtataagtatgactgtagtctgctggatcccctccccaagcagtcctatttgcatctagttggggtgccccagccagaaggacagtgcaggatcgaatacaagcagcgcatttag

SEQ ID NO: 219914 - DNA, 1560 bp, Artificial Sequence
  Description of Artificial Sequence: Synthetic coding sequence
atgagcgtgagtgtgctctccccgtcccgactgcttggggatgtctcagggatcttgcaagccgctagcctcttaattcttttactgctgctgattaaagcagtccagttatacctgcaccggcagtggctcctaaaagccctacaacagttcccatgccccccttctcattggctcttcggccatatccaggaactgcagcaggaccaggaactgcaaaggatccagaagtgggtcgagactttcccatccgcgtgcccccattggctttggggcggaaaagtgagagtgcagctctacgatccagattacatgaaggtcatcctcggcagatccgatcctaagtcacacgggtcataccgttttctcgccccttggattggttatggccttctgctgctgaacggccagacatggtttcaacacagaagaatgctgactccagccttccattacgatatccttaaaccgtacgtgggcctgatggcggatagtgtgagagtgatgctggataagtgggaagaactgttgggccaagattcaccccttgaagtgtttcagcacgtgtcacttatgaccctggacacaataatgaagtgtgcattctctcaccaggggagcatccaggtcgaccggaacagtcagagttatatacaagcaatcagtgatctgaacaaccttgtattttctagggttcgcaatgccttccatcaaaatgacactatttattccctcaccagcgctggcagatggacccacagggcatgccagctggcgcaccaacataccgaccaagtaatacagttgcggaaggcgcaattacagaaggagggcgaactcgaaaaaatcaaacgtaaacggcacttggactttctggacatattgctactggctaagatggagaatggcagcattttatcagataaagatctgcgagcggaggtggatacattcatgtttgaaggtcatgataccacagcctcaggcatcagctggattctgtacgccctcgctacccaccccaagcatcaagaaagatgccgagaagagatccactctctactcggcgacggtgcttctatcacttggaaccatctggaccagatgccatacaccacgatgtgcatcaaagaagcgctgaggctttacccacctgtgccaggtatcggacgcgagttaagcaccccagtcacttttcccgatgggaggagtctacctaagggcataatggtgctgctcagtatctacgggctgcatcataaccctaaagtttggccaaaccctgaagtctttgatccattccggttcgcaccaggcagtgctcaacattcccacgcctttttgccgtttagcgggggaagccgaaactgtatcggtaagcagtttgccatgaacgagctcaaagtggccaccgcgctgacccttttaagatttgagttactccctgatcccaccaggatacctatacccatcgcccgattggtgttaaaatccaaaaatggaatccatcttcgcctgcggaggcttccaaatccttgtgaggacaaggatcagctttag

SEQ ID NO: 219915 - DNA, 1563 bp, Artificial Sequence
  Description of Artificial Sequence: Synthetic coding sequence
atgtccgtctctgtgctcagccctagcagactgctgggtgatgtctcagggatcttgcaggctgcttccctgctgattcttctgctgttactgattaaagcagtgcagctctacttgcacaggcaatggctgctgaaggccttgcagcagttcccctgtccgccttcccattggctgttcgggcacattcaggaactccagcaggaccaggagttgcagaggattcagaagtgggtggagaccttcccgtctgcctgcccacactggttgtggggaggaaaagtgcgggtgcagttgtatgaccctgactacatgaaagttatactaggtcgctcagaccccaaaagccacgggtcctaccgcttcctggccccatggattggatacgggctcctactgttgaatgggcagacctggtttcagcaccgcagaatgttgacccctgcttttcattacgatattctcaagccctatgtggggttgatggcggatagtgttcgcgtcatgctcgataaatgggaggaactgctagggcaggactcacctcttgaggtgttccagcatgtctccttgatgaccctggacacaattatgaagtgcgctttctctcatcaggggtcgatccaggtcgacagaaacagccaatcatatatccaagccatctctgacctcaacaatctggtgttctcccgtgtacggaatgcctttcaccaaaatgatacgatttattctctgacctccgctgggagatggactcaccgcgcatgccagctggcgcatcagcacacaggggatcaggtcatccaactgcgaaaagcgcagcttcaaaaagaaggtgaactggagaagatcaagcgcaaaagacaccttgattttctagacattctgctgcttgcaaagatggaaaatggtagcatactgagcgataaggacttacgcgcagaggtggatactttcatgtttgagggccacgatacaacagcttccgggatttcttggatactatacgcccttgctacccaccccaagcaccaggaacgctgccgcgaggagatccacagcctgttaggtgacggggcttccatcacatggaaccatctggaccagatgccctacactaccatgtgcatcaaagaagctttacggttgtatccccctgtgcccggaatcggacgcgagcttagcacacccgttaccttccccgatggacgttccctcccgaaaggcattatggtgctgctgagcatctacggtctgcaccacaaccccaaggtctggcctaaccctgaggtatttgaccccttccgcttcgcaccagggtctgcacagcatagccatgcttttctcccattctccgggggatcccgcaactgtatcggcaaacagttcgccatgaatgaactgaaagtggctaccgcactcactttgctccgcttcgagctactcccagacccaactcggattcctattcccattgccaggctcgtactgaagagcaaaaatggcattcatttacgactccgcagactgcctaacccttgcgaggacaaagaccagctgtag

SEQ ID NO: 219916 - DNA, 1368 bp, Artificial Sequence
  Description of Artificial Sequence: Synthetic coding sequence
atgtcagtgtcagtcctgtccccctctagactcttgggcgacgtttctgggattttgcaagccgcttcactgctgatactcctgctgctgctgatcaaggcagttcagttgtacctgcacaggcagtggctgctgaaggcgctgcagcagttcccatgcccccctagtcactggctttttggacacattcaggaacttcagcaagaccaggagttgcagcgtattcagaagtgggtggagacttttccgtctgcatgcccacattggctctggggcggtaaggtacgggttcagttgtatgaccctgactatatgaaggtgatattgggaaggagtgatcccaagtcacacgggtcctaccggttcctcgccccatggatcggatatgggctgttgctgcttaacgggcagacatggttccaacacaggaggatgctgacccctgcattccactacgatatcttgaagccttacgtgggactgatggccgactcggtccgagttatgttggacaagtgggaggagctcctcgggcaggattcgcctctggaggtcttccaacatgtgtcacttatgactttggataccatcatgaagtgtgcttttagccaccagggcagcattcaagtcgaccggaactctcagagctatatccaagcaatttccgaccttaacaatcttgtgttttctcgagtccgcaatgcattccaccagaacgacactatctattctttaaccagtgccggacgatggacccatcgcgcttgccagctggctcatcaacataccgaccaagtcattcagcttagaaaggcacagctacagaaggagggcgaacttgagaagattaagcggaagagacatttggatttcctggatattctgcttcttgcaaagatggaaaacggctctatactgtctgataaggacttgcgggctgaggtggatacattcatgttcgaggggcatgatacaactgcgtccggaattagctggattttgtacgccctcgccactcacccaaagcatcaggaacggtgtagagaagaaatccattcgcttctgggggatggggctagtattacctggaaccatctggatcagatgccttacaccacaatgtgcattaaagaagctttgcgcctctacccaccagtgccaggtataggcagagaactgtccactccagtgaccttccctgacggccgttccctgcctaagggcataatggtcctgttatcaatctacggcctccatcataaccccaaagtgtggcctaaccccgaggtgttcgacccgttcagatttgcaccaggaagcgcccaacattcccacgcctttctccctttttccggcggaagtcggtag

SEQ ID NO: 219917 - DNA, 474 bp, Artificial Sequence
  Description of Artificial Sequence: Synthetic coding sequence
atgaaggtcattcttggcaggtccgaccccaaaagtcacggctcctaccgatttctagccccatggattggctatggacttcttttgctaaatggccagacttggttccaacatagaaggatgcttactcctgccttccactacgacattctaaagccctacgtaggactcatggctgatagcgtccgcgttatgttggataaatgggaggagctcctgggacaagacagtcctttggaagtatttcagcacgttagcctcatgacgctggacactattatgaagtgcgcatttagccatcagggctcgatacaggtcgacaggcccagcgacccgacagaagaggggtccacgactgagggcggtggggctggcgaagatcaggaggaagaagcatttggattttccgggtacccacctctgggtcagaatggtgagtgggagcatttggttaggcaaggacctccttgttag

SEQ ID NO: 219918 - DNA, 1575 bp, Artificial Sequence
  Description of Artificial Sequence: Synthetic coding sequence
atgccacagctctcgttgtcctggctcggtctcggacctgtggctgcttcgccctggctgctgctcttactcgtggggggttcctggctcctcgctcgtgtccttgcctggacctatacgttctacgacaactgcagaaggctccagtgttttccccagccccctaaacaaaactggttttgggggcatcaaggtctggtcacacctacggaggaaggtatgaaaactcttacacagctcgttactacataccctcagggcttcaagctctggctcggtccaacctttccccttttaatcctgtgtcacccagacattatccgcccaatcacctcagctagtgccgctgtggctcccaaagatatgatattctacgggtttcttaagccctggctgggagatggcctgttgctaagcggcggagataaatggtctcgtcatcggagaatgctcacccccgcatttcactttaatatcctgaaaccctatatgaagatttttaataaatccgttaatatcatgcacgacaagtggcagaggctcgcctcagaggggtccgcccgtctcgatatgttcgaacatattagtctgatgaccctcgatagcctgcagaagtgcgtgttctctttcgagtcaaactgtcaggaaaagccctccgaatatatcgccgcaattctggagctgagcgcgtttgtggaaaaaaggaaccaacagattctactccacacggattttctctattatttgacacctgatggtcaacgattccggagggcttgccacctcgtccacgactttaccgatgctgtgatacaggagagacggtgcacgctgccaacccagggcattgatgatttccttaagaataaggccaagtcaaagactctggactttatagatgtgctgctgctgagcaaagatgaagatgggaaggagttatccgacgaggatatcagggccgaagccgataccttcatgttcgagggacacgacaccacggcttctggtttgtcgtgggtcctttaccaccttgccaaacaccctgagtaccaggaacaatgtcgtcaggaggttcaggagctcctgaaggacagggagcccatcgagattgagtgggacgacttggcccagctgcctttcctcacgatgtgtattaaggagagtctcaggctccacccgccagtacccgtaatctctagatgttgcacacaggatttcgttttgcccgacgggagggtgattcccaaagggattgtctgcctcatcaacataatcggtatccactataatccaactgtctggcccgacccggaggtatatgatccttttcgctttgatcaggaaaatattaaggaacgctccccgctcgcattcatacccttctcagcgggtccacgaaattgcattggtcaggcctttgctatggccgaaatgaaagtcgtgctggccctaaccctgttacacttccggatcctgcctacgcacactgagccaagaaggaagccagagcttatcctcagagccgaaggcggactgtggctccgagtggagccgctgggggcaaactcccagtag

SEQ ID NO: 219919 - DNA, 1365 bp, Artificial Sequence
  Description of Artificial Sequence: Synthetic coding sequence
atgccacagcttagtttgagctggttagggctgggcccagtggccgctagcccatggctccttctcctgctggtaggaggctcatggctactggcccgagtgctagcatggacctatacattctatgacaactgcaggaggctgcagtgcttcccgcagccgcctaagcagaattggttctggggccatcagggtctagtgactcctacggaggaggggatgaagacactaacacagctggttactacctacccccaagggtttaagttgtggctgggaccaacctttcccctgctgatcctttgccatccagacattatccgtcccatcacgtcggcctccgctgccgtggccccaaaagacatgatcttttacggtttcctgaagccatggctgggagacgggctgctgctgagcggcggagacaagtggtctaggcatagacgcatgctcacccccgcatttcatttcaatatcctgaaaccttacatgaagatattcaataagtctgtcaatatcatgcacgacaaatggcagaggctggcttctgaaggatcagctcgattggatatgttcgagcacatctctctgatgaccttggattctcttcagaaatgtgtgttctcctttgaaagcaattgtcaagaaaagccatcagaatatatcgccgcaatcctggagctgtcggcctttgtggagaagcgcaatcagcagattctcctgcatacggattttctgtactatttgactccggacgggcagaggtttaggagagcatgtcacctcgtgcatgacttcaccgacgctgtgatccaagagaggcgctgcactctgcccacccaggggatagacgatttcctaaagaataaagcaaagtccaagaccttggactttattgatgtgttgttgttgagcaaagatgaggatggaaaggaactctccgacgaagacatccgcgctgaagctgatacattcatgttcgagggccatgataccacagcctctggtcttagctgggtattataccacctagccaagcaccccgagtatcaggagcaatgtcggcaagaggtccaggagctgctgaaagaccgtgaaccgatagagatagagtgggacgatctcgcccagttgccctttcttacaatgtgcattaaggaatcgttacgattgcacccgcctgtgcccgtgatcagccgttgctgcactcaggatttcgtcctcccggacgggagagttataccgaaaggattaaggccacttccattccgccctcgtgagcatcagggggaagtgacgtccggtttctattcactgctgggcagagcccagaagctccacagagccggagtgcgacacggatag

SEQ ID NO: 219920 - DNA, 1575 bp, Artificial Sequence
  Description of Artificial Sequence: Synthetic coding sequence
atgccgcagctcagtctttcctggctgggtctgggcccagtggccgcatcaccatggttgctgctgctactggtggggggttcctggctattggctagagtgcttgcctggacttatacattttatgacaattgcaggagacttcagtgtttccctcaacctcctaaacagaactggttctggggtcatcagggcctggtgaccccaacagaagagggaatgaaaacactcacacagctcgtgaccacttatccacagggctttaagctgtggctaggccctacttttccgctgctgatcctttgtcatccagacatcatccgacccatcaccagcgcctctgccgcagtcgctcccaaggatatgattttctatggtttcctaaaaccctggctaggagatggattactcttgagcggaggcgacaaatggtcacggcatagacgtatgctgactccagctttccatttcaatattttgaaaccctacatgaaaatattcaacaaatcggtgaacattatgcatgataagtggcagcgcctcgcatcagagggatcggctaggctggacatgtttgagcacatttcgctgatgaccctcgatagtctccagaaatgcgtcttcagttttgagagcaactgccaggagaagccttccgagtatatcgccgcaatccttgagttgtcagcatttgtggagaagagaaaccagcagattctactacatactgattttctgtattacttaactccggatgggcagaggtttagacgggcttgtcacttggttcacgacttcacagacgccgtcatccaggagaggcgctgtaccttgcctacacagggaattgacgatttcctgaagaataaagcaaagagcaagacactggatttcattgacgttcttctcctcagcaaggacgaggatggcaaggagttatctgacgaggatatccgggcagaggccgacacattcatgttcgaagggcatgatacaacagcatctggcctgtcttgggttctgtatcatttagccaagcaccccgagtaccaggagcaatgtagacaggaggttcaggagctgcttaaagaccgcgaacctattgagattgaatgggacgatctggctcagcttcccttccttacaatgtgcatcaaggagtcacttcgactgcatccacccgtgccggtcatatccagatgttgcactcaggacttcgtcctgcccgatgggagagttatccccaaagggatcgtgtgtctgattaatattatcggtatccactacaacccaacagtttggccagaccctgaggtgtacgacccctttagatttgatcaggagaatataaaggagagatcccccttggcctttatcccttttagcgccggacccagaaattgtatcggccaggcgtttgcaatggcagagatgaaagttgtgcttgctctgaccttattacatttcaggatactccccacgcataccgagccacggcgtaagccagaattgatactgcgagccgagggcggtctgtggttaagggtagagcccctgggggctaactcccagtag

SEQ ID NO: 219921 - DNA, 1575 bp, Artificial Sequence
  Description of Artificial Sequence: Synthetic coding sequence
atgagtctgctatcgcttccttggctcggccttcgccctgtcgctacttctccgtggctcctactgctgctcgttgtcggctcctggctcttggctagaatattggcttggacatacgctttttacaataactgccggaggttgcagtgttttccccaaccgccaaaacggaactggttttgggggcacctcggactgatcactcctacggaagaaggcctgaaaaacagcacgcagatgagcgccacctactcacaggggttcaccatctggctgggcccaatcattcccttcattgtcctttgccaccccgacacaattaggtctatcaccaacgctagtgcagcgatcgcccctaaagataacctcttcattcgatttctaaagccgtggcttggagagggaatcctcctctcaggtggggataaatggtctcgacaccgaagaatgctgactccagcattccatttcaatatactcaagtcatacatcaccatctttaataaatctgctaacattatgctggacaaatggcaacacctcgccagtgaaggctcctcttgtttggatatgtttgagcacatttctctgatgacactggattcgctgcagaagtgcatattctcgttcgactcccactgccaggagcgcccttccgaatatattgccaccattttagagctttcggcactggtggagaagcgcagtcaacacattttgcaacatatggacttcctgtactatttaagtcatgatgggaggcggtttcatagggcgtgcaggttggtccacgactttacagacgcggtgatccgggagcgacggaggaccctcccgacacagggtattgacgacttttttaaggacaaggctaaaagcaaaactctggattttatcgacgtgttgctcctctctaaggacgaggacggtaaggctctttctgacgaagatatccgcgcagaggctgacacattcatgttcggagggcatgatacaacagcgtccggcctgtcatgggtgctgtacaacctcgcccgacacccagaataccaggagaggtgtagacaagaagtccaggaactgctcaaggatagggatcctaaggaaattgaatgggacgacctcgcacaattgcctttcttgacaatgtgtgtgaaggagtcactccgcctgcaccctccagcccctttcataagcaggtgttgcactcaggacatcgtgttgccagatggcagggtcatcccaaagggcatcacttgtcttattgacattatcggagtccaccacaacccaacagtgtggcccgaccctgaagtctacgatcccttcagattcgatccagagaatagcaaggggcgaagcccactcgcctttatcccatttagtgcaggcccacggaactgcatcgggcaggccttcgcaatggccgagatgaaggtcgtgttagcccttatgctgctgcattttcgcttcctccccgaccacaccgaacccagacgaaagttggaattaatcatgcgcgcagaaggcggtctgtggttgagggttgaaccactgaacgtcagcctgcagtag

SEQ ID NO: 219922 - DNA, 1575 bp, Artificial Sequence
  Description of Artificial Sequence: Synthetic coding sequence
atgagtttgctttcactgccttggctggggcttaggcctgtcgccacttccccatggcttttgttgctgctggtcgtggggagctggttgctcgctcgcattctggcatggacatacgccttctacaacaattgccgcaggctgcagtgttttcctcagccgcctaaacggaactggttctggggccatctgggcctgatcacacctaccgaggaggggctgaagaattcaactcagatgagtgctacatatagccagggttttactatctggctaggtcccattattccgtttattgtgctctgccatcccgacacgatccgaagcataaccaacgcgagtgctgccatcgcaccgaaagataacctctttattcggttcctcaaaccatggttgggggaaggcatactgttaagcgggggagacaagtggagtcgtcatcggaggatgcttactcctgcatttcatttcaatatactgaagtcatacataacaatatttaacaagagcgctaacattatgctcgacaaatggcagcacctcgcgtctgagggctcatcttgcctcgacatgttcgagcacatctcgcttatgactctggacagcctgcagaaatgtattttttcttttgactctcattgccaggaaaggcccagtgaatacatagcaactatccttgaactctcggcacttgtggagaagcggtcacaacacatactgcagcacatggactttttgtactaccttagtcacgacggcagaaggtttcaccgcgcatgtaggctggtccacgactttacagacgccgttattcgcgagcggagacgcaccctgccaactcagggtattgatgacttcttcaaggataaagcgaagtcaaaaaccctggactttatcgatgtcctcctgctgtccaaggacgaggacggcaaggcgctcagcgatgaggatatcagggccgaggccgataccttcatgtttggcggacacgataccacagcttccggcctgagctgggtgctctataatctggcacggcaccccgaatatcaggaacgttgcaggcaggaagttcaagagctgctgaaggatagggaccccaaggagatcgagtgggacgacttggcgcaacttcccttcttgactatgtgtgtgaaagagtcattaagactgcaccccccagctcctttcattagccgctgttgtactcaggacattgtcctacctgacggacgagtgattcccaaggggatcacctgcctgatagatataataggcgtccaccataatcccactgtgtggccagacccagaggtgtacgatccctttagatttgaccctgaaaacagtaagggacgctctccgttagccttcatcccattctcggcgggtcctcgtaactgtatcggccaggcctttgcaatggctgagatgaaggtagtgcttgccctgatgttactgcacttccgctttctgcccgaccacaccgaacccaggcgcaaactggagctgataatgcgagcagagggcggtctgtggcttcgcgtggagcctcttaatgtttccctgcagtag

SEQ ID NO: 219923 - DNA, 1596 bp, Artificial Sequence
  Description of Artificial Sequence: Synthetic coding sequence
atgctgcccatcacagacagactgctccacttacttggcttagaaaaaaccgcctttcggatttacgcggtatctactctgctcctgtttctcctgttctttcttttccggctgcttttgcggttcttgagactttgtcggtctttctatatcacatgcaggcgtttgcgatgctttccccagccacctaggaggaactggctcctgggccatttggggatgtatctgcctaatgaggctggcttacaagacgagaagaaagttctcgataatatgcatcatgtattgctggtgtggatggggccagtcctgccactcctggtgctggttcaccctgattacataaagcccctgctgggggcttccgccgctatcgcccctaaggacgatctgttttacggttttctgaagccctggcttggggacggactgttattgtccaaaggggacaaatggagccggcacaggcggctcctgacaccggctttccatttcgacattctgaagccttacatgaagatcttcaaccagtctgccgatataatgcatgccaagtggcggcacctggccgagggtagcgctgtgtccctggacatgttcgagcacattagcctcatgacccttgactcactccaaaaatgtgtgttctcctacaacagcaactgccaggagaagatgtccgattacatctctgctatcatagaactcagcgctctgagcgttcgacgacaatatagactgcaccactaccttgattttatctactatcgcagtgccgatggacgtagattccgacaagcttgtgacatggtgcatcattttacgactgaggtgatacaggagagacggagggccctcaggcagcagggcgcagaggcctggctgaaggccaaacagggaaagactctcgacttcatagatgtgctcctgctcgcacgagacgaggacggcaaggaactctccgacgaagacatccgagccgaggccgatacatttatgtttgaggggcacgacaccacttcctccggaatttcctggatgctgtttaaccttgccaagtatcccgaataccaagagaagtgtagggaggaaattcaggaggtcatgaaaggtagagagctcgaagagcttgaatgggatgatctcacccagctcccgtttaccaccatgtgtatcaaggaatccctgcggcaatatccccctgtgacactcgtgtccagacagtgcactgaagacattaaactgccagacggaaggataattccaaagggaatcatctgcctcgtctcgatatatggcacccaccacaatccgaccgtgtggcctgattcaaaggtgtataacccttaccggttcgatccggataacccgcagcaaagatccccacttgcctatgtgccctttagtgccggtccaagaaattgcatcggccagagcttcgctatggcagaactgagagtggtggttgccttgaccctcctgagattccgcctgagtgttgatagaacaaggaaggtccggagaaaaccagagctgattctgagaactgaaaatggcttgtggctgaaagtggaacccttgccccctcgggcttag

SEQ ID NO: 219924 - DNA, 1782 bp, Artificial Sequence
  Description of Artificial Sequence: Synthetic coding sequence
atggcgccaagtggattgaaagcagtcgtgggagagaaaatcctgtccggcgtcatccggtccgtcaagaaagatggcgagtggaaggtgctgataatggatcacccttctatgcgtattctgtcctcttgctgcaagatgagcgatattctggccgaaggcattacaatcgtggaggacatcaataaacgcagggagccaattcccagcctggaagccatctacctcctgtctccaacggaaaagtcagtgcaggctctgatcaaagacttccaaggcactcctacctttacctacaaggccgcacatattttctttaccgacacttgcccagagccgttattctccgagctgggacggagcagactagccaaggttgtcaagacactgaaggagatccatcttgcattccttccctacgaggcacaggtattcagcctggatgctccccactctacctataatctctattgtccatttcgggctgaagaaaggacccgacagttggaggtactggcccagcagatcgcgaccttgtgcgcaacactgcaggagtacccagcaataaggtacagaaagggccctgaggacacagcacaactggcgcacgccgtgcttgctaaactgaacgcctttaaagccgatactcccagcctgggggagggtccagagaaaactagatcccagcttctgatcatggatagagctgctgacccggtctcaccactcttgcacgagttaaccttccaagcaatggcctatgacctgctggacatcgaacaggatacttatagatacgaaactacaggcctgtcagaggccagggaaaaggctgttttgctggacgaggatgatgatctttgggttgagctgaggcacatgcacattgctgacgtttcgaagaaagtcactgaactgctgcgaactttctgcgagagcaagcgtttaacgactgacaaagctaacattaaggacttatctcagatattgaagaaaatgccacagtatcagaaagagttgaataagtatagcacccatctgcaccttgcagacgactgtatgaaacatttcaaaggcagcgtggaaaaactgtgttcggttgaacaggatctggctatgggttcggatgctgagggcgagaaaatcaaggattccatgaagttgatcgtaccagtgctcctggacgctgctgtgcccgcatatgataaaattagggtgctgctcctgtatatactgctccggaatggtgtcagcgaagagaacctggcaaagctaatccagcacgcaaacgtccaggcacactcatccttaatacggaaccttgagcaactgggtggcacagtcactaatcctggcggatccggtacttctagtagactcgagcctcgagaacggatggagccgacctaccagttgtctagatggacaccagtgattaaagatgtgatggaagacgctgtggaagacagactggaccgaaatctgtggcctttcgtgtctgacccagcccctaccgcttcaagccaagccgcagtcagcgctagatttggacactggcacaaaaataaggccggaattgaggccagagctgggcctagactgattgtgtacgtaatggggggagttgcgatgtccgaaatgcgagctgcatacgaggtgacccgcgcaaccgagggtaagtgggaagtgctcattggcagtagccacatcctgacacccacacgctttctggatgacctgaaggcattagacaaaaagttggaggatattgctctgccttag

SEQ ID NO: 219925 - DNA, 1344 bp, Artificial Sequence
  Description of Artificial Sequence: Synthetic coding sequence
atgagagttctgactcaattggtcgcgacctatccacagggctttaaggtatggatggggccaatctttcccgtgatccgcttttgtcatccgaacattattcgcagcgtcattaatgcctccgccgcaatagttcctaaggacaaagttttttacagcttcctgaagccttggctcggagacggactcctgctttccgctggagaaaaatggagccgacacagacgaatgctgacccccgcatttcacttcaacattctgaaaccatatatgaagattttcaatgagagtgtcaatatcatgcatgccaagtggcaactgctggcgagtgaggggtctgcacgtctggacatgtttgaacacatttctctcatgactctggatagcctacaaaagtgcgtctttagtttcgacagccactgccaggaaaaaccctccgaatacatagcagcaatcctggagctatccgccctggtaaccaagcggcatcagcagatacttctctacatcgatttcctctattaccttacccccgacgggcagaggtttcggcgagcatgtcggttggtgcacgattttaccgacgccgtaatccaggagcgacgccgaacactgccaagtcagggagtggacgactttctgcaggctaaagccaaaagtaagacgctggacttcatcgatgtattgcttttgagcaaggacgaagacgggaaaaagttgtcagatgaagacattcgcgcagaggctgacacatttatgttcgaaggtcacgatactactgcctccggtctctcttgggttctgtatcatctcgccaagcatcctgagtatcaggaaagatgcagacaggaggtgcaggagctcttaaaagatagggaacctaaagagatagaatgggacgacctggcacagctgccattcctgacgatgtgcatcaaagaaagtctcaggctgcatccaccagtgccagccgtatccagatgttgtactcaggatatcgtccttccagatggcagggtgattcctaaaggtatcatctgtttgattagcgtgtttggtacgcaccacaatcccgcagtgtggcctgatcctgaagtatacgatcctttccggttcgacccaaaaaacatcaaggagaggtctccactcgcgtttattcccttttccgcgggacctaggaattgcattgggcaggctttcgctatggccgagatgaaggtggttttgggactgacccttctccgcttccgtgtgctcccagatcatactgaaccacgaagaaaacccgaattggtgctgagagccgaaggaggcctttggctgagggtggaaccactatcttag

SEQ ID NO: 219926 - DNA, 999 bp, Artificial Sequence
  Description of Artificial Sequence: Synthetic coding sequence
atgccatcgattaccactgcagcagcctctggggtgagtcgctcccccggtaaccgcacgggctcctgggtaacctgggcgtggaagccatccgaatacattaccgcaatcatggaactgagcgctctggtcgtcaagcggaataatcagtttttcagatacaaggacttcctttactttctaacaccctgtggtagacggttccatagggcttgcagattggttcatgacttcaccgacgccgtaatacaggaacgccgacgaacacttacatcgcagggagtggacgactttcttcaagcaaaggccaagtctaagactctcgacttcattgatgttctgctcctgtccgaggataaaaatgggaaggaactatctgatgaggacattcgcgctgaagcagacacattcatgttcgggggtcacgatactacggcttccgggctgagttgggtactgtataatttggcaagacatcccgaataccaggagcgttgcaggcaggaggtgcaggagttgctgaaagatcgggagcccaaagaaatcgagtgggacgatctggcacagttgcctttcctgacaatgtgcctgaaagagtcactgcgcctccaccctccgattccaaccttcgccagagggtgcacgcaggatgtcgtgttacctgactcacgcgttattccaaagggcaatgtctgtaacatcaatattttcgccattcaccacaatccctcagtgtggccagatccagaggtgtacgacccctttcgctttgaccccgagaacgcacagaagaggtctcccatggcattcattccgttctcagcaggacctcggaactgtattggccagaagttcgcgatggctgaaatgaaggtagtcttggcactcacgctgctgcgctttcgtatcctccccgatcaccgtgaacctagaagaactcccgagatcgtgcttagagcggaggacggtctttggttacgtgtcgagccgttgggctag

SEQ ID NO: 219927 - DNA, 1560 bp, Artificial Sequence
  Description of Artificial Sequence: Synthetic coding sequence
atgtccttactctccctgtcctggttaggtctcaggcccgttgccgcttcgccttggctcctgctgttggtcgtgggtgcttcctggctcctcgcacggattctggcctggacatatgcattctatcataacggtcggagactccgttgcttccctcagcctagaaagcagaattggtttctggggcacctcggactagtcactccaacagaggaggggctcagagtgctgacacagctcgtcgcgacttatccccaaggcttcgtccgttggctgggcccaataacccctattatcaacctgtgtcacccggatatcgtgcgcagtgtcatcaatacgtcagacgcgattaccgataaagacatcgtattttataagacacttaagccatggcttggcgacgggttactgttgtccgtgggagataagtggaggcaccacaggaggctgacgccagcatttcacttcaatatccttaaaccatatatcaagatattttctaaaagtgccaacatcatgcatgctaagtggcagagactggccatggagggctcaacttgcctcgatgtgttcgagcacataagcctcatgacactggactctctacagaagtgcatcttttccttcgacagcaattgtcaggaaaaaccaagcgagtacatcacagctatcatggagttgtcagccctggtcgtgaagcggaacaaccagttcttcagatataaagactttctttatttcctcactccctgcgggaggcggttccaccgagcatgcaggttggttcatgactttacggatgccgtcatccaagagcgacgcagaaccctgacgtcgcagggggtcgacgattttctccaagccaaggcgaaaagcaaaactctggattttattgacgtcctcctgctttccgaagacaaaaacggcaaggaattatctgacgaagacattcgggcagaagctgacacatttatgttcggaggccatgacacgaccgcgtcaggtctaagctgggtgttgtacaatctagccaggcacccagaataccaggagagatgtaggcaggaagttcaagagctcttgaaggatcgagagcctaaagagatcgaatgggacgatcttgctcagttgccttttttgactatgtgtcttaaggagagcttgcggcttcacccccctatcccaaccttcgcaagggggtgcactcaggacgtagtgctgcccgacagccgagttatccctaagggcaatgtgtgcaacattaacatcttcgctatacatcataaccctagcgtatggcctgatcctgaggtgtatgacccattccgatttgacccagaaaatgcacagaagcggtccccaatggcctttatacccttcagcgccggacccaggaactgtataggacagaagttcgctatggctgagatgaaagtggtgcttgcactcacactgttacggttccgcatccttccagatcaccgagaacctaggaggactcccgagattgtgctcagagccgaggatggtctgtggctgcgggtggaaccgctgggatag

SEQ ID NO: 219928 - DNA, 804 bp, Artificial Sequence
  Description of Artificial Sequence: Synthetic coding sequence
acgcccgcatttcatttcaacatcctgaagccttacatcaagatctttagcaagtcagcaaatatcatgcacgccaaatggcagcggttggcaatggaaggtagcacctgtctggatgtctttgagcacatttctctgatgaccctggattctctgcagaagtgtattttcagcttcgattccaactgtcaggaaaagccttccgaatacatcaccgctatcatggagctgtccgctttagtcgtaaaaaggaataatcagttctttagatacaaagattttctgtacttcctcactccttgcggacgcaggttccacagggcttgccggcttgtgcatgactttaccgatgccgttatacaggaacgacggagaacattgacgtctcaaggggtggatgacttcctgcaggctaaggccaagtccaagaccctggacttcatcgatgtactcctactgtctgaggacaagaatgggaaggagctgagtgatgaagatattcgcgctgaagcggatacgttcatgttcggaggccatgacacgacagcctctggacttagctgggtactatacaatctcgcgagacaccccgagtaccaagaaaggtgcaggcaggaggttcaggagctgctcaaggacagggaaccaaaagaaattgagtgggacgacctggcccagttgcctttcctgacaatgtgtcttaaggaaagcctcaggctgcaccctcccattccgacatttgcccgtggctgcactcaagacgttgttctgcctgactctagagtgattcctaaaggcctctag

SEQ ID NO: 219929 - DNA, 1512 bp, Artificial Sequence
  Description of Artificial Sequence: Synthetic coding sequence
atggcaggactctggctaggccttgtttggcagaagctcctcctgtggggcgctgcctctgcacttagtctggcaggcgcttctttggtgctaagcctcctacagcgcgttgcttcatatgccctgctgatgaaaccagatggccgagagttcttccaacagatcatagaatatacagaggagtacaggcacatgcctttgcttaagctgtgggtgggcccagtacctatggtggccttatacaacgcggaaaatgtggaggtcatcctcactagctctaagcagatcgacaagagttctatgtacaagttcttggagccgtggttgggactcggactgctcacatctaccgggaacaagtggaggtcaaggcgtaagatgctaacaccaaccttccacttcaccatcctagaggattttctggatatcatgaatgagcaggcgaacatcttagttaaaaaactggagaagcatatcaaccaagaggcatttaactgcttcttttacataacactttgtgcactcgacatcatctgtgaaactgccatgggtaaaaacatcggtgcccagtcaaatgacgacagtgagtacgtacgcgctgtgtaccgtatgtccgaaatgatctttcgccgaattaaaatgccatggttgtggcttgacttgtggtatctcatgttcaaggaggggtgggaacataaaaagtctctccagatcttgcacacttttacaaactcagttatcgccgagagggctaatgagatgaacgccaacgaggattgtagaggagacggaagggggtccgcccctagcaagaataagcggagggcatttctcgacttgttgctgagcgtgactgatgatgaagggaaccggctctctcacgaggatatccgggaagaagtggacacttttatgttcgagggccacgatacaaccgcggctgccattaactggtcactttaccttctcggcagcaatcccgaggtgcagaaaaaggtggaccacgaactggatgacgtcttcggcaagtccgataggcccgctaccgtcgaggatctcaagaagcttcggtaccttgagtgtgtcataaaagagaccctcaggctgtttccatccgtgcctctctttgctcgaagcgtgagcgaggactgcgaggtcgcagggtatcgggtgttgaaggggaccgaggccgttatcatcccgtacgccctgcacagagacccaagatacttccctaaccctgaagagttccagcccgagcgcttttttccagagaatgcccagggcaggcacccatacgcctacgtcccatttagtgccggaccccgtaactgcatcggccagaaattcgccgtgatggaggagaaaacgatcctctcctgcattctcagacatttctggatcgagagtaaccaaaaacgcgaagagttggggctggagggccaactcatactgcgaccgtccaatggtatctggatcaagctgaaaaggagaaacgccgacgagcggtag

SEQ ID NO: 219930 - DNA, 1578 bp, Artificial Sequence
  Description of Artificial Sequence: Synthetic coding sequence
atggctggactctggctgggcctggtttggcaaaagctgctgctgtggggtgccgcttccgcattgtcactggccggtgcctcgctggtcctctctctgctgcagcgcgtggcaagttacgcaaggaaatggcagcagatgcggcctataccaacggtggccagggcttacccccttgttggacatgccttactcatgaagccagacggccgtgagttttttcagcagattattgagtacacagaggaatatcggcacatgcccctcttaaagttatgggtcgggccagtccccatggtggctctgtacaatgctgaaaacgtggaagtgatcctgacatccagcaaacagattgataagtcatctatgtataagttcctggaaccttggctggggttaggacttctgacttctacaggcaacaagtggcgttcacggagaaagatgctgacccccacttttcactttacaatcctcgaggattttcttgatattatgaacgaacaggcaaacattctggtgaaaaagctcgagaagcatatcaaccaggaggctttcaattgctttttctacatcacactgtgtgccttagatattatttgcgagacggcgatggggaagaatatcggggcacagtccaacgatgacagcgaatatgtgcgggctgtctaccggatgtctgagatgatttttaggagaattaagatgccttggctgtggctcgacctgtggtatctaatgttcaaggaaggctgggagcacaagaagtctctgcaaattctgcacacattcacaaactccgtcattgccgagcgagcaaacgagatgaacgctaatgaggattgcaggggcgatggcaggggcagcgcgccatcaaagaacaagcggagggccttcctcgatctgctgttatcggttaccgacgacgagggaaaccgcctatctcacgaagatataagagaggaagtggacaccttcatgttcgaaggccacgacacgaccgctgccgctatcaattggagtctttatttgctcgggagtaaccccgaggtgcaaaagaaggtggatcatgaattagatgacgtctttggtaagagcgatcggcctgccacagtagaagaccttaaaaagttaaggtatctggaatgtgtgatcaaagaaaccctgcggctttttccctccgtccccctgtttgcacgatctgtttccgaggactgcgaagtagcgggataccgtgttctgaaagggaccgaagcagtaattatcccttacgcattacatagggatccccgatacttccctaatccagaggaatttcagcccgagagattctttccagagaacgctcaagggaggcatccatacgcctacgttccattctctgcaggtcccagaaactgcattggccaaaaattcgcagtaatggaagagaagacaatcctctcttgcatactgcgccatttttggatagagagcaaccaaaagcgggaggagcttggtctggaaggacaattgatcctaaggccgtctaatgggatctggatcaaactgaaaaggcggaatgcggatgaacgttag

SEQ ID NO: 219931 - DNA, 1503 bp, Artificial Sequence
  Description of Artificial Sequence: Synthetic coding sequence
atgtcaccgggtctcctgctcctggggagtgcagtcctcctggcctttgggctgtgttgcacctttgtccacagagctcgaagtagatacgaacatatccccggtccacctcggccatcatttctcctgggccacttaccttgtttctggaagaaggacgaagtgggtggaagagtgctgcaggacgtttttttggactgggctaaaaaatacggacctgtggttcgcgtgaacgtattccacaaaacatcagtgatcgttacatcacccgagtccgttaaaaaattccttatgtcaacaaaatacaacaaggactcaaaaatgtatagggcactgcagaccgtcttcggggagcgcctcttcggtcagggactggtttccgaatgcaactacgagcggtggcacaagcaacggcgagtgatcgatctggcattctcaaggtcaagcctcgtttcactgatggagaccttcaatgagaaagctgagcagctcgtggagattttggaggccaaggctgacggccaaactcctgtgtctatgcaggacatgcttacatataccgcaatggatatcttagcgaaggctgcctttgggatggaaacttctatgttgcttggagcccaaaagcctttaagtcaggcagtgaagctcatgttagagggcattaccgcgtccagaaataccttggcaaagtttcttcctggcaaaagaaagcaacttcgcgaggtacgagaatctattcggttcctcaggcaggtggggagagattgggtacagcgccgtcgagaagccctaaagcggggagaagaggttccggcagacatcttgactcagatcctcaaggcagaggagggggctcaggacgatgaaggattgctcgataatttcgtgaccttctttatagcgggtcacgagacttccgccaaccacctggcctttactgtcatggagctgtcccgccaaccagaaatcgttgcccgactccaggctgaggttgatgaggtcattggtagcaagcggtacttagattttgaagacctcgggaggctacagtacctgtctcaggtgctgaaggaatcactgcgattgtaccccccagcgtggggaacctttaggctcttggaagaagagacactcatcgacggggtcagagtaccagggaatactcccctgctgttctccacatacgtgatgggccgaatggatacctattttgaagaccccctcacttttaacccagatagatttgggccaggcgcacccaagccaaggttcacatattttccattctcactgggccaccgctcttgtattggccagcagttcgcccaaatggaagtcaaggtcgtcatggccaagctattgcagagactggaattccgtctggtaccaggacaacggttcggcctacaagagcaggcaacactcaagcccttggatcctgtgctatgcaccctccgtccccgaggctggcagcccgcaccaccaccaccaccatgttag

SEQ ID NO: 219932 - DNA, 1212 bp, Artificial Sequence
  Description of Artificial Sequence: Synthetic coding sequence
atgtccacaaagtacaacaaagatagcaaaatgtatcgagctctgcagacggtgttcggggaacggttgtttggccagggcctggtaagcgagtgcaactacgaacgctggcataaacagcgtcgggtgatcgacttggcctttagtcggagttctctagtgagcctaatggaaacattcaatgaaaaggcggaacaactcgtcgaaatcctcgaagccaaagctgacggtcagacacccgtcagcatgcaggatatgttgacatatactgcaatggatattctcgctaaagcagcattcggcatggaaacaagcatgctgctgggcgcacagaaacccctctcccaggcggttaagttgatgctggaaggtatcacagcatctcggaacacactcgcgaaattcctgccaggtaagaggaaacaactccgagaggtccgcgagagcatccgcttcctgcggcaagtggggcgtgactgggttcaaaggagacgtgaagcattgaagcgcggagaggaggtccctgcagatattctaactcagatcctcaaggccgaggagggtgctcaggacgatgaggggcttctggataattttgtgacattctttattgccggacacgaaacatccgccaaccacctggcattcacagttatggagctctcgaggcaacccgagatcgtggcgagattgcaggctgaggtggacgaagtgattggttccaagcggtacctggatttcgaggacctcgggagactgcaatacctgagtcaggttctgaaggagagcctgagactgtatcccccagcatggggcacgttcaggctactagaggaggaaacactgatcgatggggtgcgcgtgccgggtaacacaccactgcttttctctacttacgtgatgggaagaatggacacgtactttgaggatccactgactttcaacccagaccggttcgggccaggggctcctaagcctcggttcacctactttccgttttcgctgggtcacaggtcatgtattggacaacagtttgcacagatggaggtgaaagtcgttatggccaaactcttacaaagactggaattccgtctagtgcccggacagagatttgggctccaggagcaggccaccttaaaacctctcgatcccgtgctgtgtacactgcggcctcgtggttggcagccagctccccctcctccaccttgttag

SEQ ID NO: 219933 - DNA, 1530 bp, Artificial Sequence
  Description of Artificial Sequence: Synthetic coding sequence
atggccgctgccgctggaatgctcctgctcgggttactgcaggccggaggctccgtgctggggcaggcaatggaaaaagttaccgggggaaacctactgagtatgttgctgatcgcatgcgccttcaccctgtcactcgtttacttgattcggttggccgcaggacacttggtacagctgccagccggagttaaatctccaccctatattttctcccctattccatttttaggccatgcaattgcctttgggaagtcccccattgagtttttggaaaatgcctacgagaaatatggaccagtgttttcctttactatggtaggtaaaacctttacgtatctattggggagtgatgcggcagccctcctattcaatagtaagaatgaggatctgaatgcagaggacgtgtacagtagactgacgacccccgtctttggtaagggggtggcctacgacgttcccaaccctgtgttcctcgagcaaaagaagatgctgaaatctggccttaatattgctcattttaaacagcatgtgagcataatcgaaaaggaaacaaaggagtattttgagtcctggggggaatcaggagagaaaaacgtatttgaggcgcttagcgagctaatcatactaaccgctagccattgcctccatgggaaggagatccggagccagctcaatgagaaggttgcccagctgtatgccgacctggatggaggattctctcacgctgcgtggttgctgcctggatggctccctctaccaagtttccgtagacgcgaccgggcacacagggagatcaaggatattttctacaaagcaatacagaaacggagacagtcccaagagaaaatcgatgatattctgcagaccctgcttgacgctacatacaaagatgggcgaccacttacagatgacgaggtagccggtatgctgatcggcttactacttgcgggtcagcataccagcagtacaacaagtgcttggatggggttcttcctggccagagataagactctgcagaaaaagtgctatctggaacaaaagacagtttgcggggaaaacctgccccctctgacctacgaccagctcaaggacttaaacctgctggataggtgtattaaagaaaccctgcgcctacgtcctccaataatgataatgatgaggatggccagaaccccccagacagtagccggatacacaattccaccaggtcaccaggtgtgtgttagtccgactgtcaaccagagactgaaagactcttgggtcgaaagactggactttaatccagatagataccttcaggacaatccagctagcggcgaaaagttcgcttatgtgccttttggagcgggaaggcaccggtgtattggcgaaaatttcgcttatgtgcagatcaagacaatctggtctaccatgctccgactgtatgagtttgatctcatcgacggttacttccctactgtcaactataccacgatgattcatacacccgagaaccccgtcattcggtataagcggcgaagtaagtag

SEQ ID NO: 219934 - DNA, 1215 bp, Artificial Sequence
  Description of Artificial Sequence: Synthetic coding sequence
atggtggggaaaacgttcacttatctgcttggtagcgatgctgcagcccttcttttcaattccaagaacgaagacttgaacgcagaggacgtttatagccggttgaccacacctgtttttggcaagggagtggcctacgatgtccctaatcccgtgttccttgaacagaagaagatgcttaagtccggccttaacattgctcatttcaagcaacacgtttcgataatcgaaaaagagaccaaggagtatttcgagtcctggggggagagtggggaaaaaaacgtttttgaagctctgagcgagctcattatcctcacagcctcccactgcctacacgggaaggagatacgaagtcagctaaatgaaaaggtggcccagctgtatgctgatttggatgggggattttcacacgcagcctggctactgcccggttggctcccactgcctagctttcggaggcgtgatcgagcacaccgtgaaatcaaggacattttctacaaggccatccagaagagacggcagagccaggaaaagatcgatgacattttgcagactctgctggacgccacctataaagatggaaggcccctcacagacgatgaagtcgccggaatgctgattgggctgctcctcgcaggacagcacactagctcaaccacttctgcttggatgggattctttttggcccgagacaagaccctgcagaagaagtgctatttagagcaaaagacagtgtgcggggagaacctgccgccattgacctatgaccagctcaaggatttaaacctactagataggtgtattaaagaaacactccggctgaggccccctataatgatcatgatgaggatggccaggacaccgcagaccgtggccggatacactattccgcctgggcaccaagtgtgtgtgtcccctaccgtgaatcagcggctgaaggactcttgggtagagaggttggacttcaaccctgacaggtacctgcaggataaccccgcttccggcgagaagttcgcctacgtccctttcggcgcaggcaggcacaggtgcatcggggagaactttgcctacgtgcagattaagactatctggagtaccatgctacgtctatacgaattcgacctgattgacgggtacttccctacagtgaattataccactatgattcacacacctgagaaccccgtaataaggtataagaggaggtcaaaatag

SEQ ID NO: 219935 - DNA, 1350 bp, Artificial Sequence
  Description of Artificial Sequence: Synthetic coding sequence
atgaagcatgagaaaagcccaccatatattttttcccctatcccttttctgggccacgctatcgccttcggcaagagtcctattgagttcctcgagaacgcttacgagaagtacggaccagtgttctcctttactatggttgggaagaccttcacatatttgctgggttccgacgcagcagcacttctgtttaattcaaaaaacgaggatcttaacgctgaagacgtctattctcgcctcactactcccgtgttcgggaagggagtggcctacgatgtacccaaccctgtgtttctcgagcaaaaaaaaatgctcaaaagtggtctgaacattgcccacttcaaacagcacgtttcaatcattgagaaagaaactaaggagtactttgaaagttggggcgagagtggtgagaagaatgtgtttgaagcgctcagcgaactaatcattcttactgcctcgcattgcttgcacggcaaggaaatcaggagccagctcaacgagaaagttgcccagctctacgcagatctcgatggagggttcagtcatgccgcatggctcttgcctggttggctcccactcccaagcttccgcaggcgcgatagagcccaccgggagatcaaggacatcttctataaggccattcagaagcgacgccagtctcaggaaaagatagacgatatccttcaaactcttttggatgccacgtataaggacgggagacctctgacagacgatgaagtggccggaatgttaatcggactacttctggccggtcagcacacatccagtactacttccgcttggatgggtttttttctggctcgagacaagaccctgcagaagaagtgctacctcgagcagaaaaccgtgtgtggcgagaacctccctcctctgacctatgatcagctgaaggacttaaacctgctggaccgatgcattaaggagacgttgaggcttcgtccccctatcatgatcatgatgcggatggctaggactccccagactgtggccggatatactatcccaccagggcaccaagtgtgtgtctctcccaccgtgaatcagcgtctgaaggactcgtgggtcgagcgcctggattttaatcccgatcggtatctccaagacaatccagcttcaggggagaagtttgcatacgtaccatttggcgctgggaggcacaggtgcatcggagagaatttcgcctacgtccaaattaagacaatttggagtaccatgttaaggttgtatgagttcgacttgatcgacggctatttcccaaccgtcaattacactacaatgattcacacccccgagaacccagtgatacgttacaagagacgctccaagtag

SEQ ID NO: 219936 - DNA, 1515 bp, Artificial Sequence
  Description of Artificial Sequence: Synthetic coding sequence
atgatgaccaccagcctgatatgggggatagccattgccgcatgctgctgcctctggctgatcctcggaatccgacgccgtcagacgggcgaaccacctctggaaaacggtctcatcccttatctgggctgcgcacttcagttcggagcgaatccattggagtttctgcgtgccaatcagaggaaacatgggcacgtgttcacctgcaagttgatgggtaagtacgttcattttatcaccaatccactctcttatcacaaagtcctgtgtcatggcaagtacttcgactggaagaagtttcatttcgctacttcggcgaaggctttcggtcaccggagtatcgaccccatggacggaaatacgactgagaatattaacgacacatttataaaaacgctccagggacacgcactcaattctttaaccgagagcatgatggagaaccttcaacgcattatgcgcccacctgtctccagtaactccaaaaccgctgcttgggtgacagagggcatgtattcattttgctatcgggtgatgttcgaggcgggatacttgacaatcttcggcagggatctgactcggagagacactcagaaggcacatatactcaataacctagataacttcaaacagttcgacaaagttttcccagcgctggtcgcgggactgcccatccacatgtttcgcactgcgcacaatgccagagaaaaattggccgaaagcctgcgacatgagaatctgcagaagagagaatcaatcagtgagttgatctcactcaggatgttcctgaatgatacactgagtactttcgatgacctggagaaagccaagacgcatcttgtcgttctgtgggcctcacaggctaatacaatccccgcaactttttggagtctctttcagatgatcaggaaccctgaggccatgaaggcagccaccgaggaagttaaaagaactcttgaaaatgctggccaaaaagtgtccctggaggggaaccccatttgtctttcccaagccgagcttaatgacttgccagtcttggatagcatcattaaggagtcattacggctgtcgtccgcgagtctcaatattagaacagccaaggaggatttcaccctgcatttggaagacggctcatataatatcaggaaggatgatattattgccctgtatccacagcttatgcacctcgacccagaaatttaccccgaccctctgacattcaaatacgaccggtatcttgacgagaacggtaagactaagaccactttctattgcaatggcctcaaactcaaatattattatatgccgttcggatctggcgctaccatctgccccggacggttatttgccatccatgagatcaagcaattcctgatccttatgctctcctacttcgaattggagctaatagaaggtcaggcgaagtgcccccctctggaccagagcagagctggtctgggaatacttcccccattgaacgatatcgagtttaagtacaaattcaaacacttatag

SEQ ID NO: 219937 - DNA, 1521 bp, Artificial Sequence
  Description of Artificial Sequence: Synthetic coding sequence
atggctggcgaggtttccgcagccacgggtaggttcagcttggaaaggctgggcttaccaggtcttgccctggcagcagcactcctcctcctggccctctgcttattagtgcgcagaactcgacgaccaggagagcctcccctcatcaagggatggctgccatatctcggagtggtcttgaatcttaggaaggatcctctgagattcatgaaaacactgcagaaacagcacggtgacacgtttaccgtgctcctgggcggaaaatacattaccttcatcttggatcccttccagtatcagctggtgatcaaaaaccacaagcaactaagcttccgcgtgttcagcaataagctgttggaaaaggctttctccatttcccaacttcagaaaaatcacgacatgaatgacgagctgcatttgtgctaccagttcctgcaaggtaagtccctggacatcttattggagagcatgatgcagaacctgaaacaagttttcgaaccccagctgctgaagaccaccagctgggacacagctgaactgtatccattctgctccagtattattttcgagattacattcacgaccatttacggaaaagttattgtatgcgataataataagtttatttcggagcttcgcgacgatttccttaaatttgacgacaagttcgcgtacctggtcagcaacattcctatagaacttttggggaacgtgaaaagtattagagagaagatcatcaagtgtttttcaagcgagaagctggcgaaaatgcagggctggagcgaggtgttccagagccgccaagatgttttggagaaatactacgtacacgaagacttggaaattggtgcgcaccacctgggctttttgtgggcgtctgttgcaaacactatacccaccatgttctgggccatgtattatctcctacgtcatcccgaggctatggccgctgtacgcgacgaaatagataggctcttgcaaagcactgggcaaaaaaaaggaagtggtttccctattcacctaacaagagagcagctcgactccctaatttgcctggagagcagcatctttgaggcacttaggctgtcttcatacagcaccacgatccgctttgtcgaggaagatctcacattatcatctgagacaggggactactgcgtcagaaagggcgatttggtcgccatcttcccccctgtgttgcacggggaccctgaaatctttgaggcacccgaagagttcagatacgatcggtttattgaagatggcaaaaagaaaactactttctttaagagagggaaaaaactgaaatgctacctgatgccattcggaaccggcacatctaaatgtcctgggcgattcttcgcactcatggaaattaaacagctgctggtgattctgttgacatattttgacctcgagattattgacgacaagcctataggtctgaattattccaggttactctttgggatacaatatcctgattccgatgtcctcttccggtacaaggtcaaatcatag

SEQ ID NO: 219938 - DNA, 1506 bp, Artificial Sequence
  Description of Artificial Sequence: Synthetic coding sequence
atggtgctgtggggcccagtcctcggggctctgcttgtggtcattgccggttatctttgtctccccggaatgttaaggcagcggagaccatgggagccacctcttgacaagggaacggtgccctggctgggccacgctatggcttttaggaagaatatgtttgaattccttaagaggatgagaacaaaacacggggacgtgtttaccgtacagctgggcggacagtacttcactttcgtaatggacccattgtctttcggatccatcctgaaggacacccaaagaaaacttgattttggccaatacgccaagaaacttgtgctgaaggttttcgggtaccgaagtgtacaaggagaccatgagatgatccactccgcgtccaccaaacatttgcggggtgatggacttaaggatctgaacgagaccatgctggatagcctctcattcgtcatgctgacgagtaaaggatggtccttggacgcctcttgttggcacgaggacagtctgttccgcttctgttactatattttattcacggctgggtatctgagcctttttgggtacaccaaagacaaggagcaagacctgctgcaggccggtgagcttttcatggagttccgcaaatttgatcttctgtttcccaggtttgtgtactctctcctctggccacgcgaatggctcgaggtgggaaggttacagaggctgtttcacaagatgctttccgtctcacatagccaggaaaaagaaggaatttcaaactggctaggaaatatgctccaatttctgcgggaacagggtgtaccgagcgccatgcaagacaagttcaattttatgatgctgtgggcctctcaaggaaacacgggaccaacctcattttgggcactgctgtacctgctcaagcacccagaagcaatcagggcggtaagggaggaagctacccaggtattgggggaagccagactggaaaccaagcagtccttcgccttcaaattgggcgcactgcaacatacaccggtgctcgatagtgtagtagaggagaccctgcgcttgagagctgccccaacactccttcgactggtccatgaagactacaccttgaagatgtctagtggtcaggagtatctgtttcggcacggggacattctggcactgtttccatatctgtcggtgcatatggatcccgacatccaccccgaacctaccgtgtttaagtatgatcgttttctgaaccccaacgggtctcggaaggtcgatttctttaagaccggcaagaagatccaccactataccatgccatggggcagcggagtgagcatttgccccggtcgcttttttgccttatcggaagtgaagctttttattcttctgatggtcacacactttgatttagaattggtcgacccagacactcccttaccacatgtcgatcctcagaggtggggctttggtactatgcagccctcccacgatgtgaggtttcggtacaggctccaccccacagaatag

SEQ ID NO: 219939 - DNA, 573 bp, Artificial Sequence
  Description of Artificial Sequence: Synthetic coding sequence
atggaaaaggtccccggagaaatggaaatcgaaagacgagaaagatctgaagagctgtcagaggcagagcgcaaggcagtccaggccatgtgggcgagactttacgcaaactgtgaggatgtcggtgtcgctatcctggtgcggtttttcgttaattttccgtcggccaagcagtacttttcacagttcaagcacatggaggaccctctggaaatggaacgttcgccacagctccgtaagcacgcctgtagggtgatgggggctttgaacaccgttgtcgagaatctgcacgatcccgataaggtgtcttccgttctggccctagtgggaaaggcccacgcgctgaaacacaaagtggagcctgtgtattttaaaattctgtctggtgtgattctcgaagtggttgctgaggagtttgccagcgactttccaccggagacgcagcgcgcatgggccaagctgcgcggattgatttactcccacgtaaccgccgcatataaggaggtgggatgggtgcagcaggtaccaaacgccaccaccccccctgccaccctgccctcaagcgggccatag

SEQ ID NO: 219940 - DNA, 1194 bp, Artificial Sequence
  Description of Artificial Sequence: Synthetic coding sequence
atggaggaggatgactcctatgtgccatctgatctgacagctgaggagcggcaggagttggaaaatattagacgccgtaaacaggagctgctggccgatattcagcggctgaaggatgaaattgccgaagtggcgaacgagattgaaaacctgggttcaactgaagaacgcaaaaacatgcagcggaataagcaggtcgcaatgggcagaaaaaagttcaatatggaccctaagaagggtatacagtttctgatcgagaatgacctactcaagaatacgtgcgaggacatcgcccagtttctgtacaagggggaagggttaaacaaaacagcgatcggggactatctcggggagagggatgaattcaatatccaggtgctccacgcattcgtggagcttcatgagttcaccgatctgaatctcgtccaggctctcaggcagtttctgtggagctttcgcctaccgggagaagcacagaagattgatagaatgatggaagcatttgcacagcgttactgccagtgcaacaatggcgttttccagagcaccgatacttgttacgttctttcatttgcgatcataatgctcaacacatcgctccacaatcccaatgtgaaggataagcctaccgttgaacggttcatagctatgaatcgtgggatcaacgacgggggtgatctccccgaagaactgctaaggaatctgtacgagtcaatcaagaacgagccctttaaaattccggaagacgacgggaatgatctgacacacaccttcttcaaccctgacagggaaggttggctgttgaaacttgggggaagagtgaaaacgtggaagcgtaggtggtttatccttacggacaactgcctctactactttgaatacaccacagacaaagaacccagaggtattatacctttggagaatctttcaattcgcgaggtggaggattccaagaagcctaattgcttcgaactgtatatccctgataataaagatcaggttattaaagcctgcaagacagaggcagatggaagagtcgtggaggggaaccacacagtatatagaattagcgctccaacacccgaggaaaaagaagagtggattaagtgcatcaaagccgcaattagtcgggatcctttttacgagatgctggcagcccgtaagaaaaaggtttcctcaaccaaaagacactag

SEQ ID NO: 219941 - DNA, 1197 bp, Artificial Sequence
  Description of Artificial Sequence: Synthetic coding sequence
atggaagaggacgattcatacgtgccctcggatctgactgctgaggagaggcaggaactggaaaacattcgacggagaaagcaagaattgctggcagatattcagcgccttaaagatgaaatcgccgaggttgccaatgagatcgaaaacctggggtcgacagaagagaggaagaatatgcaaaggaacaagcaagtcgctatgggacgcaaaaagtttaacatggatcccaaaaagggcatccagttcctaatcgagaatgacctgctcaaaaacacctgcgaggacattgcgcagtttctctacaagggtgagggtttgaataagaccgcaatcggtgactacctgggagaaagagacgaatttaatattcaggtgcttcatgccttcgtggagctgcacgaattcacggatctgaacctggtgcaggccctgagacaatttctgtggtccttcaggttacccggtgaggcgcagaagattgacaggatgatggaggctttcgctcagcgttactgccagtgtaacaacggagtcttccaatctacagatacatgctatgtactgtcttttgccatcatcatgctcaatacatccttacataaccccaatgttaaagacaaaccaaccgtggagaggttcatcgcaatgaaccggggaattaacgacgggggagacctacctgaggaactcctcaggaacttatatgaaagcattaagaacgagcctttcaagatccccgaggacgacggtaatgacctcactcatacatttttcaaccctgatcgtgagggctggttgctgaagctgggcggtggtcgtgtgaagacatggaagagaaggtggttcatccttacagataactgtctttattactttgagtatacgactgacaaggaacctcgtggcattattcccctggagaacctgagtataagggaggtggaggattctaagaagccgaactgctttgaactgtatattccagacaataaagatcaagtgatcaaagcctgcaaaaccgaggctgatggtcgcgtcgtcgagggtaaccacaccgtatatcggatctctgccccaacacccgaagagaaggaagaatggatcaaatgcatcaaggctgccattagcagagatccattttatgagatgttggcagcaagaaaaaaaaaggtgagtagtacgaaacgccactag

SEQ ID NO: 219942 - DNA, 657 bp, Artificial Sequence
  Description of Artificial Sequence: Synthetic coding sequence
atgatggaggcatttgctcagagatactgtcagtgcaataatggtgtgtttcagtccacagacacttgctatgtcctctcctttgccatcatcatgttgaataccagtctccataatccaaacgtcaaggataaacccaccgtcgagagatttatcgctatgaatcggggaatcaatgacggtggagacctgcctgaagaactcttacgtaacctctacgaaagcattaaaaatgaaccttttaaaataccagaagacgatggaaacgacctgacccacaccttctttaatccggatagggaaggatggctgctgaaattggctggtggtcgcgtgaaaacatggaaacgacgatggttcattcttacagataactgcttatactattttgagtatacaactgataaagaacccaggggaatcatccccttagaaaatctgtccatccgagaggttgaagactcaaagaaacccaactgtttcgaactttacattcctgataataaggaccaagttattaaagcctgcaaaacagaggcggacggtcgagtagtcgagggtaaccacactgtataccggatcagtgcgccaacccctgaggagaaggaggagtggattaaatgtataaagttccaggtgtctccgggagaaccctag

SEQ ID NO: 219943 - DNA, 1197 bp, Artificial Sequence
  Description of Artificial Sequence: Synthetic coding sequence
atggaagaagacgactcctacgttccatcagatcttacggctgaagagcgccaggaactcgagaacatccggcgacgcaaacaggagctcctggcagatattcagagattgaaggacgagattgccgaggttgcaaatgaaatcgaaaacctgggctcaacggaagaacgcaaaaacatgcaaagaaacaagcaggttgcaatgggacggaagaaatttaatatggatccaaagaagggcatccagtttttgatcgaaaatgatctgctgaagaatacatgcgaagacatcgcccaatttctgtacaagggcgaaggcctcaataagaccgccattggggattacctaggcgaaagagacgagttcaacatccaggtcttacatgcttttgttgaactccacgaatttaccgacctcaacctagtgcaggccttgagacagtttttgtggagtttccgattgccgggagaagcgcagaaaatcgacagaatgatggaagccttcgcccaacgctactgtcagtgtaataacggggtttttcaaagcaccgacacctgttacgttctttcatttgccatcattatgctgaacacctccctgcataaccccaacgtcaaggacaagccgacggtggagcgtttcattgctatgaaccggggaatcaacgacggcggtgatttgcccgaagagttgttacgaaacctgtatgaatcaataaaaaacgaaccgttcaaaattccggaggatgacggtaacgacctgacccacactttcttcaatcccgaccgagagggttggctgctcaaactgggaggcggacgggtcaagacctggaaacgtaggtggtttattttgaccgacaattgtctctattactttgagtatacaacagacaaagaaccccgaggcattatacctctggagaatctctccatacgcgaagtcgaggattctaaaaagcctaattgtttcgagctttatatccccgataacaaggatcaggtaatcaaggcatgtaaaacagaggcagacggcagggtggtggaaggcaaccacaccgtctacaggatctccgcgcctacccccgaagaaaaagaggagtggatcaagtgcattaaagccgcaatttcacgcgatcccttctacgagatgctggctgccagaaagaagaaagtatccagcacaaagaggcactag

SEQ ID NO: 219944 - DNA, 1020 bp, Artificial Sequence
  Description of Artificial Sequence: Synthetic coding sequence
atgcagcgtaataagcaggtggccatgggaaggaaaaaatttaatatggacccaaaaaaaggaattcaatttcttatagagaacgatctgctgaagaacacctgtgaagatatcgctcaatttctttataagggagagggcctgaacaaaaccgccattggcgactacctcggcgagcgtgatgaattcaatatacaggtcttgcacgcctttgtggagcttcacgagttcacagatttgaatctagttcaagcgttaaggcagttcctgtggagcttccgcctgccgggagaagcccaaaaaatcgataggatgatggaagcattcgctcaacgctattgtcaatgcaacaacggagtgtttcaaagtacagacacctgttatgtcctgtcattcgctatcattatgctgaacacctccctgcataatcctaacgtgaaagataagcctaccgtcgaaagatttattgcgatgaatcgcggaatcaatgatggcggagatctaccagaggagctgctgagaaatctctacgagtccatcaaaaacgaaccatttaaaattccagaagatgatggtaacgaccttactcatacctttttcaaccctgaccgcgaggggtggctcctgaaacttggcggaggcagggtaaaaacatggaagcgtaggtggtttatcctcaccgacaactgcttgtactacttcgagtatacaactgataaggagccaaggggcatcattcccctggagaatctgagtatcagagaggtcgaggacagcaaaaaaccaaattgttttgagttatacattcccgataataaggaccaagtcattaaggcatgtaaaaccgaagccgacggcagagttgtggaggggaaccataccgtatataggatcagcgctcctacaccagaagagaaggaggagtggatcaaatgcatcaaggccgctattagcagggacccattctacgagatgctcgccgctagaaagaaaaaggtgagctctaccaaacgccattag

SEQ ID NO: 219945 - DNA, 1020 bp, Artificial Sequence
  Description of Artificial Sequence: Synthetic coding sequence
atgcagcgaaacaagcaggtggccatgggtaggaagaagttcaatatggaccctaaaaagggcattcagttcttgatcgaaaacgatttactgaagaacacctgcgaagacatcgctcagtttctatacaaaggcgaaggactgaataagactgcaatcggagactatctgggggagagggatgaatttaatatccaggtcctgcatgcttttgtcgaattacatgagttcaccgacctcaacttggtccaggctctgcggcaatttttatggtcattccggctgccgggtgaggcgcagaaaatcgaccgcatgatggaggcctttgctcaacgctattgtcagtgcaataacggcgtcttccagtctactgacacttgctacgtgttatcctttgccattataatgcttaatacaagccttcataacccaaacgtcaaagataagccaacggtagagagattcatagccatgaacaggggaatcaatgatggaggcgacctccctgaggagctgcttcgtaacctgtacgagagcattaaaaatgaaccatttaagattccagaggacgatggtaacgatctgacacataccttttttaacccagaccgggagggatggcttttgaaactgggcggtgggagagtgaaaacatggaaaagaaggtggtttatcctgacggacaactgcctctattatttcgaatacactaccgacaaggagccacggggtataattcctctggaaaatttgtctatcagggaagtggaagactcgaagaagccaaactgcttcgaattatatataccagacaataaggaccaggtgatcaaggcctgcaagaccgaggcagacggacgcgtggtcgagggcaaccatacagtctatcgaatttctgcccctacgccagaggagaaggaggaatggatcaagtgcatcaaagccgcaattagccgggaccccttctatgaaatgctcgccgcacgaaagaaaaaagtttcgagcacgaaaagacattag

SEQ ID NO: 219946 - DNA, 1080 bp, Artificial Sequence
  Description of Artificial Sequence: Synthetic coding sequence
atgtccctgcaacgcctccttcagcacagtagcaatggcaatcttgctgatttttgcgcaggacccgcttactcatcatacagcactctgacaggatcactcacgatggatgacaacaggcggattcagatgctcgctgacactgtggctaccttgccaagaggaaggaagcaactcgctttgactaggtcttcctccttaagcgatttctcctggtctcagcggaaactcgtcacggtggagaagcaggacaatgaaacattcggctttgagatacagagttaccgaccacaaaaccagaacgcttgcagctctgagatgttcaccctgatctgcaagatccaggaagactctcctgcccattgtgctggcctacaggccggtgacgtcttggcgaatatcaatggggtcagcactgagggctttacttataaacaggtggtagatctcattagatcctcagggaatctgctcacaatcgaaactctgaacggcacgatgatccttaagaggactgaactggaggcaaaactgcaagtcctgaagcaaactctgaaacagaagtgggtggagtatcgttcccttcagctacaggaacatagactgctgcacggtgatgctgcgaattgccctagcctggaaaatatggacctggatgagttgagcctcttcggaccactgcctggcccaggccctgctttggtggatcgcaaccgtctgtcgtccgaatcgtcttgcaaatcctggttgagctccatgaccatggacagcgaggatggataccagacttgtgtttccgaggactctagccggggagctttctcacggcagacaagcactgatgacgaatgtttcatccccaaggagggggacgactttcttagacgcagctcttcccgcaggaatcgctcgattagtaacacaagtagtggcagcatgtctcctctatgggaaggcaatctttcatctatgtttgggacactgccaaggaaatcgaggaaggggtccgttaggaaacagctgctgaaatttattcccggactacatcgggctgtcgaggaggaggagagtcgcttttag

SEQ ID NO: 219947 - DNA, 762 bp, Artificial Sequence
  Description of Artificial Sequence: Synthetic coding sequence
atgttcacactcatctgtaagatccaggaagattcccccgctcactgtgccggtcttcaagctggggatgtgctcgctaatatcaatggcgtgtccaccgaaggcttcacttacaaacaagtggtggacctgatccgctcaagtggaaacctcctaacaatcgaaactctgaacggcactatgatactcaagcgcacagagctggaggctaaactccaggtgctcaaacagaccctcaaacaaaagtgggtcgaataccgttccctgcaacttcaggagcatagactcctgcatggcgacgccgcaaactgcccaagtctggagaatatggatcttgacgaactctccctttttggacctttgccgggaccgggaccggctctggtcgatcgcaacaggttgagcagtgaatctagctgtaaatcttggttatccagcatgactatggattccgaggacgggtaccagacatgtgtcagtgaagattcctcccgaggagccttctcccggcagacctccacagatgatgagtgttttattccgaaggagggggacgacttcttgcgccgttcgtcatcccgccgaaataggtccataagtaacacatcatcgggcagcatgtctccactgtgggagggaaacctgtcatctatgtttggaacattgcccaggaaatcacggaaaggaagcgtgaggaaacaactgctgaagtttattccaggtctgcacagggctgtggaggaggaggagtccaggttttag

SEQ ID NO: 219948 - DNA, 1203 bp, Artificial Sequence
  Description of Artificial Sequence: Synthetic coding sequence
atggaagacggcgtttatgagcccccagacctcacgccagaggaaaggatggagctagagaatattagacggaggaagcaggagctactggtagaaattcagcgcctgcgggaagaactgtccgaagccatgagtgaggtcgaaggactcgaggcaaatgaaggaagcaaaacactgcaacggaaccggaaaatggccatgggtaggaaaaaattcaacatggatccgaaaaagggcatacagtttctggttgagaacgagctcctgcagaacactcctgaggagatcgcccgttttctgtataaaggcgagggccttaacaagaccgccataggcgattacctcggcgaaagggaagaactgaacctggccgtgctgcacgcgtttgtcgacctgcacgagttcaccgatctgaatctggtgcaggccctgcggcagttcctgtggtccttcaggcttcccggtgaagcccagaagattgatcgcatgatggaggcttttgctcaacgctattgcctgtgcaacccgggagtgttccagtccacggatacctgctatgtgctgagttttgccgtgattatgctcaatacaagtttgcataacccaaatgtacgcgacaagccaggacttgagcgcttcgttgcaatgaaccggggtatcaacgaggggggagatttgcccgaggagctgctccggaatctttatgacagcatccggaacgagccctttaagatccccgaagatgacggcaacgatctcacccatacatttttcaatccagacagggagggatggttgctgaagttggccggtgggagagtgaagacgtggaaacggaggtggtttatcctgaccgataactgtctgtattatttcgaatacactaccgataaggaacctaggggaatcatccctctggagaacctgtcaattcgcgaagtcgacgaccctcgaaagccaaattgcttcgagctatacattcctaataacaaaggtcagctgattaaggcgtgcaagactgaagccgacggaagagtagtcgagggcaaccatatggtataccgcatcagtgcgcctactcaagaggaaaaagacgaatggatcaaatcaattcaagctgctgtctcagtagaccctttctacgaaatgctggccgctcgaaaaaaaagaatttccgttaagaaaaaacaggagcagccctag

SEQ ID NO: 219949 - DNA, 1200 bp, Artificial Sequence
  Description of Artificial Sequence: Synthetic coding sequence
atggaagatggcgtgtatgaacctccggacctcacacccgaggagagaatggagctggagaatatacgaagaagaaagcaggaattgttggtagaaattcaacgccttagagaagaactctccgaggcaatgtcagaggtagaaggactggaagcgaacgagggtagtaaaactctgcaacgtaacagaaaaatggcgatgggtcggaaaaagttcaacatggaccccaaaaaggggatccagtttctggtggagaacgagctcctgcagaatactccagaagagatagcacgttttctgtacaaaggtgaaggactcaacaagacagccatcggcgattatctgggggagcgggaagaactgaacttggccgtgctccacgctttcgtggaccttcacgaatttactgaccttaacctcgtgcaggctttgcggcagttcttgtggtcctttcgccttcctggagaagcacagaagatcgacagaatgatggaggccttcgcccagagatactgtctttgtaaccctggcgtattccagagtacagacacctgctatgtactaagctttgccgtgataatgctgaacacttcactgcataaccctaacgtgcgtgataaacctggtctggagcgattcgttgctatgaacagaggaatcaatgagggcggtgacctgcccgaggaacttctccgtaatttatatgattccatccgcaacgagcctttcaagattcccgaggacgacggaaatgacctcacgcacacattcttcaacccagatagagaaggatggctgctcaagcttggcggtagggttaagacctggaagcgccgttggtttatcctgactgacaactgcttgtattacttcgagtatactactgacaaagaacccagggggatcataccactggaaaatctgtctatccgcgaggtggacgatcccagaaaacccaactgctttgagctgtacattcctaacaacaaggggcagctcataaaggcatgtaaaactgaggctgatggcagggtggtagagggtaaccatatggtatacaggatctccgcaccgacccaggaggagaaagatgagtggattaagtctattcaggccgcagtgtccgtggatcccttctacgagatgctcgccgcaaggaagaaaaggatatctgtaaaaaagaagcaagaacagccctag

SEQ ID NO: 219950 - DNA, 1200 bp, Artificial Sequence
  Description of Artificial Sequence: Synthetic coding sequence
atggatgaagacggcggaggtgagggaggtggggtgcccgaagacctgtcactcgaggagagggaggaactgctggatatccggaggcgcaaaaaagagttaattgatgacatcgagcgcctgaaatacgagatagcagaggtgatgacggaaattgataacctcacctccgttgaggaaagcaaaaccactcaacgcaataagcagatagcaatgggtaggaaaaaatttaacatggatccaaagaaaggcattcagtttctgatcgaaaacgatctcctgcagtctagccctgaggatgtcgcccaatttctctataagggggaaggcctaaataaaaccgtgatcggtgactacctgggcgaaagagacgaattcaatataaaagtgctgcaggcattcgtagagttgcacgaattcgccgatctgaacctggttcaagcactcaggcaattcctgtggtcttttagattaccgggagaggcccagaagatagacaggatgatggaagcttttgcatcccgatattgcttatgtaatcctggcgtgttccaaagtaccgacacttgttacgttctgtcctttgccatcattatgctgaacacgagtttacataaccacaacgttcgggataagcccacagcagagagattcatcgcaatgaatcggggtatcaacgaaggtggcgatctgccggaggaattactccgtaatctttacgagtctataaagaacgagccattcaagatccccgaggatgacggcaatgatctgacccacaccttctttaacccagatagagaggggtggcttctgaagttggggggaagagtgaagacatggaagcggaggtggttcatactgacggacaactgcctctactattttgagtataccaccgataaggagcctcggggaattatcccattggaaaatttaagtataagggaggtagaagatccacgcaaacccaattgctttgagctttataacccttctcataagggacaagtgataaaggcatgcaagaccgaagctgacggtagagtcgtggaaggcaaccacgtcgtctaccgaatctccgccccatcacccgaagagaaggaggagtggatgaaatcaatcaaggcaagcatttctcgtgacccattttacgacatgttggctaccagaaaaaggaggatcgccaacaaaaaatag

SEQ ID NO: 219951 - DNA, 945 bp, Artificial Sequence
  Description of Artificial Sequence: Synthetic coding sequence
atggcacttccacagctgcagaccgccatgttggctgcatttctgtgggatccgagggatgtggttcttactgcccaaccaggcgctgagcagtgtgccgagagctctcagcatatccgaatattgcagccacagttcagactcatccgactcagattttggaagctgtacatccagcgacgcgtgcaggcctggcagttcctgtggagctttcggctcccaggtgaggcccagaaaattgataggatgatggaagctttcgcatccagatactgcctatgcaacccaggagttttccagtcaaccgacacctgttacgtgttgtcttttgccataatcatgttgaatacaagcctgcacaaccataacgtccgagataagcctaccgccgaaagatttattgccatgaatagaggcataaacgagggaggtgatctgcctgaggaactcctgcggaatttatatgaaagcattaagaacgagcccttcaaaattcctgaggacgatggcaacgatcttactcacaccttctttaacccagaccgcgagggctggttactgaaactaggcggtagggtgaagacctggaaaaggagatggttcatcctgaccgataactgtctgtactatttcgagtatactaccgataaggagccacgaggcatcattcctctggagaatctgtccatccgtgaggtggaggaccctagaaaacctaattgtttcgaattatacaatccctcgcataagggccaagtgattaaagcctgtaaaacggaggccgacggacgggtcgttgaggggaaccatgttgtgtaccgaatctccgcgcctagcccagaagagaaagaagaatggatgaagagtatcaaggcaagcatctcccgggacccattctacgacatgctggcaacgcgcaagagacgcatcgcaaataaaaagtag

SEQ ID NO: 219952 - DNA, 1185 bp, Artificial Sequence
  Description of Artificial Sequence: Synthetic coding sequence
atggacctctgtcaccctgagcccgctgagcttagctccggtgagacagaagagctccagcgcataaagtggcatcggaaacaactgttagaggatatacaaaaactcaaggacgagatcgctgatgttttcgcgcagatcgactgctttgaatcagctgaggagagccgcatggctcagaaggagaaagaattgtgtatcgggaggaaaaaatttaatatggatcctgccaagggcatccagtactttattgagcacaagcttctgactccggacgtgcaggatattgcacggtttctgtacaaaggggaagggctgaataaaaccgctatcggaacatatttaggagaaagggatccaatcaatctccaggtgctccaggccttcgtggattgccatgagttcgctaatctgaacttagtccaggcactgcggcagttcctatggagctttcgcctcccaggggaggcacagaagatcgaccgtatgatggaggcgtttgcaacccggtactgtctatgcaaccccggtgtgttccagagcactgacacctgctatgtcctaagtttttcaattataatgcttaacacctctctgcataatccgaatgtgcgagataggcctccgtttgagcggttcgtgagcatgaaccgcggaattaacaacggaagcgatctgcccgaagaccagctcagaaacctcttcgactcaatcaagtctgaaccattctcgattccggaggacgacgggaacgatctgacgcacaccttcttcaatcctgatagggagggctggctactcaagctgggaggcagggttaaaacttggaagagacgctggttcatccttactgacaactgtctctactactttgaattcaccactgacaaggaacccaggggaatcattccacttgaaaacctgagcgtgcagaaggttgatgacccaaaaaagcctttctgtctggagctgtacaacccatcctgcagaggacagaaaatcaaggcttgtaagactgacggcgatggcagggtggtggaagggaagcacgagtcttatagaatcagcgctacgtctgctgaggagcgggatcagtggatagagtccattcgggcatccattacgcgggtgcctttttatgatctggtgtccactcgtaaaaaaaaaatcgcctctaagcagtag

SEQ ID NO: 219953 - DNA, 474 bp, Artificial Sequence
  Description of Artificial Sequence: Synthetic coding sequence
atggatctgtgtcatcccgagcccgctgagctttcaagcggggaaaccgaggaacttcagcggattaaatggcatagaaagcagctgttggaggatatccagaaactcaaagatgaaattgcagatgtttttgcacagatcgattgtttcgagtctgccgaggaatcaagaatggctcagaaagaaaaagagctgtgcattgggcgtaagaaattcaatatggatcccgctaaaggaatccaatactttatcgaacacaagttgctgacgcccgacgtgcaggatatagcccgattcctttataagggagagggacttaataaaactgccatcggtacttatctcggggagagggatcccataaatttgcaggttctgcaggcatttgtggattgccatgagttcgcgaaccttaatctggtccaggccctgaggtttagagaaggcgcttccgacctgggcttcggaggctag

SEQ ID NO: 219954 - DNA, 876 bp, Artificial Sequence
  Description of Artificial Sequence: Synthetic coding sequence
gatagatccactggtcacttgttccctagaggagtgggtatggatctatgtcacccggaacccgctgagctgtcatccggtgaaacggaggaactgcagagaatcaagtggcacagaaaacagctcctcgaggacatccagaagttaaaggacgaaatcgcagatgttttcgctcagatcgactgtttcgagagcgctgaggaaagcaggatggcccagaaggaaaaagagctgtgtatcggcagaaagaagttcaacatggaccctgccaagggcatccaatactttattgaacacaagctgctcacacccgatgtgcaggacatcgctagattcctatacaaaggcgaggggctgaacaagaccgccatcggaacctatcttggcgagcgggatcccatcaacctccaggtgctgcaggcatttgtcgattgccatgaattcgcaaatctcaaccttgtccaggcattacggcagtttctgtggtcatttcggctcccaggagaagcccagaagattgatcgtatgatggaggcattcgctacacggtactgcctctgcaaccccggagtgtttcagagcactgatacgtgctatgtcctgtcatttagtattattatgttaaatacaagcctgcacaaccccaatgtgcgggaccgcccacccttcgaacggttcgtgagcatgaacagagggataaacaacgggagtgacctccctgaagatcagttacgcgttacatgggagtgttctcaacgcaggtctcgggagcgtacttttcagaaggaagaagttgctaggaccgaagcctgccctgactgggaacgtcgcggtgtccaatgcggcagagaaccattgagacaacaccaggagtag

SEQ ID NO: 219955 - DNA, 444 bp, Artificial Sequence
  Description of Artificial Sequence: Synthetic coding sequence
tgaacccataccagtgggagcctctcctcccgggatagccaagctggcgactccgcgtccagggccggaggcagggttaaaacatggaagcggcgttggttcattttgacagacaactgtctgtattacttcgagttcacaacggataaagaacccagaggcatcattcccctggaaaatctcagcgtgcagaaggtggatgacccaaagaaacctttctgcctggagctgtacaacccatcctgcaggggccagaagatcaaggcctgcaagactgacggcgatggacgtgtggttgaggggaagcacgaatcatacaggatcagcgctacatctgcagaagaacgggatcagtggattgaaagtattcgtgctagcattaccagagtcccattttacgacctcgtctccacgcggaagaagaagattgcctcaaaacagtag

SEQ ID NO: 219956 - DNA, 354 bp, Artificial Sequence
  Description of Artificial Sequence: Synthetic coding sequence
atggacctctgtcacccagagcccgctgagttgtcatccggggagaccgaggagcttcaaagaattaagtggcatcggaaacagctgctggaggatattcagaagctgaaagatgaaatcgctgacgtctttgcccagattgattgcttcgagagtgccgaggagtcacgaatggctcaaaaagagaaggagctttgcattggccgaaaaaagtttaatatggaccccgctaaagggattcagtattttattgagcacaagctgctgaccccagacgtccaggatattgcccgtttcctctacaagggggagggcctgaataagactgccattggaacttatttgggtgaatag

SEQ ID NO: 219957 - DNA, 777 bp, Artificial Sequence
  Description of Artificial Sequence: Synthetic coding sequence
atggtgctctgcgttcagggaccgagaccccttctcgccgttgagcggaccggccaacggcctttgtgggccccttcacttgaactcccgaagcctgtgatgcagcccctgcctgccggagccttcctggaagaggtggcggagggtaccccagctcagactgaatccgaacctaaagtgttagatcccgaagaagatctgctgtgtattgcaaagacattttcttaccttcgcgagtctggatggtactggggctcaatcacagcgtcagaagcgaggcagcatctgcaaaagatgccagagggaacttttctggtgcgcgacagcactcatcccagctacctgtttacactcagtgtgaaaacgacacggggaccaactaatgtgaggattgaatatgcagatagcagctttagactagattcaaattgcttgagccggccacgcatactcgcgtttcctgacgtggtttccctcgtacagcattacgtcgccagctgtaccgccgacacccggagcgacagccccgatcccgcacccacaccggctttacctatgccgaaagaagacgcgccttctgaccccgctctcccagcccctcctccagctaccgcagtgcacctgaagctcgtgcaacctttcgtgcgcagatcaagtgcacgaagcctgcagcatctgtgtaggcttgtaattaatcgcttggtagcagacgtggactgtctccctctcccccgacgaatggctgattacctacgccagtacccattccagctttag

SEQ ID NO: 219958 - DNA, 828 bp, Artificial Sequence
  Description of Artificial Sequence: Synthetic coding sequence
atgtatctcgagcacacctcgcattgtccccatcacgatgacgacacagctatggacacccccctgccacgccctagaccactactggccgtggaacgaactggccagcggccactgtgggctcctagtttggagttaccaaagcctgtgatgcagccgctgccagccggagcttttcttgaggaagttgccgagggaacgccagcacagacagagtccgagcccaaggtgctggacccggaggaggatctcctgtgtatcgcgaagaccttcagctacctaagggaatccggctggtactgggggtcaatcaccgcttccgaagctcgacaacatcttcaaaagatgccggaggggaccttcctggtaagggacagcactcacccttcttatttgttcaccctgagtgttaagacaactcgcggtcctactaacgtgcgaattgaatacgcggacagctcctttcgtcttgattcaaattgcttgtcccgtccaagaattctcgcctttcccgacgtggttagcctggttcaacattatgtcgcttcctgcaccgctgataccagaagcgatagtccagaccctgcccctacccctgccctccctatgcctaaagaggatgcaccttccgacccagcacttcctgcacccccaccagccactgcggtccaccttaagctggtccaaccgtttgtgcgtagaagttccgctcggtccctgcaacatctctgtcggctggtcatcaacaggctcgttgccgatgttgattgcctccctctgcctaggcgaatggctgattatctccggcagtatccctttcagctgtag

SEQ ID NO: 219959 - DNA, 1269 bp, Artificial Sequence
  Description of Artificial Sequence: Synthetic coding sequence
atgcccgctggaaggaggggtcccgcagcgcagtcagccagacgcccaccccctctccttcctctgctccttctcttatgcgttttaggggcacccagagctggatccggcgctcacactgccgtgatcagcccccaagaccccacattactgatcgggagttccttgctggcaacttgcagtgtgcatggtgaccctccgggtgccacagccgagggcctgtattggacgctgaacgggcgaagattgcccccagagctgagtcgagtgcttaacgcctccactctggctttggcacttgctaacctgaacggctcacgtcaacggtccggcgataatctggtgtgtcacgcccgtgatggaagtattctggccggaagctgtctttacgtggggctgcctccagaaaagccagtgaatattagctgttggagtaaaaatatgaaagacctgacttgcaggtggacccccggtgcccacggtgagactttcttgcatacgaactactccctgaaatacaaactccgatggtacggccaagataatacatgtgaagaataccacaccgtgggcccacacagttgtcatattcccaaagatctggcgctctttactccatatgaaatatgggtggaagcaactaaccgtcttggctctgcaaggtccgacgtgttaactctcgatatactggacgtggtcacaactgaccccccacctgacgtgcatgttagcagagttggcggactggaagaccagctgtcagtgagatgggtttctccgccagcactaaaggattttttgttccaggccaagtatcagatacggtatagagtggaggattcagtagactggaaagttgtagacgatgtgtctaatcagacctcctgtaggcttgcaggacttaagcccggtacagtgtacttcgtgcaggtccgatgtaacccatttgggatctacggatccaaaaaggccggaatctggtctgagtggagtcatcccacggccgcttccacccctcgctcagagagacctgggcctggcggtggcgcttgtgagccacgcggaggtgagccgtccagcggccctgtgcgacgggaactcaagcaatttctagggtggcttaagaaacacgcctattgtagcaatctgtcttttagactgtacgaccagtggagggcctggatgcagaagagtcataagactcgcaaccaagatgaggggatcctgccttccgggaggcggggaacagcaagggggccagcacgctag

SEQ ID NO: 219960 - DNA, 702 bp, Artificial Sequence
  Description of Artificial Sequence: Synthetic coding sequence
atggggagactggtcctcctgtggggagctgcagtgttcctgctggggggttggatggccctcggacagggaggagccgctgagggagttcaaatccagattatatacttcaacctagaaaccgtccaggttacttggaatgcgtccaaatacagcagaaccaacttgaccttccactacagatttaatggcgatgaagcatacgatcagtgcaccaattatttacttcaggagggacatacctctggctgcctccttgatgctgaacaacgtgatgacatcctgtacttctcaatacggaatgggacccaccctgtcttcacagcttccaggtggatggtatattaccttaagccaagttctccgaagcatgtcaggttctcctggcaccaagatgccgtaacagttacttgctcagatctctcctatggagatctgctgtatgaagtgcaatatcgtagcccttttgacactgaatggcagactcagtcaagaagcgttacccaagctggtgtgcagtggtgcgatttgtgcctgctccaaccctcccctcctcgcttcaaaagattttcttgcttaagtctgccctcatcatgggactatagacaccccccacccaggctggccaacttctgcatcatttctcgggatggtgtatccccatgctggcccggatggtcccggacatgcgacctgcgctag

SEQ ID NO: 219961 - DNA, 771 bp, Artificial Sequence
  Description of Artificial Sequence: Synthetic coding sequence
atgggccgtctagtgctgctatggggagccgcagtgtttctcctgggtggctggatggcgcttggccaggggggtgctgccgagggagtccagatacagatcatctacttcaacctcgagacagttcaggtgacctggaatgcatctaagtactcacgaaccaaccttaccttccactacagattcaacggagacgaagcatatgatcagtgcacgaactatttactccaggagggccatacttcaggctgtttactggatgctgagcagcgcgacgatattctgtatttctccattaggaatggcactcacccagtcttcacagcctcgcggtggatggtgtactatctgaaaccctcaagtccaaagcatgtgcggttcagctggcatcaggatgctgtgacagtaacttgctccgatttgtcttacggggatctgttgtacgaggtccagtatcgcagcccgttcgatacagaatggcagagcaagcaggaaaacacctgtaatgtgacaatcgagggcctcgatgcggaaaaatgctatagcttttgggtacgcgtcaaagcgatggaggacgtctatgggccagacacctaccctagtgactggtccgaagtcacatgctggcagcgcggtgaaatcagggacgcatgcgccgagaccccaacgcctcccaaaccaaagctgtccaaattcatcctgattagcagcctcgccattctcctgatggtgagcctcttactgttatcactatggaagctctggaggtag

SEQ ID NO: 219962 - DNA, 768 bp, Artificial Sequence
  Description of Artificial Sequence: Synthetic coding sequence
atggggcgactagtccttctttggggagccgcagtcttcctgttagggggttggatggccctcgggcagggaggagctgcagaaggagttcaaatccagataatttatttcaatttggaaacagttcaggtgacttggaacgctagtaagtattctcgcactaatctgactttccattacagattcaacggtgatgaagcatatgaccagtgcacaaattacctgctgcaggaagggcacacatccggctgcctgttggacgctgagcagagggatgatatcctctacttcagcatccggaatggaacccacccagtcttcacagccagccggtggatggtgtactatctgaaaccttcaagtcccaagcatgtccgattctcttggcatcaggacgcagtgactgttacttgctcggatctcagctacggcgacttgctgtatgaggtgcaatatcgaagtcctttcgacacggagtggcagagcaaacaggaaaatacatgcaatgtcactattgaagggcttgatgcggaaaaatgttactcattctgggtaagagtgaaagccatggaggacgtgtacggcccagatacttacccgtctgactggagtgaggtgacgtgttggcagcgaggagagatacgagatgcttgtgctgagacacctacaccgccaaagccgaaactgagtaagttcatcctgatcagcagcctggcaatcctcttgatggtgtctctgcttttgctgagtctgtggaagttgtggtag

SEQ ID NO: 219963 - DNA, 411 bp, Artificial Sequence
  Description of Artificial Sequence: Synthetic coding sequence
atgcgaactcctggccctctgccagtgctcctgctgttactggccggagcacccgctgcgaggcctaccccacctacctgttactcaagaatgagggccctgagccaagagataactagagatttcaaccttttgcaggttagcgagccctcagagccctgcgtacgctatttaccgcgtttgtacctcgatatccataactactgcgtcttagataagcttcgcgattttgtggcaagccccccttgttggaaggtggcccaagtagatagtttgaaagataaagcccgaaagttgtacacgattatgaacagcttctgccgcagggacttggtgtttttgctggacgattgcaatgcattggagtatccaattcctgtgaccactgtgttgccagaccggcagcgatag

SEQ ID NO: 219964 - DNA, 3762 bp, Artificial Sequence
  Description of Artificial Sequence: Synthetic coding sequence
atggcagcccaagtgacactggaagatgccctttccaacgtggatctcttggaagagctacccctcccagaccagcagccctgtatagagccgccaccctctagtttgttgtaccagccaaatttcaacaccaattttgaggatcggaacgccttcgttacaggaatcgccaggtacatcgaacaggccacggtccactccagcatgaacgagatgctagaggaaggacaagaatacgctgtcatgctgtatacatggagatcttgcagtcgggctattccccaagtaaagtgtaatgagcagcccaaccgggtggagatatatgaaaaaacggtggaagttctcgagccagaagttaccaagctgatgaacttcatgtactttcagaggaatgccatcgaacgcttttgtggcgaagtgaggcgcctgtgccatgcagagaggaggaaggactttgtgtcagaggcatacctcattacactcggtaagtttattaacatgtttgccgtactagatgaactcaaaaacatgaagtgctccgtgaaaaacgaccacagtgcctacaagcgggcagctcagtttcttaggaaaatggccgacccgcagtctatccaggaaagtcagaacctaagcatgtttttagccaaccacaacaaaatcacacaaagcctccagcagcagcttgaggtgataagcggctatgaggaactgctagcagatattgtgaatctgtgcgtcgactattatgaaaaccgtatgtatctgacccccagtgagaagcatatgctgttgaaggtgatgggctttggactgtacctgatggatggatcagtcagcaatatttacaaactggatgccaagaaacgcattaacttaagtaaaatcgataagtactttaaacagcttcaggtggtccccctgtttggcgacatgcagatcgagcttgccaggtacatcaaaacctccgcacactatgaggaaaacaagagtcggtggacctgtacgtcctcgggctcttcgccacaatataatatctgcgagcagatgatccagatacgggaagaccatatgaggttcatctcagagctcgcgaggtattcaaattcggaggtggtgactggttcaggacgccaggaggcccagaagacagatgcggagtataggaagctgtttgatcttgctctgcaggggctgcaacttctgagccagtggtctgcccacgtaatggaggtttatagctggaaactagttcacccaacagataagtattcaaacaaggattgccctgattctgctgaggagtatgaacgcgcaacacgctataactatacgtccgaggaaaagttcgcactagtggaagtgatcgctatgattaaaggcctgcaagtactgatgggtcggatggagtcagtcttcaaccatgctatacgccacacggtttatgctgcactgcaggatttcagtcaggtcacgctgcgggagcccctgcgccaagccatcaaaaaaaagaagaatgtgattcagagcgtgctgcaagcgattaggaagactgtctgtgactgggaaacaggtcacgaacccttcaatgacccagccctccgcggagaaaaggatcccaaatccgggtttgacatcaaagtcccaaggcgggctgtcgggccaagctcaacccaactttacatggtcaggactatgctcgagtcacttattgccgacaaatcagggtccaagaaaactttaagatctagcttggagggaccaactatcttggacatagagaagtttcacagggagagcttcttttatacacacctgatcaatttctctgagaccttacagcagtgctgcgacctctcacagctgtggttcagggagttcttcctggagttaacgatgggaaggcgcatccagttcccaatcgaaatgtctatgccatggattttaacagaccacatactcgaaactaaagaggcctccatgatggagtatgtgctttacagcttagacctttataacgattcagctcactacgcattgacccgcttcaacaagcagttcctgtacgacgaaattgaggccgaggtgaacctttgtttcgatcaatttgtctataagctcgccgaccaaatctttgcgtactacaaggtaatggcagggagcctccttctggacaaacgcctgaggtcagagtgcaaaaaccagggcgctacaatccatttgcctccctctaaccgctatgaaacattgctgaagcagagacatgtgcaactcctgggtcgctccatcgacctgaaccgcctgatcacacagcgcgtgtcagctgcgatgtataaaagcctggaacttgctatcgggagattcgagtctgaggatttgaccagcatcgtcgaattggatgggctgctagagatcaatcggatgacacacaagctccttagtcgatatcttacactggatggattcgatgccatgtttcgagaggcaaaccataatgtttctgcgccatacggcagaatcactcttcatgttttctgggaactgaattatgattttctgcccaactactgctataatggcagtaccaaccgattcgtacggacagttctaccctttagccaagagtttcagcgggacaagcagccgaatgcacaaccccaatacctgcacggctccaaggcactgaatctggcatattccagtatatatggatcctataggaactttgtggggcctccccattttcaggtcatctgtagactgctcggctaccaaggcatcgcagttgtgatggaagagctgttaaaagtagtaaaatccttgcttcagggtaccatcctgcagtacgtcaaaacactgatggaggtgatgccaaaaatctgtcggcttccaaggcatgagtatgggagcccaggtattctggagttcttccaccaccagttgaaggatattgtggagtacgccgaactgaaaaccgtgtgcttccaaaacctccgtgaggtaggcaacgccattctgttctgcctgctgatcgagcagtctctatccctggaggaagtgtgcgatctgttgcatgccgcaccgtttcagaacatcctgccaagggtacacgtcaaagagggagaacgattggatgccaaaatgaaaagactcgagtccaaatatgcacctctccacttagtacctctaatagagcgccttggcactcctcagcaaattgccattgcacgggaaggggacttgttgacaaaggagcgcctttgttgcggcctgtccatgttcgaagtcatactcaccagaatacgatcattcctagacgatcccatttggcgaggcccactaccttccaatggggtgatgcacgttgacgaatgcgtggagttccacagactgtggtccgcaatgcaatttgtgtactgtatcccggtgggaacccacgagtttaccgtggaacaatgctttggggatggtttacactgggccggttgcatgataattgtgctcttgggccagcagcgtcggttcgctgtcctggacttttgctatcatttactgaaggttcaaaaacacgatggcaaggatgaaattattaaaaacgtgccactaaagaaaatggttgaaagaatacggaaatttcagattttaaatgatgagattatcaccatattggacaagtatttgaagtccggggacggcgagggaactcctgtggagcacgtaagatgcttccagccacctatccatcagagcctagctagcagctag

SEQ ID NO: 219965 - DNA, 3768 bp, Artificial Sequence
  Description of Artificial Sequence: Synthetic coding sequence
atgggacccaagcatgttcttaggcagcccggaccgtccgagcgccatcatccagaagtcccagcatggacccctagggcaggtcccccttgttggctctgtcgtcagcgctgggggtggacgttgcacccacctgggagggggtgtcctgcgctgctgctcagcgagcctagaatggccgctcaagtgaccttggaggatgccctatctaacgttgatctgctagaggagcttcctctcccagaccagcagccctgtatcgagccacctccatcttcgcttctgtaccagaatgagatgctggaagaggggcaggagtatgcggtgatgctctatacgtggcgctcatgctcccgcgcaatccctcaggtcaagtgtaatgaacagcctaatagagtggaaatctacgagaaaactgtggaggtcctggagcccgaagtcacaaagctgatgaactttatgtattttcaacggaacgccatcgaaagattttgcggtgaagtgaggcggctttgtcacgctgagcggaggaaggatttcgtttccgaagcctatctgatcacattgggcaaatttataaacatgttcgccgtgcttgatgagctcaaaaacatgaaatgctccgttaagaacgaccattctgcttacaagcgagctgcacagtttctcagaaagatggcggacccacagtccatccaggaaagccagaacctctcaatgtttctcgctaatcataataagatcactcagagcctccagcagcagctcgaggtcattagtggctacgaggagctgctggcagacatagtgaatctctgcgttgattattacgaaaacagaatgtaccttactcctagtgagaagcatatgttgttgaaagtgatgggtttcggcctctatctgatggacggtagcgtgagcaacatatacaaactggacgctaaaaagcgaattaacttgtccaagatagataagtatttcaagcaattgcaggtcgtgccactgtttggcgacatgcagattgaactggcacgttacataaagacctctgcccactacgaggagaataaatcaaggtggacttgcacttcttctggaagttcaccgcaatataatatctgcgagcagatgattcagatccgagaagatcatatgaggttcatcagtgagctggctaggtactcaaattccgaggtcgtgacaggatccgggagacaggaagcacagaagacggacgctgaatacaggaagctattcgatctggccttgcagggactgcaactgttgtcccagtggagcgcacatgtcatggaagtgtacagttggaagttagtgcacccgactgacaagtacagtaacaaggactgccctgactccgctgaggagtacgaacgtgcgacccggtacaattacacctccgaggagaagtttgcactggtcgaggtgatcgccatgattaaggggttgcaggtgttaatgggacggatggaatctgtgttcaaccacgcaattcgccacacagtctacgctgcgctccaggacttttcccaggtcactcttagagagccgctgcgacaggccattaagaaaaagaagaatgttattcagagcgtcctacaagccattaggaagacggtgtgtgattgggagacaggccatgagccttttaacgacccagcgctacgtggcgagaaagatcccaagtccggatttgacattaaagtgccaaggcgcgcagtgggaccgtcttccactcagctctacatggtgagaactatgctggagtctctgattgccgacaaatccggttcgaaaaaaacactaaggagctccctcgaaggacccaccattctggacattgaaaagttccacagggaatccttcttctacacccacctgatcaacttttcagaaaccttgcagcagtgctgcgacctttctcagctctggtttagagagttcttcctggagctgacgatgggtaggcgcatccaatttcccatcgaaatgagtatgccgtggatactcacagaccacattttagagacaaaggaggcttcaatgatggaatatgtgctgtattcgttggatctgtataatgactcggcccattacgctctgacacgcttcaacaagcagttcttatatgacgaaatcgaggccgaagtgaatctgtgcttcgaccaatttgtatacaagctggccgatcaaatctttgcttattacaaggtcatggccggtagtctactactagataaaagattgcgaagtgagtgtaaaaatcagggggcaactatccacttgcctccatcaaaccgctatgagaccctgcttaagcagcgtcacgtgcagttactcggccgaagcattgacttaaacaggctgattacacaacgggtgtccgcagccatgtataagtctttagagctggccataggccgtttcgagtctgaagacctgacatcaattgtcgagttggatggcctgttagagatcaacagaatgacacacaagctcttgtctagatatctgacattggatggcttcgatgctatgtttcgagaagccaatcacaatgtgagtgctccctatggcaggatcacacttcacgtcttctgggagctgaactatgattttttacccaattattgttacaatggcagcacaaaccgattcgtgcggaccgtgcttccttttagtcaggaattccagcgggacaaacagccaaatgctcagcctcagtacttacacggatccaaggcactcaatctcgcttactctagcatctatggatcataccggaactttgttggcccacctcattttcaggtcatctgtcgactgctcgggtaccaggggatcgccgtggttatggaggagttgctcaaagtggtgaagtcactgctacagggtacaattttacagtatgtgaagacgcttatggaggttatgcccaagatatgccgcctccccagacacgaatacggaagtccaggcatcctggagttcttccatcaccaactcaaagacattgtagagtacgcagaattgaaaacggtgtgtttccagaacttgcatgcagccccatttcagaacatcctgccacgggtccacgtaaaagagggtgaaaggctcgatgccaagatgaagagactcgagtcaaagtacgcccctctccaccttgttcccctgattgaaaggctaggaacacctcagcaaatcgcgattgctcgggaaggtgatcttctgaccaaagaacgactgtgttgcggactgagcatgtttgaagttattcttacacggatccggtctttcctggacgatccaatctggagaggccctctaccttccaacggtgtgatgcatgtggacgagtgcgtggagtttcatcgactctggagcgccatgcagttcgtatattgcatccccgtgggaacccacgagtttacagtcgagcaatgtttcggcgacggactccattgggccggttgcatgatcatcgtcttgctcggccaacagcgcaggtttgcagtactggatttttgttaccacctcctcaaggtccagaaacacgatgggaaggacgaaatcattaagaatgtgccccttaaaaaaatggtagagagaatccgaaagtttcaaattctgaatgatgagatcattactatcttagacaaatatcttaagagcggcgacggtgaggggacgccagtcgaacacgttagatgctttcagccccctatacatcagtcactcgcctccagttag

SEQ ID NO: 219966 - DNA, 2469 bp, Artificial Sequence
  Description of Artificial Sequence: Synthetic coding sequence
atggcagagagtttgggttctgccgagctgctgaggcagttaaagagtctaggaatggagaggttgttacatgcagtcaacaccttcctgagacagagctgcacctacttacctctcctgacatttgggggaaaaacttcctttgtcagtctagatgtgtacggtaccgaagccaactgttctgccacttcctgtagcttcccaaaagcagccgctacttggccacgaaggcaagccccaggtccgctcggggaactcgtccggggaccacccgatcaaggcgtggcagagcagtctttctcccatggcctcttcgagtttggcatcactaacgtgccgtgtatattctctcccccacagatgtttccttggatcattcagttatacatggtcagaactatgctcgagtctctgattgcagacaaatctggatccaaaaagacactgcgctccagcctggagggcccaactattttggatatcgagaagttccaccgcgaatcattcttttatactcacctgatcaacttcagcgagacgctgcaacagtgctgcgacttaagtcaactttggttcagggaattcttcctggagcttaccatgggcaggaggatacagtttcccatcgagatgtcaatgccttggatcctcacagaccatatcctggagactaaggaggcctccatgatggaatatgttctatatagcttagacctttataacgactcagcacactatgcactcacacgctttaataagcagtttctctacgacgagattgaggccgaagtcaacttgtgtttcgaccagttcgtgtacaagctcgctgaccagattttcgcatactacaaggtgatggctggctctcttttgctggataagcggctgcggagtgagtgcaagaatcagggggctacaatacacctccctccttcaaacagatacgagactttgttgaaacagcgccatgtgcaactgctgggtagatccatcgatctgaatcgcctgattactcagcgggtaagtgctgctatgtataagagcctcgagctggctattggcaggtttgaatcagaagacctgacgtcgattgtggaactcgatggtttgctggagatcaatagaatgacgcacaagttactttcaaggtacctgacactcgacgggttcgacgctatgtttcgcgaggctaaccacaatgtctcagccccatacgggaggataaccctgcacgtcttttgggaactaaattacgatttcctgccaaattactgttataatggctccaccaatagattcgtgcgcaccgtactcccattctcgcaggagttccagcgtgataagcaacccaacgctcagcctcagtacctgcacggatccaaggctctgaacttggcttactcaagtatatacgggtcctatagaaactttgtgggcccaccacatttccaggtgatttgccggctcctgggatatcagggcatcgccgtcgtgatggaagagctgcttaaggtggttaagagtcttctccagggaaccatattacagtatgtgaaaaccctgatggaagtcatgccaaaaatttgtagattgcctcgacacgaatatggcagccccggtatcctcgagttctttcaccaccagctgaaggatatcgttgagtacgccgaactcaagaccgtgtgcttccaaaacctccgcgaggttgggaacgccatactgttctgcctcttgattgaacagtctctgtcgctggaagaagtctgtgacctgctacacgcggcaccctttcagaatatcttgccccgagttcatgttaaagagggggagcgattagacgctaagatgaaacggttggaatccaagtacgcccctctgcacctggtcccattaatcgaacgactgggtacccctcagcagatagccatcgctagagagggggacctgttgacgaaggaacgtctttgttgcgggctgagcatgttcgaagtgatcctgactagaatccggtcctttctggatgacccgatttggcgaggaccccttccgtccaacggtgtgatgcatgttgacgaatgcgttgagtttcacagactgtggtctgccatgcagtttgtttactgcatccctgttggaacacatgagttcactgtcgagcagtgcttcggcgatggactccactgggctggatgcatgattatcgtgctcctggggcagcagcgcaggtttgccgtcctcgacttttgttaccatctcctaaaggtgcagaagcacgatggtaaagatgaaattatcaagaatgtccctctgaagaagatggtagagcggatcaggaagtttcagattctcaatgacgaaattatcacgattctggataaatacctgaagtccggtgacggagaaggcactcccgtagagcatgtgcgatgtttccagccccctattcaccagtccctcgcctctagctag

SEQ ID NO: 219967 - DNA, 3762 bp, Artificial Sequence
  Description of Artificial Sequence: Synthetic coding sequence
atggctgcccaggtgaccctcgaagacgccctgagcaacgtggacttgctggaagaacttcccttgcctgaccaacagccgtgtattgaacccccaccaagcagcctgttgtaccagcctaattttaacacaaattttgaagacaggaacgcctttgtgaccgggatcgcacgctatatcgaacaggcaactgtccatagcagtatgaacgagatgctggaggaaggacaagagtacgcagtgatgctgtacacttggaggagctgcagccgtgctatccctcaggtaaaatgcaatgagcaacctaacagagtggagatctatgagaagactgtcgaggtgctggagcctgaggttacaaaactgatgaacttcatgtactttcaaaggaatgccattgaaaggttttgcggggaagtccgacgcctatgccacgcagagagacggaaggatttcgtgtccgaggcgtacctgatcacattggggaaattcatcaacatgttcgccgtactggacgaactaaagaacatgaagtgttcggtgaaaaacgatcacagcgcttataaaagagcggctcagtttttgaggaaaatggcggatccacaatccattcaagagagccagaacctgagcatgttcctagctaaccacaacaaaataacacaatccctgcaacaacagctggaagttatctccggttatgaagagctcctggcagatatcgtaaatctttgcgtggattattatgagaacaggatgtatctcacaccatccgagaagcatatgttattaaaggtcatgggatttggattgtatctaatggatggttcggtatcaaacatatataagctggacgctaagaagcggatcaacctgtctaagattgataagtactttaaacagcttcaagtcgtgcccctgtttggagatatgcaaatcgagctggcgagatatatcaagacatctgcccattatgaggaaaacaaatcccgctggacatgcacctcctcagggagtagtccccagtacaacatatgcgagcagatgattcagatcagagaggatcatatgcgtttcatatcagaactggcccgatactctaactccgaagtcgtgacaggatcagggcgtcaggaagctcagaagaccgacgcagagtacagaaagctctttgacttggcgctacaagggctacagttgctctctcaatggtccgctcatgtcatggaagtttacagctggaaacttgtgcaccctactgataagtattcaaataaagattgtcccgattccgccgaagaatatgagcgcgcaacacgttacaactacactagcgaggaaaagtttgcccttgtggaggtcattgccatgattaagggactccaagtgcttatgggcaggatggagtctgtgtttaatcacgctattaggcacacagtgtacgcggctttgcaggatttttctcaagtgactcttcgcgagccactgcgccaggcaatcaagaagaaaaagaatgtcatccaatccgttctccaggccatcaggaaaactgtgtgcgactgggagacaggtcacgaaccatttaatgatcccgcactcagaggtgaaaaagaccccaagtctggattcgatattaaagtgccgaggagagccgtgggcccaagcagcacgcagctgtatatggtcaggacaatgcttgagagcctgatcgccgacaagtctggcagtaagaaaacattgaggagcagccttgagggtcctaccatcttggatatcgagaagtttcatagagaaagcttcttttatacacacctgatcaatttctctgagacgctacagcagtgttgcgatctaagccagttgtggttccgggagttttttctagagctgaccatgggacgcaggattcaattccctatcgaaatgagtatgccatggatcctcaccgaccacatccttgagactaaggaagcctccatgatggagtacgtgctttactcgttggacttgtacaacgattccgctcattacgctctgaccagattcaacaagcagtttctgtacgatgaaattgaagctgaggtgaatttatgttttgaccaatttgtctacaaactggcagaccagattttcgcatactataaagtgatggctggaagcctcttgttagacaagaggcttcgctctgaatgtaagaaccagggggctactattcacttacccccatccaatcggtacgaaactctgttgaagcaaagacatgtgcagctgctgggcagatccattgatttgaacaggctgatcacacaaagggtgagtgctgcaatgtataagtctctggaattggctataggtaggttcgagtcagaagacctaacaagcatagtcgagctcgatgggctgcttgagataaaccgaatgactcataagctgctatcaagatatctcacactggacggctttgatgccatgttcagagaggcaaaccacaatgtgtccgctccctacggcaggatcaccttgcacgtgttctgggagctgaattacgatttcctgcctaattattgttataacgggtctacaaaccggtttgttcggaccgttctccccttttctcaggagtttcagagggacaagcagcctaatgcccagcctcagtacctccatgggtcaaaagcactgaacctggcttactcaagtatctatggtagttaccggaatttcgtgggacctcctcacttccaagtgatctgtcgtctgctgggataccaagggatcgcggtggtgatggaagaattactcaaggtagtcaaatctttactgcaaggtactattcttcagtacgtgaagacattaatggaagtaatgcctaagatttgccgtctccctcgtcatgagtatggatctccagggatcctggagttcttccatcaccagctcaaggacattgtggaatatgccgaattgaaaacagtatgctttcagaatctgagggaggtaggaaatgccattctcttttgtctgctgatcgagcagtccttgtctctggaggaagtatgcgatttgctgcatgcagccccttttcagaatattctgccacgcgtccatgtcaaggaaggggaaagattagatgcaaaaatgaagcgcttagagtctaaatacgcgccacttcacctagtgcccctgatcgagcgcttaggaacacctcagcagatcgcgatcgcccgagagggggatctgctgacaaaagagagactttgctgcggcctcagcatgttcgaggtgattcttacacgcattcgatcttttctggatgatcctatttggcgtgggcctctgccctccaacggggtcatgcatgttgatgagtgcgttgagttccatcggctgtggagtgccatgcaatttgtgtactgtatcccagtcggaactcatgagtttacagtggagcaatgctttggcgatggccttcattgggcgggttgcatgattatcgtgttgttggggcagcagaggcgcttcgccgtgttagatttttgttatcacctgttgaaggtgcagaaacacgacggcaaagacgaaatcataaaaaacgtgcccctgaagaagatggtggagaggatccgcaagttccaaatccttaatgatgaaataattacaatactcgataaatacctgaaatccggcgacggggagggaacgccagtggagcatgtacgatgctttcagccacctattcaccagagtctggcatcctcttag

SEQ ID NO: 219968 - DNA, 486 bp, Artificial Sequence
  Description of Artificial Sequence: Synthetic coding sequence
atggcagcccaggtcactctggaggatgcactcagcaacgtcgaccttctcgaagaactgccgcttcccgatcagcagccatgcattgaacccccaccgtcaagcctgctgtatcagcctaatttcaataccaacttcgaggaccgcaacgcctttgtcaccggcattgcaaggtatattgagcaggcaaccgtgcatagcagcatgaacgagatgctcgaagagggacaggagtatgccgtgatgctatatacatggcgctcatgctcaagagctatcccacaggtaaagtgtaacgagcagccaaaccgcgtagagatatacgagaagaccgtggaagtgcttgaaccagaggtcaccaagctcatgaacttcatgtactttcagaggaacgccattgagcgattctgtggggaggtcagaaggctctgccatgctgaaagaaggaaagatttcgtgtctgaggcgtaccttatcactctttag

SEQ ID NO: 219969 - DNA, 456 bp, Artificial Sequence
  Description of Artificial Sequence: Synthetic coding sequence
atggctgcccaggtaacacttgaagatgctctgtcgaacgtggatctgctggaagaattgccattgccagatcaacagccgtgtattgagcccccacctagctccctactatatcagcccaacttcaataccaattttgaggataggaatgcattcgttacgggcattgctagatacatagagcaggccacagtgcacagctcaatgaatgaaatgctggaagaggggcaagagtacgctgtcatgctgtacacatggagatcatgctcacgcgcaatcccacaggtcaagtgtaatgaacagcctaacagagtcgaaatatacgaaaaaactgttgaagtgctggagccagaggtgaccaagttaatgaacttcatgtactttcagcgcaacgctattgagaggttctgcggcgaagtcagacggctgtgtcacgccgagcggcgtaaggattag

SEQ ID NO: 219970 - DNA, 3837 bp, Artificial Sequence
  Description of Artificial Sequence: Synthetic coding sequence
atgacgacccacgttactctcgaagatgcccttagtaatgtggacctgcttgaggagcttcccttgcccgatcagcaaccctgcatcgaaccgcctcccagttctattatgtatcaggcaaactttgatacgaattttgaagataggaatgcttttgtcactggaattgctcggtacatcgaacaggctacagtgcattcaagcatgaacgagatgttagaggaaggacacgagtatgccgttatgctctatacctggagaagctgctccagggcgattccacgcgtcaagtgcaatgagcagcccaaccgcgtagagatttacgagaagactgtggaggtcctagaacccgaggtaaccaaactgatgaagttcatgtattttcaaagaaaagcgatagaacggttctgttccgaggtgaagagactgtgccacgccgaaaggcgcaaggactttgtgtcagaagcttatctgctcaccttggggaagttcatcaacatgtttgcagttctggatgagctgaaaaatatgaaatgttcagtgaagaatgaccatagcgcctataagcgggctgcacagttcctcagaaaaatggctgacccccagagtattcaggaaagccagaatctctcaatgttcctggctaatcataaccgcattactcaatgcctgcatcagcagctggaagtcatacccggatatgaggaacttctagccgatatcgtgaatatttgcgtcgattattacgagaataaaatgtatttgacacctagcgagaaacacatgctgctgaaagtgatggggttcggcttatatctgatggacgggaatgtcagcaatatctataaactagacgccaagaaaagaatcaatctatcaaaaattgataaatttttcaagcagctgcaggtagtgccactgtttggtgacatgcagattgaactggccagatatattaaaacatctgctcattacgaggaaaataagtccaaatggacatgcacacagtcctcaatcagccctcagtacaacatatgtgagcaaatggtgcagatcagagatgatcatattcgctttatcagcgaactggcccgatactcgaactccgaggtagttacggggagcggactcgattcacagaaatccgacgaggagtaccgcgagctattcgacttagcccttcggggtcttcagttgttatctaaatggtcggctcacgtgatggaagtttattcctggaagctggtgcaccccacagacaagttttgcaacaaggattgcccaggcaccgccgaggagtacgagcgtgccacaagatataattatacctccgaggagaaattcgcattcgtcgaggtgattgccatgataaaaggccttcaagtgctcatgggaagaatggaatccgtgttcaatcaggcaatacgcaacaccatttatgcggctttgcaagactttgcccaggttactctgagagaacctctgagacaggctgtgcgcaaaaaaaagaacgtgctaatctcagttctccaggcgatacggaagacaatttgcgattgggagggcggacgtgaacccccaaacgacccgtgtcttcgaggcgagaaagatcccaagggaggttttgacatcaaggtccctcgcagagctgttggaccatctagtacacaggcctgccaatggtcccccagagcgctgttccacccaacaggcggtacacaagggcgtcgagggtgccgctcgctcttatacatggttcgcaccatgttagaatccttaattgcagacaagagcggaagcaagaagactctgcgcagttcacttgacggacctatagtgcttgctatagaggatttccataagcagtctttttttttcactcatttactaaatatctccgaagctctgcagcagtgctgtgatctgagccaattatggttccgcgagtttttcctggagctcaccatgggtcggaggatccagtttccgatagagatgtccatgccttggatactgaccgatcatattttagaaacaaaggagccctcgatgatggagtacgtactgtacccactggacctttacaatgatagcgcatattatgcgctgaccaagttcaaaaagcagttcctctatgacgagattgaagccgaagtcaacctctgttttgatcagtttgtgtacaagctggctgaccagatttttgcatactacaaagctatggccggaagtgtcctactggacaaacgcttcagggccgagtgcaagaactatggcgttataataccttacccgccatctaataggtacgaaacgctgctgaagcagcggcacgtgcagctcttgggcagatccatcgatttgaacaggctaataacacagcgtatctccgctgccatgtacaaatccctggaccaggccatctctaggttcgagagtgaggaccttacttccattgtcgagttagagtggcttctcgaaatcaacagacttacccaccggcttttgtgcaagcatatgactctggattcttttgatgccatgtttcgggaagctaaccacaacgtctcagccccttatggacgaatcacgttgcacgttttctgggagcttaactttgattttctacctaactattgttacaatggatcgacaaacagattcgtgagaactgctatcccattcacacaggaaccccaacgtgataagcccgctaacgtgcagccctattatttgtacggcagcaaaccactgaatattgcctacagccatatatattccagctaccgcaacttcgtgggccctcctcattttaagactatctgcaggttattaggctatcagggcatcgccgtggtgatggaagagttgctgaaaatcgtaaaatcattattgcagggcactatcctgcaatatgtaaaaacactcatcgaggttatgccaaagatctgccgattgcctcgccatgaatatgggagcccagggatccttgagttcttccaccaccagctaaaagatattatcgagtatgctgaacttaagaccgatgttttccaatcactgcgtgaggttggaaatgcgatcctcttttgcttgttaatagaacaggctttaagtcaagaagaagtgtgtgatttgttgcacgcggctccattccagaatatcctacctagagtctacatcaaggagggggaacgactggaagttagaatgaagcgactggaagctaagtacgccccactgcatctggtgccactcattgaacgacttggaacgccccagcagattgctattgcgcgagaaggcgaccttcttacaaaggagagactttgttgcggtctgtctatgttcgaagtcattctcacccgaattcggtcttacttacaggatccaatctggagggggcctccacccactaatggcgtcatgcatgtggacgagtgtgtggagtttcatcggctgtggtcagctatgcagttcgtgtactgtattcccgtgggcaccaacgaatttaccgcagaacagtgttttggggacggcctgaactgggccggttgttctataattgtcttacttgggcagcagaggagattcgacctgttcgacttttgctaccacttgctgaaagtgcagaggcaggatggcaaggatgagataatcaagaacgtccctctgaagaagatggcagaccggatcaggaagtatcagatactgaataatgaagtatttgcgatccttaacaagtacatgaagtctgtcgaaaccgatagctctacggtggagcatgtccggtgcttccagccgcctattcatcagagtctcgcaacaacatgttag

SEQ ID NO: 219971 - DNA, 3762 bp, Artificial Sequence
  Description of Artificial Sequence: Synthetic coding sequence
atgacaacccacgtgactctagaggacgccctgtcgaacgttgacctgctggaagaactaccgctgccagaccagcaaccctgcatcgagccaccaccttccagtataatgtatcaggcaaattttgacactaactttgaggaccgcaatgcatttgtaactgggatagcccgatatatcgagcaagcaacggtgcatagctctatgaacgagatgctggaggagggtcatgagtacgccgtcatgctgtacacctggagatcgtgttcccgtgccattcctaaagtgaaatgtaatgaacagccaaatcgagtcgagatatacgaaaagacagttgaggtactagaacctgaggtgaccaagctcatgaaatttatgtactttcagcggaaagctatagagcggttttgcagcgaggtgaaacgcctgtgccatgccgagcgcaggaaagatttcgtaagtgaggcctacctcctcacgctgggcaaatttataaatatgtttgcagtgttagacgaactgaagaacatgaagtgttcggtcaagaacgaccattcagcctataaacgagccgcacagtttcttcgcaaaatggctgacccccagtccatacaggagtcccagaatctctcgatgtttctggccaaccacaatcgcataacacaatgcctgcaccagcaactcgaggtgatcccaggttatgaagaactccttgctgacatagtgaacatatgcgtggattattatgagaataaaatgtacctaaccccctccgagaaacacatgcttctcaaagtaatgggattcggcttatacttaatggacggcaacgtttctaacatatacaaactggatgccaaaaaaagaataaatcttagcaagattgataagttcttcaagcagctgcaggtggtcccgttattcggagacatgcagattgagctggcaaggtacatcaagacttccgcccactacgaggaaaataagtctaagtggacctgcacacagagttcgatatctccacaatacaatatctgtgagcagatggtacaaattcgtgacgaccacatccgattcatctcagagctagcgaggtactctaactccgaagtggtgactgggtctggactggactctcaaaaatctgacgaggagtaccgggagctttttgatttggcactgcgcggattacagctgctctcaaaatggtcagcgcacgttatggaggtctattcttggaaactcgtgcatccaacggacaagttctgtaataaagattgtccaggaaccgcagaggagtatgaacgggctactaggtacaattatacatcagaggaaaaattcgcctttgtcgaggtgattgctatgatcaaaggcttgcaggtactgatgggcagaatggaatctgtatttaatcaagctatccgcaacaccatctatgcagccctgcaggatttcgcacaggtaacattacgagaacctctgcgccaggctgtgagaaagaagaagaatgtcctgatatctgtgctgcaagccatcagaaagaccatttgtgactgggaagggggacgcgaacctcctaatgacccatgtttgcgcggagaaaaagatccgaagggaggcttcgatatcaaagtaccacgcagagcagtgggtcccagcagcacccagctctacatggttcggactatgctcgaaagcctcattgccgacaagagtgggtccaaaaagaccttaagaagctcccttgatggtcctatagtgctggccatcgaggattttcacaagcagagcttttttttcacacatctgctcaacatctcggaagccctccaacagtgttgcgacctgagtcagctgtggttcagagagtttttcttggaattaaccatgggcagacggatacaattccctatcgagatgtctatgccttggattctaactgatcatatcttggaaaccaaggagccctccatgatggagtacgtgctgtaccctctggatctctacaatgactccgcctactatgctctgaccaaattcaagaagcagttcctctacgatgaaatcgaagccgaggtgaacctgtgttttgaccagttcgtgtataaacttgccgaccagattttcgcttattataaagctatggcgggaagcgtcctactcgataaaaggtttcgggcagaatgtaaaaactacggtgtgattatcccgtatcctcccagcaatcggtatgaaaccctcctgaagcagaggcacgtacagcttttagggaggagtattgatctgaaccggctcatcacacagcgcattagcgccgcaatgtacaagtccctggaccaggccatcagtagatttgagagcgaggacttaacatctatcgtggagcttgagtggctcctcgagattaataggctcactcacagattgttgtgcaaacacatgacactagactcgtttgacgcgatgtttcgtgaggctaatcacaacgtttccgctccatacggacgcatcacactacatgtgttctgggaacttaactttgacttcctacctaattactgctataacggatccaccaacaggtttgttaggaccgcgataccctttacacaagaaccgcaacgggataaaccggcaaacgtgcaaccttattacctttacgggagtaaacctcttaacattgcatactcgcacatttattcttcttacagaaacttcgttggccctccccatttcaaaaccatctgtcggttgctgggctaccaggggattgcagtagtaatggaagaattattgaagatagtgaaaagtctgctgcaagggacaatcctgcagtacgttaagacattgatcgaagtgatgcctaagatctgcagattgcccagacacgagtacggctctccaggtatcctcgagtttttccaccaccaactgaaagatattattgagtatgccgagctgaagaccgatgtgtttcagtcactgagagaggtagggaacgctattttgttctgcctccttatagagcaggccttgtcacaggaggaagtttgcgacctgctgcacgccgcaccattccaaaatatcttgccacgcgtgtatattaaagaaggtgaaaggctggaggtccgtatgaaacgccttgaagcaaagtacgccccactacaccttgtcccattgattgaacggctggggactccgcagcagatagctatcgctcgagagggcgacttgctcaccaaagagcggttatgttgtggtctctcgatgttcgaggtcatacttacacggattagatcttatttgcaggatcccatctggcggggtcccccaccgacaaatggcgtaatgcatgtggacgagtgcgttgagtttcatagactctggagcgctatgcagttcgtgtactgcatccccgtgggaactaacgaatttaccgcagaacagtgctttggagatggcctcaattgggcaggctgcagtatcattgttttgttgggtcagcaacgaagatttgacctgttcgacttctgttaccatctgttaaaggtccaacggcaggacgggaaagatgagatcattaaaaacgtgcctctgaagaagatggctgaccggatccgtaagtaccaaatcctgaacaacgaggtatttgcaattctgaacaaatacatgaaatcagtggagactgattcgagtaccgtggaacacgtgcgatgtttccagccaccgatccaccaatccttagctaccacatgctag

SEQ ID NO: 219972 - DNA, 3762 bp, Artificial Sequence
  Description of Artificial Sequence: Synthetic coding sequence
atgaccactcatgtcaccctggaagacgctctcagcaatgtggatctgctcgaggagctgcctctcccagatcagcaaccttgcatcgagcccccaccttcttccatcatgtaccaggccaattttgacaccaactttgaagaccggaacgcctttgtgaccggaattgctaggtatattgaacaggcaacggtccattccagtatgaacgagatgctggaggaaggacacgagtacgccgtgatgctgtacacctggaggagttgtagtagagctattcccaaagttaaatgcaacgagcaaccgaacagagtggaaatctacgagaagacagtcgaagtgctggaaccagaggtgacgaagctaatgaaatttatgtactttcagcgcaaagctatcgagaggttctgtagtgaagtcaagagattgtgtcatgctgagagacggaaagatttcgtgtccgaagcatatctactgaccctagggaaatttataaatatgtttgctgtactcgatgaactcaagaacatgaaatgctctgtgaaaaatgatcactcagcgtacaagcgagctgcccagttcctgcgtaagatggctgacccccaaagcatccaggaatcacaaaatctttctatgttcctcgcaaatcataatcggatcactcagtgtctccaccagcagttagaggtgattcccggatacgaggagctcttggctgatattgttaacatatgcgtggactactacgagaacaagatgtatctcaccccatcagagaaacacatgttactgaaagttatggggtttggcctgtacctcatggatggcaacgtgagcaatatttacaagctggatgccaagaagcggattaacctgtccaaaatcgacaaattttttaagcagctacaggtagtgccattatttggggatatgcagatagagctggcacgttatattaagacgagtgctcactatgaggagaacaagtcgaagtggacgtgtacacagtcatccatctcaccgcagtacaacatttgtgaacagatggtccagattagggacgatcatatccggttcatctccgagctggcccgatactcgaattctgaagtggtcacgggatccggcctggacagccagaaatcggatgaagaatatcgagagctgtttgatctcgcgctcagagggcttcagctgctgagcaagtggtctgctcacgtcatggaggtctactcctggaaattggtacatcccactgacaagttttgtaataaagactgccctggtacggcagaggagtacgagagagctactcgatacaattacaccagcgaagaaaagtttgcgtttgtggaagtgatagcaatgatcaagggactgcaagttttgatgggacgtatggagagcgtattcaatcaggccatccgtaacaccatatacgccgcactgcaggatttcgcccaggtgacactgcgggaaccattgcgccaagccgtgcgcaaaaaaaagaatgtactgatctcagtgctccaggccatacgaaagaccatctgcgattgggaggggggtcgagaaccccctaacgatccgtgccttaggggtgagaaggatccaaagggaggctttgatataaaggttcccagaagggcggtgggaccctcgtccactcagctgtacatggtccggaccatgcttgagagtcttatcgctgacaagtcaggatctaaaaagacgctccggagctcgctggatgggcctatagtgctcgcgatcgaagattttcataagcagtcctttttctttacccatctgctgaacattagcgaggcgctgcaacagtgttgtgatctaagccagctttggtttcgcgagttcttcctcgagcttacaatggggcgtaggatccagtttcccattgaaatgagcatgccttggatactcaccgaccatattttggaaacaaaggaaccaagtatgatggaatacgtcctctatccattggacttatacaacgatagtgcctattacgccttaaccaaatttaagaagcagttcctttacgatgagatcgaggcagaagtgaacctgtgcttcgaccagttcgtttacaagctcgctgatcagattttcgcgtactataaggccatggccggttcagtcttgcttgataagaggttccgcgcagaatgcaagaactatggcgtgatcatcccctatccaccatcaaatcggtatgagactttgcttaaacaacgacacgttcaacttctcggacggagcatcgacttgaatcgcctcattacccagcgaattagcgcagccatgtacaagagcctggatcaagcaatttctagatttgagtcagaagatctgacgtctatagtagagctggaatggctgctggaaatcaatcgactgacccaccggctgttgtgtaagcatatgacgttagactcttttgacgcaatgttccgtgaagccaatcataacgtaagtgccccatacggccgtatcactctgcacgtgttttgggagctcaacttcgactttcttcccaattattgctacaatgggagcactaacagattcgtgaggaccgctattccatttacccaggaaccacagcgggacaaacccgcaaatgttcaaccgtactacttatacggatcgaagccgctgaatatcgcctattcccatatttactcttcctaccgcaatttcgtcggacctccacattttaagaccatttgccggttgttgggataccagggcatcgccgttgtcatggaggagctgctgaagattgtaaagagcctgcttcaggggaccatactccagtatgtaaaaacgttgattgaagtaatgccgaagatctgcaggctgccccgtcatgaatacggatcccctggtatcttggagttcttccaccaccagctaaaggacatcatcgagtatgcggaacttaagactgacgtctttcagagtcttcgtgaggttggcaacgcaattctgttttgtctccttatagagcaggccctgtctcaggaagaagtatgcgacctgctgcacgccgcaccattccagaatatattaccacgagtgtacattaaggagggtgagagacttgaggtgcgtatgaaaaggctcgaagctaaatacgctcctctccatctggttccactgattgagcggctcggtacaccacaacagatcgctatcgcccgtgagggagatttgctgaccaaagagcggctgtgctgcggcctgagcatgttcgaggtgattctgacacggataagatcctatttgcaggatccaatctggagaggcccacctccaactaatggggtgatgcacgtagacgagtgtgtggaattccatcgcctttggtcagcaatgcaattcgtgtattgcattcccgttggaacaaacgaatttactgccgaacagtgtttcggtgacggtttgaattgggcgggatgcagtatcattgtgttactcggccaacagaggagattcgacctgtttgacttctgttaccacctgctgaaggtacagaggcaggacggaaaggatgagatcatcaagaacgttcctctaaaaaagatggccgaccggatcagaaagtaccagatcctgaacaatgaagtgttcgccatcctaaataaatacatgaaatctgttgagacagatagtagcaccgtggagcacgtgcgctgctttcaaccgcctattcatcagtcactcgctactacctgctag

SEQ ID NO: 219973 - DNA, 2859 bp, Artificial Sequence
  Description of Artificial Sequence: Synthetic coding sequence
gagaaaagaaggcgatggacctgcacccaatcttctatctctccccagtacaatatctgcgagcagatggtgcaaatccgggacgatcacatcaggttcattagcgagttggctagatattccaactctgaggtcgtcacaggctctgggctcgactcacagaagagcgatgaagagtacagggaacttttcgacctcgccctcagaggtctgcagctactgtctaagtggagcgctcacgtgatggaagtgtatagctggaagctagtgcatccgactgacaaattctgtaacaaggattgtcccggaaccgccgaagagtatgagcgagcaacgagatataactatacgtccgaagagaagtttgccttcgttgaggtgattgccatgattaagggccttcaagtgctgatggggcgtatggagtcagtatttaatcaagcgattcgcaacactatctacgcggctctgcaggattttgcccaagtaaccttgagagagcctctgagacaggccgtgcgcaaaaaaaaaaacgtccttatctccgtactccaggccatcagaaaaacgatctgcgattgggaagggggacgtgagccaccaaatgatccatgtctgagaggagaaaaagaccccaagggcggatttgacatcaaagtgcccaggcgggctgttggtccaagttcaacccaggcttgtcagtggagccccagggccctcttccacccaacaggtggtacccaaggcagaagggggtgccgctccctgttgtatatggtccgaaccatgctggagtcactcatcgctgacaaatctggaagcaagaagacgcttaggagcagccttgatgggccaatcgtccttgctattgaggacttccacaagcagtcattttttttcacccacttgctaaatatctctgaagccttgcagcaatgctgtgatctctctcagctgtggtttcgggagttctttctggagctgaccatggggagacgcattcaatttccaattgagatgagtatgccttggatactgacggaccacattttagagacaaaagaaccaagtatgatggagtacgtgctctacccattggatttgtacaacgactccgcgtattatgctctgactaagtttaaaaagcagttcctatacgatgagatcgaagcagaggtgaacctctgctttgatcaattcgtttataaattggccgatcagatcttcgcatactacaaagccatggcgggaagcgttctcctggataagagattcagggccgagtgtaaaaattatggagtcataatcccctaccctccatccaataggtatgaaactcttctgaagcaaaggcacgtccagttgctggggcgtagcattgacctgaaccggctgataacccagcgaatctcagcagcaatgtataagtctttagatcaagcaatctcgcgattcgagagcgaggatctcacgtccatcgtcgaactggagtggcttctcgaaatcaaccgactcactcatagactgctctgtaaacacatgaccctggacagctttgatgctatgttccgtgaggccaaccacaatgtgtctgctccctatgggaggattactttacatgttttttgggaactcaactttgacttcctgcctaattactgctacaatggcagtactaatcggtttgtgagaactgccatacctttcactcaggaaccccagagggacaagcctgctaatgtgcaaccttactacctgtatgggagcaagccactcaacatcgcctactcacacatttattcctcttatagaaatttcgtgggaccccctcactttaagacaatatgtcggctgctaggataccagggtatcgctgtggtcatggaggagttgttaaaaatagtcaaatctctgctgcagggtaccatcttgcagtatgtgaaaaccctgatcgaagtgatgcccaagatctgccgattgccaagacacgagtatgggagtccaggcattcttgagttcttccaccaccagctgaaggacatcatcgagtatgcagagttgaaaacagacgtcttccagagtctgagggaagtggggaacgcaatccttttctgtctgctgatagaacaggctctgagccaggaggaggtttgcgatctgcttcatgcagctcctttccaaaacatcctgcccagggtctacatcaaagagggcgagaggctggaagtcaggatgaaacgcctcgaagcaaagtacgctcccctgcacctggtacccctgatcgagaggcttggaaccccccagcagatagctatcgcccgtgagggcgacttattgactaaagaaagattatgctgtgggctatcaatgttcgaggtcatcctcaccagaatccgtagttacctgcaagacccaatttggcgcggacctccccctacaaatggggtgatgcatgtagacgagtgtgtagaatttcacaggctttggtcagcaatgcaattcgtatactgcatcccagttggcaccaatgagtttactgccgagcagtgcttcggcgacggactcaactgggcagggtgcagcattatcgtcctgctgggacagcagagaagattcgatctgtttgacttctgctaccacctgctgaaggtccaaaggcaggatggaaaagacgagattattaagaatgtgcccctgaaaaagatggctgaccgcatcagaaagtatcagattctgaacaacgaagtcttcgccatcctgaataagtacatgaagtctgtcgaaactgatagcagcaccgtcgagcacgtgagatgtttccagccgcctatccaccagtctttggctacaacttgttag

SEQ ID NO: 219974 - DNA, 651 bp, Artificial Sequence
  Description of Artificial Sequence: Synthetic coding sequence
atggccggaagcgtccttctggacaagcggttccgcgcagagtgcaagaattacggagtgattatcccatatcccccttctaaccgatacgagaccctactcaaacagcggcatgtgcaactactgggacggagcatcgatctcaatcgtctcattactcagcgaatttccgcggcaatgtacaagtcccttgaccaggccatttcccgctttgagtcagaggatcttacgagcatcgtggaactggagtggctgctcgagatcaaccgtctgacccaccgactcctttgcaaacacatgaccctggattccttcgatgccatgtttcgggaggccaaccacaacgtgagcgccccttacggtcggataacattacatgtgttctgggagctcaactttgatttcctgccaaattactgttacaacggatcaaccaacaggttcgttcgcacggcatctttccacccacgaaccactactcggcaaacgtgccaacgacccgcactgctaccattgtggatccaggcctcccaacactgtctacaaccccacttgcagctgcttcaggaatttagaggggcaacctcattccaggattatgctgatagctgggtcattcgcgcaagcttatggtcgtggcggaattgctag

SEQ ID NO: 219975 - DNA, 3537 bp, Artificial Sequence
  Description of Artificial Sequence: Synthetic coding sequence
atgaccactcacgtcactctggaggacgctttatctaacgtagacctccttgaggagctccctctaccaaacgagcagcccaacagggtggaaatctacgaaaaaaccgtggaggtcttagagccggaagttacaaagctgatgaagttcatgtacttccaacggaaggcaatagagagattttgctccgaggtgaagaggttatgccacgcagaacgaagaaaggacttcgtgtccgaagcctacctgttaactctgggtaagttcattaatatgtttgccgttctggacgaattaaagaacatgaagtgcagtgtgaagaacgatcactccgcctataagagggccgctcagtttctgaggaagatggctgacccgcagtcaattcaagagtcgcagaatttgtccatgtttttggcaaatcacaatcggatcacccagtgcctgcaccagcagttggaagtgatcccaggttatgaagaactcctggcagatatcgtgaacatatgtgttgattattacgagaacaaaatgtacctgacaccgtccgagaagcatatgctgctcaaggtaatgggctttgggttgtatctgatggatgggaatgtgagcaatatttataagctcgatgctaagaagagaatcaatctttctaagatcgacaaatttttcaagcagctgcaggtggtgcccctcttcggagacatgcagatcgaactagctcgatacataaagaccagtgctcattacgaggagaacaagagtaagtggacctgcacccagagttcaatatcaccacagtataatatttgcgaacagatggtgcaaatcagggacgatcatatccgttttattagcgaactcgcgaggtactctaattccgaggtggtgactggttctggcttagactcccagaaatctgatgaagaatatagagagctcttcgatttggctctgagaggattgcagctgctgtcgaaatggtccgcacatgtgatggaggtgtatagctggaagctagtgcaccctacagacaagttctgtaacaaggattgtcccggaaccgcagaagaatacgaaagagccacgaggtacaattacacctccgaggaaaagttcgcctttgtagaggttatagccatgatcaaggggctccaggtgctgatggggcgaatggaaagtgtgttcaatcaggctatacggaacactatttacgccgctctgcaggatttcgcccaggtgacactgcgagaacccctccgccaagctgtaagaaaaaagaagaacgtgctgatttccgtgctgcaggcaattagaaagacgatctgtgactgggagggaggtcgcgagccgcctaacgacccctgcctgagaggggagaaggatcctaagggcggttttgatataaaggtgcccagacgggcagtgggcccaagcagcacacagctgtacatggtgaggaccatgttggaatctctgattgctgataaatctggaagcaaaaaaaccctccgcagctcattagatggccctattgtcttagccatcgaggatttccataagcagtctttcttcttcacccacctgctgaacatcagcgaggccctgcagcagtgctgcgacctcagccaactgtggtttcgcgagttcttcctagagctcacaatgggtcgcagaattcagtttccaatcgaaatgagcatgccctggatcctgaccgatcatatcctggaaacgaaggagccctctatgatggagtatgtgttgtacccattggacttgtataacgatagcgcttactacgccctaaccaagtttaaaaagcagttcctgtacgatgagattgaggctgaggtcaatctgtgttttgaccagttcgtatacaaactagctgatcagattttcgcttactacaaggctatggctggttccgtattgctggacaaaaggtttcgtgccgaatgtaagaactatggagtcattatcccctacccaccgagcaaccgatatgagactctcctaaaacagagacatgtgcaattgctgggacggagcatcgatttgaatcggctgatcacccagagaatctccgctgccatgtataagtcactagaccaggcaatttccagattcgagagtgaggacctcaccagtatcgtggagctcgaatggctgctggagataaatagactcacccataggttactgtgtaagcacatgacactggactcatttgatgcaatgttccgggaggcaaatcacaatgtcagcgccccttatggcaggattacgcttcacgtcttttgggagctgaatttcgactttctgcccaattactgttacaatggatctactaacagatttgtacgaactgctatcccattcacacaggagccccaaagggacaagccggcaaatgtgcaaccttattatctgtatggaagtaagcctctcaatattgcatacagccatatttattcctcatacagaaattttgttggacccccacactttaagaccatttgtagactgttaggatatcaagggattgcagtcgtgatggaggaacttctaaaaatcgtaaagagtctgctgcaagggaccatactacagtatgtcaagactctgatcgaagttatgcccaagatttgtagactccccaggcacgagtatggatctcccggaatcctggagttcttccaccatcagcttaaagacatcatcgaatatgccgagctgaagaccgatgtcttccagtctttgagagaagtcggcaatgccatcctgttctgtctcctgatcgagcaggccctctcgcaggaggaggtgtgcgacttacttcatgcagctccttttcagaatatccttccgagagtgtacatcaaggaaggcgagcgtctggaagtcagaatgaaacggcttgaagcaaagtacgcgcctctgcaccttgtgcccctgatcgagcgactgggcaccccacagcagatcgctatcgctagagagggcgacctcctgacgaaggagagattatgctgcggattgtccatgtttgaggtaattctgacacgcatcagaagctacttacaagaccccatttggcgcggacctccgcctactaatggcgtgatgcacgtggacgaatgcgtggagtttcataggctgtggagcgccatgcagttcgtttactgcatcccagtggggacaaatgaatttacagcagaacagtgtttcggtgacggtcttaactgggccggttgttcgattattgtgttattggggcagcaaagacgctttgaccttttcgacttttgctaccacctgctcaaggtacagcgccaggacggtaaagatgagatcataaaaaatgtcccccttaagaagatggccgacaggattcggaaatatcagattctgaataatgaagtatttgcgatcttgaacaagtatatgaagtctgtggagaccgactcatccactgtagaacatgttcgctgctttcagcccccaattcaccagagcctggctactacgtgttag

SEQ ID NO: 219976 - DNA, 4617 bp, Artificial Sequence
  Description of Artificial Sequence: Synthetic coding sequence
atggaaccaaggatggaatcatgcctcgctcaggtcctgcagaaggatgtcggcaaaagactgcaagtggggcaagagctaatcgactatttttcggacaaacagaagtctgcagatctggagcacgaccaaaccatgcttgataagctcgtggacgggctggccacctcgtgggtcaattctagcaattacaaggttgttcttcttggcatggatattctttccgccctcgtgacgcgcctgcaggatcgcttcaaagcccagatcggcactgtgttaccctctcttatcgatcggcttggagatgcaaaagactccgtccgtgaacaggatcagaccttgctactcaagataatggaccaggcagctaatccacagtacgtgtgggaccggatgctgggcggttttaaacataagaattttaggacaagagagggaatttgtctctgcctcatagccaccttaaacgcctctggggctcagactttgaccctgagtaaaatcgttccccatatttgcaacctcctgggtgatcccaacagccaggtgcgagatgccgcaattaacagcctggtcgagatttatagacacgtcggggaacgggttcgcgcagacttgtctaagaagggcttacctcagagtagactaaacgtgatcttcacaaaatttgacgaagtgcagaaatccggcaacatgattcagtccgctaacgataaaaattttgatgacgaagatagcgtcgatggcaacaggccctcttcggcgtcaagcaccagctccaaggctccaccttcatctcggagaaacgtgggcatggggaccactcgcagactcgggtcaagtaccctcggatcgaaatcctccgctgctaaagaaggggcaggagcggtggacgaagaagacttcatcaaggcctttgatgacgtgccagtcgttcagatttacagcagccgagacttagaggaaagcattaacaaaatacgtgagatactgtccgacgacaaacatgactgggagcagcgggtgaatgctctcaaaaagatacggtcattgctgttagcaggggcagccgagtacgacaattttttccagcatctgcggttactggacggcgcatttaaactttcagcaaaagacctacgttcacaggtggtccgagaggcctgcataactttaggacacctgtcttctgtgctaggcaacaaattcgaccatggtgctgaggccataatgccaacaatattcaatctcatccctaattccgccaagatcatggctacctccggggtcgtggccgtgagactgatcatcagacacacacacatccctcggcttattccggtgatcacctcaaattgtacaagcaagtccgtggccgtgcgacgacggtgctttgaattcctggacttactgttgcaggagtggcagacccactctctggaacgtcatatcagcgtcctggctgagacaatcaagaagggaatccacgacgcggactctgaggcacggattgaggcgagaaaatgctattggggcttccattcccacttcagccgagaagccgaacacctgtatcataccctcgaatcttcataccaaaaagctctgcagtctcatttgaagaactctgatagtattgtgtcgctccctcagtccgacagaagctcctcgtcttcgcaggagtcacttaaccgcccattgagcgccaagaggtctcccacaggctcgacaacgtcccgggcatccactgtgagcactaaaagcgtgagcaccacgggctctctgcagcggagcagatctgatattgacgtgaacgctgctgcgagcgcaaaatctaaggtgtctagctcgtctgggacaaccccattctccagtgccgctgccttaccccctggttcctacgctagcttgggccgaatcaggacacggcgtcagagctccgggagcgctacaaacgtggccagcaccccggacaaccgaggacggtctcgtgcaaaggtggtctcacagagccagcgctccagatcagccaatccggcaggagctgggtcccgttcatcaagtcctggcaaactgctaggtagtggatacggcggtctgacaggcggatctagcagaggcccacccgtcacaccgtcttctgaaaagcgctccaagatccccaggtcccagggatgcagtcgcgagacctcgcccaaccgcattggtctcgctaggtccagtaggatccctcgaccttcgatgagccagggatgctccagggacacctctagggagtcctccagagacactagccccgctcggggatttccaccacttgaccggttcgggctggggcagccaggaagaatcccaggatcagtgaacgcaatgagagttctctccacatcaaccgacctggaggcagccgtcgccgacgccctgaagaagccggttagacggaggtacgaaccctatgggatgtatagcgatgatgacgccaattccgacgcttcctccgtttgtagtgagcgatcctacggtagtaggaacggtggtatcccacattatctgcgacaaacagaagacgtggctgaggttttgaaccactgcgcttcttctaactggagcgagaggaaagaggggctgctgggcctgcagaatttgctgaaaagccagagaaccctcagcagggtagagctgaaacggctctgtgagatcttcacaagaatgtttgcagatccgcacagtaagcgtgtgttcagcatgttcctcgagacactagtggactttatcatcatacataaggatgatttgcaggactggctattcgtcctcctgacccagctgctgaaaaaaatgggagccgacctgttaggctcagtgcaggccaaggtgcagaaagcactggacgtcaccagagacagctttcctttcgaccagcagtttaatatcctgatgaggttcatcgtcgaccagacacagactccgaatctgaaagtgaaggtggcgattctgaagtatatcgaaagcttggccaggcagatggaccctaccgactttgtgaactcttccgagacaaggctcgccgtcagccggatcatcacttggacaactgagccgaagtcaagtgacgtgcgcaaggctgcccaaatcgttctcataagtttattcgagttaaacacaccagagttcacgatgctgctgggcgcattacctaagacatttcaggatggcgctacaaagttgctgcataatcatctcaaaaatagctctaacacaagcgttggatctccatccaatacgatcgggagaacaccttcaaggcatacatcctccaggacaagtccactgaccagccctacaaactgttcccatggcggactgagccctagcagactgtgggggtggtctgctgacgggctcgctaaacaccccccacccttctctcaacctaactcaattcctacagcaccttcccataaggcactgaggagatcctactccccttccatgctggactacgataccgagaacttgaattccgaagagatctatagcagtcttaggggggtcacagaagccatcgaaaaattttcgtttcgtagccaagaggacctgaatgaacccataaaacgggatggcaaaaaagagtgcgacatcgtgagtcgcgatgggggagctgcatctccggcaactgaaggaagaggaggttccgaggtggaaggaggcagaactgccctagataataagactagcttgctgaacacccaaccccctcgtgcgttcccaggccctcgtgccagggactacaatccatacccttactccgatgcaattaacacctacgataagaccgcactgaaggaagcggtttttgatgacgacatggaacagttgcgagacgtaccgatcgatcattctgacctcgtcgctgatcttctaaaagaactgagtaatcacaacgaaagggtggaggaacgaaaaggagctctgctggaactgctgaaaatcacgcgcgaagactcactgggggtgtgggaagagcacttcaaaacaatcctgctgctgcttcttgagactctgggcgataaagaccacagtatacgggctcttgccctaagagtgttgagagagatcctcagaaatcaacctgcccgtttcaagaactatgcggaacttactatcatgaaaactttggaagcccacaaagacagtcacaaagaagttgtccgggctgccgaggaagctgcttctactctggctagttcaatccatcccgagcaatgcattaaggtcctttgccccatcattcagacagccgattatcccattaacctggctgctataaagatgcagactaaagttgtggagcgaattgccaaagaatcactcttacagctgttggtggatatcatcccaggactgcttcagggatacgacaatacggagagttccgtacggaaggcgagcgtgttttgtctggttgccatatattccgttatcggcgaggacttgaagccccaccttgcccagctgaccgggtcgaagatgaaactccttaatctgtatataaagcgggcacagactactaactccaattcatcgagttcctcagatgtcagcacacattcctat

SEQ ID NO: 219977 - DNA, 4437 bp, Artificial Sequence
  Description of Artificial Sequence: Synthetic coding sequence
atggagcctagaatggaatcctgtctggcgcaagtcctacagaaagacgtgggcaagaggttgcaagttggacaggagctgatcgactatttctcagacaagcaaaagtccgcagacctggagcatgaccaaacgatgctcgacaaacttgttgatggcctggcaacctcttgggttaatagctccaactacaaagtggtgttacttggcatggatatcctgagtgctctggtcactaggctgcaggacagattcaaggctcagatcggcactgtgctcccatccctcatcgacagactgggtgacgccaaggattctgtgagggaacaagatcagacgttgctcctgaaaattatggaccaggctgccaacccgcagtacgtatgggacaggatgctgggagggtttaaacacaagaatttccgaacccgtgaaggcatctgtctttgtttaatagcaacattgaatgccagcggagcccaaactttgacattgtcaaagatcgtccctcacatttgtaatctgcttggggaccctaattcgcaggtgagggacgccgcaatcaacagccttgtggagatatatcgccatgtgggcgagagggtgagagctgacctgtctaagaagggcttgccgcagagcagactgaatgtcattttcactaaattcgatgaggtccaaaagtcaggcaacatgatacagtctgccaatgacaagaattttgacgatgaggatagtgtcgacggtaacaggccctcgtccgctagtagcacctcctcaaaggcaccaccctccagccggcgaaatgttggcatgggaaccacacggcgtttaggcagctctacactgggttccaagagtagcgcagccaaggagggcgctggagccgtggatgaggaggactttataaaagcctttgacgacgtccccgtggtccaaatttattcttctcgggatcttgaggagtctatcaacaaaatccgggaaatactgtccgatgataaacacgattgggagcagcgcgtgaatgctctcaaaaaaattaggtccctcctgctggctggagccgcagaatacgataactttttccaacatcttcgactgctcgacggcgctttcaagctgtctgccaaagaccttagaagccaggtcgtgcgcgaggcatgtattactctgggccacttgtcttccgtgcttggcaacaaatttgatcacggggctgaggcgatcatgccaacgatttttaacctgatcccaaacagtgctaagatcatggccacctccggggtcgttgccgtgcggctcattatacggcacacccatatcccaaggctgatccccgtaataacgtcaaactgtacctcgaagtccgtggccgttaggcgacgctgtttcgagttcctggacctcctgctgcaagaatggcagacgcactccctggagagacacatttctgtactggcagaaactatcaagaaaggcatccacgatgccgatagtgaagctcgtattgaggctcggaaatgctactggggttttcactcccatttcagtcgtgaagctgagcacctctatcacacgctggagtcatcttatcagaaagcactgcagtcccatttgaagaatagtgacagcattgtgtccctaccccaaagtgacagatcctcttccagttctcaggaaagcctgaaccgcccattgtctgccaagagaagccccacaggttccacaacatctagggcctccacagtttctaccaaaagcgtgtctacaaccgggagcctgcaacgctcacgctctgacattgacgtaaacgctgcagcaagtgcaaagtccaaggtgtcaagttccagcggtacgacgcctttttcctctgctgccgctctcccacccggaagctatgcgtcccttgacgggactaccactaaggcagaggggaggatccgcaccagacgccaatcttctggctccgcaaccaacgtggcctccacaccagacaacagaggcaggtcccgtgccaaagtggtgtcacaatcccagagaagtcgttctgccaaccccgcaggggctggatcccgcagctcttcacccggtaagctgctgggaagtggctatggaggcctcaccgggggatcctctcggggtccacccgtgacaccctcaagcgaaaagcgcagtaaaatccctcgaagccagggatgctcacgcgagacttcaccaaaccgaatcggattagataggttcggattaggccagccaggcagaatccctgggagcgtgaatgcaatgcgagtgcttagcacaagcactgatttggaggccgcagtggcagacgccctcctgttgggagacagtcgaagcaagaaaaagcccgtaaggaggcgctatgagccttatggaatgtattcagacgacgacgcaaatagcgatgcctccagtgtgtgttccgagcggtcttacggatcaaggaacggaggcataccacactacttacgccaaacggaggatgtagcggaagtcctgaaccactgcgcatcttcaaattggtcagagagaaaagagggcttgctgggcctgcaaaatctactcaaatctcagagaacactgtccagagtggagttgaagagactgtgcgaaatcttcacacgcatgtttgccgacccccattccaaagtgttctccatgtttctggaaaccttggtggatttcattattattcacaaggatgacttgcaagactggctctttgtcctcctgacccagctactgaagaagatgggagctgatcttctggggtctgtccaagcgaaggtgcagaaagccctggatgttacccgcgatagctttccttttgaccagcagtttaatatcctgatgcgctttatcgtggatcagacccagacgccaaacctaaaagtcaaggtggcgattttgaaatatatagagagtctggccagacaaatggaccctactgactttgtgaactccagtgaaacccgactagcagtcagcagaataattacctggacgacagagcctaagtcgagtgatgtgcggaaagctgctcaaatcgttttaatctccctgttcgaactaaatacacctgagttcaccatgttactcggcgctctgccgaagacttttcaggacggcgcaactaagttattgcataatcacctgaaaaactcttccaatacaagcgttggtagcccatctaataccatcggtcgaactccgagccggcacacttcgagcaggacaagccctttgacctcccccacgaactgtagccacgggggtctgagccccagcatgctggactatgacacagagaacctgaattctgaggagatctacagttccctgcgaggggtcaccgaagccattgaaaagttttctttccggagccaggaagacttgaacgagcccatcaagcgggacgggaagaaagaatgcgacattgttagcagagacgggggtgcagcctctccagctaccgagggacggggaggttcagaagtggagggaggcaggaccgctcttgacaacaaaacttccctgctgaatactcaacccccaagggcttttccaggcccacgcgcacgagactacaacccatatccctactcagacgcaattaacacctacgacaaaacagccctgaaagaggctgtttttgatgacgacatggagcaactgcgtgatgttccaatcgaccactccgatcttgtggccgatcttctcaaagagctgtcaaaccacaacgaaagggtggaagagagaaagggtgccttacttgagctcctcaagattacccgggaggacagcttgggcgtctgggaagaacacttcaagacaattcttctgctcctgctggagactctgggagataaagatcatagcatcagagctctcgctctgcgagtgctgagggagattctgaggaatcagccagcaagatttaagaactatgctgaattgacaataatgaagacccttgaagcacataaagattctcacaaagaagtcgtgagagccgctgaagaggccgctagtacgttggcctcctcaatccatccagaacagtgcatcaaagtcctatgtccaataattcagactgccgactatcctatcaacctagctgccattaagatgcaaactaaagtggttgaacggattgctaaggagagcctccttcagttgcttgtggatatcattccgggactcctgcagggctatgataacaccgaatcgtcagtgaggaaagccagtgtattttgtctcgtcgctatctattcagtcattggagaggacctcaagccacatttagctcagctcacaggctcaaaaatgaaacttttgaacctctacatcaaacgggcacagaccactaattccaattcaagttctagctctgatgtgtccacccactcctag

SEQ ID NO: 219978 - DNA, 4416 bp, Artificial Sequence
  Description of Artificial Sequence: Synthetic coding sequence
atggaaccacgtatggaaagttgcctggcccaagtcctacagaaggatgtggggaaacgccttcaggtgggccaggagttgatcgactacttctcagataagcaaaagtccgcggacttagagcatgatcagacgatgctggacaagcttgtggatggcctggccacgagttgggtgaactcatccaattataaagtggttctgctgggtatggacatcctttcggcccttgtaacccgccttcaggacaggttcaaagcacagatcggcacggtcctcccttccctgattgatcggcttggcgacgcgaaggactcggtgcgagaacaggatcagactctactgctcaaaatcatggaccaggccgctaaccctcaatacgtgtgggacaggatgctaggcggtttcaagcacaagaatttccgaactagggagggcatttgcttgtgcttaatagccaccttaaatgcctccggcgcacagactctgacgctttccaaaatcgtccctcatatctgtaacctcctgggggaccctaattcacaagtgcgtgatgctgctatcaactctctcgtggagatctacaggcatgttggtgaacgagttcgtgcagacctctccaaaaaaggactgcctcagtccagactgaatgtcatcttcactaagttcgatgaggtgcagaagagcggcaatatgatccagtctgccaacgacaaaaattttgacgatgaagactcagtagacggcaacagaccatcttccgcttcttccacaagctcaaaggctccgcctagctctagaagaaacgtggggatgggaactacaaggaggctgggatcatctacactcggaagcaaatcatccgccgctaaggagggggctggcgctgtggacgaggaagacttcattaaggcctttgatgacgtgccggtggtccaaatctatagtagcagggatctggaggaatccataaacaagattcgggagatactgagcgatgataagcacgattgggaacaacgcgtaaatgcactgaagaaaatcaggagtttgctcctggccggtgctgccgagtatgacaatttcttccaacaccttcggcttcttgatggcgctttcaagctatctgctaaagaccttcggtctcaggttgtgagagaggcatgtatcacactgggacatctgtcttctgtcctaggcaataagtttgaccacggagctgaagcaatcatgcccacaattttcaacctcatccctaattccgcaaagattatggccacaagtggagtcgtggctgttcgattgatcatcaggcatacccatattcccagactgatccctgtgataacctccaactgtacttccaagtccgtcgccgttcgaagacggtgtttcgaatttctggatctcttgcttcaagagtggcagactcactcactggagagacatatttcagtcctcgccgaaacaattaagaagggtatccacgacgcagacagcgaggcacggatcgaagctcgaaaatgttattggggcttccactcgcactttagtcgggaagcagagcacttgtaccatacgctggaaagctcctatcagaaagcactccagtctcacctcaaaaatagtgatagcattgtcagtttgccacagagtgatcggagttccagttcatctcaggagagcctcaacaggcctctctcagctaaaagatcgcctacaggaagtaccacctccagagcatccaccgtcagtacaaaatccgtctccacgactggttcgcttcagcgctcgagatccgacatcgatgtcaacgcagccgcatctgccaagtccaaggtctcatctagtagcggcactacaccattctctagtgccgctgctctccctccagggagctacgccagcctgggcaggataagaaccaggcgtcaaagcagcggttctgcaacgaacgtggcttcgactcccgacaaccggggtaggagtagggctaaggtcgtgagtcagagtcaaaggtcccgaagtgctaatcctgcgggtgcaggctcacgatcctcatctcctgggaagttgctgggaagtggatacggcggactgactggtgggtcttccagggggccacctgtcacaccatcctccgagaagagaagcaagatccctcgctcccagggatgctctagggagactagtcctaataggatcggactcgatcgcttcgggctgggccagcccggtaggatcccaggctccgtgaacgccatgagggttctctctactagtactgaccttgaggccgcagtagccgatgcactgttattgggggactctcgctctaagaagaagccggtgcgtcggcgatacgagccctatggcatgtacagcgacgatgatgccaacagtgatgccagttccgtgtgttctgagcggtcctacgggtcccgaaatggaggcatcccgcactacctgcgccagacagaggatgtggctgaggtgctgaaccactgtgctagctccaattggagcgaacgcaaggagggattactcggcctgcagaacctcctcaaaagccagcggacgctgtccagagtcgagctcaagcgactttgcgaaattttcactcggatgtttgcagacccacatagcaagctggtgttttctatgttcctggagacactggtcgactttataattatccacaaggatgaccttcaggattggctttttgttctgctgacgcagctcctcaagaagatgggcgctgatctgctgggcagtgtgcaggctaaagtgcagaaggcgctagatgtcactcgtgatagcttcccatttgatcaacagttcaatatcctcatgaggttcattgttgaccagactcagacgcccaatctgaaggtgaaggtggcgatactgaaatatatcgagtcccttgcgaggcaaatggatcctacggactttgtgaacagttctgagaccaggctggccgtttctagaattatcacctggactaccgaacctaaatcttccgatgtgcgcaaagctgcgcagatagtcttgattagcctcttcgagcttaatacacccgagttcaccatgctgttgggggctctccccaagacgtttcaggacggagccacgaaactcctgcacaatcatctgaagaactcttctaacacttcggttggttctcctagcaatacaattgggagaacaccaagtaggcacacaagctcccgtacctcacctcttacctctcccaccaactgttctcatgggggacttagcccaagtatgctcgactatgacacagagaatctgaactctgaggagatctattcctccctgaggggggtaaccgaagcaatcgaaaaattctctttcaggagtcaggaggatctgaacgaaccaattaagcgcgatggaaagaaggaatgtgatatcgtctccagggacggcggagctgccagccctgccactgaggggagaggtgggtctgaggtcgaagggggtcggacagcactggataacaaaacatctttactgaacacacagccccctagggcctttcctgggcctcgcgctcgcgattacaatccatacccatatagcgatgcaatcaacacttatgacaagactgccttgaaagaggccgtgtttgatgatgacatggagcagcttagagatgtccctatagatcacagcgatctggttgccgatctgctgaaggagctttccaatcataacgagagggtggaagaaaggaagggagcattgctggagttattgaagattaccagagaggacagcctgggagtgtgggaggagcactttaaaactattctactcctcctgcttgaaacactcggcgataaagatcattcaatccgggcacttgccctgagagtcctaagggaaatcctcaggaaccaacctgccaggttcaaaaattacgcggagcttaccatcatgaaaaccctggaagcccacaaagattcccacaaagaggtcgtgagagccgctgaggaggctgcgagcactttagcaagttcaattcacccggagcagtgtattaaggtgctgtgtcctatcatccaaactgctgactacccaattaatttggctgcaattaagatgcaaactaaggtcgtggaacgaatcgctaaagagtccctcctgcagttgttggtggatatcatacctggtctcttacaggggtatgacaacactgaatcttccgttcggaaagcatcagtcttctgcctagtagctatttactcagtcattggggaagatttgaaaccccacctggcccaactgaccggttctaagatgaagctgttgaacctctatattaagcgggcacaaactacgaactccaattcgagctcctcatcagatgtctcaacacatagttag

SEQ ID NO: 219979 - DNA, 2115 bp, Artificial Sequence
  Description of Artificial Sequence: Synthetic coding sequence
tgaaccaaattcgatgaagtacagaagtcaggaaacatgatccaatctgccaacgataaaaacttcgacgacgaggactctgttgatggaaaccgacccagcagcgcaagctccacatcttcaaaggcccctccaagtagtcgcagaaacgtagggatgggaactacaaggcgattgggtagcagtaccttggggtcaaaaagtagcgctgctaaagaaggagccggtgccgtcgacgaggaggacttcataaaggcattcgatgacgtgcccgtggttcagatttactcatcacgggatctcgaagagtctatcaacaaaatcagggagatattgagcgatgacaaacacgactgggagcagcgggtaaacgctcttaagaaaatcaggtccctgctcttggccggagctgctgaatacgataacttcttccagcacctaagactcttggacggggcttttaaactgtcagctaaggacctccggtctcaggttgtgcgagaggcctgtattaccctcggccacctgagtagtgtgctaggcaacaaatttgatcatggtgcagaggcaatcatgcccaccattttcaacttgatccccaacagcgccaaaatcatggcaacttccggagttgtcgctgtcagactgattatcaggcatactcacatcccccgactcatcccggtgataacatcgaactgtacttcgaagagtgttgccgttaggcgacgctgcttcgaatttctggacttgctcctgcaggagtggcaaacccactctctggagcgccatatctcagtgttggccgagactatcaagaagggtattcacgatgcagatagtgaggcaagaatcgaggcgcgaaagtgttactggggattccactcccatttctcccgagaagcggagcatctgtaccacaccctagagtcaagttatcagaaagctctgcagtcccatcttaagaactccgactcaattgtgagtctcccacagagtgatcggtcaagcagtagctcgcaggagtccctaaacagacctttgagcgcaaaacgcagccctactggctctacgacatcccgagcgtccacagtgtccactaaatctgtgagcactacaggctcactccagcggtcacggtcagatatagatgttaatgcagccgcaagcgccaaatccaaggtctcaagctcaagcgggaccaccccattctctagcgcggctgccctccccccaggaagctatgcaagcctgggtcgaatccgaacccgccgacagagcagtggtagtgccaccaatgttgcctcaacgcctgacaatcggggtcgcagcagggccaaggttgtgagccagtcccaaagaagtcgtagcgccaacccggctggcgctggttcaaggtcctcgagtccaggtaagttgcttggaagtggctacggaggcctcaccggcggttcgagcaggggtccacccgttactccaagctccgagaagcgaagcaaaatacccaggagtcagggctgctcacgggagacaagccctaataggatcgggcttgaccggttcgggctggggcagcctggacgcattcctggcagcgtgaacgcaatgcgggtcctgagcaccagcactgatctcgaagcggctgttgccgatgccctcctactgggtgattcccgatcaaagaaaaagccagtgcggcgaagatacgaaccttatggcatgtactctgacgatgatgccaactccgatgcaagtagcgtatgtagtgaacgcagctacggatcacgaaatgggggaataccccactacttaaggcaaacagaggacgtggcagaggtgttaaatcactgtgcaagttccaattggtccgagcggaaggaagggctgttgggactacagaatttgctcaaaagtcagagaaccctgtcgcgggttgagctaaagcgcctgtgcgaaattttcacgcggatgtttgccgatccgcactccaaaattgccgatagtgaagccgaatgcgaagacaaggaaggcaatcttttcccttctgaagtaagttgcactgtgtccttccaatacgtgttcggcgatagctgcggcttttataataactcatag

SEQ ID NO: 219980 - DNA, 4485 bp, Artificial Sequence
  Description of Artificial Sequence: Synthetic coding sequence
atggagccacgcatggagtcctgcctcgctcaggttctccagaaagatgtcggaaagaggcttcaggttggccaggaactcatcgattatttctctgacaaacagaagtccgctgacttagagcacgaccagaccatgctcgataagctcgtggacgggcttgcaacctcatgggtgaactcatctaactataaggtcgtactcctcggcatggacatcctgtccgccctcgtgacacgactgcaagaccgattcaaagctcagataggaacagtcttgcctagtctcattgaccggcttggcgacgcaaaagattctgtcagggaacaggatcaaactctgctgctgaaaattatggatcaggcggctaatccacagtatgtgtgggacaggatgctgggcggttttaaacataaaaatttccggaccagagagggaatttgtctgtgcctgattgccacccttaatgcaagcggagctcagaccctgaccctgagtaagatagtgcctcacatctgcaatctactgggggaccccaatagtcaagtgcgggatgccgctattaacagccttgtagaaatttatagacacgtgggtgaacgcgtgagagctgacctgtcaaagaagggcctgccacagtcacgcctgaatgttatcttcactaagtttgacgaggtgcaaaagtctggaaacatgattcagtccgccaacgataaaaactttgacgacgaggattcagtggatggcaatagaccctccagcgcatcgtcaacttctagcaaggccccaccttctagtagaagaaacgtggggatggggacgacgcggaggcttgggagctccacccttgggagcaaatcttcggccgcaaaggaaggggctggagccgtggatgaagaggactttatcaaagcctttgatgacgtgccagtcgtacagatctactcctcccgtgacctggaggaatctattaacaagatccgcgagatcctgtcggacgataagcatgactgggagcagcgggtgaacgctctcaagaaaattcgttcccttcttctggcgggtgcggcagagtatgacaactttttccagcacttgagacttttggacggagctttcaagttgtccgccaaggatctgaggtcccaggtcgtaagggaggcgtgcattaccctcggtcacctctcttctgttttaggaaataagttcgaccacggggcagaggccataatgccaacaatctttaatctcattccaaattcagctaagatcatggccactagcggcgtcgtagcagtgcggttgattatcaggcacacacacattccaagattgatcccagtgataactagtaattgtaccagtaagagcgttgctgtgcgtcgtcgatgcttcgagttcctggatctgttattacaagagtggcagacccacagtctggaaagacacatttctgttctggcggagaccattaaaaaggggatacacgatgccgacagtgaagcgcgaatcgaggcccgtaagtgctactggggatttcacagccatttcagtcgggaagccgagcatctataccatacacttgaaagcagttatcagaaggcactccagagccacttgaaaaattcagattccattgtttcactcccacagtctgatcggtcctcttcttcctctcaggaaagcctcaatcgccctctctctgctaagcggagtcctactggtagcacaacttctcgggcttccacggtgtctaccaagtcagtgagtacaaccgggagtctccagaggtcacgcagcgatattgacgttaatgcagccgcatctgctaaatctaaggttagcagcagcagcggtaccactcctttttcgagcgccgctgccctaccccctggcagctatgcgagtcttggtcggattagaacacgccgtcagtctagcggcagcgcaaccaatgttgcttctacaccagataaccgagggcgttcgcgggctaaggtcgtgagtcagtcccagaggtcgaggtcagctaacccagctggagcagggtccagaagctcttcacctgggaagctgctgggttccggttacggcggtctgaccggcggaagctcccgcggacctccagtgacaccctcttcggaaaaacgatctaaaatacctcgctctcagggatgttcccgggaaacatccccaaatcggatagggcttgataggttcggactggggcagccaggtcgcatcccaggatcagttaacgcaatgcgcgtactcagcacatccacagacctggaggcggcagtggctgacgctttagtgagaggaacaagcaccggcaaaaagaagcccgtgcgaagacgctacgagccctacgggatgtacagcgacgacgatgctaattccgacgcatcatcagtgtgcagcgagaggagctacgggagcagaaacggaggtatcccacattacttaaggcaaacggaggacgttgcggaggtgctgaaccactgtgcttccagcaactggagcgagcgaaaagaggggctgctgggcctgcaaaacctgttaaaaagccagagaactttaagcagggtagagctgaagcgcctgtgtgagatattcactcgcatgttcgctgaccctcatagcaagatagctgactctgaggctgagtgcgaggataaagaaggtaacttgttcccttctgaggttagttgtacgagggtgttcagtatgttcttagaaacacttgtcgactttataatcatacacaaagacgatctacaggactggctgttcgtactgctgactcagctgcttaagaaaatgggagcagatctgctgggctccgtgcaggccaaagtacagaaggctctggacgttacgcgggatagtttcccgttcgatcagcagttcaacattctgatgcgtttcatcgtggatcagacacagaccccaaacttaaaagtgaaggtggccatcctcaaatatatcgaaagcctggctaggcaaatggaccccacggatttcgtcaactcctctgagacccggctggcggtatcacggatcatcacctggacaacagagcccaaatcttctgatgtgaggaaggcggcacagatcgtgctcatttccctttttgaactcaacactcccgagttcaccatgctgctcggggctttgcccaagaccttccaagacggggcaaccaagcttctccacaatcatttgaagaactcctctaacaccagcgtgggctcacccagtaacactattggcagaactccatcccggcacacgtcctcgagaacaagtcctttgacttcgcccacgaactgcagccatggtggactttccccttcgatgttggattatgatacggaaaatttgaacagcgaggagatatactcgtcgctccggggagtcactgaagccattgagaaatttagcttccgaagtcaggaggatctgaacgagccaattaaacgggatggcaagaaagagtgcgacatcgtgtccagagacggtggcgctgccagcccagccactgaaggtcggggtggcagcgaagtggaggggggacgcaccgcactggacaataagacctcactgctgaacacccagcctcctcgtgcttttcccggacctagagcgagggactacaacccatacccctattcagacgctattaatacctatgacaagaccgctctcaaagaagccgtgttcgacgacgatatggagcagctgagagacgtgccaatcgatcatagcgatctggtcgctgaccttttgaaggaactaagcaaccacaacgagcgcgttgaagaaaggaagggagccttattggagctgctaaaaataactcgggaggactctttaggggtgtgggaggaacattttaaaactatcttgctcctactgctggagacactgggagacaaagaccattccatccgagccctcgccttaagagtgttaagagagatcctgagaaaccagccggcaaggttcaagaattacgcggaactcaccataatgaagacgctggaggctcataaagactcgcacaaagaggttgtccgcgcagccgaagaggcggcaagtacactggcttccagtattcaccctgagcagtgtatcaaagtgctctgccccatcattcagacagccgactatccaatcaacttagccgctatcaagatgcagacaaaggttgtggaacgcatcgccaaggagagtttactgcagttactggtggacataattcccggtttgttacagggctatgacaacacagagtcaagcgtgagaaaggcttcagtgttctgcctcgtggcaatctatagcgttatcggagaggatctcaagccgcacctggctcaactcacgggaagtaagatgaaactgcttaacctgtacattaagagagcccagaccacgaatagtaatagcagtagcagcagtgatgtctccacccacagctag

SEQ ID NO: 219981 - DNA, 4434 bp, Artificial Sequence
  Description of Artificial Sequence: Synthetic coding sequence
atggaaccaagaatggaatcctgtttggcgcaagtgttacagaaagatgttggcaaacgcctacaggtcggccaggaactgatagactatttctctgacaaacagaagtctgccgacctggagcacgaccagaccatgttagacaagctcgtggacggtctggccacgtcctgggtgaactccagcaattataaggtcgtcctgctgggcatggacattctatccgcgttagtgacgaggctgcaagatagatttaaggcacagattgggacagtcctgccatctctgattgaccgattgggcgacgcaaaggattccgtgcgagaacaggatcagaccctgcttttgaagattatggatcaggccgctaacccccaatacgtctgggacaggatgctgggcggattcaagcacaagaattttagaactagggagggcatctgtctctgtcttatcgcgacgctgaacgcttcaggggcacaaacactcacattatcgaagatcgtgccacacatatgtaacctactaggcgaccctaactcacaggtaagggatgccgctattaattccttagttgagatctaccgtcatgtgggcgagcgggtgcgcgcagacttgagcaagaaggggctgccgcaatcaagattaaatgttatctttacaaagttcgacgaagtccagaaatctggtaatatgattcagtctgctaacgacaaaaactttgatgatgaagattccgtcgatggcaaccgtcccagctcagccagctccaccagcagtaaggcaccgcctagcagtagacgcaacgtgggaatgggaaccaccaggcgtttgggcagcagtacccttggatctaagtcctctgccgctaaggagggagcaggtgcagtagacgaagaagattttatcaaggcatttgacgacgtcccggtcgtgcaaatctatagttcacgagatttagaagagtccattaacaaaatacgagagatcctaagcgacgacaaacacgattgggaacagagagtgaatgccttgaagaagataaggtctctactacttgcaggagctgctgagtacgacaatttctttcagcatctgcgtttgttggacggggctttcaagctttccgcaaaggatttgaggtctcaagtggttcgagaagcttgcattacacttggccacctaagtagtgtgctcggaaacaaatttgaccacggggctgaggccatcatgccaactatatttaaccttatccctaactcagcgaagatcatggccacaagcggagtggtggccgttcgcctcatcattaggcacacccatattccgagacttataccagtcatcacaagtaattgcacctctaagagcgtcgccgttagacgacgttgctttgaattccttgatctgctactccaggagtggcagacacacagtttagagcgccatattagcgtgcttgctgagaccattaagaaaggtatccatgacgcagactctgaggccagaatcgaggccagaaagtgctactggggatttcattctcacttctccagggaagccgagcacctgtaccacacgcttgagtcctcatatcaaaaggccctgcagagtcacctgaagaactctgacagcattgtttccctccctcagagcgataggtcttccagttccagtcaggaaagcctaaatcgccctttgtccgcaaaacgttccccaacagggtccaccacttcgcgggcatccacggtctcaactaaaagtgtcagcacaactgggagtctccagcgatcccggtccgatattgacgtgaacgcagccgcatcagcaaaaagcaaggtctcatccagctccgggacgacccccttttctagcgcagcagctctcccgcctgggagctatgcttcacttgagagtcgccatatgcgagaagacatggaatacatcggattggattccggccgaattagaacccgaaggcagtcatccggctccgccacgaatgtggcgagcaccccggacaaccggggtaggtccagggcaaaggtggtgtctcagagtcagcccggatctaggtcctcttcaccagggaagttgctggggtccggttatgggggactgacaggtggctctagccggggacccccagtcactcccagttctgagaagagatctaagatccctagatcacaggggtgtagtagagagacatctcctaaccgcatagggctggaccgcttcggcctcggccaaccaggcagaattcctgggtctgtaaatgccatgcgggtgttatccaccagtacagacctagaggctgctgtggcagatgccctgcttctcggtgactctaggagcaagaaaccagtccgaaggagatatgagccctatggaatgtattcggacgatgatgcaaactcagacgcctctagcgtttgttccgagcggagctacgggtctaggaacgggggtatcccacactacctaagacagacagaagatgttgccgaggtcctgaatcattgtgcaagttctaactggtctgaacgtaaggaaggcctcctcgggctgcagaatttactcaaatcacaacgcaccctgtctagggtcgagctcaagcgcttgtgtgagattttcacaaggatgttcgcggatccccactccaagcgggtgttttccatgtttctggagaccctggtggacttcatcatcatccacaaggatgacctgcaagattggctttttgtgctgctgacccagttactaaagaaaatgggcgctgacttgctcggatctgtgcaggcgaaagtccaaaaagcattagatgtcactcgcgactcattcccgttcgatcagcagttcaatattctcatgcgttttatcgtggatcagactcaaactccaaacttaaaggttaaagtagccattctgaagtacatcgaaagtttggccagacagatggaccctacggactttgtaaattcaagcgaaaccaggctggcagtctcacggattataacatggactaccgagcccaagagctcagatgtgagaaaagcggctcagattgtccttattagcttattcgagttaaataccccggagtttaccatgttactgggagctcttccaaagacatttcaggatggggcaactaaactcctgcataaccacctgaaaaacagctctaatacctccgtgggaagtccttcaaacacaattgggcgaactccctcacgccatacatcatcccgcacatccccactgacctctcccaccaactgcagtcatggagggcttagcccttcgatgctcgactacgatacagagaacctcaacagcgaagaaatatattctagcctcaggggagtcactgaggctattgagaaattttcctttcgttcccaggaggatctcaatgaacctatcaaaagggatggaaagaaggaatgtgatatcgtgtccagggacggtggggctgcctctccggcaacagaaggacgcggagggtctgaagttgagggaggcagaaccgctctggataacaagaccagcctgttgaacactcagcctcctcgggcttttccaggcccaagagccagggattataatccctacccatatagcgatgcaattaatacctatgacaagacagctctgaaagaagctgtgtttgatgacgacatggaacagctgcgtgacgtgccgatcgaccactctgaccttgtcgccgacctcctcaaggaattgagtaaccacaatgaaagagtggaggagcggaagggtgcactcctggaactacttaagatcactagggaggactccctcggtgtgtgggaggagcacttcaaaactatcttgctcctcttgctcgagactcttggagataaagatcatagcataagggcactggccctgagggtcctccgggaaatcctccgtaatcagccagcccgattcaagaattacgctgagctgaccatcatgaagacgctggaggcccataaggattcgcataaggaagttgtgagggcagccgaggaagctgcatccaccctagcgtcctcaattcaccccgaacagtgtatcaaggtgctatgccctataattcagaccgcggactaccccattaatctggcggctataaagatgcagactaaagtcgtcgagcggattgccaaggaatccctgttgcagctcctcgtggacataatcccgggtttactgcagggttacgacaataccgaaagcagcgtcaggaaagccagcgtattttgcttagtggccatatactctgtgataggagaggatctgaaacctcatttagcccagcttaccggaagcaagatgaagctgctgaatctgtatatcaaacgcgcacagacaaccaattctaactcatcctccagctctgatgtatcaacgcatagctag

SEQ ID NO: 219982 - DNA, 3768 bp, Artificial Sequence
  Description of Artificial Sequence: Synthetic coding sequence
atgctgcaaaactgtagcgataaaaactttgacgatgaggattccgtggatgggaaccgaccgtcttcagcaagctccacatctagcaaagccccaccttcctcccgaaggaatgttgggatgggaactaccaggagattgggcagtagcacactgggttcaaaatcgagtgctgctaaggaaggagccggtgcagtggacgaggaggactttatcaaagcgtttgatgacgttccagtcgtacagatctattcaagccgcgatttagaggaaagcatcaataagattcgcgaaattctcagcgacgataagcacgactgggaacagcgtgtaaacgcccttaagaaaatacggtctctcctgctggctggtgccgctgagtacgacaatttcttccagcacttgcgtctcttagatggggctttcaaactttctgctaaggatctcaggagtcaagtggtacgggaggcgtgtatcacccttggccacctgtcctctgtgttaggaaataagtttgatcacggagcagaggccatcatgcccacaatatttaatctgatccccaattctgccaagatcatggctacctccggtgtcgtcgctgtgagactaattatccggcacacacacatccccaggctcattccagtcattacctcaaactgtacatcaaagtctgttgctgtcagacggagatgcttcgaatttctagacctgctcctgcaggagtggcaaacacattcccttgagaggcacataagcgtgcttgcggagactataaagaagggcatacacgatgccgattctgaggcccgtatcgaagccaggaaatgttactggggctttcacagtcattttagtcgagaggctgagcacctgtaccacaccttagagtctagttaccagaaagcactccagtctcatctcaagaatagcgacagcatcgtgtcgcttccccagagcgacagatcttcctcttcaagccaggaatctctcaaccgaccactgtcggctaaacggtcccctacggggtcaactaccagtagagcctctaccgtgtcgacaaaatctgtctcaacaaccgggagcctccagaggtcccgctccgacattgatgtgaatgccgctgcatcggccaaaagcaaagtgagctctagttctggcaccaccccctttagctcggcagcagcactgccaccagggtcgtatgcttcactgggcaggatccggactcggaggcagagcagtggtagcgcgacaaatgtcgcatccacccctgacaacaggggtcgctcacgggctaaagtagtgtcccagagtcagcgatcccgatcagctaatcccgcaggagctggttccagatccagctctcctggcaagctgctgggctccggctacggcggactgaccggcggttcatctagaggacccccagtgaccccttctagcgaaaaacgatcaaagatcccacgcagtcagggttgctcacgagagacttctcccaaccggattggcctggacaggtttggattaggacagcccggaagaattccaggtagtgtcaatgctatgcgcgttctgagcacatcaactgatctagaggccgctgtggcagacgcactcaaaaagccagtgcgaaggcgttatgaaccctacggaatgtattctgatgatgacgcgaactccgatgccagctccgtatgttctgaaaggagctacggttcacgtaatggcggaattccccactacctgcgtcagaccgaggatgtggctgaggtgttaaatcactgcgcctccagcaactggagcgaaaggaaagaagggctgctggggctacaaaatctgttgaagtcgcagaggaccttgtctagagttgaactgaaacggctctgtgagattttcacacggatgtttgctgatccacatagtaagattgctgacagcgaagcggagtgcgaagacaaagaagggaatctgttccctagcgaggtttcatgcacccgtgtgttcagcatgtttctcgaaaccctggtcgactttattatcatccacaaggacgatttgcaggactggctatttgtgcttctcacacagctgctgaagaaaatgggagctgacctgctgggatctgtgcaggccaaggtacagaaagcccttgatgtcaccagggattcttttccttttgaccaacagtttaacattctgatgaggtttatcgtggaccagactcagactccaaacttaaaggttaaggtagcaattttgaagtacatcgaatctcttgccaggcagatggaccccaccgatttcgtgaattcctcagagacccggttggctgtctcacggattattacatggactacagaacccaaatcttccgatgttcggaaggctgctcagatcgtgctgataagcctattcgaactaaacacccctgagttcacaatgttgctgggtgcactgcctaagacattccaggacggggcaactaagttattacacaaccacctaaaaaactcgtccaacacctcagtgggttcacccagcaatacaatcgggagaaccccatctagacacacctcctcgaggacgtccccgcttaccagtcccacaaactgctcccacggcggactgagcccgtccatgctggactatgacacagaaaacttgaactccgaagagatctattcaagcctcagaggcgtcacggaggccattgagaagttcagcttcaggtcacaagaagacctgaatgagcctatcaaaagggacggaaaaaaggagtgcgatatagtctcccgagatggtggcgcagctagtccagccactgaaggacgaggaggctctgaagtagagggaggtagaaccgctctagataacaagacaagtctcttaaatactcaacctccgagagcctttcccggacctcgggctcgcgattataacccgtacccatactctgacgcgatcaacacttatgataagacagctctcaaggaggccgtgttcgacgacgacatggagcagcttcgggacgtgcctatcgatcattccgacctcgtggccgacttgctgaaagagcttagtaatcacaacgaaagagtggaagaacgaaaaggagccctcctggagcttctgaaaataacacgcgaagacagtctgggcgtgtgggaggagcattttaagacaattctgctgttactgctcgagacactgggagacaaggatcattcgattagagctctggcactgagagtgctgcgggaaatcttacggaatcagccagcaagatttaagaattatgcggaactaactataatgaaaaccctcgaggctcacaaggactctcacaaagaagtggtgcgtgcggcagaggaagccgctagcactctcgccagctccatccaccccgagcagtgcatcaaagtgttgtgtcctattatacaaacagctgactatcctattaatctggcggcaattaaaatgcagaccaaggtggtcgagcgcattgcaaaggaaagcttgctgcaacttctcgtagatattattcctgggctgttacagggctatgacaacaccgagtcatcagtgcgcaaggctagtgtcttttgcttggtagcgatctattcagttatcggggaggatctaaaaccacatttagcccagctgactggcagcaaaatgaaactgctcaacttatatattaagcgtgcacagacaactaactccaacagcagctcctcctctgatgtgagcacccactcctag

SEQ ID NO: 219983 - DNA, 3738 bp, Artificial Sequence
  Description of Artificial Sequence: Synthetic coding sequence
atgacaacagggaaagataagaactttgatgacgaagattccgtcgatgggaaccgcccatccagcgctagctccacctccagcaaagcacccccatcctcccgaagaaatgtgggcatgggaaccactagacgtttaggcagttctaccctcggcagcaaaagctccgctgcaaaagagggagccggagccgtagacgaggaagactttattaaggctttcgatgacgtccccgttgtgcagatctattccagtagggatctggaggagtcaattaataagatcagggaaatcctcagcgatgataaacacgactgggagcaacgggtcaacgctttaaagaaaattaggagcttactgctcgccggagcagccgagtacgacaacttctttcagcaccttagattactagacggagcctttaagctctcagcaaaggatctgcggagccaagtggtccgggaggcctgtatcactctcggccacctctcgagtgttctgggcaataaattcgaccatggcgctgaggcaattatgcctactatctttaatttgatacccaatagtgcgaagatcatggcaacgtcgggcgtggtcgctgtcaggcttataattcggcatactcacatcccgaggctgatccccgtcatcacctctaattgtacatcgaagtccgtggccgtaaggagacggtgctttgaatttctggatctcctgctccaggagtggcagacccattctcttgagcgtcacattagcgtgctggccgagactatcaagaagggaatccacgacgctgatagcgaggcgagaatcgaggctagaaaatgttactggggattccattcacacttctcaagagaggccgagcacctgtaccatacgctcgagtcatcataccagaaggccttacagagccacctgaaaaacagcgattccatcgtttctctcccacagagcgacaggtcgtcttcttcatcacaggaatccctcaatcggcctttgagtgctaagaggagcccaacaggctcgacaacatccagagctagtacagtgtccacaaaatcagtatctacaactggttccttgcagcggtctcgcagtgacatcgatgtcaatgctgctgccagcgctaagtccaaggtgagctcttcttctggaacaacaccattctcttccgcagctgccctgcccccaggttcctacgcttcactggacggtaccaccacaaaggctgaaggcagaattcgaacaaggcgacagtcaagcggctccgccacaaacgtggcatcaacaccagacaaccgaggtcgctctagagccaaagtcgtttcgcagagccagcggagccgcagtgcgaatcccgcaggagctggctcccgaagtagctccccgggaaaattgcttggcagcggctacggaggactgaccggtggctcaagcagaggacctccggtcactcccagttccgaaaaacgcagtaaaataccccgttcccagggatgctcccgggagacaagtcctaatcgaattgggttagatcgattcgggttggggcaacctggacgcataccagggtctgtgaatgcaatgcgcgtgctgtctacttccacagacctggaggccgcagtggccgatgctctgttgctgggagattcccgctccaagaagcctgtgcgtcgacgatacgagccctacggaatgtattcagatgatgatgctaactccgacgcaagctccgtatgcagtgagcgctcttacggatcgagaaatggcggaattcctcattatctccgccagactgaggacgtcgcggaggtgctgaatcactgtgcttcctcaaattggtcggagcgcaaggaaggactgttgggcctgcaaaatctgctgaagtcacagagaacactctccagagtagagctgaagcgactctgcgagatatttacgcggatgttcgccgatccccatagcaaggtcttctccatgtttttggagacactcgtagacttcattattatccacaaggatgatcttcaggattggctttttgttctcctgacacagctccttaaaaagatgggcgcagatctcctaggcagtgtgcaggctaaagtccagaaggcactcgatgtgacccgtgacagttttcccttcgaccagcagttcaacattctaatgaggtttattgtggaccagacacagacacctaacctgaaagtgaaggtagctattctcaaatacattgagtcgctggctcggcagatggatccaaccgattttgtgaattcatccgagaccagattggccgtgtcgaggattatcacctggacaactgaacctaagagctccgatgtacggaaagcagctcagatagttttgatctccctatttgaactcaatacccctgagttcaccatgcttttgggcgcactgcctaagactttccaagacggagcaactaaattgctacataaccacctgaagaactctagtaacacgtcagtggggagccccagtaacaccatagggcgaactccttctaggcacacaagttcaaggacctcccctttgactagccctaccaattgctctcacgggggattgagcccgtctatgttggactacgacacagaaaacttgaattccgaggagatttattcctccctgcgcggtgtgacggaagctatcgaaaaattcagtttccgcagccaggaagatctcaacgaaccaataaaaagagacgggaagaaggagtgcgatatcgtgtcacgggatggaggagccgcaagtcccgcaaccgaggggaggggaggatccgaagtcgagggaggccgtacagcccttgacaataaaacctctctacttaacactcaaccgccacgcgctttccctggtccacgagcacgcgattacaacccgtatccatactccgacgccatcaacacatatgacaagacggcgctaaaggaggccgtttttgacgatgacatggagcagctgcgagacgtcccgatcgaccattccgatctggtggccgaccttttaaaggagctgagcaatcacaatgagcgtgtggaagagagaaaaggggcattacttgaactcctcaaaatcacacgggaagacagcctcggggtgtgggaagaacattttaaaacaatcctcctgcttctgctggagacactcggagataaggaccattccatcagagctctggctctgagagtcctcagggagattctcagaaatcagccggctagatttaaaaactacgccgagctcacaatcatgaagacgctggaagcccacaaggattcccataaagaagttgtgcgggctgccgaagaggctgcctcaaccctggcttcttcaattcatcccgaacagtgtatcaaggtgctctgtccaatcattcagactgctgattacccaattaacttagccgctattaagatgcagaccaaggttgtcgagcggatagcgaaagagtctctgctccagctcctcgtggatatcatccctggccttctacaggggtacgataacacggaatcttccgtccgtaaggcttcagtcttttgcctggtggcaatctattccgtgatcggcgaggatttaaaaccccacctggctcagcttacaggctctaaaatgaagctgctcaacctatacattaagcgggctcagaccaccaacagcaactctagcagcagttctgacgtctccactcatagctag

SEQ ID NO: 219984 - DNA, 2988 bp, Artificial Sequence
  Description of Artificial Sequence: Synthetic coding sequence
atgggacttcggaaccacttccctggagaggcggaaacgctctataactcattggagccatcttaccaaaaatccctgcagacataccttaagtcttccggctccgttgcttcattaccacagtcagatagatcatcttcttcatcacaggaatccctgaaccgacccttcagctctaagtggtccaccgctaacccctcaaccgtcgctgggagggttagtgccggatctagtaaagcgtcatccctacctgggtcactgcagcgtagcaggtccgatatcgatgttaatgcagcagccggtgctaaagctcatcacgctgcaggtcaatccgttcggagtggtcggttgggcgctggtgctttaaacgccggttcctacgcctcacttgaggatacgagtgacaaactggatggcaccgcatccgaagatggcagagtaagggcaaagctgtctgcaccactggcgggaatgggaaacgccaaggctgattcccgtggacggagcagaaccaaaatggtgtcccagagccaacctggttcacgctcaggatctcctggaagggtgctgaccactaccgctctctccactgtaagcagcggggtccagagggtcctggttaattccgcctctgctcagaagagaagcaagatcccacgatctcaaggttgtagtcgggaagcttctccatccaggctgtcagttgcaagatctagcaggattccacgtcctagcgtaagtcaaggttgctctagagaggcctcgagagagtcttcacgtgacacttcacccgtgcggagcttccagcccctgggacccggttacgggataagtcaatcctccaggttgtcttcaagcgtgtcagctatgcgggtccttaataccgggtcagacgtggaagaggctgtggctgacgcactgaaaaaaccggcaagacgacgatacgagtcttacggtatgcacagtgatgatgatgcaaactctgatgcgtcaagcgcatgcagcgaacgatcctactctagccgaaacggctctattcccacctatatgagacagaccgaggacgtagcagaggtgctcaaccgctgcgcctcttccaattggtctgagcgcaaggagggcctgttaggcctgcagaacttacttaagaaccagcgcacactgagccgcgtagaacttaagaggctgtgtgagatattcacacgcatgttcgccgacccgcacgggaaaagagtatttagcatgttcctagaaactttggtagattttattcaggttcataaggatgacttgcaggactggctgttcgtgctgctgacccagctattaaaaaagatgggtgccgaccttctcggatccgtgcaggcaaaggtccagaaggccctcgatgtgacaagggagagcttccccaatgacctccaatttaatatccttatgaggttcacagttgatcaaactcagaccccgagtcttaaggtcaaggtggctatcctaaaatacatcgagacattggccaaacagatggacccaggggatttcattaattcatccgagacgcgactggccgtgagtagggttattacatggactaccgaacccaaaagctcagacgtcagaaaggccgctcagagtgtgctgattagcctgtttgagctcaacacacctgaatttactatgcttctgggcgcactcccgaaaacattccaggacggggcaactaagctcctgcacaatcatttgcgcaacacaggtaacggtacgcaaagctcaatgggctcgcctctgaccaggccaacgcccaggagtccagccaattggtcttccccactaacaagcccaacgaacacttcacagaatactctgagtccaagcgccttcgactatgatactgaaaatatgaactcagaagatatatattcttcccttaggggcgtgactgaggcaattcaaaacttctccttcagatcacaggaagatatgaacgaacctctcaaaagagactccaagaaggacgacggcgacagcatgtgtgggggtccaggcatgtccgaccctcgtgccggaggcgacgccacagatagttcacagaccgccttggacaacaaagcttccctgctgcattcgatgcctactcattcatcgccccgaagccgagattacaacccttacaattacagtgattctatctccccatttaacaagagtgccctaaaggaagctatgttcgacgatgatgctgaccagtttcctgacgatctaagcttagaccatagtgacctggtggccgagcttctgaaggaactttcaaaccacaatgagagagtcgaggaaagaaagatagccctgtacgaactcatgaagttgacccaggaagaaagcttctctgtttgggatgaacacttcaagacgatcctactcctgctgctcgagacgctgggcgacaaggaaccaaccatcagggccctcgctctcaaagtgttacgcgagatactccgacatcaaccggctcgttttaagaactacgccgagctcacggttatgaaaactcttgaagcccacaaggatccccacaaggaggtggtcaggtcagccgaggaagctgccagcgtgttagccacgagcatctccccggagcagtgcatcaaggtcctttgcccaattattcagaccgcagattaccctataaatctggctgccattaagatgcagacaaaagtcatagaacgggtctccaaagagaccttgaatcttctgctgcccgagattatgcctggtctgattcagggctacgacaactcggagtcttctgttcgaaaggcctgcgtcttctgtctggtagccgtgcatgccgtgattggggacgaactgaaaccccacctgtcacagctgaccggaagcaaaatgaagcttcttaatctatacattaagagggctcagacgggctcaggaggggctgatccaaccactgacgttagcgggcagtcctag

SEQ ID NO: 219985 - DNA, 1296 bp, Artificial Sequence
  Description of Artificial Sequence: Synthetic coding sequence
atgagaaggctgatttgcaagagaatctgtgactacaaatcatttgatgacgaagagagcgttgacgggaacaggccctcgtcagccgcttctgcatttaaggtccccgctccaaagacatctggcaatcctgctaactccgctagaaagccgggatccgctgggggaccaaaggtcggcggagcctccaaggagggaggcgctggggctgtcgatgaggacgactttatcaaagctttcactgacgtgccttccatacagatctactcaagccgcgaactggaagagacactcaataaaataagggagatcttatcagatgacaagcacgattgggatcaacgggcaaatgcacttaaaaaaataaggagcctgctggtggccggagctgcccagtacgactgtttttttcaacacctgcgactcttagatggcgcactgaagttgtctgctaaggatctgagaagccaagtggtccgcgaggcttgcatcaccgtggcccacttgagcacagtgctgggtaacaaatttgaccacggggcagaggccattgtcccaaccctgtttaatctggtaccaaattctgccaaggtcatggcgacttctggttgcgcagctattcgattcatcatccggcatactcacgtaccccgactcattcccctgattacttccaactgtacttccaaaagtgttccagtacgaaggagatctttcgagttcctcgaccttctgttacaagagtggcaaactcatagtctcgagagacacgccgcagtgctggtggaaaccatcaagaaggggattcacgacgcagatgctgaagcgcgagtcgaggctaggaagacgtacatgggcctgcgtaaccattttcccggtgaggccgaaacactttataacagcctggagccaagttatcagaaatccctgcagacctacctgaagtcatcagggagcgtggcctctctaccacaatctgatcgcagctcttcgagcagccaggaatcattgaaccgcccattcagctctaagtggtcaacagctaacccatccacagtcgccggacgcgtgagtgccggatcctcaaaagcatcaagtctcccaggtagtctgcaaaggtctagatctgatattgacgtcaacgccgcagcaggcgcaaaagcacatcatgcagccggtcaaagcgtgaggtcaggtcggctcggggctggcgctctgaatgccggaagctacgccagtttagaatgtgaggcattttggcgctcaggacgaactgccaagctctatagcgtgtag

SEQ ID NO: 219986 - DNA, 4518 bp, Artificial Sequence
  Description of Artificial Sequence: Synthetic coding sequence
atggaacctaggagcatggaatacttttgtgcacaggtgcagcagaaggacgtgggagggcgactgcaagtgggccaagaacttcttctgtatctgggtgcgcctggagccatctccgaccttgaagaggacctggggcgtttaggcaagactgtcgacgccctcacggggtgggttggttcgtccaactacagagtgagcctgatgggacttgaaatattatccgcattcgtggacaggttatccaccaggtttaaatcatatgtcgctatggtgatcgttgctctaatcgatagaatgggagacgctaaggataaagtgcgcgacgaagcgcagactttgatcctaaagctgatggatcaagtggccccacccatgtacatctgggagcaactggccagcggtttcaagcataagaatttccgttctcgagaaggcgtctgcctctgcctgatcgaaaccctgaacatcttcggagcgcaacccctggtgatttcaaagttgatcccacacctatgcattctatttggggactctaattctcaggttcgcgatgccgcaattttagccatcgtggaaatataccggcatgtgggcgaaaaggtacgcatggatctctataagaggggtattccccctgctcgactggagatgatattcgccaaattcgacgaagtccagagttccggcggaatgatcctgagcgtgtgtaaggataagtcatttgatgatgaagagagtgtggacggaaatcgacccagcagtgcggcatctgcattcaaggttcccgcaccgaagacttctggaaatcccgcaaatagcgcaaggaagccagggtctgctggcggtcccaaggttgggggagccagcaaagagggtggcgctggcgctgttgatgaggatgattttatcaaggcatttaccgacgtaccttctatccaaatttatagttcacgggaattggaagagactctgaacaaaatcagggaaatcctctccgacgacaagcacgactgggaccagagagccaatgcattgaaaaaaattcgttctcttctagtggcgggagcggctcagtatgactgctttttccaacacctcagattgctggacggcgcattaaagctgtctgccaaagatctaagatctcaggttgtccgagaggcttgcatcactgtcgcgcaccttagcaccgttctggggaataaattcgaccacggcgcagaagctatagtgccaaccttatttaacttggttcccaatagtgctaaggtcatggccacatctggctgcgccgcaatacgttttatcatccgccacacgcacgtgcctagattaatccctctcattacatctaattgcacttctaagagtgtgcccgttcgtagacgcagttttgaattcctggacttgctgttgcaggagtggcagactcactctctagagagacacgccgcagtactagtggagaccattaagaaggggattcacgatgccgatgctgaggccagggtcgaggctaggaaaacttatatgggcttgcgcaatcatttccccggtgaagccgaaaccctctataattccctcgagccctcttatcagaagagcctgcaaacctatttaaaatcatctggcagcgtcgcatcactgccacagagtgaccggtccagctcctctagccaggagtccctgaatcgccctttttcctccaaatggagtacagctaatccttcaacggtggcaggtagagtgagcgccggaagttccaaagccagcagcctgcctggcagcctgcagcgaagccggtcagatatcgatgtcaacgcggctgccggagccaaagctcatcatgccgcaggacagtccgtgcggtcgggtcggctgggtgcgggtgctctgaacgcaggttcatacgccagtcttgaggatacttccgacaaactggacggcaccgccagcgaggacggccgtgtgagggcaaagcttagcgcaccactcgccggtatgggaaatgctaaggccgatagtcgtggcaggtcaaggactaagatggtgagtcaatcccaacccggtagtaggtctggctcacccggtcgggtgttgaccactacagctctgagtacagtgtccagtggggtgcagcgcgtcctggtcaactccgctagtgcacaaaagcgctctaagattcccaggagtcaaggctgttctcgagaggcaagcccaagccggctgagcgtggccagaagtagccgtatccctagaccatctgtctctcagggatgcagtcgggaagctagtagagagtcatcacgggatacctctcccgtgcgatcctttcagcctcttggccctggatacgggatctcccagtcttcaaggctgtccagctctgtatctgccatgagagttctgaatactggatctgatgtcgaggaggccgtggccgacgctctgaaaaagccggctcgtcgtagatacgaatcttacggaatgcattcggacgatgacgcaaactctgatgcatcaagcgcctgcagcgagaggtcctatagcagtagaaacggaagtatccctacatacatgcgacagacagaagatgtcgccgaagttttgaacaggtgcgcaagctccaactggagtgagcgaaaggaaggattgcttggcctccagaacctgctcaagaaccagcggactctcagcagggttgagctaaagcgtctctgcgagatatttacacgaatgttcgcggacccacacggaaaggtttttagtatgttcttggaaacactcgttgatttcattcaagtgcacaaagacgacttgcaggattggctgtttgtcctacttacgcagttgctcaagaagatgggggcagacttactggggagcgtgcaggccaaggttcaaaaagcgctggacgtgaccagagaatccttccccaatgacctgcagtttaacatcttaatgcgatttactgtcgatcagacacagaccccttcgctaaaggtgaaagttgctatcctgaaatatatagaaaccctggcgaaacagatggaccctggtgactttataaatagttccgaaacccgcctggccgtgtccagagtaattacctggaccacagagccaaaaagttccgatgtgaggaaagctgcccagtctgtactgatttctctattcgagctcaatacccctgagttcactatgctgttaggggcactgcccaaaacctttcaggacggggcaacgaaactcctgcacaaccatctacggaataccggcaacggcacgcaatccagcatgggcagcccacttactagaccaacccccaggagccccgctaattggtcaagccctcttaccagccctaccaataccagtcagaataccctctcccctagcgctttcgattatgacacggagaacatgaactccgaggacatttactctagtctgagaggggtcactgaggccattcagaatttctcattccgctcacaggaagacatgaacgaacccctgaagcgagacagtaagaaagacgacggagattctatgtgtgggggtcctggcatgtccgatcccagggcgggaggtgatgcaacagactcttctcagaccgctttagacaataaagctagtcttcttcacagcatgcccacacattcatctccccgatctcgcgactacaacccttataattacagtgactctatctcgcccttcaataagtcagcgctaaaggaagcgatgttcgatgatgatgcggaccagtttccagatgatctctcccttgatcactctgacctggtcgctgaactgctcaaagaactgtctaatcacaacgaaagggtagaggaacgaaaaattgcactgtatgagctgatgaaactgacccaagaggagtccttctcagtttgggatgagcactttaagactatcctccttctcctcctcgagaccctgggggataaagagcccaccataagggcgctcgcccttaaggtcctgagggaaatcctgcgccatcagccagcccgttttaagaactacgccgagctcacggtgatgaagaccctggaggctcacaaggaccctcacaaggaagtggtgcgatctgcggaggaggccgctagcgtcctggccacctctatctctccagaacagtgtatcaaggtgctgtgtcctatcattcagactgccgactaccccatcaaccttgccgcaatcaagatgcaaaccaaggtaatcgaacgtgtatctaaggagaccctgaatctcctgctgcctgagatcatgccaggactgatccaagggtacgataatagtgagtctagcgtgcgcaaggcttgtgtgttctgcctggtagccgtgcacgccgtcatcggcgacgaactcaagccacatctgagccagttgacgggcagtaagatgaagctgctcaacttgtacatcaaaagagctcagaccggttcgggcggagcagaccctaccactgacgtcagtggacaaagctag

SEQ ID NO: 219987 - DNA, 4542 bp, Artificial Sequence
  Description of Artificial Sequence: Synthetic coding sequence
atggagccacggagtatggaatatttctgtgcacaagtgcagcagaaagacgtcggcggtcggctgcaggtgggtcaggagttactactatacttgggagcacctggggcaattagtgatctcgaagaggatcttgggagactgggcaaaactgtcgacgctcttactggatgggtcggaagttcaaactatcgcgtaagccttatgggcctggagattctttccgcctttgtggaccggctaagtacccgcttcaagagctatgttgctatggtaatagtggcactgatcgacaggatgggtgatgcaaaggataaagttagagacgaagcccagaccctaatactgaagctaatggatcaggtggctcctccaatgtacatctgggaacagctcgccagcggttttaaacacaagaattttagatccagagagggcgtgtgtctttgcctcatcgaaaccctgaacatctttggcgctcagccactcgtgatatctaaactgatcccccatctgtgcatcctgttcggagacagcaattctcaggtgagagatgcagcaattctagctatcgttgaaatctatcgccacgtgggagaaaaggtgcgcatggatctttataaaagaggcattccccctgcgaggctcgaaatgatttttgctaagttcgacgaagtgcagtcttccggcggaatgattctcagcgtatgcaaagacaagagcttcgatgacgaggaaagtgtggatgggaatcgcccatcaagcgccgcatctgccttcaaggtgcccgctcccaaaacgtctgggaatccagctaattcagcccgtaagccaggaagtgccggtggacctaaggtaggcggagcttccaaagaaggaggcgcaggtgctgtggacgaagacgactttattaaggcgtttactgatgtgccgtcgattcagatatatagctctcgggaactagaggaaacattaaataagatccgagagatactctcagacgacaaacacgactgggaccaacgtgcaaatgcactgaaaaagattaggagccttcttgtggcaggcgctgcacagtacgattgtttcttccagcacttgagattgttggacggcgctctgaaactgagtgctaaagatctgcgctcccaagtcgtgagggaggcctgcattaccgtcgctcatctgtcaaccgtgctgggaaacaagtttgaccatggagctgaggctatcgtgcccacattgtttaacttagtaccaaactcagctaaagtgatggctacttcagggtgcgccgcaattcgcttcattattcggcacacccatgtgcccaggcttatccctttgataacttcaaattgtacaagcaagtctgtgcccgtcaggcgacgtagtttcgagttcctagacctgctgctgcaggagtggcagacccattcccttgagcgacatgcagccgtgctggttgagaccattaaaaaaggcatacacgacgccgatgcagaagccagagtggaggccagaaaaacatacatggggctcagaaatcacttccctggcgaagctgagaccctgtacaacagccttgaaccttcttaccagaagtccctgcagacctatctaaaatcttccggcagcgtggcctccctgccccagtctgaccggtcatcaagctccagtcaggaaagccttaacagaccattttcgtctaaatggtccactgccaacccatctacagtggccggtagggtgtctgcaggatcatctaaagcctcctctctacccggtagcctccagagaagccgctcagacattgacgtgaacgccgcagccggtgcaaaagcccatcatgccgctggccagtccgtgcgctcagggagactgggcgcaggcgcactgaatgcgggatcctacgccagccttgaagacacgagcgacaaactggacgggactgcgtcggaagatggcagagtgagagctaagctctctgcccctttagcaggtatgggcaatgccaaagctgacagtaggggacggtcgcgaacaaaaatggtgtcacagagccagcctggctccaggtcagggtcaccgggacgtgtgctgactaccacggccctgagcaccgtcagctccggcgtgcagagggtccttgtaaacagcgcatccgcccagaagcgcagcaagatccctaggagccaaggctgttcgagagaagccagcccctcaaggctgagcgtagctcgaagttctcgcatacccagaccctcagtatcacaggggtgttcccgcgaggcaagcagggagtcctcccgagatacgtctcccgtgcggagcttccagccactgggacctggctacgggatatcacagagctcgaggttgagttctagcgtgagcgccatgagggttctgaataccggctccgatgtggaagaggcagtggctgacgccctgttactgggggatatccgcacaaagaagaaacccgctagacggcgatatgagtcatatggcatgcactccgatgatgacgccaattctgatgcttccagcgcctgctctgagaggtcttacagcagccgcaatgggtccataccaacatacatgcgacaaacagaggatgtagccgaagtcctgaacagatgtgccagttcaaattggtcagaacggaaggaaggcctactcgggttacagaacttgctaaaaaaccagcgaaccctcagtagagtagagttgaaacgcctttgtgagatttttacgaggatgttcgctgaccctcacggcaaagtgttttccatgtttcttgagactctggtggacttcatccaggtgcacaaggacgacctgcaagactggctttttgtcctgctgactcagctactgaaaaaaatgggcgctgacctgcttggctccgtgcaagccaaggtccagaaggcgctggacgtgacacgggaaagctttcctaacgacttacaattcaacatcctgatgcgcttcacagtcgatcaaacccagaccccaagcctcaaggttaaggtagcaattctgaagtatatcgaaacactggcaaagcagatggaccctggggactttatcaattctagtgaaacaaggctggcagtcagccgagtgataacatggactacagagccaaaatctagcgatgtacggaaggcagcgcagagcgtccttatttccctgtttgaattgaatacaccagaattcacaatgcttttaggggctctccctaagacattccaggacggcgctacaaagcttttgcacaatcacctccgcaatacaggtaatggtacccagtcctcaatgggctcgcctctcacaagaccgacacccagatcacccgctaactggtctagccccctgacctctccgacaaacactagccaaaacactttatcaccatccgctttcgattacgatacagaaaacatgaactccgaagatatttacagtagcctccgcggtgtcacggaggccattcagaatttttccttcaggtcacaggaagacatgaacgagcctcttaagcgagattccaagaaagatgacggagacagtatgtgtgggggtcctggaatgtctgacccccgagccggaggggatgccacagactcaagccagactgcccttgacaacaaggccagcctgctgcactccatgccgacacactctagccccagatctagagattataatccatacaactactcggacagcatcagtcctttcaacaaatcggccctcaaggaggccatgttcgatgatgacgctgaccaatttcctgatgatctgtccctcgatcatagcgatttagtggccgagctgctgaaagagctctcaaaccataacgagagagttgaggaacgcaagattgcactgtacgaactgatgaagctcacacaagaggagtccttcagcgtgtgggatgagcacttcaaaactatcctgctgcttctgctggagaccctcggagacaaagaacctactatccgggcactggcccttaaggtattgagggagatactcaggcaccagccagctagattcaaaaactatgccgagctaacagtaatgaaaacactggaggctcacaaagaccctcataaagaggtggtgcgaagcgccgaagaagccgcttctgtgctagccacatctatttcgccggagcagtgtatcaaggtgctgtgccccattatacaaaccgccgattacccaatcaatctcgccgcaattaagatgcaaactaaagtaatcgaacgtgtctccaaggagaccttaaacttgctgttacctgagattatgcctgggctgattcagggctatgataatagtgaaagctccgtgaggaaggcatgcgtgttttgtctggtggccgtacacgcagtgataggcgatgagctaaagccccacctttcccaactgacaggaagcaagatgaagctactgaacctgtacatcaagcgggcacagacaggctctggcggtgctgacccgactactgatgtgtccggccagtcctag

SEQ ID NO: 219988 - DNA, 4545 bp, Artificial Sequence
  Description of Artificial Sequence: Synthetic coding sequence
atggagcctagatccatggaatacttttgtgcccaggtgcaacaaaaggacgtgggcggtcgcctgcaggttggccaggagttgctcctatatctgggcgctcccggagcaatctccgacctcgaggaggacctcggtcggttaggaaaaaccgtagacgccctgaccggttgggttggctcctccaattatagggttagcttgatgggactagaaatcctgagcgccttcgtagaccggctgagcacacggtttaaatcctacgtggccatggtcatcgtggcactgatcgataggatgggagatgccaaggataaggtccgggacgaagcacagaccctgatcctgaagttaatggaccaggttgccccacccatgtatatttgggagcagcttgctagcgggttcaaacacaagaatttccgcagtcgagaaggcgtgtgtctatgccttattgaaaccctgaatatcttcggcgctcagcccttggtgatttcaaaactgataccacatttgtgcattcttttcggtgatagtaactcgcaagtgcgagacgctgccatcctcgccattgtagaaatctatcgtcacgtgggggaaaaagtgaggatggatctgtacaagagagggattcctcctgcacgactggagatgatctttgctaaattcgacgaagtgcagtcaagtgggggaatgatcctgtctgtgtgcaaggataagtcatttgacgacgaggagtctgttgacggtaaccggccttcgtccgccgcttcagcctttaaagtgccagcacctaaaacctctgggaacccagctaactccgccagaaagccgggaagtgccggaggacctaaggttggagccggtgcaagcaaagaaggcggtgccggagctgtcgatgaagacgactttattaaggcgttcactgatgtcccttctatccagatatatagctcccgcgagctagaggagacgctcaacaaaattagggagatcctgtcagacgataagcacgactgggatcagcgcgctaacgcgctgaaaaagataagaagtctgttggtcgcaggagctgctcagtatgactgtttttttcagcatctgaggctactggacggggctctgaagctgtccgctaaagatctacgctcgcaggtagtaagggaggcctgcatcacagtggcccacctctccacagtgctgggtaataagtttgatcatggcgctgaggccatcgttccaacactctttaatttggtaccgaactcggccaaggttatggctactagtggctgcgccgcaattagattcatcataagacacacacacgtgccgagactgatccccttaattacgtctaattgtacttcgaaatccgttcccgtgagaaggaggagcttcgaattcctggacctcctactgcaggaatggcagacacactcgttagagcgtcatgctgcagttctggtggaaactatcaagaaaggaattcacgatgccgatgccgaggctagagtagaagcaaggaagacatacatggggctgcgcaaccactttccgggtgaagctgagacactttataattcgctggaacccagttatcaaaagagcctgcagacttaccttaaatcttctggctctgtggctagcctgccacagagcgaccgttccagctcttcctcacaggaaagtcttaaccgccctttcagcagcaagtggtctacagcaaacccaagcaccgtggctggaagagtttccgccggatcctctaaagccagctcccttccagggtccctacagagatcacgcagcgacatcgatgtgaacgcagctgcgggtgccaaagctcaccatgcagcaggtcaatccgtgagaagtgggcgtctgggggctggcgctctgaacgcaggctcctacgctagtttagaggacacttctgataagctcgacggcacagcctccgaagatggcagggttcgggctaagctctccgcgccattagcgggaatgggtaacgcaaaggccgattctagaggacgctctaggactaagatggtgagccaaagccagcctgggagccgatccgggagtccaggtcgggtactgacgacaacggcattatccacagtgtcctctggcgtgcaaagggtgctggtgaacagcgcctcagcacagaaaagatccaagattcccaggtcacagggctgctccagggaagcgagtccctcccgcttatctgtggcacgttcatcccgcatcccgaggccatcggtgtcccaggggtgcagccgggaggcctcccgagagagtagtagggatacctctccggtacggtccttccagccactggggcctggctacggtatctctcagtcaagcagattgtcttcttccgttagtgcaatgagagttttgaacacaggctccgatgtggaagaagccgtggcagatgccctccttctgggggacattcgcaccaagaagaagccagctagaagacgctacgagagttacgggatgcacagtgacgatgacgccaacagtgatgcatcatcagcatgcagtgaaaggtcctacagctccagaaacggttctattccgacttatatgaggcagaccgaggacgtggctgaggtcctgaatagatgtgcctcctcaaattggagcgagcgcaaggaaggcctgctggggttgcagaacctgctgaagaatcaacgaaccctgtcccgggtcgagctgaagcggctgtgcgaaatttttacacggatgttcgccgacccacacggtaaggtcttctccatgttcctggaaaccctggtggattttatccaggtgcataaagatgatcttcaggactggttgtttgttctgctcactcagcttctgaaaaagatgggggcagacctcctcggaagtgtccaggcgaaggtgcaaaaagctctggatgtgacgcgagagtcgtttcctaatgacctccagtttaacatccttatgaggtttactgtagaccagacacaaacgccttcgctgaaggtcaaggtggccatcctcaagtacattgaaaccctggccaaacagatggatcccggagattttatcaattcgtccgaaactcgactggccgtttcaagagtgatcacgtggactacagaaccaaagtcatccgatgtgcggaaggctgcccagagcgttctgatttccctatttgaactgaacaccccagagttcaccatgctcctcggcgctctgccaaaaacgttccaggacggggcaacaaaattacttcacaatcacctgcgcaacaccggaaatggcactcagtcttccatgggcagtcctcttactcgaccaacacctaggtcgcctgcaaactggtctagtccactcacttctcccactaatactagccagaataccttgagcccttccgcctttgactacgacactgagaacatgaattctgaagacatttattcttctctcaggggtgtcacagaggccatccagaatttcagttttcggtcccaggaagacatgaatgagcccctgaagagggactccaaaaaggatgatggcgattccatgtgcggtggtcctggcatgtctgaccctcgagcgggtggcgatgcaaccgactctagccagactgcgctggacaataaggcctcacttttacactcaatgcctactcatagctccccgagatcacgcgattataatccgtataattatagcgacagcatctcaccattcaataaatccgcccttaaggaggctatgttcgacgatgatgccgaccagtttcccgacgatctgagcctggatcactctgacctggtggccgagctcctgaaggagctgtctaatcacaatgaacgagtggaagagcgcaaaattgcactctacgagctcatgaagctgacacaggaggagtctttcagtgtgtgggacgagcatttcaaaacgattctgttgctgctgttggagactcttggcgacaaagagcctaccatccgagcgctggcgctcaaggttctgcgtgagatccttcgacatcagcctgctcggttcaaaaactacgcagaacttaccgttatgaagactcttgaggcgcataaggatccccacaaggaggtggtacggagcgccgaggaagccgctagtgtgctagccacctccattagccctgagcagtgtattaaggtactttgtccgatcatccaaaccgcagactacccaatcaacttagcagccattaaaatgcagaccaaggtgatagaaagggtctccaaagagactctgaacttactgctgcccgagataatgccgggacttattcagggatatgacaactcagagtcgtctgtgcggaaagcctgtgttttctgtcttgtcgctgtacacgctgtaatcggggacgagctgaagcctcatttgtctcaactcaccggatctaaaatgaaacttttaaatctttatataaaaagggcccaaactgggagtggcggagccgaccctacaaccgacgtgtcagggcaaagttag

SEQ ID NO: 219989 - DNA, 3882 bp, Artificial Sequence
  Description of Artificial Sequence: Synthetic coding sequence
atggctatgggtgatgataaatcattcgatgacgaagaatctgttgacggaaacagaccttcctcggctgcaagtgcctttaaagtgcctgcacccaagaccagtggtaaccctgccaatagtgcacgtaaacccggaagtgccggtggccctaaagttggcggtgccagcaaagaaggaggcgcaggcgcagtggacgaggacgatttcattaaagcgtttactgacgttccgtctattcagatttatagtagccgcgaacttgaggaaaccctcaacaagattagagagattctgtcagatgataaacacgattgggaccagcgcgctaacgccctcaaaaaaattcggagtctgctcgtggccggagcggctcagtacgattgcttcttccagcacttacggttgctagacggcgcactgaagctcagcgctaaggaccttcgctcccaagtcgtacgtgaagcctgcatcacggtggcacacctgtctacagtgcttgggaataagtttgaccatggtgctgaggctattgtccccactctctttaaccttgtgcccaacagtgccaaagtgatggctacgtcaggctgcgctgcgattcgcttcattatccgacatacacatgttcccaggctgataccccttatcacctccaactgtacatccaagtctgttcccgtcagacgcaggagttttgaattcttagacctgttgttgcaagagtggcagacacactccctggaaaggcacgcggctgtcctggtggagactattaagaaaggcatccacgatgccgatgcggaggcccgtgtcgaagccagaaagacatacatggggctgagaaaccattttcctggagaagcagaaaccttatacaactcattggagccaagttatcagaagagtcttcagacttacctcaaatctagcggttccgtcgccagtctaccacagagcgaccgtagtagttccagctctcaggagtccttgaacagacccttctccagcaaatggtccactgccaacccctccactgtcgcgggacgggttagtgctggctccagcaaggccagttctctaccagggtctcttcagcgctcaaggtctgacattgatgtcaatgcagcggcaggggctaaagcccaccacgcagccggacaatcggtcagatcgggccgactcggtgccggagccctgaacgcgggtagctatgcaagcctggaagacactagcgataaacttgatggtactgcatctgaagatgggagggtgcgggcaaaattgtcagctcctctggccggtatgggtaacgcgaaggctgattcaagaggcagatctcgaaccaaaatggttagccaatctcagccgggtagccgatccggaagtcccggacgcgtcctaacgactaccgctctctctaccgtttcttccggggtgcaaagagtgttagtgaactccgcttccgcccaaaagaggagtaaaataccaaggagtcaaggctgttctagagaagcctcccctagtagactatcagttgcacggtctagtcgcatccccagaccctccgtgtcccagggctgctctcgcgaagctagtagggaaagttcgcgcgatacatcccccgtccggtcatttcagccgttggccagtcgccaccacagcaggagtaccggtgcgctctacgctccggaggtatacggagccagcggccctgggtacgggatcagccagtcttcgagattgtctagttctgtatccgccatgcgcgtgctgaataccggctctgacgtggaggaggccgtggccgacgccctgaagaagcccgcacgcaggaggtacgagagctatggtatgcactcagatgatgatgccaattcggacgctagttcggcgtgctcagaacgttcctacagctcacgcaacggctccatccctacttatatgcgccaaacagaggacgtggcagaggtgttaaatcggtgcgctagctctaattggtccgaaagaaaagagggattgctgggtctacagaatctgctgaaaaaccagaggacgctcagtcgggtggagctcaagcgactgtgtgaaatcttcacgcggatgttcgccgacccccacggcaaggttttttccatgttcctggagacattggtcgatttcatccaagtgcacaaggacgacctccaagactggctgtttgtcctcctgacccagctgttgaagaagatgggggcagatctgctgggaagtgttcaggctaaagtccagaaagccctggatgtcacccgcgagagtttccctaacgacctccagttcaacatcctaatgcggtttaccgtggaccaaacgcagacccccagcctgaaagttaaggtggctattttgaagtacattgaaacattggctaaacaaatggaccccggagattttataaattcaagtgaaacacgcttagctgtcagccgtgtgattacatggaccactgagcctaagtcaagtgatgtacgaaaagccgctcaatccgtgctgatttcgctgtttgagttgaacaccccagaattcaccatgctgttgggggcacttcccaagacgttccaggacggtgccacaaagctcctacataaccatctgaggaataccggaaatggcactcagtcgtccatgggcagtccacttactaggcccacgcccagaagtccggcaaactggtcatcaccactgacttcgcctacaaatacgtcccagaacaccctatccccttccgccttcgactatgacaccgagaatatgaacagcgaggatatttattcctcactgaggggtgtgactgaagcaattcagaatttttccttcaggagccaggaagacatgaacgagcctctgaaaagggattcgaagaaagacgatggggactcaatgtgcgggggtccaggcatgagcgacccgagagctggtggggatgccacggactcatctcagactgctttagataacaaagctagtctccttcactcaatgccaacacatagctctccccgatctcgggattacaacccatataactattccgattctataagtccgttcaataaaagcgcactcaaggaggccatgtttgatgacgatgccgatcagttccctgacgatttaagcttggatcacagcgacctggtggcagagctattgaaagagctcagtaatcataatgaacgggtggaggagcgtaagattgctctctacgagctgatgaaactgacacaggaggagtcattttccgtgtgggatgagcacttcaaaaccatcttgctgctcttactagagaccctgggggataaagagccgactatcagggccctggctctgaaggtgctccgcgaaatactccggcatcaacccgctcgctttaaaaactacgccgagctgacagtcatgaagacactggaggcacacaaggacccccacaaagaggtggttagatctgccgaagaggctgcttccgtcctcgcgacctcaatttctccagaacagtgcatcaaggtcctgtgtcccatcatccagaccgcagactaccctataaatctggcagctatcaagatgcagaccaaagtcattgaacgcgtttccaaagagacacttaacctgctcctgcctgagattatgcccggactgattcaaggctacgataactccgaatctagcgttaggaaagcctgcgtgttttgccttgtggctgtacacgctgtcatcggcgatgagctgaagccacacctatcacagttgacagggtccaaaatgaaattgctcaacctatacatcaaaagggcccaaacagggtctggcggtgcggatccaacaactgatgtcagtggccaatcttag

SEQ ID NO: 219990 - DNA, 3192 bp, Artificial Sequence
  Description of Artificial Sequence: Synthetic coding sequence
atgagacgtctgatctgcaagcgaatttgcgattacaagagttttgatgacgaggagtccgttgacgggaatcgaccaagtagcgccgcaagcgccttcaaggttcccgcaccaaaaaccagcggcaacccagctaacagcgcgaggaagcctgggtccgccggagggcctaaggtaggtgagcttttatcgatcatgatttacagctcaagggagctggaggagactttgaacaagatcagagaaatcctgagcgatgacaagcacgactgggatcaacgcgcaaatgcattgaagaagattcgaagccttcttgtggctggcgcagctcaatatgactgcttttttcaacatctccggctcttagatggtgcattgaaactcagcgctaaagaccttagatctcaggtcgtccgcgaggcctgtattacagtagcgcatctgagtacagtattgggaaacaaatttgatcacggagccgaagcgatcgtaccaacgctgttcaacttggtccccaattcagcgaaggtgatggccacctccggctgcgctgccataagattcataatccgccacacccatgtgccaagattaattccactgatcaccagcaactgtacctccaagtccgtccccgtgagaaggagatcgtttgagtttcttgatcttctgttgcaggaatggcagacacactccctggagagacacgccgcagtgctagtggaaaccataaagaagggcatccacgatgccgacgcagaggccagggtggaagctagaaaaacatatatgggcctacgaaaccacttccctggggaggccgaaacgctatacaactctctggagccctcataccagaaatcactgcagacatatctcaagagtagcggaagcgttgcgagtttgccccagtccgatcgcagttcgagctcctctcaggagtctctgaaccgcccattcagtagtaagtggagtacagcaaaccctagcaccgtggcagggagagtgtccgccggatcttctaaggcctcgtccctaccagggagtctgcagaggagcaggtctgacattgacgtaaacgcagcagctggcgcaaaggcccatcatgcagcaggacagtccgttcgctccggcagactaggcgctggcgctctcaatgccggtagctacgcatctcttgaagacactagcgataagctggacgacctgttctcagacaacgggagggtacgagccaaactgtcggccccactagccggtatggggaatgccaaagccgattctcgtgggagaagtcgcaccaaaatggtgagccaatcgcagcgctccagtagccctgataagaatgaggggagccaatctgctaatactatcggcgcaggaagtaggtccggctccccgggtcgggtgctcaccactacggccctgtcgacggtgtcttccggagtgcagcgcgtgttggttaactccgcttccgcccagaaacggagtaagatcccccgttcccagggatgtagcagggaagcctcaccctcccggttgtcagttgctaggagcagtcgcatacctcggccatctgtgagtcaggggtgcagcagagaggcttctagagagagcagcagagatactagtccggttcgctcgtttcaacccttagggcctggatatggaatttcccagtcatccagactatccagtagtgtgagcgctatgagagttttgaacaccgggagcgatgttgaagaggcggttgccgacgctctggtcctcttcgactttaaaaccaaaaaaaaaccagctaggcgtcgttacgagtcctatggcatgcactcagatgatgatgcaaatagtgacgcatcctctgcctgctcggagcgttcttattcctcacggaatggttcaatcccaacatacatgcgacagacagaagatgtagccgaggtcctgaatagatgcgcatccagtaattggtctgagcggaaagagggcctgttgggactccaaaacctgttaaagaaccagaggacactttcacgcgttgagttgaagaggttgtgtgagatcttcacaaggatgttcgctgaccctcatgggaaagttttctctatgtttcttgaaactttggttgatttcattcaagttcacaaggacgacctgcaagactggcttttcgtactgctaacacaactgctcaagaagatgggagctgatttactgggatccgtacaagcgaaagtgcaaaaagctctggatgtaactagagagagctttcccaacgatctgcaatttaatattcttatgcggttcactgttgaccagacccagactccatcactgaaagtgaaagtggccatactgaagtacattgagaccctggctaagcagatggaccccggtgatttcatcaactcttctgaaacccgcctggctgtatctagagtgatcacctggacaaccgagcctaaatccagtgacgtgaggaaagcagcccagagtgttctgatctcactgttcgagctgaacactcctgagtttactatgcttttgggtgccctgccaaagactttccaagatggcgcaactaagcttctccataaccatctgcggaataccggaaacggcacgcagtctagtatgggctctcctttaaccaggcctacacctaggtcccctgctaactggtctagccctctgacttctcctacaaatacttcccaaaataccctctcccctagtgcctttgactacgatacagaaaatatgaactccgaagacatttactcctcattacggggagtcacagaggctatccagaactttagcttccgatcccaggaggatatgaacgagccccttaagagagactcaaagaaagatgatggcgattcaatgtgcggcggacccggaatgtctgatccacgtgccggaggtgacgctacggactcgtcgcagactgctctggacaacaaggcctctttgctgcactcaatgcccactcactcctcacctagaagccgcgactacaacccttacaattactctgacagcatttccccattcaataaatccgccctgaaggaagccatgtttgacgatgacgccgatcaattccccgatgacctgtcccttgaccactcagatcttgtggccgaactgctgaaggagcttagcaaccataatgagagggtgtag

SEQ ID NO: 219991 - DNA, 1680 bp, Artificial Sequence
  Description of Artificial Sequence: Synthetic coding sequence
atgccaccgccttcccccgactcggaaaatggcttttaccccggactgccttcttccatgaacccagcattctttcctagttttagcccggtgtctcctcatggatgcaccggcctgagcgtccccactagcggcggaggaggcggtggctttgggggaccgttttccgcaactgccgtgcccccacctcctccccctgctatgaatattccacagcagcaaccccctcctcctgccgcaccacagcaaccgcaatctagaagatccccggtgagtccgcagctccagcaacagcatcaggcagctgctgccgctttcctgcagcagaggaatagttacaaccaccaccagcccctgcttaagcagtccccgtggagtaaccaccagtcctccgggtgggggacaggatccatgtcctggggggctatgcacggacgcgatcacagaagaactgggaacatggggatccctggcactatgaatcaaatcagcccgcttaaaaagcccttctctggcaacgtcatcgcgccacccaaatttactcgcagtaccccctcgttgactccaaagtcctggattgaggacaacgtgttccgcaccgataacaattctaatactctgctgccccttcaagatcgcagtaggatgtatgattccctgaatatgcacagcctcgaaaactccctgatagatattatgagagcagaacacgatccactcaaaggaagactgtcctatccacaccccggaacagataacttactgatgttaaacgggagatcaagtctgttcccaattgatgacggtctgctggacgatgggcacagcgaccaggtgggcgttctgaactcacctacatgctactcagcccatcagaacggagagcgtatcgagagattcagcagaaaagtttttgtgggaggcctgcctccagacatcgacgaagacgaaatcacggcgagctttcggaggttcggcccactggtcgtggactggccccataaagccgagagcaagtcctactttccccctaaggggtacgcgtttctgctgtttcaggaggagtccagcgtgcaggcgttgatcgatgcctgcattgaagaagatgggaagctatatctttgtgtgagcagcccaaccatcaaagacaagcctgtgcagatccgaccttggaatctcagcgactccgattttgtcatggacgggagtcagcctcttgaccccaggaagacaatttttgtgggcggagtgccacgccctctgagagccgtagagctagccatgatcatggataggttatatggtggcgtctgctacgcaggaattgacacagaccctgagctgaaatatcccaaaggcgctggcagggtggccttcagtaatcagcagagctacatcgccgcaatctctgcgaggttcgtccagctacagcatggcgacattgacaagcgcgtggaagtgaaaccatacgtcctagacgatcagatgtgcgatgagtgccagggcgctcgctgtggcggtaagttcgccccatttttttgtgccaatgtaacctgcctgcagtattattgtgaattctgctgggccaatatccattccagagccggtcgggagtttcataagccactggttaaagaaggcgcagacagaccgcgtcagatccacttccggtggaactag

SEQ ID NO: 219992 - DNA, 1731 bp, Artificial Sequence
  Description of Artificial Sequence: Synthetic coding sequence
atgccacccccaagtcctgattccgagaatggattttaccccggtctcccatcttcaatgaatccagctttcttcccctccttctcccccgtaagtcctcacggttgtacaggtttgagtgtgccaccgccacccgctatgaacatccctcaacaacagcccccaccaccggctgctcctcaacagcctcaatcacgcagatctcccgtttcaccccagctgcaacagcagcaccaggccgcagccgcagcatttctacaacagagaaactcttacaaccatcatcaaccgttactgaagcaatctccttggtcaaaccatcagtcctctggatggggtacgggaagcatgtcatggggggcaatgcatggcagagatcacagacgcacagggaacatgggcatcccgggaaccatgaaccagatcagtccacttaagaaacccttctccggcaatgtgatagcaccccctaaatttacacgcagcacgccatctcttactccaaaatcgtggatcgaggacaacgtgttccggactgacaacaatagtaatactttactgccactccaggtgaggtcttctctgcagctaccagcctggggtagtgactctttgcaagattcctggtgtacagctgctggaacttcaaggattgatcaagaccgctcgcgcatgtatgattcccttaatatgcattccctggaaaatagtctgatcgacattatgcgcgcagaacatgatccacttaagggtagactctcctatcctcatcccggtaccgacaacctcctcatgttaaacgcaaggtcatatgggcgacgcagaggccgatcatctctcttcccaatagacgatggactgctggatgacggccactctgaccaagtaggagtgcttaactccccaacttgctactcggcgcaccagaatggagaacggatagagaggttcagtcggaaagtgtttgtcggcggtctgccacctgatatcgatgaggatgagatcactgcatctttccgtcgctttggccctctggtggtagattggccccataaagctgagtctaagtcctacttccctcccaagggatatgctttcctgctgttccaggaagagagcagcgtgcaggctttgatcgatgcctgtatagaggaagatggaaagttgtacctgtgtgtgagctccccgactattaaggacaagcccgtccagattcgtccctggaacctgtcggactctgactttgtcatggacggctctcagcccttggatccaaggaagaccatctttgtggggggtgtgcctcggccactgagagctgtagagctggcaatgattatggatcggctgtatggcggtgtgtgctatgctggcattgacacggatccggagttaaagtaccctaaaggggctggacgcgttgcgttttctaatcagcaaagctacatcgccgctattagtgccaggttcgtgcaactgcagcacggtgatattgataaacgtgtggaggttaagccttatgtgctggacgaccaaatgtgtgatgagtgccaaggggcacgctgcggtggcaaatttgcccctttcttttgcgctaacgtgacatgcctacagtattactgtgagttttgctgggctaacatccatagtcgcgctggccgagaatttcataagcccctggtcaaggagggcgctgatcggcctcgacaaattcacttccgttggaactag

SEQ ID NO: 219993 - DNA, 1704 bp, Artificial Sequence
  Description of Artificial Sequence: Synthetic coding sequence
atgcccccacctagcccagattccgagaatggattctatcccggactcccctcctccatgaacccagctttctttccttcctttagccctgttagcccccatggctgcacagggttgtccgtccccacttcggggggtggtggcggagggtttggcggaccatttagtgccacagccgtgccaccgcctccacctcccgcaatgaacatcccccagcagcagccaccaccccctgccgcaccgcaacagccgcagagtcggaggagccctgtgtcgccccagctgcagcagcagcatcaggctgcggcagctgcattcctgcaacaaaggaactcctataaccaccatcaaccgctgctgaagcagagcccatggagtaatcaccagtcttcggggtggggtaccggatctatgagctggggtgctatgcatgggagggaccatcgcaggacgggcaacatggggattccaggaactatgaaccagatttcgcctctgaaaaagccattttctggcaatgtgattgcacctcctaaattcactcgctcaacccctagccttacccctaaatcatggatcgaggataacgtcttcagaaccgataacaactctaacactcttctgccgttgcaggaccggagccgcatgtatgacagcctaaacatgcactccctggagaattccctgatcgatattatgcgcgctgaacacgatccactaaaaggacgcctgagttatccacacccaggtaccgacaatcttctaatgttaaacgcgcgaagctacggtcgaagaaggggcaggtcttccctcttccccatcgatgacggcttattggatgatggccatagcgatcaggtaggagtgttgaacagccctacctgctactcagctcatcagaacggagagaggatcgaaaggttttcaaggaaagtgttcgttgggggattaccacctgatattgatgaggacgaaatcactgcatcattccggagattcggccctctggtcgttgactggcctcataaggccgaatctaaatcttatttccccccaaaggggtacgcttttttgctctttcaggaggagtcttctgtgcaggcccttatagatgcttgcatcgaagaggatggaaaactgtatctgtgtgtgtctagcccaaccatcaaagacaaacccgttcaaattcgtccctggaatcttagtgactctgacttcgttatggatggaagccagccgctggaccctcggaagactatctttgtcggcggagtgcctagacccctgcgcgctgttgaacttgcaatgattatggatcggctgtacggcggagtttgttatgccggtattgataccgaccccgagctcaagtatcctaagggtgcgggaagagttgccttcagtaatcagcagtcctacattgccgctataagcgcacggtttgtgcagcttcagcatggcgacatagacaagagagtggaggtgaaaccttacgtgctggacgatcagatgtgtgatgaatgccaaggtgcacgctgcggcggtaaatttgccccattcttttgtgccaatgtcacctgtctgcagtactactgtgaattctgttgggccaacatccatagtcgagcaggacgtgagttccacaagcccttggtcaaggaaggagcagaccgcccaagacagattcactttcggtggaattag

SEQ ID NO: 219994 - DNA, 1689 bp, Artificial Sequence
  Description of Artificial Sequence: Synthetic coding sequence
atgcccccaccaagccccgacagtgagaacggcttctatccaggactaccttcctccatgaacccggcatttttccccagctttagcccagtatctccacatgggtgtacaggtctgtcagtgcctacctcgggaggcggtggcggaggatttggcggaccattttccgcaacagcagtgcccccacctccacccccagcaatgaacatcccacagcaacaacctcctccccctgccgctccccaacaaccccagagccgacggtcaccagtgtcccctcagctgcagcagcaacaccaggccgcagcagccgcatttctacaacagcgcaacagttacaatcatcaccaaccactcctgaaacagagcccatggagcaatcaccaatcatctggatggggcactggaagtatgagttggggggctatgcacggccgtgaccatcgtcggacaggtaatatgggaatacccggtactatgaaccagatctcgccattgaaaaaaccctttagtggaaacgtcattgctccccctaagtttacacgtagcacccccagcttaaccccaaagagctggattgaagacaacgttttccgtaccgataataactctaacactttgttacccttgcaggtgcggatggatagatcacggatgtacgactccctgaatatgcattccttggagaatagtctgatcgatattatgagagctgaacatgaccctctgaaaggtagactatcctacccccaccctggcaccgataacctgctgatgctgaacggccgatcgagtctctttcctatagatgatggacttcttgacgacggccattctgaccaagtcggcgtcttaaactccccaacgtgttacagtgctcaccagaacggagagaggatcgaacgcttctcacgtaaggtgtttgtgggcggactcccccctgatattgacgaggacgaaatcacagcttccttccgacgcttcggcccactggttgtcgattggccccacaaagccgagtcaaagagttacttcccccctaaaggatatgccttcctcctgttccaagaggaaagctctgtgcaggctctcatagatgcgtgtatcgaagaagacgggaagttgtacttgtgtgtctcttctcctacaataaaggacaaaccggtgcagatacggccatggaacctgtcagactccgattttgtgatggacgggtctcagccactggaccctagaaagacaatttttgtgggcggagtccctcggccactgagggctgtggagctggcaatgatcatggacagattgtatggaggcgtgtgttacgccggtatagatacggatcctgaactcaagtacccaaagggggctggacgggtcgcattttcaaaccaacagagctacatagccgctatcagtgctagatttgtgcagctgcagcacggcgatattgacaaacgcgtggaggtaaagccttacgttctcgatgaccagatgtgtgacgagtgtcaaggtgccaggtgtggcggtaagtttgccccattcttttgtgcaaacgtgacctgtttacagtactactgtgaattttgctgggcaaatatccatagccgagctggccgagagtttcataaaccactggtcaaggaaggcgcagataggcccaggcaaatccactttcgatggaattag

SEQ ID NO: 219995 - DNA, 3024 bp, Artificial Sequence
  Description of Artificial Sequence: Synthetic coding sequence
atgcgggactttggcttcggcgtcctccagacggctccactaagatcatctagtcccggacctctgttctgcggcgaggcctatggcccttatgctgtgggctccgttaatccgctgccatctgctaccccctttggcccactgtcccccccaccactccctgtcacaggctttcttgaggcagcctcacccttctctgttccactggggggaggggctggctctccagcagctgctgccagttcatccagcccgttcctggcgcaccagcagactatgcaagacgagctgctgctgggtctcacacagcaacccgcacgtcccctttctggggctgcagcgactgagaagcttccagatcaccatcctggtggaggtactatcgctggggttactcacttgctccccagtcaggatttcaagccaagcctccaccatcccagcagcagtagcgctagttcttgttgttgctgtcggacatcctctccccaggatttcagcaagagacaacaacagcagttaagtagtcagaagcggaaagaattctctcctccacatctgccccatcctccggatagcaagccacccccaccaccccctcccctgcattgtccgggacggttctctccaccaccaccgcctgctgggccactccttcaacccgctcagctggcccagaggcagcagcagcagcctccgcagcagtttagtcttctccatcaacaacacctgagtccccaggactttgccccaagacagcgccctgccgatttacctcccctgccacaactgccaccaagccccccagctgctcctagacggcgacacggaggagctggctcgcccaggaaaactcctgccgcaggtgaaggcagcgccgcagagtcccctaatgccggtctggccagctctacccctgtgaaccccgcacccggttccatggagagccccaatcatcccttattgaactctcctagcaatctcttaccaggcggagccttgggagccggagccttcagttccttacagtcccctgacctgcctcacccaggaggcggtggagggggaggaggcggtggtccccctggtggcggtggagggggtggcagcgcctcaccgccaccgttgcccggattcggaacaccgtggtcggtgcagactgctagtccacctcctcaaccccagcaaccccctccgactcagccccagcagcaaccaccaccgcctcagcagcctccacagcctcaaccccaaccgccaggttccagcgctactacccctggaggcggatcaggtgggtccttgagtgccatgccacccccatcccccgattctgagaatggattttaccctggtcttccaagctcgatgaacccggctttttttccatctttctcgcctgttagccctcacggctgcactgggctctcagtaccaactagtggcggtgggggaggcggattcggcggaccgttttccgcaacagcagtgcctccacccccaccacccgctatgaacatcccccagcagcagcctccacccccagcagccccacagcaacctcagagtcgacgatctccagtaagtccccagttgcaacaacagcaccaggctgccgcagcagctttcctgcagcagagaaatagctataatcatcatcagcccctgctgaaacagtcaccctggtctaatcaccagtcttcgggttgggggaccggcagcatgtcttggggagcaatgcatggccgagaccacaggcgaacagggaacatgggaattccagggacaatgaaccagatttctcccctgaaaaagccattttcaggcaatgtgatagccccacctaagttcacgagaagcaccccctcgctcacaccaaagagttggatcgaggataacgtgttccgaactgacaataattcaaatactctgctgcctttgcaggtcagaatggatcggtctcgcatgtacgattcgcttaacatgcacagtctggaaaattccttaattgatataatgagggcagagcacgatcctctgaagggtcgcctcagttacccccaccctgggacagacaatttgttaatgttgaacgcgcgttcctatggaagacgcagaggccgatcatcattatttccgatcgacgatggccttctggacgacggccactcagaccaggtgggagtactcaacagtcctacctgttactcagcccatcaaaacggcgaacggatcgaaagattctctaggaaggtgttcgtggggggactgcctcccgatatcgacgaggatgaaattaccgcctctttccgaagatttggccctctcgtcgtagattggcctcacaaggccgaaagtaaatcatattttccccctaagggatacgccttcttgcttttccaagaagaatccagcgtccaagctcttatcgacgcctgtatagaggaggacggaaagttgtacctttgcgtgtcatcccccaccatcaaggataagccagttcagattcggccatggaaccttagcgattccgactttgttatggacggatcacagcctctggacccgagaaagaccatatttgttggaggagtgcccaggccactgcgcgctgttgagctcgcgatgattatggataggctatatggaggagtttgctacgccggaatagacactgacccggagctgaagtatccaaaaggtgccggtcgggtcgcctttagtaaccagcagagctatatcgccgctatttcagcgcgtttcgttcagctacagcacggtgatattgacaaacgggtggaagtaaagccgtacgtattagatgatcagatgtgtgatgagtgccaaggagccaggtgcggcggtaaatttgccccttttttttgcgctaacgtaacgtgcctacagtattactgtgaattctgttgggcaaatatccattcgcgcgcaggacgggaatttcataaacccttggtgaaagaaggcgctgacaggcccagacagattcattttagatggaactag

SEQ ID NO: 219996 - DNA, 1770 bp, Artificial Sequence
  Description of Artificial Sequence: Synthetic coding sequence
atgccacctccatcaccggactcagaaaatgggttctacccaggccttccttcaagcatgaatcccgctttcttcccaagcttcagccctgtgagtccacatgggtgtaccggattaagcgtccctaccagcgggggaggagggggtgggttcggaggccctttcagtgctaccgccgtccccccacctccccctccagctatgaatatccctcagcagcagccaccaccacctgcggctccccagcagccccagagcagacggtcaccggtcagcccccagctacagcagcagcatcaagctgcggcagccgctttcttacagcagagaaactcctataaccatcaccagcctctgcttaaacagagtccatggagcaaccatcagagctctggttggggcacaggctctatgagctggggcgcaatgcatggaagagaccataggagaacaggtaatatggggatccctggcactatgaaccagatcagccctctgaaaaaaccctttagtgggaacgtgattgcacctccaaagttcactcggagcacaccatctttgactcccaaaagctggattgaagataacgtgtttcggactgacaataactctaacacgctgctcccactccaggtacgctctagcctgcaactacctgcctgggggagcgatagtctgcaggacagttggtgtacagccgctggcaccagcagaatcgatcaggacaggtcaagaatgtatgacagcctgaatatgcactccctagaaaactctctgattgatatcatgcgagctgagcatgatcccttgaaaggaaggctaagttatcctcacccaggaacggataatcttctaatgctcaatggcagatcaagtttgtttcctatagatgacggcttgctggatgacggtcattcagaccaggtcggggtcttaaattcccctacttgttattctgcgcatcagaacggggagagaattgaaaggtttagtcgcaaagtgttcgtcgggggtctaccaccagatatcgatgaagacgaaataacagctagcttcagacggtttggcccactagtggttgattggccgcataaagcggagagtaagtcctatttccctccgaagggctatgcttttcttctcttccaggaggaaagctctgtccaggcactgatcgacgcctgtattgaggaagacggaaagttatatttgtgtgtcagctcacccactatcaaggacaaacccgtgcaaatcagaccctggaacctgtcagatagcgattttgtcatggacggcagccagcctctagatccaaggaagacaatatttgtcggtggggtgcctagaccactccgggctgtggaactcgctatgataatggatcgactgtacggcggagtgtgctatgccggaattgataccgatcccgagctgaaatacccaaaaggtgcaggcagagtggctttttctaatcaacagtcctacatcgcagcgattagtgctaggttcgtgcagctgcagcatggcgatatcgataaaagagtcgaagttaagccatacgtcttggatgaccagatgtgcgatgagtgccagggagctcgttgcggaggtaaattcgcacccttcttctgtgcaaatgttacatgtctgcagtactactgtgagttttgctgggcaaacatccattcccgcgcaggacgcgaatttcataaaccccttgtcaaggagggcgctgacagacccaggcagatacactttcgatggaactag

SEQ ID NO: 219997 - DNA, 3105 bp, Artificial Sequence
  Description of Artificial Sequence: Synthetic coding sequence
atgagagacttcggctttggagtgctgcaaacagcgcctttaaggagtagctcacctggccctctgttttgtggcgaagcttatggcccttatgctgtggggagtgttaatcctcttccatccgccacgccctttggaccacttagcccaccccctctgccagtcaccggttttcttgaggctgcatcaccatttagcgtacctttgggcggaggggctggaagtcccgcagccgcagcgtccagcagttctccatttcttgctcaccagcaaaccatgcaggatgaattgcttctagggctcacacagcagcctgcccgtcctcttagcggggcagctgcaacagagaagttgccggatcatcatcccggtgggggaacaattgcaggcgttacccatctactgccaagccaggattttaagcctagcttacaccatccctcttcctcctccgcttcatcttgttgttgttgccgcacgtcttcccctcaggatttcagcaaaagacagcagcagcaactgagctcccagaagcgcaaagagttcagccctcctcatttgccccacccacctgactccaaacctcctccgcctccccctcctttgcattgccccggtcggtttagcccaccacccccacctgccggtccactgctacagcccgcacagctggcccagaggcagcagcaacaaccgcctcagcaattttccttactgcatcagcaacacctcagcccccaggacttcgcacccagacagagacccgctgatctccccccactcccacagctgccaccgtctccccctgcagcccctcgaaggagacatggcggagcgggaagccccagaaagacccccgctgcaggcgaaggtagcgcggctgagtcaccaaacgccggtctcgcttcctctacgccggtgaatcccgctcctggatcgatggaatcacccaaccatccactgctaaatagtccttcgaacttgttacccggaggagctctgggagccggagcgttctcttccctccagtctcctgacctgccccacccaggtggtggaggcggaggaggaggaggcggtcccccaggaggagggggtggcggaggaagtgccagtcctcccccattgcctggatttggcacaccgtggagcgttcagacggcgtccccgccaccccagccccagcaacccccacccactcagccacagcagcagcctcccccaccccagcagcccccacagcctcagcctcagccgcctggatcatccgctacaacacctggtgggggttccggcggttctctgagcgctatgccacccccatctccggatagcgagaacggcttttacccgggtctcccatctagcatgaatccagccttctttcctagcttctctcctgtctcccctcacggttgtacaggcttgtcagttcctacctctgggggaggtggcggagggtttggaggaccatttagcgccaccgccgtgccccctccacccccacctgctatgaatatcccacagcagcagccacctccgccagccgcaccgcagcagccccaatctcggagatcacccgtctcacctcaactacagcagcaacatcaggcagccgctgctgccttcctgcagcagaggaatagctacaatcatcaccagcccctccttaaacaatccccttggagcaatcatcagtcctctggctggggcaccggatcgatgtcttggggggctatgcatgggagggatcacaggcggacgggaaatatggggattcccggaacaatgaatcaaatcagcccccttaagaagcccttttctggtaatgtgattgcaccccctaaattcacccgctcaaccccgtctctgacaccaaagtcgtggattgaggataatgtgtttcggacagacaacaactctaatactctgctacccctgcaggtccgatctagtctgcagctccctgcttgggggagtgacagcctacaggactcttggtgcaccgccgcaggcacaagcaggatcgatcaagatcggagcagaatgtatgatagtctgaacatgcatagtctcgagaattccttgatagatatcatgagagccgagcatgacccactgaagggccgtttgagttaccctcatcctgggacagacaatttgctcatgctcaatgccagaagctacggtcgaagacgaggacgctctagtttattccccatcgacgacggtttgctcgacgacggccactcagatcaggtgggggtattaaatagcccgacctgctacagcgctcaccagaacggcgagcggattgaaagattctcgcgcaaggtcttcgttggtggcctgccgccagatatagacgaggacgaaattactgccagctttcggaggtttggtccactcgtggtcgattggccacataaggcagaatctaaaagctatttccctcctaaaggctacgcatttctgttgttccaggaagaatcctccgtgcaggcccttattgacgcttgtatcgaggaagatggcaagctgtatctgtgcgtgagctctcccaccattaaggacaaacccgtccagatccgtccatggaacctttctgactctgacttcgtgatggatggcagccagcctctcgaccccagaaaaaccatctttgtgggcggtgtgcctcgacccttacgcgcagttgagctcgctatgattatggatcgactgtatggcggtgtgtgctatgccggaatagacacagatcccgaactcaaataccctaaaggcgctgggagggtagccttctctaatcagcaatcatacatagccgcaatttctgctcggtttgttcagctgcaacatggcgacatcgataaacgggtagaggtaaagccctatgtgcttgatgaccaaatgtgcgatgaatgtcaaggagcacggtgcggaggtaagtttgcacctttcttctgcgccaatgtgacgtgcttgcagtattattgcgaattttgctgggccaatatacactctcgcgctggacgcgaattccacaaacctttagtgaaagagggagctgatcggccacgccagatacattttaggtggaactag

SEQ ID NO: 219998 - DNA, 3081 bp, Artificial Sequence
  Description of Artificial Sequence: Synthetic coding sequence
atgcgggatttcggttttggggtgttacaaaccgcccctctccgctcctcaagtcccggaccgttgttctgcggggaggcatacggaccctatgctgttgggtccgtcaatccactcccttctgcaaccccctttggacctctcagccctcctcctctgcctgtgactggttttctggaggccgctagcccttttagcgtgccgctagggggtggggctgggagtcccgctgccgctgctagtagtagttctccctttctggcacaccagcagacaatgcaggatgaactgctgttaggcctgacgcagcagccagcgcgacctcttagcggggctgcagctacagaaaagcttcccgatcatcatccgggaggaggcaccatcgctggtgtgacccacctgctcccgtcccaggattttaagccctcactccaccaccctagcagctcttccgcctcctcatgctgttgctgccgtacctcttctccccaggacttttcgaaaaggcaacagcagcagctctcttcccagaaacgcaaagaatttagcccacctcaccttcctcatcctcctgatagtaagccgcctccaccaccccctccccttcattgtcccggacgcttctccccccctcccccacccgcagggcctctcctccagcctgcacaactggctcaacgccagcagcagcaacctccgcagcagtttagcttactgcatcagcagcacttgagccctcaggattttgctcctagacagaggcctgccgaccttccgccactgccccagctcccaccgtcgccacccgcagcacctagaagacgccacggcggtgcgggaagccctagaaagacgcccgctgcgggagagggctctgccgctgaaagtcccaatgcagggctcgccagtagtacaccagtgaacccggcacctggcagcatggaaagtcccaatcatcccttactgaactcaccctcaaatctcctccccggaggagccctgggagccggagctttctcgagcctgcagtcacctgacctcccacaccccggtggcggagggggtggcggaggaggcggaccacccggtgggggtggcggaggtggctcagcgtctcctccccctctgcccggatttggaacaccttggagcgttcaaactgcaagtccacctccacaaccacaacaaccccctcctacacagcctcagcagcagccccctcctcctcagcagccgccacagccccagccccaacctcccggttcaagcgcaacaactccgggaggcggaagtggtggttccctctccgcgatgccaccacccagcccagactccgagaatggattctacccaggtctccccagcagcatgaatccggctttctttccctctttctctccagtgagcccccatggctgcacaggactgtccgtgcccaccagcggcggaggtggaggtggctttggtggccctttctctgccacagccgttcccccacctccaccacctgcgatgaacattcctcagcagcagccccctccccctgccgctcctcagcagcctcagtctcgtaggtctccagtgtcccctcagttgcagcaacagcaccaggcagccgctgcagcttttctacagcagcgcaattcatacaatcatcaccaaccgctgcttaaacagtctccttggagcaaccatcaatcctctgggtggggtacgggtagcatgagctggggagcaatgcatgggagggatcatcgccgaactggcaacatgggcatacctggcacaatgaaccagatttctcccctgaagaaacctttctccggcaatgtaattgcgcctccgaagtttactcgcagcaccccttcattgacaccaaagtcctggatcgaggacaatgtgttcagaacggataataacagtaatacccttttacctttgcaggtcaggtcatcactgcagctgccagcgtggggcagcgactcgctgcaggactcctggtgcactgcagcagggacttctcggatcgatcaagaccgttcgcgcatgtatgatagtctgaatatgcatagcctggagaattcactgatcgacattatgcgtgccgaacatgatccactcaagggacggctgagctacccacacccaggaactgacaatctgctcatgctgaacggacgctctagccttttccccattgacgatggcctgcttgatgacggacatagtgatcaggtgggcgtactgaattcccccacatgttactcagcgcaccaaaacggtgagagaattgagcggttctcgcgtaaagttttcgtcgggggactgcccccagatattgacgaggacgagattacagcgtcctttcggaggtttgggccactcgtcgtcgactggccacacaaagccgagtccaagtcctattttccaccaaagggctatgcgtttctgttattccaggaggagagcagtgttcaagctctaattgacgcctgcatcgaggaagatgggaagctgtatctgtgtgtgtcctccccaacaattaaggataagccagtacagattcgaccatggaatttaagtgactccgactttgtgatggacggttcccaacctcttgacccccgaaaaacaatctttgtggggggtgtgcctcgccctctgcgcgctgtggaacttgccatgataatggatcgcttatacggcggtgtgtgctacgcaggcattgatacagatcctgaactgaagtatcccaagggcgcagggagggttgcattttctaatcagcagtcctacattgctgccatttccgcaaggtttgtgcaattacagcatggcgacattgacaagcgtgtggaagtgaagccgtacgtccttgacgaccagatgtgcgacgagtgccagggggctcgttgcggcggtaagttcgccccattcttttgcgcgaatgtgacctgtttacagtattactgtgaattctgttgggccaacatccactcacgagcaggcagggaattccataagcccctcgtgaaggaaggtgcagaccggcctcggcagatccatttccgttggaactag

SEQ ID NO: 219999 - DNA, 2097 bp, Artificial Sequence
  Description of Artificial Sequence: Synthetic coding sequence
atgcaggacgatctactgatggacaaaagcaagactcaaccacaaccacagcagcagcaaagacaacaacagcagccacagcccgaatcctcagtgagtgaggccccttccactccgctgtcctcagaaacccccaaacccgaggaaaacagtgctgttccagcgcttagtcccgcagctgcacccccagcgccaaatggaccggacaagatgcaaatggaatccccattgctcccaggcctcagctttcaccagcctccgcagcaacctcccccacctcaggagcctgccgctccaggagcctctttgagcccctcctttggatctacttggagcactgggaccaccaacgccgtcgaagattctttcttccagggaatcacccctgtgaacgggacgatgttgtttcagaactttcctcatcacgtgaaccctgtcttcggcggaactttctctccccagattggcctcgcccagacacagcaccaccagcaaccgcctccaccagccccagcccctcagcccgctcagcctgcccagccaccccaggctcagccgccacagcagcgcagaagtcctgctagtccaagccaggccccatacgcacaacgatcagctgcagcagcttacggccatcagccgattatgaccagtaagccgtccagttcttcagcagttgccgcagcggcagcagcagcggctgcctcatctgctagcagtagctggaacactcatcagtctgtaaatgccgcatggagcgcgccatctaatccttggggtgggctgcaagccggacgggacccgaggagggccgtaggggttggcgttggggtcggcgttggcgtacccagtcctcttaatccaattagtcctttaaaaaaacctttttcctcaaatgtgattgctccccctaaatttcccagggccgctcctctgacctctaaaagttggatggaggacaatgcgttcagaaccgacaacggcaacaacctgcttcctttccaagaccgttcacgaccttatgacacatttaatctgcactcccttgaaaatagcctgatggatatgatcaggaccgatcacgagcccttgaaaggtaagcattatccaccctcagggccaccgatgagctttgcggatataatgtggcggaaccacttcgctggacgcatgggaattaatttccaccatcctggtaccgataacattatggcccttaataatgcatttctagatgattcacatggagaccaggccctgtcaagcggcctgagcagtccaacccggtgtcagaatggagaaagggtcgagagatattcacggaaggtttttgtcggaggactcccacctgatattgacgaagacgaaatcacggctagcttccgcagatttggtccgttagtggtagactggccacacaaagctgaaagcaaatcttacttccccccaaaaggctatgcctttctactgttccaggaggaatcctcagtccaggcactgattgacgcctgcctggaggaagatggcaaactgtatttgtgcgtgtcctccccaaccatcaaggacaaacccgttcagatccgcccttggaatctgagcgactcagactttgtaatggatggctcccagccgcttgaccctaggaaaacaatttttgtggggggagtcccacgtccacttcgcgctgtcgaactggcaatgattatggaccgattgtacggaggtgtttgctacgctgggatcgacaccgatccagaacttaaataccccaagggcgctggtcgtgttgctttcagcaaccagcagtcctacatagctgctattagtgcccgtttcgtgcagctgcagcacaacgatattgacaaacgtgtcgaagtaaaaccttatgtgttggacgatcagatgtgcgacgaatgtcagggcacgaggtgcggtggaaagtttgcgccttttttttgcgcaaacgtcacctgcctgcagtactactgtgagtattgttgggcttctatccactctcgggctggtagggagttccacaagcctctggtgaaggaaggcggagaccgaccaaggcacgtgcctttccgctggtcatag

SEQ ID NO: 220000 - DNA, 2055 bp, Artificial Sequence
  Description of Artificial Sequence: Synthetic coding sequence
atgcaggatgaccttctcatggataaatctaagacccagccccagccacagcagcagcagagacaacagcagcagccgcagcccgaatccagtgtgagcgaggccccaagtactcctctgtcgtctgagacgccaaagcccgaggaaaactccgccgtgcccgctctcagccccgctgctgccccaccagcccctaatggccctgataaaatgcagatggaatcccctcttcttcctggtctgagttttcaccaacctccacagcagccaccaccgccacaggaacctgccgctccaggcgctagcctcagtccaagttttggctccacctggtccaccggcacaactaacgctgtggaggatagcttcttccaagggataaccccagtcaacggtacaatgctgtttcagaattttcctcatcacgttaaccccgtcttcgggggtacgtttagtcctcagataggtctagctcagacccagcaccatcagcaaccacccccacccgcacccgctcctcaacccgctcagccggcacaaccgcctcaggctcagccccctcagcagcgtagaagcccagcctctccatcccaagcaccatacgcccagaggtctgccgcagcagcttatggccaccagccgatcatgacctctaagccgtcaagcagtagcgcagtggccgcagccgcagcggctgccgctgcttcaagcgcctcctcttcttggaatactcatcagtctgttaatgccgcttggagcgccccatcaaatccttggggagggttacaggctggcagagatccccgacgggctgtgggcgtcggcgtgggggttggtgtgggcgtcccctctccactcaatcccattagcccgttgaaaaagcccttctccagcaatgtgatcgcgccaccaaagtttccgagggcagcgccactcacttcaaagtcttggatggaggataacgcctttcgaaccgataacggtaacaacctgctgcctttccaggataggtccaggccctacgacacgtttaacctacattctttagaaaattctctcatggacatgataagaacagatcatgagcctttgaaaggccgaatggggatcaattttcatcatcctggcacagataatataatggccctgaattcccgctccagcctctttccatttgaggatgcttttcttgacgacagccatggcgaccaggcactgagcagtgggctgtccagccccacacggtgtcaaaacggggagcgagttgagcgctactctaggaaggttttcgtggggggactgccccctgatatcgacgaggacgaaattaccgccagcttccggagattcggacccctggtagtggactggccccataaggcagagtctaagagctatttccctcccaaaggctatgcttttctgctcttccaggaggaaagctccgtgcaggctttgatagacgcatgtctggaggaggacggcaagctctatctttgcgtgtcctcccctactattaaggacaagcccgtgcagattcgcccttggaatctctccgactccgactttgtcatggatggctcacagcctctagacccgagaaaaaccatctttgtgggcggagtaccacggcctctccgcgctgtggaactcgccatgatcatggaccgtctctatgggggtgtctgctatgccggaatcgacacggatcctgaacttaagtacccaaagggagcaggacgagtggcattctctaatcagcaatcctatatcgccgcaataagcgcacgctttgtgcagttgcagcacaacgacatagacaaaagagttgaggtcaagccatacgtcctagacgaccaaatgtgcgacgagtgccaggggaccaggtgtggcggaaagtttgcaccttttttctgcgccaacgtgacttgcctgcagtactattgcgaatactgctgggccagtattcattcacgcgctggcagagaatttcataaacccctggtcaaagagggcggtgaccgacccaggcatgtaccctttcgttggagttag

SEQ ID NO: 220001 - DNA, 2055 bp, Artificial Sequence
  Description of Artificial Sequence: Synthetic coding sequence
atgcaagatgatctgctaatggacaagagcaaaactcagccgcagccacagcagcagcaacgccagcagcagcaaccccagcctgagagttctgtcagcgaagccccatcaacccccctgagttccgaaactccaaaacctgaggaaaattccgccgtccccgcattgagtccagcagccgctcccccagctcctaacgggcctgataagatgcagatggagtcccccttgctccccggtctcagcttccatcagcctccacagcagccacccccaccccaggagcccgcagccccaggcgcttcactatccccatcattcggcagcacatggtccaccggtactaccaatgctgtggaagactccttcttccaaggcatcacaccagtgaatgggacgatgttatttcagaactttccacatcatgttaaccccgtattcggaggcactttttctcctcagattggtctcgctcaaactcagcaccaccagcagcctccccctccggcacccgcacctcagcccgcacagcccgctcagccgcctcaagcccagcctcctcaacagagacgttcccccgcaagcccctcgcaggctccctacgcacagcgatcggcagctgccgcttacggacaccagccaattatgacgtctaagccgtcctcctcatcggcggtcgccgctgctgccgcagcagcagcggctagttctgcctcttcctcttggaacacccaccagtccgttaacgcggcatggtccgccccatcaaacccctggggaggccttcaagccggacgggatccgaggagagcagtcggcgttggagttggggtgggggtgggtgtgccctccccacttaaccccatctcgcccttaaagaaaccatttagtagcaatgttattgccccaccaaagtttcccagagccgctcctctcacaagcaaatcttggatggaggacaacgcctttcgtaccgataatggcaacaatttgttgccttttcaggacaggtctcgcccatacgatacatttaacctgcattcactggagaactccctaatggatatgattaggaccgaccatgagcccctaaagggaaggatggggatcaattttcaccaccccggaacagacaatattatggcactcaattccagatcctcgctttttcccttcgaagacgcttttctggacgacagtcacggcgatcaagcactgtctagcggtctttcctcgcccacgcgctgtcagaatggggaaagggtggaacgctactctagaaaagtgtttgtgggtggcttacctcctgatatcgatgaggacgaaatcaccgcttcctttcgacgcttcggcccactcgtggtcgattggcctcacaaagccgagtcaaaaagctacttccctccaaaagggtacgcatttctgctcttccaagaggaatcctccgtccaggctctgatcgatgcatgcctggaggaggatgggaaactgtacctctgtgtgagcagccctacaattaaggataagccagtccagataagaccttggaacctgagcgattcagacttcgtgatggatggctcccagccacttgacccccgtaaaaccattttcgtcgggggagtgccccgtcctctgcgggctgtggagctggctatgattatggataggttatatgggggagtgtgctatgcaggcatcgacaccgaccctgagctcaaataccccaagggagccggtagggtggctttctccaaccagcaaagttacatcgccgcaatttccgcccgtttcgtgcagcttcagcacaatgatatcgataaacgggtggaggtgaaaccctatgtccttgacgatcagatgtgtgatgagtgtcagggaactaggtgtgggggtaagtttgcccctttcttctgtgctaatgtgacttgtctccaatattactgcgaatactgctgggcctcaatccatagccgagccggacgtgaatttcataaaccattggtgaaggaggggggagacagaccgagacacgtgccgtttagatggtcctag

SEQ ID NO: 220002 - DNA, 2190 bp, Artificial Sequence
  Description of Artificial Sequence: Synthetic coding sequence
atgggagattacggattcggtgttttggtgcaaagcaacactgggaataaatcagcatttccagttcggtttcacccacacctccaaccgccacaccaccaccagaacgcaacacctagccccgcagcctttatcaacaacaataccgccgctaatggtagttcagcgggaagtgcctggttattcccggctcccgcaacgcataatattcaggacgagatccttggctccgagaaggccaagtcacagcagcaggagcagcaggatcccctggaaaaacagcaactctccccaagcccaggccaagaagctggtatcctgcctgagaccgagaaagctaagtctgaggaaaatcagggcgataattcgtccgagaatggaaacgggaaagaaaaaatccggatcgagagtccagtcctgaccggctttgattatcaggaggcaacgggcctgggtacttccactcaacctctcacgtcctctgccagctctctgacgggattctccaactggtcggcagctatagcaccgagcagttccacgattattaacgaggatgctagcttctttcaccagggcggagtgccagccgctagtgcaaacaatggtgctctattgttccaaaatttccctcatcatgtttccccaggattcgggggatcttttagccctcagattggaccactttcccaacatcatccgcaccacccacattttcagcatcaccactcccagcatcagcagcagaggcggtcacctgcctccccacatcctcccccatttacccatcgcaacgccgcattcaatcagctgccacacttagctaataacctgaataagccgccttctccatggagctcttatcaaagccccagtcctacaccaagcagcagctggtctccgggaggcggaggctacggcggatggggcggatcgcaaggtcgggatcatcgcagagggcttaatggtggaatcactcctttgaatagtattagccccttaaaaaaaaatttcgcctctaatcatatccagctgcagaaatatgcccgtccaagttctgccttcgcccctaaaagctggatggaagactcacttaaccgggcagacaacattttccccttcccagatcgccctaggacattcgatatgcactctctagaatccagcctcattgacatcatgcgggcagaaaatgacaccatcaagggaaggctaaattattcgtaccccggtagcgactcgtccctgctgatcaatgctcggacttacgggaggcgcagaggacagagtagtctgtttcctatggaagacggatttcttgacgatggtcggggagatcagcctctgcatagtggtttgggttctccccactgtttttctcaccagaacggggaaagagtggagcggtactcccgcaaagtgttcgtgggaggcctcccaccggacattgatgaagacgaaattactgcttctttccgacggttcggtcccttgatcgtggactggccccacaaagcagaatccaaaagttacttccctcccaaaggatacgcctttctactctttcaagatgaaagctctgtacaggccctcatcgacgcttgtatagaggaagacgggaaactttatctgtgcgtgagcagcccaaccattaaggacaagccagtccaaattcgtccctggaacctctccgattcggatttcgtaatggatggctcacagcccctcgatccccgaaaaacgatttttgtcggtggggtgccaaggccactgcgcgctgtggagctcgccatgattatggatcgactttacggcggtgtgtgctatgcaggcatcgacacagaccctgagctaaagtatcccaaaggggctgggcgagtggcttttagtaatcagcagagctacatcgccgctatttctgcccgtttcgttcagctccaacatggcgagatcgacaagagggtggaagtgaagccatatgtgctagacgaccagctgtgtgacgagtgtcagggcgctaggtgtggcggaaagtttgccccttttttctgcgcaaatgtgacctgtttacagtactactgcgagtactgttgggctgcgattcattctcgggctgggagggaattccacaagcctctagtaaaagagggaggagaccggcctcgccacatctcattcagatggaattag

SEQ ID NO: 220003 - DNA, 2139 bp, Artificial Sequence
  Description of Artificial Sequence: Synthetic coding sequence
atgggggactatgggttcggtgtgctggtacagagtaataccgggaacaaatctgccttcccggtgcgattccatccacaccttcagcctccccatcatcatcagaatgctacccctagccctgcagcttttataaataataacaccgcagctaatggtagcagcgccggatccgcatggctattccctgctcccgctacacacaatattcaggatgaaatactgggcagtgagaaggctaagagccagcaacaggagcagcaggatcctctggaaaagcagcagttatccccatcccctggccaagaggcagggatacttccagagactgaaaaagctaaaagcgaggagaatcagggcgacaactcttcagagaatggcaatggtaaagaaaagatacggattgagagccctgtattgacaggcttcgactaccaggaagccacagggctcggcactagcacacaaccgctaacctcgtctgcatcgtccctgaccggtttcagcaactggagcgctgcgatcgctccttcatcctccactataattaacgaagacgcttcatttttccaccagggcggagtccccgcagcaagcgcaaataatggggctttactgtttcaaaacttcccccatcacgtcagccctggctttggaggatctttttcccctcagattggtcccctcagccagcatcatccccatcatcctcattttcagcatcaccactcgcaacatcagcagcaaaggcggagtccagccagcccgcaccctccgccattcacacaccggaacgccgctttcaaccagctgcctcatttggccaacaacttaaacaaacctccttccccctggagtagttaccagagtcccagccctactccgagctcaagttggagtccgggtggcggtgggtacggaggttggggaggaagccagggccgtgaccatcgcagaggcctcaacggtgggatcactcccctaaattccatatccccgctgaagaagaactttgcctccaaccatatccaactacagaaatacgccaggccaagctctgccttcgcaccaaaaagctggatggaagactctctaaacagggctgataacatctttcctttcccggacagacctcgcaccttcgacatgcacagcttagaatcgtcgctcattgacattatgcgtgctgagaatgacaccatcaaggcaaggacctacggtagacgaagggggcagtctagtctgtttcccatggaggacgggttcctagatgatgggagaggggatcagcctctacattctggattgggtagcccgcactgcttctcacaccagaatggagagcgggttgaaaggtactcaagaaaagtgtttgtcggaggtctcccacccgacatcgacgaagacgagatcaccgcttccttccgtcgctttggtcccctgattgtggattggccgcataaggcagagtctaagagctactttcctccgaaagggtacgcttttctcttattccaggacgagtccagcgtgcaggcgctgatcgatgcttgcatcgaggaagacgggaagctgtatctctgtgtaagcagtccaactataaaagacaaacctgtgcagattcgaccctggaatctaagcgatagtgatttcgtcatggacggcagtcagcccctagaccccagaaaaaccatttttgtgggaggagtcccgcgtcccctcagggcagtggaactggctatgattatggaccggctgtatggaggcgtctgctacgccggaatcgatactgatcccgagctgaagtacccaaagggcgcaggcagagtggccttctccaaccagcagtcctacatcgccgcaatctcagccaggttcgtgcagttgcagcacggcgaaatagacaaacgggtcgaagtcaaaccctatgtacttgatgatcaactgtgcgatgagtgtcaaggggctaggtgtggaggtaagtttgctccatttttttgcgcgaacgtgacctgtctgcagtactattgtgagtactgctgggccgcaatccactctcgggctggtagggaatttcataagccactggttaaggaaggaggggatcgaccccgacatatttcattcaggtggaattag

SEQ ID NO: 220004 - DNA, 2049 bp, Artificial Sequence
  Description of Artificial Sequence: Synthetic coding sequence
atgtccacccccgctgtccctcaggatctgcagcttcccccatcacagagagctcagtctgccttcaaggagcagcgcaggcagaagctgaaggaacatctacttagaagaaagactctgtttgcctacaaacaggaaaatgaaatgttgtcatcaagggaccagcgcgtcgttactagcgaagatcaggtgcaggagggcactaaagtcctgaagctgaaaacaaagatggcagataaagaaaatatgaagagaccagccgagtctaaaaacaataccgtcgtgggcaagcactgcatccctctgaagccatctaacgagctcaccaattccaccgtcgttattgatacccataagccaaaagattctaaccaaactccccatttattgttgaccgaagacgatccccagtcccagcatatgactctgtcacaggccttccacttaaaaaacaacagtaaaaagaaacagatgaccactgaaaaacaaaagcaggatgctaacatgccgaagaagccggttctgggaagctatcgtggccaaatcgtccaatccaagattaacagtttccgcaagcccctgcaagtgaaggatgagagttcggcagcaacgaagaaactgtccgcgactatccccaaggccactaagccgcagccagtgaatactagctccgttactgttaagtctaataggtcctccaacatgaccgcaacaacaaaattcgtctccaccacctctcagaacacacagctcgtgcgtccgcctatacgcagccatcacagcaacacccgagatacagtcaagcagggcatctctcgcacttctgccaatgtgaccatccgtaaagggcctcatgagaaagagctgctgcagtcaaagaccgctctgagttctgtaaaaacctcgtctagccagggcataatccgcaataagactctgagtcggagtatcgctagcgaggtgattgccaggcctgccagtctctctaatgataagctgatggaaaaatcagaacctgtcgatcagcgtaggcacacggctggtaaagcaatcgtcgactcccggtctgcccagcccaaagagaccagtgaagagcgaaaggccaggttgtccgagtggaaggctggaaaaggccgagttctcaaaaggccaccaaactctgttgttacacagcatgaacccgctgggcagaatgagaagccagtgggtagcttctggaccacgatggccgaggaagatgaacagcgcctctttactgaaaaggttaacaacaccttctctgaatgtcttaatcttatcaacgagggctgcccaaaggaagatattctagtcaccctcaatgatctcattaaaaatatccccgacgcgaaaaagctggtaaagtattggatctgtcttgcccttatcgaacctattacttcccctatcgagaacattattgccatttatgaaaaggccattctggcaggagctcagcctattgaagagatgaggcacacaattgtggatattctcacaatgaaaagccaggagaaagccaacttaggcgagaacatggagaaaagttgtgcttccaaagaggaggtgaaagaagtgagcatcgaggataccggcgtcgatgtcgaccccgagaaactggaaatggagtccaaactgcatcgcaacctgttgtttcaagattgtgaaaaggaacaggataacaagacaaaagatcccactcacgatgtgaagaccccaaatactgagaccagaacaagttgtctcatcaagtacaatgtgagcacaactccttacttgcagtccgtgaaaaaaaaagttcagtttgatggaacgaatagcgcgttcaaagaactgaagttcctgactccagtgcgcaggtcccggagattacaagaaaagaccagtaaattgccagacatgcttaaggatcattacccttgcgtaagtagtctggaacaacttacggagttgggtcgggaaaccgacgcctttgtgtgtcgtcccaacgcggcactttgtcgggtgtactatgaggccgacacaacctag

SEQ ID NO: 220005 - DNA, 1485 bp, Artificial Sequence
  Description of Artificial Sequence: Synthetic coding sequence
atgtccactcccgctgtgccacaggatcttcagctcccaccttcccaacgggcacagtccgccttcaaagaacagcgtagacagaaattgaaggaacacctcctgcggcgtaagacactttttgcctacaagcaggagaatgaaatgctcagcagtcgagatcagagagtggttacctctgaggaccaggtccaggaggggaccaaggttttgaagctgaagaccaagatggccgataaagagaatatgaaacgcccagccgagagcaagaataatacggtggttggcaaacactgcatacccttgaaaccatcaaatgagctcaccaatagcacagtcgtcatagacacccacaaaccaaaggactccaatcagactccccaccttctactgacggaggacgacccccagtcacagcacatgactctcagccaggcctttcatttgaaaaacaacagtaagaaaaaacaaatgacaacagagaagcagaagcaggatgcgaacatgcccaaaaaacctgtcctcggatcataccgcggacagatagtacagtccaagattaatagttttcgcaaacctcttcaggtgaaggacgagtcatctgccgctacaaaaaaactctccgccactatcccaaaagccaccaagccacaacctgttaacacatctagcgtaactgttaagtccaataggtcaagtaatatgaccgctacaactaaattcgtgtctactacatctcagaacactcagctggtgaggcctcctattcgatctcaccactccaacactagagacactgtcaagcaagggatctccagaacatccgcgaatgtgactatcaggaaaggccctcacgaaaaagagctcctccagagcaaaacagccttgagcagtgtcaaaacttctagctcacaggggattatcaggaataaaaccctatcaagaagtattgcttccgaggttatcgctcgccctgccagcctgtccaacgacaagttaatggagaagtccgagccagttgaccagagaaggcacaccgctggaaaggcaatcgtggattctcggtcagctcagcctaaagaaactagtgaagaacgaaaagcccgactatcagaatggaaggcaggaaaggggagggttctgaaacggcctccaaatagcgtggtcacacagcacgagccagctggacagaacgagaagccggttgggagcttctggaccactatggccgaggaagatgaacagagattattcaccgaaaaagtgaacaacactttctctgaatgtctgaatctcattaacgagggctgtccgaaggaggatatcctggtgacactgaacgatctgatcaagaacatcccagacgcaaaaaagttggtgaaatactggatctgcctcgccctaatcgaaccaatcacaagtccaatcgaaaacattattgcaatatacgaaaaagccatcctcgctggggcacaagtaaggtag

SEQ ID NO: 220006 - DNA, 2052 bp, Artificial Sequence
  Description of Artificial Sequence: Synthetic coding sequence
atgagcacgccagcggttccacaggaccttcaactccccccatcacagcgcgcacaatctgcttttaaagagcagcggagacaaaagctgaaggaacatctgctgaggaggaaaacgcttttcgcgtacaagcaggaaaatgagatgttgagctcttcccgagaccagagggtcgtgacctctgaggaccaggttcaggaaggaaccaaggtgctgaaacttaaaaccaaaatggctgacaaagaaaacatgaagaggccggcagaatcaaagaacaacaccgtcgtcggaaagcactgcattccacttaaaccatccaatgaactcactaactctactgtagttatcgacactcataagccaaaggattccaaccaaactcctcacttgttgttgaccgaggacgaccctcaatcccaacatatgaccctctcccaggcatttcaccttaagaacaactccaaaaagaagcagatgacgaccgaaaagcaaaagcaggatgcaaacatgccaaagaaaccagtgctaggatcatacagaggccaaattgtgcagagtaagatcaactcctttcggaagccgctgcaggttaaggacgaatccagtgcagcaacaaagaaactgagtgcaaccattccaaaggctacgaagccacaaccagtgaacaccagctccgtaaccgtcaaaagcaataggtcatcaaacatgacagccactaccaagttcgttagtacaacaagtcaaaacacacagctcgtcaggcctccaattaggtcacaccactcaaacacacgggacaccgtaaagcaaggtattagcaggacgtccgcgaacgtcaccattcggaagggccctcacgagaaagaactgctgcaatcaaagaccgcattaagttcagtgaagactagcagcagtcaggggataattaggaacaaaacactctcccgctctatcgcctcagaggtcatcgcgagaccagctagcctaagcaacgataagctgatggaaaagagtgaacccgtcgatcagcggcgacatacagcaggaaaagccatagttgacagcaggtctgcccagcctaaagaaacttctgaagaaaggaaggctagactctccgagtggaaagctggcaaaggacgggtgctgaagcgccctcctaattcagtagttacccagcatgagcctgcagggcagaatgagaaaccagttggaagcttttggaccacaatggccgaagaggacgaacagcgccttttcacagagaaggtcaacaatacattttctgagtgcttgaacctgataaacgagggatgcccaaaagaggatatcctggtgacccttaatgatttgattaaaaacatccccgatgcaaaaaaactggtgaagtactggatctgccttgctcttatcgaacccataacgagccccattgagaatattattgccatttacgaaaaagcgatcctggcaggagcccagccaatcgaagaaatgcgccacacaatagttgatatcttaacaatgaaatcacaagagaaggccaatctgggcgagaacatggaaaagagttgcgcttccaaagaggaagtgaaggaggtgtcaatcgaagacacaggtgtggatgttgatccagagaaactagagatggaatccaagctgcacagaaaccttctgttccaggattgtgagaaggagcaggacaacaaaactaaggaccctacacacgacgtcaagacccctaacacggagaccaggacatcctgcctgattaagtataatgtatctaccaccccatatctccagtcagtgaaaaaaaaagtccagttcgacggcacaaattctgcttttaaagagctgaaatttcttacacctgtcaggagaagccgaagattgcaggaaaaaacttcgaagctaccagatatgctcaaggaccactatccatgcgtgtcctcgctcgagcagcttactgaattagggcgtgagacggacgcatttgtgtgcagacccaatgctgccttgtgtagggtctactacgaggcagacactacgtag

SEQ ID NO: 220007 - DNA, 1488 bp, Artificial Sequence
  Description of Artificial Sequence: Synthetic coding sequence
atgtcaaccccagccgtgccgcaagaccttcagcttcccccttcccagcgagcacaaagtgcgttcaaggagcagcggaggcagaaactcaaagaacacctgcttagaagaaagaccctctttgcctacaaacaggaaaatgagatgctgagcagttccagggatcagcgtgtggtcacgtccgaggaccaagtccaggagggaaccaaagtccttaagctgaaaaccaagatggccgataaagaaaacatgaagcgacctgcagagtctaagaacaacaccgtggtgggtaaacactgtatccctctcaagccgtccaacgaactgactaattctacagtagtgattgatactcacaagcctaaggatagcaaccagaccccccacctgcttctgactgaggatgacccacagagccagcacatgactcttagtcaagcctttcatttgaagaataacagcaagaagaagcaaatgaccactgagaagcaaaagcaggacgccaacatgcctaaaaaacccgtgctcggcagctaccggggtcagatcgtacagtccaaaattaactcctttcgcaagcccttacaggtgaaagacgagtcttctgctgctaccaaaaaactctcagccacaattcctaaggctaccaagccacagcccgtaaatacctcctctgttacagttaagagcaatcgttccagcaacatgactgccacaacaaagtttgtctccacaaccagccagaacacccagctggtaaggccaccaattcggagccaccacagcaatacgagagataccgtcaaacaaggtatcagccgaactagcgcaaatgtcaccattaggaagggtccccacgagaaggagttactgcagtccaagactgcattatcatcagtaaagacatccagcagccagggcattatcagaaataagacactgagccgctccatcgcatctgaggttattgcacgcccagcttccttgtccaacgataagctgatggagaaatcagagcccgtggaccagagacgtcatacggcaggtaaagcaatcgttgattcccgcagtgctcagcctaaggaaaccagtgaggaaagaaaagccagactgtctgagtggaaagccggtaagggaagagtactcaagcgtccacccaatagcgtcgttacccagcatgagcctgccggtcagaacgaaaaacccgtcggctcattttggacgacaatggcagaagaagacgagcagcggctattcacggaaaaagttaataacacatttagtgagtgtctgaacctgattaatgaaggctgcccaaaagaggacatcctggtgaccctgaacgatctcatcaagaacatacccgacgcgaaaaagctggtcaaatactggatttgtctggcactcatcgagccaataacttctcccattgaaaatatcattgcaatctatgagaaagcaattctagctggcgctcagcatatctag

SEQ ID NO: 220008 - DNA, 5919 bp, Artificial Sequence
  Description of Artificial Sequence: Synthetic coding sequence
atgggtgatgattcagagtggcttaaacttcccgtggaccaaaagtgtgagcataaactgtggaaggccaggctttccggatacgaggaggccctgaaaatatttcagaaaattaaagatgagaagtcccccgagtggtccaaattcctggggctaatcaaaaaatttgtgacggactccaatgctgtggtacagcttaagggcctggaggccgctctggtttacgtcgagaacgcacacgtggcaggaaaaacaaccggtgaggttgtgtctggtgtcgtgtcgaaggtgttcaaccaaccaaaagcgaaagctaaggagctgggaatagagatttgtctaatgtatatcgaaatagaaaaaggggaggcagttcaggaagaattactcaaaggactcgataataagaacccaaagataatcgtcgcctgcattgaaaccctgcgaaaagccctgagcgagtttggaagcaagatcattcttctcaagcctatcatcaaagtcctcccaaagctctttgagtcacgcgaaaaagccgtgagagacgaggctaagctcatcgccgtggaaatctacagatggatcagagacgcactaaggcccccactgcaaaacataaacagcgtacaactgaaagaattggaggaagaatgggtaaagcttcctacttcagcacctcggcctacacgatttctacggagccagcaggagttggaagccaaattggaacagcaacagtccgctgggggtgatgctgaaggcggaggggatgacggagacgaggtgccccaaatcgacgcgtatgaactgcttgaagcggtcgaaatactgagcaaattaccaaaggatttttacgacaaaatagaagccaaaaaatggcaagagagaaaagaggcactcgagagcgttgaggtgctgattaagaatccaaagttggaagccggagattacgccgacctggttaaggcactgaaaaaagttgtggggaaggataccaacgttatgctggtggcgctcgcggcaaagtgtctgacagggttggccgttggccttcgcaagaaattcggacagtacgcaggacacgtggtcccaactattctggagaagtttaaggaaaagaagcctcaggtggtgcaagcactccaggaggctatcgacgcaattttcctgactacaaccttacagaacatctcagaggatgtacttgctgtgatggacaataaaaacccaacgatcaaacagcagacctccttattcatcgcgaggtcgtttagacactgcaccgcttctaccctgccaaagagcctccttaaacctttctgtgccgcactactaaaacacattaacgatagcgcccctgaagtgagagatgcggcattcgaggcattgggcacagctctgaaagtggtcggtgaaaaggctgttaacccctttttagccgacgtcgataagcttaagctcgataagatcaaagagtgttccgaaaaagtggagctgattcacggcaaaaaggcagggttggccgctgataagaaagagttcaagcccctccccggacggactgctgctagcggcgctgccggagataaggataccaaggatatcagtgctccgaaaccaggtccgctgaaaaaagctcctgctgctaaagcaggagggcctcccaagaagggcaagccagcggcaccaggcggagccggaaacactgggacaaagaacaagaagggcctcgagactaaggaaatcgtcgaacccgagctttcaatcgaagtttgcgaagagaaagctagtgcagtgctgccacctacgtgtatacaattactcgatagtagcaactggaaagagcgactggcttgcatggaggaattccagaaggcagttgaactgatggaccgcacagaaatgccctgtcaggccctggttcggatgctagccaagaagccaggatggaaagaaaccaactttcaggtcatgcagatgaagctccacatcgtcgccctgatcgcccagaaaggcaatttcagcaagactagcgcgcaggtggtcctcgatggactggtcgataagataggggacgtgaagtgcggcaacaatgccaaagaagccatgactgccatcgctgaggcatgtatgcttccctggactgctgagcaggtcgtcagtatggctttctcccaaaagaatcctaaaaaccagtccgagacactgaactggctgagtaacgccatcaaggagtttgggttcagcggactgaatgtaaaggcctttatcagcaatgtgaaaacagctctggcggcaacgaacccagccgtacggaccgcagccatcaccctcttaggggtcatgtacttatacgtcggcccatccctgagaatgttctttgaggacgaaaagccggctctgttgtcacagatcgacgctgaatttgaaaaaatgcaggggcagagtccaccggctcccaccaggggtatatctaagcatagcacgtccgggacggatgaaggcgaagacggcgatgagcctgacgatggctccaatgacgtcgtagatctgctcccaaggactgagatctccgacaaaataacaagcgaattggtgagcaagatcggggataaaaactggaaaatccgaaaggagggcttagacgaggtcgccggtattattaatgacgccaagtttattcagcccaatatcggggaactgcccacagctcttaagggccgactgaacgattccaataagattctggtccagcagactcttaacatacttcagcagttagcggtcgctatgggaccaaacattaagcagcacgtgaaaaatctcggcatacccatcataaccgtgctgggtgactccaaaaataatgtgcgtgccgctgccctcgctaccgtcaacgcttgggccgaacagacgggaatgaaggaatggctggaaggcgaagatctgtctgaagagctaaagaaagagaatccttttctccggcaggaactattgggttggcttgccgagaagttgccaaccctacgaagcactccaaccgacctgatcctgtgcgtgccccatctatattcttgcttggaggaccgcaacggagacgtccgtaaaaaggcacaggacgcactcccattctttatgatgcacctcgggtacgagaaaatggccaaagccacagggaagcttaagcctacttctaaagaccaggtcctggccatgcttgagaaagcaaaggtgaatatgcctgcgaagccagctcccccaacgaaggcaacttccaagccgatgggtgggagtgcccctgccaaatttcagcctgccagcgcccctgctgaggattgcatttcgtcatccacagaacccaagccagaccctaagaaggccaaagcacccggattatcaagtaaggctaaatccgctcagggcaaaaaaatgccctccaagacttctctcaaggaagacgaagacaagtccggcccaatctttattgtggtccctaatgggaaggaacagcggatgaaggatgagaaagggttgaaagtgctgaaatggaactttaccacgccacgagatgaatatatcgagcagctgaaaacccagatgtccagttgtgtagccaaatggctgcaggacgaaatgttccattctgactttcagcatcacaataaggctcttgcagtcatggtagatcacctggagtccgaaaaagaaggcgttatcgggtgcctcgaccttattctgaaatggctcaccttgaggtttttcgacacaaacactagtgtgcttatgaaagccctagaatacttgaagttgttgtttactttgttgtccgaagaggagtatcatcttaccgagaatgaagcttcctcttttatcccctatttggtggtgaaagttggagaaccgaaagacgtgattaggaaggatgttagggccatccttaacaggatgtgtctggtctaccccgcttccaaaatgttcccttttattatggagggcaccaagagtaaaaattctaagcagcgcgctgagtgtctcgaagaattggggtgcttggtggagagctatggcatgaatgtgtgtcaacccacgcccggaaaggcgctaaaggaaatcgcagttcacataggcgatcgggacaacgctgttcgtaacgctgccctgaataccattgtgacagtgtacaacgtgcacggggatcaggtgttcaagctcatcggcaacctatcagagaaagatatgtctatgctagaagagaggatcaaacgcagtgctaaacgtcctagcgctgcacctatcaaacaggtagaagaaaagccgcagagggcccaaaacattagtagtaacgccaacatgcttaggaagggtcccgcagaggacatgagcagcaaactgaaccaggctaggtctatgagcgggcaccctgaggctgcccagatggtacgtcgagaattccagctcgacctggacgaaatagaaaatgacaacgggacagtacgatgcgagatgccagagttggttcagcataagctcgatgacattttcgagcccgtcctgatacctgagcccaagatccgcgctgtatctccacattttgacgatatgcacagcaacacagcgagcaccataaacttcattatttcacaggtggccagcggggatattaacacctccattcaggctctgacacagctctttcagattgaatctctggctagggaagcgagtaccggcgtgttgaaagacctcatgcatggcttaatcaccctaatgctggattcacgcatagaggatctcgaggagggccagcaggtgattagatccgtcaacttgctggtcgtgaaagtgctggaaaaatcagatcagactaatatactgagcgctctgctggtgcttctgcaggacagcctgctggccacagccagttcccctaagttttcagaacttgtaatgaagtgtctgtggcgaatggttcgcctgctgcccgatactattaactccatcaatctggaccggatactcctggacatccatatttttatgaaggttttccctaaggagaaacttaagcagtgcaagtcagagtttccaatcagaaccctgaagacactactgcatactctctgcaagttaaaagggcctaagattctggatcaccttactatgattgataacaagaacgaatcagagctggaagctcacctgtgtagaatgatgaaacacagcatggaccaaaccggtagcaagagcgacaaggaaactgaaaaaggagcctctaggatcgatgaaaaatctagtaaggctaaagtgaatgatttcctggccgaaatcttcaagaagatcggctctaaagagaacacaaaagaaggcctggccgagctgtatgagtacaagaagaagtacagcgacgctgatatcgagcctttcctcaagaactccagtcagttttttcagtcttatgtggagcgcggtctccgcgttatcgagatggagcgggaaggcaagggcaggatctccacatccaccgggatcagtccacagatggaggtgacgtgcgtcccaacgcccactagcaccgtgtcgtctatcggcaataccaacggggaagaggtaggtccttctgtctacctggagcgattgaagattctcagacaaagatgtggtctagataacacaaaacaagatgatcgcccacccttgacttccttattaagcaaacctgctgtccctactgtggcgagttccacggatatgctgcactcaaagctctcccagctgagggagtcacgcgaacagcaccagcactccgacctcgacagcaaccagacccacagcagcgggaccgtgacatcctctagcagcacagcaaatattgacgatctgaagaaacggctggagaggatcaaatccagcaggaaatac

SEQ ID NO: 220009 - DNA, 5918 bp, Artificial Sequence
  Description of Artificial Sequence: Synthetic coding sequence
atgggtgatgattcggagtggctaaaactccccgtggatcagaagtgtgagcataagctgtggaaggcccgtctgagcggatacgaagaggctctaaaaattttccagaagattaaagacgaaaaatccccagagtggagtaaatttctgggcttgatcaaaaagtttgtcaccgacagtaacgcggtggttcagctgaaaggattggaagcagcactcgtttatgtggaaaacgctcacgtggccggtaaaaccaccggcgaggtggtctctggggtggtgtctaaggtgtttaatcagccaaaagctaaagccaaggagttgggaattgaaatttgtctgatgtatatcgagattgagaagggggaagctgtgcaggaagaattgctgaagggtctggacaacaaaaaccctaaaattatcgttgcttgcatcgagacactgaggaaggctttaagcgagttcggatctaagattatactgctgaaacccattattaaggtgctgccaaagctgtttgagagtcgagagaaggcagtgcgcgacgaggccaagcttatcgccgttgagatctaccgctggattcgtgacgccttacggccacccctgcaaaatataaacagtgtgcagcttaaagagctggaggaggagtgggtgaagctgcccacaagtgcacctcgccctacgagatttctgcgctcccaacaggaactggaggctaaattagaacagcagcaatccgccggaggcgatgctgaagggggtggtgacgacggtgacgaggtgccccagatagatgcttatgaactgcttgaggctgtggagattctctcaaaattaccaaaggacttctatgataagatcgaggcaaaaaaatggcaggagcgtaaggaggccctggagtccgtcgaggtcttaatcaagaatcccaagttggaggcaggagattatgcagacctggtgaaggccctgaaaaaagtcgtcgggaaggatacaaatgtaatgctggtggccctggctgctaaatgcctgaccgggctggccgtgggcctccgtaagaaatttgggcagtacgcaggccatgtcgtgcccacaatcctggaaaagttcaaggaaaaaaaacctcaggtggtccaagcgctacaggaagctattgatgcgatatttctgacaacgacgctccaaaacatctcagaggacgtcttagcggtcatggacaataaaaatcccactattaaacagcaaacgagtttattcatagcacgatctttccgacactgtaccgcgagtaccctgcccaagagcctgctgaagcctttttgcgctgcattgctcaaacacattaacgactcggctccggaagttagggatgccgcattcgaggctctgggcacagccctgaaagttgtcggggaaaaggccgttaatcctttcttagctgacgtggataaactgaaactcgacaagataaaggaatgttccgagaaggtggaattgattcacggtaaaaaggcaggattggcagccgacaaaaaggaatttaagccactccctgggaggactgccgctagcggcgcagctggggataaagataccaaagacatttcagcgcctaaacctgggccactaaagaaagcaccagccgcaaaggcagggggtcctccaaaaaaggggaaaccagccgcaccgggaggcgctggcaacacaggtacgaaaaacaaaaagggactggagaccaaagaaatcgtggaacctgagctgtctattgaggtctgtgaggagaaagcctccgctgtgctccctcccacttgcattcagctgctagactcctcaaactggaaggagagattggcctgtatggaggaatttcaaaaggcagtcgaactcatggatagaaccgagatgccctgccaagcactggtgcggatgctggccaaaaagcctggatggaaggaaacaaatttccaagtaatgcagatgaaactgcatatagtcgctttgatagcacaaaaaggcaattttagtaaaacatctgctcaagtggtgctggacggactggtagataagataggtgatgtgaagtgtggcaataatgcaaaggaagctatgacagctatcgctgaggcttgtatgctgccctggacagcggagcaggtggtctctatggctttttcccagaaaaatccaaagaaccagtctgaaactctcaactggctgtcaaatgccatcaaagagttcggatttagtgggctaaacgttaaggcgttcatttcaaatgtgaaaactgcgctcgcggcaaccaatcctgcagtgcggacagcggctataaccctcttaggggtcatgtatctttatgttggccctagtctcaggatgttttttgaggatgagaaacctgcgcttctgagccagattgatgccgaatttgaaaaaatgcaaggccagtcccccccagcacccacccgcggaatatctaaacacagcacttccggtaccgacgaaggggaagatggcgacgagccggatgatgggtctaacgatgtagtggacctgctgccgcgtacagagatcagtgataaaattaccagtgagctcgtgtcaaagatcggcgacaagaattggaagatcaggaaagagggcttggacgaggtcgcaggcatcatcaatgatgcaaagttcattcagcctaatattggcgaactgccaactgccttgaaggggaggttgaacgacagcaacaagatcctggttcagcagaccctcaatattctgcaacaactggccgtggcgatgggaccaaatattaagcaacacgtgaaaaatcttggcattccaataatcacagtgcttggtgattcaaagaataacgttcgagccgcagccttagcaacagtgaatgcctgggcagagcagactgggatgaaggagtggctggaaggagaagacctcagcgaagaactgaaaaaggagaaccccttcttgcgccaggagctcttgggatggctggctgagaagctgcccacgttaaggtctacgcctactgatcttatcctgtgcgtcccccacctttactcttgccttgaggataggaatggagacgtgcgaaaaaaggcgcaggacgccctgccattctttatgatgcacctgggctacgagaagatggccaaagcaaccggaaagctaaaaccaacgtctaaggaccaggttctggcaatgctagagaaagcaaaagtcaatatgcccgctaaacctgcacctccaaccaaggccacttccaaacccatgggcggtagtgcacctgccaaatttcagcctgctagtgcacccgcagaggattgtattagttcgtccaccgaacctaagcctgacccgaaaaaggcgaaggcacctggcttgagctccaaggctaaatccgctcaggggaagaagatgccatctaagacttcacttaaggaagatgaggacaagtccgggcctattttcattgttgtgcccaacggaaaagagcagcggatgaaagatgaaaaagggctgaaggtgttgaagtggaatttcactacgcctagggatgagtacatcgagcagctcaagactcagatgagtagctgcgtagcaaaatggctgcaggatgaaatgtttcacagtgacttccaacaccacaacaaggctctcgccgtaatggtggatcacttggaatctgagaaagagggcgtgattgggtgtctcgatttgatcctcaaatggttgactctccgtttctttgacacaaacacctcagttttgatgaaagctttggagtacctcaagctgttattcaccctgctttccgaggaggaatatcatctcaccgagaacgaagcctcgagttttatcccctacctcgtcgtgaaagtaggtgagcctaaagacgttatcaggaaggacgtgagggccattttgaataggatgtgtcttgtgtaccctgcatcaaaaatgtttcctttcattatggaagggactaaaagcaagaactccaagcagcgcgctgaatgcttggaggaattggggtgtctggtcgaaagctatgggatgaacgtgtgtcaaccgacacctggaaaagccctgaaggaaattgccgttcacatcggcgacagagataatgccgtccgtaacgccgcacttaatacaatcgtgaccgtttacaacgttcatggcgatcaggtcttcaagctgataggcaacttatcagagaaagacatgtcaatgctcgaagagcgcattaagcgctctgccaaacgaccatccgccgcaccaatcaagcaggtggaagaaaagcctcagcgagcccagaacattagcagcaacgccaatatgctgagaaagggtccggctgaggacatgtctagcaaacttaaccaagccaggtccatgtctggccaccctgaggccgctcagatggtacgacgcgagttccagctggacctggacgagatcgagaatgacaacggaactgtccgttgtgagatgcccgaactggtgcaacacaagctggacgatattttcgagccagtgctcatacccgagcctaaaattagagccgtctctccacattttgatgatatgcacagcaataccgcttctacaattaactttataatcagccaagtcgctagcggcgatattaacactagcatccaggctttgacccagctcttccaaatcgaatctctcgctcgcgaagcctcaactggcgtgttaaaagatctaatgcacggtctgataactcttatgctggatagccggattgaggatctggaggagggacagcaagttatcagaagcgtgaaccttcttgtggtgaaggtgctcgaaaagtccgaccagaccaacatactctctgctctcctcgtattgttacaggattctctgctagctacagcctctagccccaagttctcagagctggttatgaaatgtctgtggcgcatggtgagacttctgcctgacacaatcaattccatcaatctggaccgtattctgttggacattcacatctttatgaaagtgttccctaaagagaagcttaagcagtgcaagtcagaattccctatcagaactctcaagaccttgctccataccctttgcaagctgaaaggtccgaaaatattagaccatctcacaatgatcgataataagaacgagagcgaacttgaggcacacctgtgtcgcatgatgaaacattccatggaccagaccggatctaaatcggataaagagaccgaaaaaggtgcaagccgcatcgatgagaagagctctaaagccaaggtcaatgacttcctggcagagatctttaaaaagatcggcagcaaggagaatacgaaagagggtctggccgagctatacgaatacaaaaaaaagtactctgacgctgacattgagccattcttaaaaaattcctcgcaattctttcaatcctacgtagagcggggtctgcgggtaatcgagatggagagggaaggaaaggggaggatcagcacttcaacgggcatttccccccagatggaagtgacatgtgtgcctaccccgaccagcacagtgagcagcatcgggaacaccaatggcgaagaggtgggcccttcggtgtatctagagcgacttaaaatacttcggcagcgctgtggtctcgacaatacaaaacaggacgacaggccacccctcacgagcctgctctcaaagcctgccgtccccactgtggcaagttctacagatatgctacattcaaaactgagccagctgagggaatcccgcgaacagcatcaacactccgacctggatagcaaccagactcactcatcaggcacagtcacttctagctcaagtactgcaaacattgacgacctcaagaagagactggagcgaataaagtccagcagaaagta

SEQ ID NO: 220010 - DNA, 906 bp, Artificial Sequence
  Description of Artificial Sequence: Synthetic coding sequence
atgggggatgactcggagtggctaaaactgcctgtagaccagaagtgcgagcataagttgtggaaagcgaggctctccgggtacgaggaggctcttaagatctttcagaagataaaggacgagaaatctcccgagtggagtaaatttctcggccttatcaagaaattcgttaccgatagcaatgctgttgtacagttaaaaggactggaggcggctcttgtgtatgtcgaaaacgctcacgtggcaggtaaaactacaggcgaggttgttagtggcgtggtgagtaaggtcttcaatcagccaaaggccaaggcgaaggagctgggcatcgaaatttgcctgatgtatattgagatagagaaaggcgaagcagtgcaggaagagttactgaaaggtcttgacaataagaatccaaagattattgtagcgtgcattgaaacattaaggaaggcacttagtgagtttggctctaaaatcatcctgcttaagcctatcataaaggtactcccaaagttattcgagagtcgcgagaaggcagtgagggacgaggcaaagctgatcgctgtggagatctaccggtggatacgggacgccctgagaccgcctcttcaaaacataaactcagtgcagctgaaggagctggaagaagagtgggtcaaactgcctactagcgcccctagacctacaagatttctcaggagccagcaggagctggaggccaagctggagcaacagcagtccgctggaggagatgccgaggggggaggggacgacggtgatgaggtgccacagatagatgcttacgagctgctcgaggctgtagaaatcctttccaagccaaaaactttcatgaccaagttgcggcagaagaacggaaagcgtgaaaaaaggccatggagtctctag

SEQ ID NO: 220011 - DNA, 6119 bp, Artificial Sequence
  Description of Artificial Sequence: Synthetic coding sequence
atgggcgacgacagcgagtggctcaagctcccggttgatcagaagtgtgagcacaaactgtggaaggctcgcctcagtggctacgaggaggctctgaagatctttcagaaaattaaagatgaaaagtctcctgagtggagcaaattccttggcctcattaagaaattcgtgaccgatagtaatgccgtcgtgcagctcaagggcctagaagcagcattagtctacgtagaaaatgctcacgtggctggaaagacaactggcgaggtcgtgtctggtgttgtatcaaaggtgttcaaccaacccaaagcaaaagcaaaggaattaggcattgaaatctgcctgatgtacatcgaaatcgaaaaaggcgaagctgtgcaggaggagctcttgaagggactggacaataagaatcctaagattattgtggcttgtatcgaaaccctccgcaaagcactgagcgaatttggttctaagataattttgctgaagccaatcataaaagtgctgcccaagctgttcgaatcccgggagaaggccgtgcgggacgaagccaagctcattgctgtagagatctataggtggatacgcgacgcactcaggcctccgctccagaatatcaatagcgttcagctaaaggaactcgaagaagagtgggtcaaactccctacatctgcaccgagaccaacgcgattccttcgtagccagcaggagctggaagctaagcttgagcagcagcaatccgcaggcggtgatgccgaagggggaggtgatgacggggatgaagtacctcaaatagacgcatacgagctgcttgaggccgtggaaatcctctccaagctgccaaaagatttttacgataaaattgaagcaaaaaagtggcaagagcgcaaagaggctttagagtccgttgaggttctaattaagaatcccaaattagaagcgggtgattacgcggatctggttaaagctctgaagaaggtggtaggaaaggacaccaacgtaatgctggtggcactggctgctaaatgtctgacaggccttgctgttggccttcgcaagaagtttggccagtacgccggacatgtcgtgcccaccatcctcgaaaagttcaaagaaaaaaaacctcaggtagtacaggccttgcaggaggccatagacgcaattttcctgaccaccactcttcagaacatatctgaggatgtgctcgcagtgatggataacaagaatcccacgatcaagcaacagaccagtttatttattgctcggagttttaggcactgcaccgcaagcacactgcccaagtctctcctaaaacctttctgcgcagcactacttaagcatattaacgattccgcccctgaggtgcgcgatgctgctttcgaagcactgggaaccgccctgaaagtggtaggggaaaaggctgtcaacccattccttgcagatgttgacaagctgaagctggataagatcaaagagtgttctgaaaaggttgaactcatccacggtaaaaaggcagggttagcagcagataaaaaggagttcaaaccactgcccggtaggacagccgcatcaggggcagcaggtgataaagacacaaaggacatctctgccccaaagccaggccctcttaagaaggcccctgctgcgaaggcaggcggacccccaaagaaaggaaagcctgccgctcccggaggcgctgggaacactggaacaaagaataaaaagggactggaaaccaaagagatagtcgaaccagaattatcaatagaagtctgtgaggagaaagcgtcagccgttcttccgcctacatgcattcagctcctggacagcagtaattggaaggagaggctcgcatgcatggaagaattccaaaaggcagtggaactgatggacaggaccgaaatgccttgccaggccttggtgcgaatgctggctaagaaacctggatggaaagaaaccaatttccaggtcatgcagatgaagcttcatatagtcgcactgatagcacaaaagggtaattttagcaagacatctgctcaagtggtccttgacgggttggttgacaagattggcgacgtgaagtgtgggaataatgcaaaagaagctatgacagcaattgccgaggcctgtatgcttccctggaccgctgagcaagtcgtgagtatggctttctctcaaaagaaccccaagaatcagagcgaaacattaaattggctatctaacgcaatcaaggaatttggcttctccggactcaatgttaaagctttcataagcaatgtcaagaccgctctggcagccacaaatccagccgtgaggactgccgctatcacactgctgggcgtgatgtatttgtacgttggaccgagcttgagaatgtttttcgaagacgagaaaccggcactcctgagccagatagatgcggaatttgagaagatgcaagggcaatcccctcccgcacctaccaggggtatctccaagcatagcacatctggaactgacgaaggggaggatggcgatgagccagacgacggcagtaacgacgtggtggacctgctcccacgaaccgagattagcgataagatcacctcggagctggtgtcaaaaattggggataaaaactggaaaattcggaaagaagggctggacgaggtcgctggaattattaatgacgcaaagttcatccagcctaatatcggcgagctgccaaccgctctgaaaggcaggctgaatgactccaacaaaatcctggtccagcagacgcttaatatcctccaacagctggcagtggctatgggcccaaatattaagcagcatgtgaagaacctcggaattccaatcattacggtgctgggcgattcaaagaacaacgttcgtgccgcagccctcgcaactgtgaatgcttgggctgaacagacgggaatgaaggaatggctcgagggggaggatttatccgaggagctgaagaaggaaaatccatttctccgacaggagctccttggatggctggctgaaaaacttcccaccctgcgctcgacgcccaccgacctcatcctctgtgttcctcacctttatagctgtctggaggatcgcaatggagacgtaaggaagaaggcccaggacgcattgccctttttcatgatgcacttgggctacgagaagatggctaaagccactggaaaactcaaacccacaagtaaggatcaggtgttggccatgctggagaaagccaaagtgaatatgccagccaaacctgcccctccaaccaaggcaacgagtaagcctatgggtgggagcgctcccgcaaaattccagcccgcttccgctcccgcagaggactgtattagttcctcgacagagccaaaacccgatccgaaaaaggccaaagctcctggcctgtcctctaaggccaagtccgcccaaggaaagaaaatgcccagtaagacttccctgaaagaggatgaagacaaaagcgggcctatattcatcgttgtcccgaacggaaaagagcaacgcatgaaagacgagaagggattgaaggtcttgaaatggaacttcaccacaccgagagatgagtacatcgaacagctgaagacccagatgagttcttgtgtggctaaatggctgcaggatgagatgtttcacagcgatttccaacaccacaacaaggctctggccgtcatggttgatcatttggagagtgagaaggagggggtcatcggttgtttggatctgatcctgaaatggcttacgcttaggttttttgacacaaacacaagcgtactgatgaaggccttggaatatctcaagctcttgtttaccctactcagcgaggaggaatatcacctgacagaaaatgaggcatcatcattcatcccttacctggtcgtaaaagtgggggaacccaaagatgttattaggaaggacgtgagagctattctgaaccgcatgtgcttagtgtatcccgcaagcaagatgttcccatttataatggagggtaccaaaagcaagaactccaaacagcgagccgagtgccttgaagaacttggctgtctggtggaatcgtacggcatgaatgtatgtcaacctaccccaggcaaagccctgaaagaaatcgccgttcacatcggggatcgtgacaatgcagttcgcaacgctgctctgaacacgatcgtcactgtatacaatgttcacggagatcaggtgttcaagctgataggaaacttgtccgaaaaagatatgtctatgctcgaggaacgtattaagaggtcggctaaacggccaagtgctgcccctatcaagcaggtggaagaaaaaccccagagggcccagaatatctcttctaacgctaatatgctgaggaagggcccagcggaagatatgagtagtaaattgaaccaggccagatcaatgagcggccaccctgaagctgcgcagatggtgcgacgagagttccaactggacctggatgaaattgagaatgacaacggcactgtcaggtgtgagatgcccgagttagtgcaacataaattggatgatatcttcgaaccggtgctaattccagaacccaagatacgtgcagttagcccccactttgacgatatgcattcaaatacagcatctaccattaatttcatcatcagtcaggttgctagtggagacataaacacaagcatacaggctctgacccagatcgatgaagtccttaggcaagaggataaagccgaggcaatgtctggccatatcgatcagttcctgatcgctacttttatgcaactacggctgatatataacacacacatggctgacgagaagctggaaaaggacgagataattaagttgtactcttgtatcataggcaatatgatatcattgtttcagattgaaagtttggccagggaagcatctactggagtgctcaaagatctcatgcacggcctcattaccctgatgctggactctcgaatagaagacctggaggaggggcagcaggtcatccggtcggttaaccttctcgtagtgaaagtactggaaaaaagcgatcagacaaacattcttagtgccttacttgttctcctgcaggactcccttctggctacggcttcaagccccaaattctcagaattggtcatgaagtgcctgtggaggatggtacgcttgctgcctgatactattaattccatcaacctagatagaattcttctggatattcatatcttcatgaaagtgttccctaaggaaaagctcaaacaatgtaagtctgagtttcccattcgtacgctgaaaactcttctacataccctgtgtaaactgaagggtcctaaaagttgcatgtgtcttccacagatcctggaccatctcacgatgatcgacaacaagaatgaaagtgaactggaagcccacctatgtaggatgatgaaacatagcatggaccaaaccggaagcaagtcagacaaagagacagaaaagggagcgtctcggattgatgagaagagttcaaaggctaaggtaaacgacttcctggccgagatatttaaaaaaatcggctctaaagaaaacaccaaggaggggctggcagaactgtatgagtataagaagaagtactccgatgctgatatcgagcccttcctgaaaaattcttcacagttcttccagtcttatgtcgaaaggggactgcgcgtaattgaaatggaacgggagggtaaaggccgaatatctacatctaccgggataagccctcagatggaggtcacctgcgtacccaccccaactagtacagtgagttctatcgggaacaccaacggggaagaagtaggaccgtcagtctatttggagcgtctgaagattttgagacagcgatgtggcctggacaatacaaagcaggatgataggccccctttgacatcattgctgagcaagcccgcagtgcctacggttgcctcatcaacagatatgcttcactccaagctatctcagctcagagagtccagagaacaacatcagcacagtgatttggactcgaatcagacacactctagcggtaccgtgacatcaagtagctcaaccgcgaacatcgatgatctgaagaaaagactggagaggatcaaaagttcccgcaaata

SEQ ID NO: 220012 - DNA, 456 bp, Artificial Sequence
  Description of Artificial Sequence: Synthetic coding sequence
atgggcgatgatagcgagtggctgaaattgccagttgatcaaaagtgcgagcacaagctgtggaaagcgagactgtccgggtacgaagaggccctgaaaattttccaaaagatcaaggacgagaagtcccccgaatggtccaagttcctggggctcataaaaaaattcgtcaccgattcaaatgccgtggtccaactgaagggacttgaggcagccttagtttatgtggagaacgcccatgttgccggaaagaccacaggcgaagtggtctcaggcgtcgttagcaaggtgttcaaccagcctaaagccaaagctaaagaactcggcattgaaatatgcttaatgtatattgagattgaaaaaggtgaagctgtgcaggaagagctgctcaagggcctcgacaacaagaatcctaaaatcatcgtcgcttgcatcgagacactccgcaaggcctag

SEQ ID NO: 220013 - DNA, 6098 bp, Artificial Sequence
  Description of Artificial Sequence: Synthetic coding sequence
atgggcgatgatagcgagtggctgaaactgccggtcgatcagaaatgtgaacataagctgtggaaggcacgcctctccggctacgaggaggcattgaagatcttccagaaaattaaggacgaaaagagccccgagtggtctaaattcctgggcctgattaagaagtttgtgacagactcgaatgcagttgttcagttaaagggcttggaggcagctctggtctatgtcgagaacgctcacgtggcgggaaagaccacaggggaagttgttagcggcgtcgtgtccaaagtgtttaaccagccaaaggcaaaggcgaaggaacttggaatcgagatctgcctgatgtatattgagattgagaagggtgaagccgtgcaagaagaacttctgaaagggctcgataataagaaccccaagattattgtcgcatgcattgagaccctccgcaaagctttgagcgagttcggctcaaaaatcatcctattgaagcccatcatcaaggttctgccaaagctgttcgaaagtagagagaaggcggtccgtgacgaggcaaaactgatagcagtcgaaatttaccggtggatccgggatgcactcagacctcccctccaaaatattaatagtgtgcagctgaaggagctagaagaggaatgggtcaagttgcctaccagcgctccgcgacccacaagatttttgcgtagccagcaggagcttgaagcaaagctggagcagcaacagtcagctgggggagatgctgaaggcggtggcgatgatggcgatgaggttccacagatagacgcgtacgaactgttggaagcagtagagattctcagcaagctgccaaaggacttttatgataagatcgaagccaaaaaatggcaagagcggaaagaggctctggagtcggtggaggtgcttattaaaaacccaaagctcgaggctggtgactatgccgacttagtgaaggcgctgaaaaaggtcgttggtaaagacactaacgtcatgcttgtggcactggctgcaaagtgtttgactgggctcgctgtggggctgaggaagaagttcggacagtacgccggtcatgtagtgcccactattcttgaaaagttcaaagagaaaaagcctcaggtggttcaggccttacaggaagctatcgatgctatcttcctgaccacgacactccagaatatcagtgaggatgtcttggccgtaatggataataagaaccctaccatcaagcagcagacatccttgttcatcgccaggagctttcggcattgcacagcctcgacactgccaaaatctcttttgaaacctttctgtgctgcgctactcaagcacatcaatgacagcgccccagaggtcagggatgctgcattcgaagccctgggtactgccctcaaggtggtcggggaaaaagccgtcaacccctttcttgctgatgtggataagttgaaactggataaaatcaaagaatgctctgaaaaagtggagcttattcacggtaagaaagccggactggccgcagacaaaaaagagtttaaacctctgccaggacggacagcggcaagcggtgcagcaggtgacaaggacactaaggacatctctgcccctaaacccggtcccctgaagaaggcccctgcagccaaggcaggagggcctcctaaaaaaggcaaaccggctgccccaggcggagcgggaaatactgggactaaaaataagaagggattggagacaaaagagatcgtggaaccagagttgagcatcgaggtatgtgaagaaaaagcttccgctgtgctgcctcccacctgcatacagctgctggactcctccaactggaaggaaagactggcttgtatggaggaattccagaaagcagtcgagcttatggacaggacggagatgccttgccaggccctggttagaatgctggcaaagaagcctggctggaaggaaacaaatttccaagtaatgcaaatgaagctgcatattgtcgccctgatagctcagaaaggcaacttttcaaaaacctccgcccaggtcgtcttagacggcctcgtagacaagatcggggatgttaaatgcggtaataacgccaaggaagcaatgacggcaattgctgaagcctgcatgctcccctggaccgccgaacaggttgtgtcaatggctttttcacaaaaaaatcctaaaaaccaaagcgagaccctgaattggctgtcaaacgccattaaagagttcgggttcagcggtctcaatgtgaaggccttcatcagcaatgtgaaaaccgccctggccgcaacaaacccagccgtgagaaccgcagcaataaccctcttgggcgtgatgtacctctatgtggggcctagcctccggatgtttttcgaggacgaaaagcccgcactcctcagccaaattgacgccgagttcgagaaaatgcagggacagtcccctcccgcaccaactcggggtatctcaaaacattccacctcaggaactgacgagggagaggacggtgacgaaccggatgacggttctaacgacgtagttgacttgctgcctagaactgaaattagtgataagattacatctgagcttgtgtccaaaattggtgataaaaattggaagattagaaaggagggcctagacgaagtggccggaataatcaatgatgccaagtttattcagcccaacatcggggagttgccgaccgccttaaaaggtcggctgaatgactctaataaaatcctggtgcagcaaacccttaacattctgcagcagcttgccgtggcaatggggcctaacattaaacaacacgtgaaaaatctcggtatcccgattatcaccgtgttgggcgattccaaaaataacgtccgcgctgcagcacttgccactgttaacgcgtgggccgagcagaccggaatgaaggaatggcttgaaggtgaggatctgagcgaagagctgaagaaagagaatccctttctgaggcaggaactcctgggttggctggcagaaaagttacctaccctccgatcgaccccgacagatttgatcttatgtgtccctcacttatactcatgtcttgaggacagaaacggcgatgtccggaaaaaggcacaagacgccctacctttctttatgatgcaccttggatacgagaagatggctaaggctacaggtaaacttaaacccacctcaaaggaccaagttctagccatgctggaaaaggcgaaagtgaatatgcccgctaagccagctcctcccactaaggccacgtccaagcccatgggcggatctgcaccagccaaatttcagccagcatccgccccagccgaagattgcatttcttctagtacagagccgaagccagatccgaagaaagcgaaggcaccaggactgtccagtaaggccaaatccgcccagggaaaaaaaatgccctctaaaacgtctctgaaggaagatgaggataaaagcggcccaatcttcatcgtggtaccaaacggaaaagagcagcgcatgaaagacgagaagggtctcaaggtactgaagtggaattttactaccccgcgtgatgagtatatcgagcaacttaagacacagatgagtagctgcgtcgccaaatggctgcaggacgagatgtttcattccgattttcagcaccacaacaaagccctagcagtgatggtcgaccaccttgagtccgaaaaagaaggcgtcattggctgtctagacctgattttgaagtggttaactctccgtttctttgatactaacacaagcgttctgatgaaggccttagaatacctgaagctcctgttcactttactctcagaggaagaataccaccttaccgagaacgaagcttcatccttcatcccatacctcgtcgtgaaagttggcgaacctaaggatgtgattagaaaagatgtgcgagcaattctgaatcgaatgtgcctggtttatcctgcctctaaaatgttccccttcatcatggagggtaccaaatctaagaattctaaacaaagagcagaatgtctagaagagctggggtgtctggtggaatcttatggtatgaacgtctgccagcccacacccggtaaggctttaaaggaaatcgccgtccacatcggcgatagagacaatgcagtcaggaatgccgctcttaataccattgtgaccgtgtataatgtccatggagaccaggtttttaagttaattgggaatctctccgaaaaagacatgagcatgctggaagaacgcatcaagcgatccgcaaagaggcctagcgccgctccaattaaacaagtagaagaaaagcctcaacgcgctcaaaacatctccagcaacgccaatatgttgcgcaagggtcccgcagaggatatgtcaagtaagctgaaccaggccaggtcaatgagcgggcaccccgaagcggcacagatggttaggcgcgagttccagcttgacctggatgaaatcgaaaatgataatggaacagtgagatgcgagatgcccgaactggtgcagcacaaattggatgatatctttgagccagtgttgataccggaaccgaaaatcagagccgtgagccctcactttgatgatatgcattccaacactgccagcacgatcaactttatcatatctcaagtggcctccggagacatcaatacatctattcaggccctgacccagatagacgaggtgttgaggcaggaggataaggctgaagccatgagcggtcacatagatcagtttctgattgccacctttatgcaactgaggttaatctacaacacccacatggcggacgaaaaactggagaaggatgaaataattaaactgtacagttgtattatcggcaacatgattagtctcttccagattgaatctctggcacgcgaggccagcacaggagtcctgaaggacctgatgcatggattaataactctgatgctggattcccggatagaagatctcgaagaaggccagcaggtgatacgaagcgtcaatctgttagtagtcaaagtgctcgaaaaatccgatcaaacaaatatactttctgccctgttagttctccttcaagactcccttctggcaactgccagctcacccaagttctctgagttagtgatgaaatgcttgtggcgcatggtgagattgctgccagacacgattaattcaatcaacctcgatcgcatcctccttgacattcatatcttcatgaaggtcttccccaaggaaaaactcaagcagtgcaagtctgaatttcctattaggaccctgaagaccctgttacacaccctatgcaagctgaaaggtcctaaaattctggaccacttaacaatgatcgataacaagaacgagtctgagcttgaggcccatctctgcaggatgatgaaacattccatggatcagaccggctcaaagagtgataaggagacagagaagggggcttcaagaatcgatgagaagtcatctaaagctaaagttaatgacttcctggccgaaatcttcaagaaaataggcagtaaggagaatactaaagagggtcttgccgaactctacgaatacaagaaaaaatattctgacgcagacatcgaaccattcctcaaaaatagtagtcagtttttccaatcttatgtggaacgcggtctcagggtcatcgaaatggagcgtgagggcaagggccgtatcagtacctccacaggcatcagccctcagatggaggtaacttgtgtgcctactcctacgagtacagtttcaagtatcggaaataccaatggagaggaggtcggtccaagcgtttatctggagaggcttaaaatactccgtcagcggtgcggtctggataacaccaagcaagatgatagaccccctctgaccagcctgctgtccaagccggctgtgccgacagtggcatcatccaccgatatgctccacagcaagctgagtcagctgcgggagtctagagagcagcaccagcattccgacctggatagtaatcaaacccactccagcgggactgtgaccagctcgtcctctacagctaacatagatgacctgaagaagaggctcgagcggatcaagagcagcagaaagta

SEQ ID NO: 220014 - DNA, 1020 bp, Artificial Sequence
  Description of Artificial Sequence: Synthetic coding sequence
atgaaagactctctggtactccttgggcgagttccagcccatcccgattctcggtgctggttcttagcctggaaccctgcaggcaccctccttgcctcatgcggcggagaccgacgtatccggatctggggaaccgagggggattcctggatatgcaaaagtgtgttgagcgagggacaccaaaggacagtacgcaaggtcgcttggtctccttgtggaaattacctagcttctgccagttttgatgccactacttgcatctggaagaaaaatcaggatgactttgaatgcgttaccacactagaaggacacgagaatgaagtaaagtctgttgcctgggccccttcaggtaacctacttgccacgtgcagccgagataaatcagtctgggtgtgggaggtagacgaggaagatgagtacgaatgtgtgtccgtgcttaactctcacacccaggacgtgaaacacgtagtctggcatccctcacaggaactgctggcatctgcttcttacgatgataccgtgaaactctaccgggaagaggaagatgactgggtctgctgcgcaactctcgaaggtcacgagtcgacagtctggtctttagcttttgaccccagtggtcagagactagcttcatgttccgacgaccgcacagtgagaatttggcgccaatatctccctggtaacgaacagggggttgcttgcagtggatcggacccgtcctggaagtgtatttgtactctgtctggattccacagccgaactatctatgacatagcttggtgtcagctcaccggggcattggccactgcctgtggggatgacgccattcgagtcttccaggaggatcctaactctgaccctcagcagccaaccttttcactgaccgcacacctgcaccaggctcactctcaggatgtaaactgcgtcgcatggaacccgaaagaacctggcctcctggctagctgcagcgacgacggcgaggttgccttctggaagtatcagcgccctgaaggcctgtag

SEQ ID NO: 220015 - DNA, 1380 bp, Artificial Sequence
  Description of Artificial Sequence: Synthetic coding sequence
atggccgcttccggggctgtagagccaggcccacctggcgctgctgtggctccatcaccagccccagctccaccacctgcccctgatcatctcttccgccctatcagtgccgaggatgaggagcagcagcctaccgaaatcgaaagtctgtgcatgaactgctactgcaacggaatgacccggctgctcttaacaaagatccccttctttagggaaatcatagtctcatcatttagttgtgagcattgtggctggaataacacggagattcagagtgctgggagaattcaggaccaaggggtgcggtacactctttcagtgagagcattggaagatatgaaccgggaggtagtgaaaacggacagcgccgctactcgaattcccgaactcgacttcgaaatccccgcattcagccagaagggtgccttgacaacagtggaaggtttaatcacacgagcaatatccggtctggaacaggaccagccagcacgtcgggcaaacaaggatgcaaccgcggagaggatcgacgagttcattgttaagctgaaggaattgaaacaagtagcttcgccatttaccctgatcatagacgacccttccggtaacagcttcgtcgagaatccccatgctcctcagaaagacgacgccctcgtgattacccactacaacaggaccaggcagcaggaagagatgctaggtctgcaggaagaggcccctgccgagaaacccgaggaagaggacttaaggaacgaagttcttcagttctcgaccaattgtcctgaatgtaatgctcctgcacagaccaacatgaagctcgttcagatccctcacttcaaggaagtaatcataatggcgaccaattgcgaaaactgcgggcatcgaaccaatgaagtgaagtctggcggtgccgtggaaccattgggcactcggattacacttcacatcacagacgcttccgatatgaccagggatctcctcaagtctgaaacatgttctgtggaaattcccgaactggagtttgagttgggcatggctgtcctgggcggtaaattcaccactttggaaggcttactcaaggatatcagggagctggtgaccaaaaatccttttaccctgggggattcaagcaaccccggacagaccgaaagactgcaggaatttagtcagaagatggatcagataatcgaaggaaacatgaaggcccattttatcatggatgatccagccggtaactcctatctccagaatgtctatgcgcctgaagacgaccccgagatgaaagtggagagatacaagcgcacctttgatcaaaacgaagaattgggactgaacgacatgaagacagagggctacgaggcaggcctggctcctcaacgttag

SEQ ID NO: 220016 - DNA, 585 bp, Artificial Sequence
  Description of Artificial Sequence: Synthetic coding sequence
atgtgggtcaagttactgtctatcgtggccgagttttgcttctccccttttctcgtcaccgacgaagagacagcgtcagacgccctggagaggaactctctgtcatcccaagaccctcaacagccaacatctaccgtaagtgtgacagaggattcatctactagtgaaatcgacaaggaggagaaggaacagaccacacaagaccctgacctgacaaccgaggcaaatcctcagtatctgggcctggccaggaaaaagtccgggatcctccttttgactcttgttagtttcctgatttttatcctattcatcatagttcagctgttcataatgaaattgcggaaggcccatgttatttggaaaaaggagaatgaagttagtgaacacactcttgagagttaccgctcacgatcaaacaatgaagagacctcctcagaggagaagaatgggcagtccagccaccctatgagatgtatgaattacatcaccaagctctactccgaagctaagacaaagagaaaggagaatgtccaacatagcaagctggaggaaaagcacattcaggtgcccgagtccatcgtttag

SEQ ID NO: 220017 - DNA, 525 bp, Artificial Sequence
  Description of Artificial Sequence: Synthetic coding sequence
atggcctgcctcggttttcagagacacaaagcccagctgaacttagctactagaacttggccctgcaccctcctgtttttcttgttatttattcccgtgttctgtaaggcaatgcacgtcgcacaaccagcagtggtcctggccagctcccgcggaatagcctcatttgtttgtgagtacgcctccccaggcaaggctaccgaggtcagagtcacagttctgaggcaagctgatagtcaggtgactgaagtgtgtgcggcaacatacatgatgggcaatgaattgacctttttggatgacagcatctgtacaggcaccagctccggtaatcaggtgaacctgaccattcaggggttgcgcgcaatggatacgggcctctacatctgcaaggtggagctcatgtatcccccaccgtattacctgggaattggcaatggcactcagatttatgtcattgctaaagagaagaagcccagctataaccggggtctgtgcgagaacgcacctaatagagccaggatgtag

SEQ ID NO: 220018 - DNA, 672 bp, Artificial Sequence
  Description of Artificial Sequence: Synthetic coding sequence
atggcttgcctgggatttcaacgacacaaggctcaactgaatttagcgacaaggacatggccatgcaccctgcttttcttcctgttattcatccccgttttctgtaaggccatgcacgtcgctcagcccgcagttgtgctcgcaagttctaggggtattgcctcctttgtttgcgaatacgcctcccctggcaaagccaccgaagtgcgggtcaccgtcctgagacaagccgattcacaagtcaccgaggtttgtgcggcaacatatatgatgggaaatgaacttacattcctggacgactctatctgtacaggcacatccagcggcaaccaagtgaacctgacaatccagggcctaagagccatggacacaggactgtatatttgcaaagttgagctcatgtacccacccccatattacctcggaattggtaacggtacgcagatctacgtcatcgatcccgagccatgtcctgattctgatttcctgctctggatactggctgcagtttcctccggcctgtttttttatagctttctcctcacagccgtctctctgtcgaagatgcttaagaagcggtcccctttgactactggtgtgtatgtaaaaatgccccctactgagcccgaatgcgaaaagcagtttcagccatactttatcccaattaattag

SEQ ID NO: 220019 - DNA, 414 bp, Artificial Sequence
  Description of Artificial Sequence: Synthetic coding sequence
atgcacgtggcacaacccgcagtggtcctggcttcctcccgcggtattgcatcctttgtgtgtgagtacgccagccctggaaaggccaccgaggtaagagtaacagttcttagacaggccgatagtcaggtgacagaagtgtgcgcggctacatacatgatgggaaacgagttaactttcctggatgatagcatctgtaccggaacatctagcggcaaccaggtgaatctgacaatccaaggcttaagagccatggacacaggtttgtatatctgcaaagtcgagctcatgtatcctccaccctactacctgggcattgggaatggcactcaaatttatgtaatagccaaggagaaaaagccttcctacaaccgcggactatgcgagaatgccccaaacagagcccgtatgtag

SEQ ID NO: 220020 - DNA, 171 bp, Artificial Sequence
  Description of Artificial Sequence: Synthetic coding sequence
atggcatgccttggattccagcggcataaggcccaactgaatcttgccacgagaacgtggccttgcacactcctttttttcctcttgtttatacctgttttttgcaaagtgccaccaactgaaccggagtgcgagaagcagttccagccctatttcatccccatcaattag

SEQ ID NO: 220021 - DNA, 660 bp, Artificial Sequence
  Description of Artificial Sequence: Synthetic coding sequence
atggcgtcggctggtgacacacaggcaggcccaagagacgcagcggaccaaaattttgattacatgttcaaactcctgttaattggcaatagtagtgtcgggaaaacatctttccttttcaggtatgctgacgactcgttcactccagccttcgtctctaccgtaggaatcgacttcaaagtgaaaacagtgtacagacacgataagcgaatcaaactgcagatttgggacaccgccggacaggaacgttaccgcactataactaccgcctattaccggggagctatggggtttctgctgatgtacgacatcgccaaccaagaaagtttcgctgctgtgcaggactgggctacgcagataaagacttacagctgggataatgcccaggtcatcctagtcggaaacaagtgcgatctagaagacgaacgtgtcgtgccagcagaagacggcagacgtctggcagatgacttgggtttcgaatttttcgaagccagcgcaaaggagaacatcaacgtgaaacaggtcttcgagcgactggtcgacgtgatatgtgaaaagatgaacgagtccctggagccgagttcatccagtggcagtaatggaaagggacctgccgtgggggatgcacccgcaccccagccctcttcctgctcctgctag

SEQ ID NO: 220022 - DNA, 1566 bp, Artificial Sequence
  Description of Artificial Sequence: Synthetic coding sequence
atgctgccccgaagacccctagcctggcctgcatggctcctgcgaggggctccaggtgccgctggtagctggggacgtcctgtcggccctctcgcccgtaggggatgctgcagcgccccaggtacccccgaggtaccccttacaagagaacggtatccagtgcggagactgccgttctccaccgtgagtaaacaggatctggcagcgtttgaacgcatcgtgccaggcggagtggtgaccgacccggaggctttgcaagcacccaacgtggattggctgagaacccttcgcggatgtagtaaggtgctcttgcgccctcgcaccagcgaagaagtgagtcatattctgcggcactgccacgagcgcaacctggcagtaaaccctcaaggcggtaacacaggtatggtgggcggaagcgtgccggtgttcgacgaaatcatactgtccactgcccgaatgaatcgggtgctctctttccacagcgttagcggcatacttgtctgtcaagcagggtgtgttcttgaagagctatcacggtacgttgaagaacgtgactttataatgcctcttgatctgggggctaaagggtcctgtcatattggtggaaacgtggccactaatgcaggcggactcaggttcttgcgctatggttctctgcacggcactgtcctggggctggaggtggtcttggctgacggaacggtgctggattgtttgacctctctccgcaaggacaataccggatatgacctgaagcagttgtttatcggatctgaaggaacattaggcatcatcaccacagtctctatattatgccccccaaagccacgcgcagtgaatgtggccttcctcggatgtcctgggttcgcagaggtgctacagaccttttcaacctgcaaagggatgctgggggagatcttgtcggcctttgaattcatggacgcagtctgcatgcagctcgtggggagacatttacacctggcatcccctgtgcaggagtctccattctatgtgctcatcgaaacctcaggctcaaacgccggacacgacgccgagaaactgggtcactttctagagcacgcactgggatctggcctggtcaccgacggcacaatggcgactgatcaacgcaaggtcaagatgttgtgggcactccgggagaggatcaccgaggccctgagccgggacgggtacgtatacaaatatgacctgagtttacccgtggagcgactgtatgacattgtcacagaccttcgggcaaggctgggtccccatgccaaacatgtggtcgggtatggccatctgggagacggaaatctgcatctgaacgttacagccgaagctttttcacccagcctcctagccgctctagaaccccacgtgtatgaatggacagctggccaacagggctctgtgtcggccgaacacggagtggggtttcgaaaaagagacgtgttggggtattccaagccacctggagcccttcagcttatgcagcaactgaaggcactgctggatcccaaagggattctgaacccatataaaacactgcccagccaggcctag

SEQ ID NO: 220023 - DNA, 960 bp, Artificial Sequence
  Description of Artificial Sequence: Synthetic coding sequence
atgctgcccagaagaccactggcgtggccagcctggctcctgcgcggagctccaggcgcagccggatcctgggggagacctgtgggtcccctggctaggagaggctgttgtagcgcgccaggaacacccgaagtgccactcacgcgtgaacgctacccagtgaggcgactgccattttctacagtgtctaagcaggacctagcagctttcgaaaggatcgttcccggtggggtggttacagatcccgaggctctgcaagcccctaacgtggattggctgcgaacccttcggggttgcagcaaagtgctattgcgacccagaacttccgaagaagtgtcacatattttgcggcactgccacgagcggaacctggcagtcaaccctcaggggggtaacaccgggatggtgggtggcagcgtcccagtattcgatgaaattatactgagtacagctcggatgaacagggtcttgtctttccactctgtcagcggcattttggtgtgtcaggcaggatgcgtgctggaggagctttcccgatatgtggaggagagagattttatcatgcctctcgacctgggagctaaagggagttgccacatcggaggaaacgtagccaccaacgctggaggtctcagattcctgcgttatgggtccctccacggcaccgtgctggggctggaggttgtgcttgcagacggcactgtgctggattgcctgacatctctgcgaaaagacaatactggatacgatttgaaacagctgttcattggttcagagggcacgcttgggattatcaccaccgtttcgattctgtgccctccaaaacccagggccgtaaatgtggcattcctagtcacctgcgttcctccagcttgtggaccaggaagccctcggcctgctcgccttcctcacccagctctgcggacgcccggtgtgtgtcctcaacccctaaggctgtag

SEQ ID NO: 220024 - DNA, 1164 bp, Artificial Sequence
  Description of Artificial Sequence: Synthetic coding sequence
atggtcggcggaagcgtgccagtgttcgacgaaataatattgagcactgccagaatgaatcgggtcttgtcctttcacagcgtttcagggattctcgtttgccaggccggttgtgtgctggaagaattgtcccgttatgtcgaggagcgagacttcatcatgccccttgatctaggcgctaaagggtcatgtcacataggcggtaacgtcgctaccaacgccggtggtctccggttcctccgatatgggtcattgcatggtacggtcctcggtttggaggtggtgctggcagacggcacagtacttgattgcctgacttctctaaggaaagacaacactggttacgatcttaagcaactgtttattgggtccgagggaactctgggcatcatcactaccgtatcgattctgtgcccccctaagccacgcgcagtgaatgtggcttttctggggtgtccaggattcgctgaagttctccagacattcagcacctgtaagggaatgctcggagagatactctctgccttcgagttcatggacgctgtgtgcatgcagctggtgggcagacatctgcacctcgccagccccgtgcaggagagccccttctacgttctgatagaaacaagcggctctaacgccggtcatgatgctgagaaactgggccattttttagagcacgcattgggcagcggtctagtaactgatgggacgatggcgaccgaccagcgtaaggtaaagatgctgtgggcccttagggagcggattactgaggccctgtcacgagatgggtacgtatataagtatgatctaagcctgcccgtggagaggctgtatgacatcgtaaccgacttgagggccagactcggcccacatgcgaaacacgttgtgggttacggccatctcggggacggcaatttgcatctaaatgtgactgccgaggccttctcccccagcctgttggcagccctggagccccatgtgtatgagtggacagccggtcagcaggggagcgtctctgctgaacacggcgtgggtttcagaaaaagagacgttctcgggtattccaaaccacctggagccctgcaacttatgcagcagctaaaggcgcttctcgaccccaagggaatactcaacccctacaaaactcttccaagtcaggcctag

SEQ ID NO: 220025 - DNA, 978 bp, Artificial Sequence
  Description of Artificial Sequence: Synthetic coding sequence
atgttgcctcggaggccgttggcttggcctgcgtggcttttaaggggggctcccggtgcagctgggtcatggggccgtccagtaggccctctcgctaggaggggttgttgctctgccccaggaacacctgaagtgcctctgactagagagcggtaccccgtgcgcagactcccctttagtactgtatccaagcaggacctggctgctttcgaacggatcgtgcctgggggtgtggtcacagaccctgaagcactccaggctccgaatgttgactggctgcggactttgagaggctgtagcaaggtattattacggcctagaacgtccgaggaggtgagccacatactcagacactgccatgagaggaacctcgctgtaaatccccaggggggtaacacgggcatggtggggggtagtgtacccgtgtttgacgagattattctgtcgacagctagaatgaatagggtgctgtcttttcatagtgtcagcggcatcctggtctgtcaggcaggttgcgtactggaggagctgagcagatatgttgaggagcgggattttataatgccgctcgacctgggcgcaaaaggctcctgccatatcgggggaaacgttgcaaccaacgctggcggactgcgattcctgagatatggctccctccacggcaccgttctgggcctggaagtcgtgttggccgacggaactgtgctcgattgtttgaccagcttgcgcaaggacaatacaggctatgatctgaagcagctgttcataggctcagaaggcactctgggcatcataaccacagtatcgatcctgtgtcccccaaagccaagggctgtcaacgtggcgtttctggttacatgtgtaccaccggcttgtggtcccggaagcccacggccagctaggttaccacaccccgcactgaggactcccggattacgccaggaatccctggcctcctcttgccatgctcacgtgtag

SEQ ID NO: 220026 - DNA, 426 bp, Artificial Sequence
  Description of Artificial Sequence: Synthetic coding sequence
atgctgtgggcccttagagaacgcatcactgaagcattatcccgcgatggctatgtgtacaagtacgacttaagcctgcccgtagagcggctctatgatatcgtaactgatctccgggcaaggctggggccacacgctaagcacgtcgtgggatatggacacctcggcgacggcaatctgcacttaaatgtgactgccgaagccttttcacctagtctgctagccgctctcgagcctcacgtgtatgaatggactgccggacagcagggtagcgtctctgcagaacatggagtcggtttcaggaaacgtgacgtgttaggctatagtaagccccctggtgctcttcagctaatgcagcaattgaaggcccttttagaccctaaaggcattttaaatccctacaagaccctgccctctcaggcctag

SEQ ID NO: 220027 - DNA, 609 bp, Artificial Sequence
  Description of Artificial Sequence: Synthetic coding sequence
atgtctttccctcccttgtggcctacacgccatgtgccggcttcgcaccccacttgcccactgcttcctggcccttgttgttgtccacattgtctctgtgattctgctccacccagcctcccttgtccgaccttagtgcagggcgcttcaagaccaatactgattttgcgagccttcccgggtccttgtcactcagttccttgccatgacttaaagctgcaagtgggagcatctccctttcggcatggttgcccaccaagcgtgcgttgtccatcaagactgatagccggtgtgcccggttgttcagtgttatcatggtcattgggccatagcctgagtggtattgattctagggtgggcgctacccctggtctgggccactccctctcctgggttcgggctcctcccggtctgggacacagcctgagcggtgtgggagccacccctgggcttgggcacctcctatctggggtcggcgcatcaccaggcgaagacaccgaacatgctgccgctctgacaccttgtggcgtgcctcctgttccgggatgtcgctctcatagccagcctctgtctcacttagtgtctagcagccggtgttgtgggccttag

SEQ ID NO: 220028 - DNA, 849 bp, Artificial Sequence
  Description of Artificial Sequence: Synthetic coding sequence
atggcgttgtcctgcagttcctggtgtagaagtccacaatggaagttcgaggcatctaagtcacacgccaatcatcgccctatctgtctttcgcccagaatctggcccggaagcgcaagcgccaccagcaccgtgtgcagctcttcagagtcctttttaccccgaggtccacccgctgtgtcgctgctgctacatggcccacccactgtgagttttccaccaccctggcctacccatcacgtgcttccttcaccagtcgcccatcctccgtgtccctgcttgcctcctgatatgcctctggagctcccaggtccatgctgctgtccacactgtttatgcgatagcgctccaccatccctgccgtgccctacattggttcagggagccagtcgccctatcctcattttgcgggcttttccagggccttgccattcagtcccatgtcacgaccttaagctccaggtgggggcaagcccattcagacatggctgcccaccaagtgtgcgatgcccctcccggttaattgccggagttcctggttgttccgtattgtcctggtctttggggcattctctgagtggcattgattctagagttggagccactcccggactgggacattccctgtcatgggtgcgggcacctccgggactaggccattccttgtcaggggtgggcgctacccctgggttggggcatctgctgagtggcgttggcgcaagccccggagaggacacagagcatgccgctgctctcacgccctgcggggtcccaccggtgccgggatgcagatcccattcacagcctctctcccatctggtgagctcatctaggtgctgtgggccttag

SEQ ID NO: 220029 - DNA, 1245 bp, Artificial Sequence
  Description of Artificial Sequence: Synthetic coding sequence
atgggcggtctatctgcgaggccaacggctgggcgaactgatcctgctgggacctgctggggtcaggatcccggtagcaagatggccactgtgattccaggtcctctgtcactcggtgaagatttctatagagaggcaattgaacattgccgttcttataacgcacgcctatgtgccgaaagatccctccgtcttccatttctggatagtcaaaccggcgtcgcgcagaataattgctacatctggatggaaaagacccatcgaggccctgggctggcgcctggacaaatttacacctatcctgcacgatgttggcggaagaagcggagactgaatatcctcgaagaccccagattaagaccttgcgaatacaagattgactgcgaggctccattgaagaaagagggcggactgcccgaggggcctgtgctggaagcactcctgtgcgcggagaccggcgaaaagaaaatagaactgaaggaagaggagactataatggattgccagaaacaacagcttctggagttcccacacgatctcgaggtggaagacctcgaggatgacatccccagacgcaaaaaccgggctaagggaaaagcttacggtatcggcggactcaggaaaagacaggacactgccagcttggaggaccgagataagccctatgtgtgtgacatatgtggcaagaggtacaaaaaccgccctgggttaagttaccactatacacacacacacctcgcagaggaggagggggaggagaatgccgagcgacacgcgctccctttccatcgcaagaacaaccacaagcaattttacaaggagcttgcctgggttccagaggcgcagagaaagcacaccgccaagaaagctcctgacggcacagtcatccccaatggctactgtgacttctgcttgggcggatccaagaaaacgggctgccctgaagatcttattagctgtgcggattgtggacggagtggtcatccgtcgtgtttgcagttcacagtcaatatgacagcagcggttcgcacttaccggtggcaatgcatcgagtgtaagtcctgctccctgtgcggaacaagcgagaacgacgatcagctgcttttttgcgacgactgtgaccggggataccacatgtactgcctgtccccacctatggctgagcccccagaaggctcatggtcatgtcacttgtgtcttaggcacctgaaggagaaggcttctgcgtacatcactctgacctag

SEQ ID NO: 220030 - DNA, 1074 bp, Artificial Sequence
  Description of Artificial Sequence: Synthetic coding sequence
atggccaccgtaattcataacccccttaaagcactcggcgatcagttctacaaagaggctatcgaacactgcaggtcctacaactcccgcctgtgtgccgagaggtcggttcgcctgccattcctcgactcccagaccggagttgcacagaacaactgttatatctggatggaaaaacgacacagaggacctggcctggcaccaggccagctttacacgtatcccgcacgctgctggcggaaaaaaaggagactgcacccaccggaggatcccaaactgcgcctgcttgagatcaaacctgaggtggaactgcctctgaagaaagacggcttcacctctgagtcgacaactttggaggccctgcttcgtggcgaaggcgtcgaaaaaaaggttgacgccagagaggaggagtccattcaggagattcagcgtgtccttgaaaatgatgagaacgttgaagaaggaaatgaggaagaggacctagaggaagacataccaaaacggaaaaaccggactcgaggacgcgcacgaggatctgccggagggaggagaagacacgacgctgccagccaggaggatcatgacaaaccgtacgtgtgcgatatctgcggtaaaagatacaaaaacagacccggattgtcttatcactatgcccatacgcatctggcctccgaggaaggtgacgaggcgcaggatcaggagacccggagtccccctaaccataggaatgaaaaccacaggccacagaaggggccagatgggactgtaatccctaacaactactgcgatttttgcctggggggaagcaatatgaataagaaaagcggcaggccagaggaactggtctcatgtgctgactgcggtcgctcagcacacctgggtggagagggtcgtaaagaaaaagaggccgctgccgctgcgaggacaaccgaggacctctttgggtccacatcagaatccgatacgagcacttttcacggcttcgatgaagatgacctcgaggagcctaggagctgtaggggaaggagatccggaagaggttcgccaactgccgataagaagggctcctgttag

SEQ ID NO: 220031 - DNA, 999 bp, Artificial Sequence
  Description of Artificial Sequence: Synthetic coding sequence
atggaaaaaactcacaggggcccaggacttgccccaggacagatttatacgtacccagccaggtgctggcgaaaaaagcgccgtctcaacatacttgaggatccaaggctcaggccatgcgagtacaagatagattgcgaggccccactgaaaaaggaaggcggactgcccgaagggcctgtgctcgaggctcttctctgcgcggaaactggtgaaaaaaagatagaactcaaggaggaggagacgataatggattgccagaaacagcagctgctggagtttccacacgatctggaggtggaagacttagaagacgacattccacggagaaagaaccgggctaagggtaaggcatatggcattggcggattaagaaaaagacaggacacggcctccctggaagaccgcgacaagccctacgtttgtgacatttgtggcaagcggtataagaaccggccaggactgtcctaccactacacgcacacacaccttgcagaggaggagggtgaagagaatgcagaaaggcacgctctgcccttccacaggaagaataaccataaacagttctataaggaacttgcctgggtcccagaggcacagagaaaacacacagcgaaaaaggcccctgacggaaccgttatcccgaacgggtattgcgacttctgtcttggtgggagcaaaaagacaggctgtcccgaggacctgataagttgcgccgactgcggacgtagcgggcatccttcgtgcttgcagttcactgttaatatgacggccgcagtcagaacctaccgatggcagtgtattgagtgtaaatcttgttcgctctgcggtacctcagaaaatgacgaccagctgctcttttgcgacgattgcgaccgaggctaccacatgtattgccttagtccgcctatggccgaaccgcctgagggctcttggagttgtcatctgtgcctacgacatttgaaagaaaaggcttccgcgtatatcacattaacatag

SEQ ID NO: 220032 - DNA, 1143 bp, Artificial Sequence
  Description of Artificial Sequence: Synthetic coding sequence
atgggtggtctctcagcaagacctaccgcagggcgtactgatcccgctggtacatgctggggacaagatcctggctcaaagatggctactgtgattcccggacccctttctcttggcgaggatttctaccgcgaggctatcgaacattgtaggtcctataacgctaggctgtgcgcagagaggagcctgagattaccttttctggatagtcagaccggagttgcccagaataattgctacatctggatggaaaagacccaccgtggcccaggattggctccgggacaaatttacacctatcctgccaggtgttggagaaaaaagagacgactgaatatactggaagatcccaggttgcgcccatgtgaatacaagatagattgtgaggcccctttaaagaaagaaggcggattgccagaaggtcccgtcttagaggcactgctctgtgccgaaaccggagagaaaaagatagagctcaaggaggaggaaaccatcatggattgccagaagcaacaactccttgaattcccccatgacctagaggtggaggatctcgaagacgacatcccaagaaggaaaaatcgcgcaaaaggcaaggcttacggtataggcggtctcaggaaacgacaagacaccgcttctctcgaggatcgggacaagccctacgtgtgtgacaagttttacaaggagctggcctgggtgcccgaggcgcagcgtaagcacacagcgaaaaaggcgcctgatggcacggttatacccaacggctattgtgacttctgcttggggggttcgaaaaaaactggatgccccgaggatctaataagctgtgcggattgtggcagatccggccatccctcctgcctgcaattcacagttaatatgaccgccgcagtgaggacgtaccgatggcagtgcatcgagtgtaaaagctgctccttatgcggtacgtcagagaatgatggagcgtcttgggcgggactcacacctcaggatcagctcctgttctgcgatgactgcgaccgcggataccatatgtattgtctttcaccacctatggccgagcctcccgagggaagttggagttgccatttatgccttagacaccttaaggagaaagcctctgcttacattactttgacatag

SEQ ID NO: 220033 - DNA, 612 bp, Artificial Sequence
  Description of Artificial Sequence: Synthetic coding sequence
atggcgacggcaatccagaatcccctgaaaagcttaggtgaggacttttatcgggaagcgatcgagcactgtaggtcctacaatgcgagactgtgcgccgaacgaagcctcagactgccgtttttggactcacagacaggtgtagcacagaataactgttacatctggatggaaaagacccaccgaggacccggactcgcccctggacagatctacacttaccccgcaaggtgctggcgcaaaaagagacggttgaatattctggaagacccgaggttgcgaccctgcgaatataaaatcgattgtgaggcaccattaaaaaaggaggggggtctcccagagggtccagttcttgaagccctgttgtgcgcagagactggcgaaaagaagatcgaactcaaggaggaggagacaattatggattgtcagaaacagcagctgttggagttcccccacgatctcgaggtcgaggatctagaagacgacattcctcggagaaaaaacagagccaagggaaaagcttacgggattgggggtctgaggaaaagacaggacaccgcttcactcgaggatcgagacaaaccctacgtgtgcgacagcgagtcattctag

SEQ ID NO: 220034 - DNA, 1245 bp, Artificial Sequence
  Description of Artificial Sequence: Synthetic coding sequence
atgggagggctcagcgccaggccaacagccggaaggaccgaccctgctggcacctgctggggccaggacccgggatccaagatggccaccgtcataccaggcccactctccctgggagaagatttctatcgggaagcaattgagcactgccgtagctacaatgctaggctgtgcgcggagcgcagtctgcggcttccttttctggatagtcaaacgggcgtggcccagaataattgttacatctggatggagaagacccacaggggaccaggcctggcccctggacagatctatacatatccagcccgatgttggcgtaaaaagcgccgtttgaacatcctcgaggaccctagactgagaccatgcgagtacaagatcgactgtgaggccccattgaagaaagagggcggtctgcccgagggcccagtcctggaggcactgctgtgcgccgaaactggggaaaagaaaattgagcttaaagaagaggaaactattatggattgtcagaaacagcagcttcttgagttcccgcacgacctggaagttgaggacctagaggatgacatccctaggcgtaaaaacagagccaaggggaaagcatatggcattggaggactcaggaaaagacaggacacagcctccttggaggacagggacaaaccctacgtatgcgatatctgcgggaagcgatacaagaaccgacctgggttgagctaccattacactcacacccaccttgcggaggaagaaggggaggagaacgctgaaaggcacgctttgccattccatagaaaaaacaaccacaaacagttttataaggaactggcgtgggttccagaagcacagcgcaaacacaccgcgaagaaagcaccggatggaaccgttatccctaacggttactgtgacttttgcctgggcggatctaagaaaacaggctgccctgaagacctcatcagctgtgctgactgtggaaggagcggccacccatcctgcttgcagttcactgtgaatatgaccgccgctgtgcgcacatacagatggcagtgtattgagtgcaaatcttgttcattatgcggaacgtccgaaaatgatgaccagcttcttttctgcgacgactgtgaccgaggctaccatatgtattgcctgagtcctccaatggccgaaccccctgagggatcatggtcttgtcatctatgtctcagacatctcaaagaaaaggctagtgcttacatcacactcacttag

SEQ ID NO: 220035 - DNA, 1167 bp, Artificial Sequence
  Description of Artificial Sequence: Synthetic coding sequence
atggccacagctatccaaaatccgctcaagtccttgggtgaggacttttacagggaagcaattgagcattgcagatcttacaatgcacgactatgtgcagagcgctccctgcggctgcctttccttgattcgcagactggagtggcgcagaacaactgctacatctggatggaaaaaacacacagaggaccagggctcgccccaggtcaaatatacacttatccagctcggtgttggcggaagaaacggagactgaacatcttggaggaccccaggttgagaccgtgcgaatataaaattgattgtgaggctccgttgaaaaaagaaggaggattgccagaggggccagtcctggaggccttgctgtgtgcagaaacaggcgagaaaaaaatcgagcttaaggaagaggagacaattatggactgccagaaacagcaactgcttgagttcccccacgacttagaggtggaggaccttgaagacgatattcctcggcgaaagaaccgtgcgaaaggcaaggcgtacggcattgggggacttcgaaaaagacaggataccgcttctttggaggatagggataagccttacgtctgtgacatttgcggcaagcggtataagaatcgaccaggtttgtcttatcactacacccacactcacctggccgaagaggaaggggaggagaacgcagaacgccacgcgctcccatttcatagaaaaaacaatcacaaacaattctacaaggaattggcttgggttccggaagcccagaggaaacacacagccaaaaaggctcccgacgggacagtaattccaaacgggtattgcgacttctgcctaggaggctcaaagaagacaggctgtcccgaggatttaattagctgtgcagactgtggcaggagcggccacccgtcttgcctccagtttaccgtgaacatgactgctgccgtgcggacatatcgctggcagtgcatagagtgtaagtcctgtagcctgtgcgggacgtctgagaacgacgaccaactgttgttctgcgatgattgcgacagaggctatcatatgtactgtctgtcacccccaatggctgagcctcctgaagggtcatggtcttgtcatctgtgtctacgacacctgaaagagaaggcctccgcttatatcaccctcacgtag

SEQ ID NO: 220036 - DNA, 1176 bp, Artificial Sequence
  Description of Artificial Sequence: Synthetic coding sequence
atggccgcagtggtagaaaacgtcgtaaaacttcttggagaacagtactacaaagatgcgatggagcaatgtcacaactacaatgcgaggctctgtgctgagcgcagcgttaggctgccctttctcgattcccagacgggtgtcgcacagtccaattgttacatctggatggagaagcggcataggggccctggactggccagcggccaattatatagttatcccgcacgcaggtggcggaaaaaacgacgggctcacccccctgaagatcccaggctgtccttccccagcatcaagcctgacacagaccaaactctcaagaaagagggactgataagccaggatggcagcagtctggaggccctgctaaggacagatcccctcgaaaagagaggtgcccctgatccccgtgtagacgacgactctctgggagagtttcccgtgacaaactctcgagccagaaaacgcatcctggagcccgacgattttctcgatgacctggacgacgaggattacgaggaagatacccccaagcgacgcggaaagggcaaatcgaaaggcaagggagtgggctctgctaggaagaaattagatgcaagtatcctggaagaccgggataagccatacgcctgtgatatatgtggaaagcggtataagaaccgccctgggctttcataccattacgcccattcacacctagccgaggaggagggagaagacaaggaagattctcagcctccgacaccagtgagccagcgctcggaagagcagaagagtaaaaagggccctgatggcctggccctgcctaataattactgtgacttttgtcttggcgactctaaaataaacaagaagaccgggcagcccgaagagctcgtgagctgtagtgactgtgggagatccggtcacccttcttgccttcagttcacacctgtcatgatggcagctgttaaaacgtaccggtggcaatgtattgagtgcaagtgctgtaacatctgtggcacttctgagaacgatgatcagttgcttttctgtgatgattgtgatcggggatatcatatgtactgtctgactccgtccatgagcgaaccccctgagggaagctggtcatgtcatttgtgtctagatttgctgaaagagaaggccagtatctatcaaaatcagaattcaagctag

SEQ ID NO: 220037 - DNA, 1134 bp, Artificial Sequence
  Description of Artificial Sequence: Synthetic coding sequence
tcatctattattcagaaccggctcaaaaagctcggagaccagttctataaagaggcgatcgagcactgccgctcttacaatagtagactgtgtgctgaaagatcagtgagactgcctttcttggattcacagactggggtggctcagaacaactgctacatctggatggaaaaacgccatcgtggcccagggctcgcacccggacagttatacacttaccccgctagatgttggcggaaaaaacggaggttgcacccgccagaggacccaaagctacgcctactggagatcaagccggaggtcgaacttccattaaaaaaggacggttttacttccgaatcaaccacattggaagccctgctacgaggggaaggggtggagaagaaggtcgatgccagagaagaagaatccatccaggagatccaacgcgttctcgaaaatgatgaaaacgtggaagaaggaaacgaggaagaagatctagaggaagacattccaaaacggaagaacagaacacgcggtcgcgctcgcggttccgccggaggtaggcggagacatgatgcagctagccaagaggaccacgacaaaccctatgtgtgtgacatttgcggaaagaggtacaaaaacaggcccggactgagctaccactatgcccacacccacttagcttccgaggagggagatgaggcgcaagaccaggaaactcggagccccccaaaccaccgaaacgaaaatcatagacctcagaaaggtcctgatggaacggttatacccaataattactgcgatttttgcctgggcggttctaatatgaacaaaaaatcaggccgtcccgaggaactggtctcttgtgccgactgtggccgtagcggccaccctacttgtcttcaattcaccttgaacatgactgaagcagtcaaaacctacaagtggcaatgcattgaatgtaagtcttgtatcctgtgtggcacttctgagaatgacgatcagctgctcttttgcgacgattgcgacagaggataccacatgtactgtctaaatcctcccgtggctgagccacctgagggatcttggtcatgtcatctctgttgggaactgttgaaagagaaggcgtccgcgtttgggtgccaggcttag

SEQ ID NO: 220038 - DNA, 1074 bp, Artificial Sequence
  Description of Artificial Sequence: Synthetic coding sequence
atggcaactgttattcataatccacttaaggccttgggggaccagttttataaggaagcaattgaacattgtcgttcctataacagtagactgtgcgctgagagatccgtgaggctgccatttttggactcacagacaggcgtcgcccagaacaactgctacatatggatggagaagcgtcaccgcggacctggtctggcgcctggccagctttacacttaccccgctcgatgctggaggaagaaaaggcggttgcaccctcccgaagaccctaagctgcgtctattggagatcaagcctgaagtggagttgcctttgaaaaaggacggctttacttccgagtccacaactctggaggccctcctgcgcggtgaaggcgtcgagaagaaggttgatgcacgggaagaggagtcgatccaggagatccaaagggtgctagagaatgatgaaaatgtggaagaggggaacgaggaggaggatctggaagaagacattccaaagcgaaagaacagaaccagaggcagagctcgcggttcagcaggaggtaggcgtcgacacgacgcggcaagccaagaggatcatgacaagccctacgtgtgcgatatatgtggaaagaggtacaagaacagacccggattgagttatcattatgcacatactcacctggctagtgaagaaggtgatgaggctcaagaccaggagacacgatctccacctaaccaccggaacgagaatcaccggccacagaaaggacccgatggaacagtgatcccgaataattattgtgacttttgcctggggggttcaaatatgaacaagaagtccggaagaccagaggagttagtgtcgtgtgctgattgtgggcgaagcgcccatttgggcggtgagggcaggaaagaaaaagaggctgccgctgccgcacgcaccacagaggaccttttcggctctactagtgagtccgacacatctacgtttcacgggtttgacgaagatgacctggaggaaccaaggtcatgccgagggaggcgatccggccgaggctctcctacagctgacaagaagggttcctgttag

SEQ ID NO: 220039 - DNA, 1137 bp, Artificial Sequence
  Description of Artificial Sequence: Synthetic coding sequence
atggcaactgtcattcataacccccttaaggccctgggggatcaattttacaaagaggccattgagcactgtcgatcgtacaatagtcgcctttgcgccgaacggtccgtgcgtctgccatttctggactctcagacaggagtggcccagaataattgctatatctggatggagaaaagacacagagggcctggacttgccccaggccagctgtatacgtaccctgcccgatgttggcggaagaaaaggcgccttcatcctcctgaggaccccaaattgagactcctggagatcaagccggaggtagagcttccactgaaaaaggacgggtttacatccgagtcaacaaccctagaagcattgttacggggtgaaggggtagaaaagaaggtagatgcaagagaggaggagtctattcaggagatccagagagtcctcgaaaacgacgaaaacgtggaagagggaaacgaagaggaggacctggaggaggatattcctaagagaaagaaccggacacgagggcgagcaaggggtagtgcgggaggacgcaggagacacgacgccgcaagccaggaggaccatgacaaaccctatgtgtgtgacatttgcgggaagaggtataaaaatcggccaggactctcgtaccactacgctcatacccacctggcctccgaagagggggatgaggctcaagaccaggagactagatctccaccaaatcacaggaacgaaaaccatagaccacaaaagggaccggacggaaccgtgatcccaaataactattgtgacttttgtttgggtgggagtaacatgaacaagaagagtgggcgaccagaggaactcgtgtcatgtgctgactgcggtcggtctggccaccccacctgcctgcagtttaccctcaatatgaccgaagctgttaagacctacaaatggcagtgtattgaatgcaaatcgtgtattctttgcggcacatctgaaaacgacgaccagttattattttgtgatgactgtgatcgagggtatcacatgtactgcctaaatccccctgtcgcagagccaccagagggcagttggagctgccatctgtgctgggagctgctcaaagagaaagcctctgcttttggatgtcaggcctag

SEQ ID NO: 220040 - DNA, 4110 bp, Artificial Sequence
  Description of Artificial Sequence: Synthetic coding sequence
atgagcccatgtggtagaaagatgggcgagggaagacagcagcgtcgtgccccagtgggtaaactcctgctgctacccggacgcagggatactccacacgggagaagcggctcctctggtgcgagaacccagcgtagcctgctgtggctgctcgtacatgtgtggctgtgggcagcgagtggaagctctgcccagctcttcaaccttacgctgtcagtggatgagggtctgcctcctgatacactggtgggggatatacgggcaggtttgcctgccgctcaacagcaagagggaagcggcttttttctctctgaggattctgatgactcccctctgttggatgatttccacgtccacccggacacaggtatcatccgaacagctcgtaggctggaccgggaaaggagagatcactatagttttgttgccgctaccctgctgggggcagtggttcaggtggaaattcgggtgaatgatgtgaacgaccatagcccaagattccctctcgactctttgcagctggacgtgtctgaactgtctccacctggcacagcatttcgcctgccagtggcccacgatccagatgcagggctcttcagcactcaaggctacacccttgtccagcctagcgacctgcccaaggacccggcaggacccttctttcaacttagataccggacaccaggaccccttccgtctccattgctcccaggcagctcttcgccattagagcccttggatttggtgctccttcgaagactggaccgggaagaggccgctgctcacagattacaaatcgaagcctgggacggaggcaggccacgcagaactggcttactgtccgtggaactcagggtcctcgacgaaaatgataatcctcccgtctttgaacaagacgagtatcgagccgctgtgagggaggacgcacagccaggcgctgaagtatgccgggtgagggctaccgaccgagatctcgggccaaatggtttcgttcggtactccgttagagcacggcaggtgcccggagcagggtctggtgggggtgctctgggcgacgcagcatactttgcagtggaggagctctccggggtggtacgggtatggcggcctctggatagagaggcacaggcatggcatcaactcgtagtagaggctcgtgacgggggagccgaacctgaagtggctacggttcgggtcagtatcgccgtactcgacgttaacgacaacaggccagctattcacgtcttgtttttgaccgaggggggtgtggccagagttagcgagggggcaaggccgggagactatgtggctagagtctctgtgtctgacgctgacggcgactgggaaaaggaggatgaagccaccggtgagcttggtgtcggactcggagatggtagcattagcctgtcccttgagggaggggagggtgacttcgcactgctgcctggaggcccaccaggagtttttttcctgtgtgtggagggacccttagacagggagtctagggatctgtatgaactgctattagttgctactgatgccggatctccccctttgagtacagaagagactctgctgttgcgagtggcagatttgaacgatcagccccctctgttctctcaacagcactataaagctagcgttagcgaagcggctgcacctgggacagtggtgatgtgggtttcggccagcgacgctgatgaagcgggttcggaccacgcttggctccggtataccgtggtgcagctgtcggcgccttgtaacctgggcagccttcagtccaagatggtgcacactgccgagtgcggtccatctttcgccatagacagtgaatctggtgcaatatctacaatccgcacactggatcgggaggtccaggaagccgtagagctcaaagtcgttgcccaggaccttggagaaccacctcttagtgccacctgcttagtaagtatcaccgtggatgatgtcaatgataatgagccaatcttttggaggcaagtgtataacgcgacaattgctgaacatgcacctgtaggacactgcttcctgcaggttaccgcatctgacgcggactcagggctgtacggcttcattgaatacagtctatacgatggatttctgtcgtatgaggcccctcaagcatttagaattgacccacacgacggtcaaatatgtgtctcccaagacatcgacagggagcgcgatccagcgacatacgatctgcttgttgaagcaaaggatggcggtggtctgagcgcacaggcctttgtgcgcgtggatctggaggatgtgaacgacaatcatcctgtgttcaatcctagtacctatgtgacgtcaatcagcgatgaaacccaaccgggaacagaaattatcaacgtgctcgctaccgaccaggactctggaatctacgggaccgtggcttacgaacttataccgggaaacgtatccagcctgtttactatcgatagcaccaccgggatcatctatttgaccttgcctctcagccatctggagtctaccactctgtccctcatggtttctgcgcaagatggtgggggacttacagcagtcattaatgcagatgtgacgattcacatattccagacgacactcgcccctgccgagttcgaacggccaaagtacaccttcctggtgtacgaagacgtgcctgaagatagcccaatcggcactgtgaaagccagagaaccgcttaattcttcagagcccattttttacaggataagttcaggggatctaggtggcaagttctccatccacccccgtctggggaccatccgcacccgtaagcctttggaccacgaaacacagcccgtcgtggtcctcaccgtgcaggcacaactaggatctgcccctgcatgcagctctactgaggtgaacatcaccgtgatggacgttaacgacaaccaccccgcttttttgaggaccagcgacgagattcggatttctcagaccaccccaccagggacagctttatatctcgccagagcagaggaccgggacagcggacgtaacggtcttattagatacagtatagcgagtccccaacccggagtgtttgctatagatcgggctcttggggtgctgttcctgaacgggtccctcggcgcaggagagcaacgagaactgactctgactttgagagccgaggaccaaggagtacatccacaggctgctctacttgtgttgacagtagtcatcgagaaaagggagcacagtccatcctggacatttgaacatctggtttaccaggtagaggtgtctgaaagtctgtccccaatgactcagatgctacagacccaagctcacccccttgggcctcagcgagccgcatcccctctacggtactccctggagccatccgttgattccgctatgtttggaatccggccatacacaggttggatctaccttaggagacagttcgactatgagtccacccaaacttacaattttcgcgtgtttgcttggatacctgaggacggattcctgcagaatgtgagcactaccgttatagtccgagtctgggatgagaacgacaattcacccactttcctccacgatgtcctgtttctaaaagtggaggagtctcctgtcccccaaggcgtaatagggaagattaccgctatcgacatggactccggcaagaatgggcagctactctattttctgttaagcgacggaaaatttttcaagatgaatcccaacaccggggagcttatcaattgggtggccctggacagagaacaccgtggacatcatgagatgaccgtgctggtgacggatcgtggatcccctcccaggaacgctacaatggccgtgtacgttagcgtgactgacattaatgataatcgtcccttctttccacagtgcttacccggaaaggagcttcacgtcaaggtcctggaagggcagcccgttaatatgcttgtgactaccgtctttgccaaagacccagatgagggtaataatgctgaagtcacctattcggtttcttccgctaggccaatgccactgaaaggcaaaactgccttcgggaagcaaagttgcaaaaagcagacaaataaacagaccaataagattttgacttag

SEQ ID NO: 220041 - DNA, 8750 bp, Artificial Sequence
  Description of Artificial Sequence: Synthetic coding sequence
atgaggctggatgagatcaccaaatccgaaaacgaggacggagaaaaaaagatgttcacacagcagttcgagtcaacagacgcctgcgtgtatgaggtttatgttaaaattaattctatagttaaatcacagagtcagtgtggacttaagagggggtctcccgaaaccgaattgtggggcgcaattgttttccgctcccaggaagagaacgcaaagcccgtcaaagagacagaggtcaccgcttccgatgccgactccggactgtatgggtttatcgagtattccctgtatgatgggttcttgagttacgaggctccgcaagcattccgaatcgatccccacgatgggcagatctgcgtaagccaagatatcgatcgggaacgcgaccctgctacttacgacctgctcgttgaggccaaggacggggacgaacagcggatgacccacctggccctggtgaaagggggactctccgcccaagccttcgtccgggtagacctggaggacgtgaatgataaccacccagtgtttaatccttctacctatgtgacttccattagcgatgaaactcagccaggtaccgaaattatcaacgtcttagctacagatcaggactctggcatttacggcacagtggcctacgagctgattccagggaatgtcagttcgctctttacaatcgatagcacaaccgggctgtacagccctgaagtggagatcctctctgctgtgaatttcagcgcagacaaggaggtgatgaactcgcttgaaatgtttctcccattacttagacattttaaaaaagttgagcgcgatgaggaagccgcagaaaaaaagttcgaagctagcagggggtggtttatgcgctttaaaggcaggcgccatctccactacctgaaggtccaggatgaagccgctagcgccgatggtgaggccgcagccaggtatgtagctaatctggcgaagatcctgggagaggggattatttatctcacattgcccctgagtcacctggagagtaccactctaagccttatggtttctgcccaggacggcggtggcctaaccgccgtgatcaatgccgatgttaccatccatattttccagactacactagcccctgccgagttcgagaggcccaaatacacttttctggtatacgaagacgttccagaggattcccccataggcactgtgaaggctcgtgagcccctcaacagcagtgagccaatcttttaccgcatctcttcaggcgacctcgggggaaagttctcaattcacccacggcttgggactatcaggactaggaagccactagatcacgagacccagcccgtggttgttctgacagtacaggcccagctgggatcagctccagcatgttccagcaccgaggtcaatataactgtgatggatgtcaatgataatcatcctgcgtttctccggacatcagatgagatccgcatctctcagacaacccctccaggcacagccttgtaccttgctagggctgaggaccgggacagcggtaggaatggattgatacgttatagcattgcgtccccccagccgggagtcttcgccattgatagagcgctgggagtcctgttcctgaatggatcgctgggagccggagaacagcgggaactcacgcttaccctgcgcgctgaggaccagggcgtccacccacaggccgcactgctggtcttaactgtggtgatcgaaaagagggagcattcccctagttggacatttgaacacctcgtctaccaggtcgaagtaagcgaatctctgtcacctatgacccagatgctccagacacaggcgcatccattggggcctcagcgggctgcgagcccacttaggtacagtctcgagccttccgtggactcggcaatgttcgggataagaccctataccggatggatataccttaggagacagttcgattacgagtccacccaaacatataactttcgagtattcgcttggattcctgaggatgggttccttcagaacgtgagcacgacagtgatagttcgcgtgtgggatgagaatgataatagcccaacattcctccatgacgttttgtttttgaaggttgaagaatcgccagtgccacaaggggttatcgggaagatcactgctattgacatggactcagggaaaaacggccagctgctgtactttctactttcggacggaaaatttttcaaaatgaacccgaatacaggtccggcaggcactatctacgtgattacctgggcggatggcgctgccgcattctcaggtaccgactttgccttctcaagtgatgagctgcaggctttcgtgttgaagagtttattctgtgaactgggtgaaggcgagttgattaactgggtcgcgcttgaccgcgagcacaggggtcatcatgagatgactgtccttgtgacggacagaggatcgccccctagaaacgcaaccatggcagtgtatgtgagtgtgaccgacatcaacgataatcggccattctttccacagtgcctgcccggaaaggaactccatgtgaaagtgttagaagggcaaccagtgaacatgctggttaccaccgtttttgcaaaggatccagatgaaggtaacaacgcagaggtgacatattcagtatccagtgaggacagcagtgatcactttaaaattgatgctaacaatggtgagatccgtactacgacaatcctgagctacgattatcgtccatcttatcgcatgagtgtgattgccactgaccaaggggtcccccctctgcagggacaggcagttgtcaatatccaggttatccctctgagtaaggggcgagcgattatgagccagaatatcaggcacctcattattcctgagaacctgaaacccaccaagattatgtcgctcattaaatcttctgaccatctgcagcaacactacaacggcaagttgcatttttccatcgtggccgacgacaaggatggacacttcgagattgactcttcaacaggggacttgttcctatccaaggagttggactacgaaaccactagccattatctgtttagagtgataaccactgaccattcgaagaatctctccctgagttcgacagtcttcctgagcatcgacgttgaggaccagaatgatcatagcccatcattccaggatgagttgatcgtgatttccgtcgaagaaaacgtgccaataggcaccttagtgtatgtatttaacgctaaagatgacgatgggtctttcttgaacagccgaatccagtattacatcgaatcccataaccccggaactaatccttttctcattcacccctctttcggtaccctggtcactgtgagcaggctggaccgtgaaagcatacctacagtcatcctcactgtgactgcctccgatcaggcagttaacgtgacggataggcgactgcggtcactgacagcacagatcgtcatccttgacgttaacgaccataatcctacattcattagctttcctaatgctcacgtgaaggaggatgttaccgtaggctccctcgtgcatcatattacagcccacgaccccgatgaaggccgtaatggtaaggttacatactcaatacttagtggcaatgaaaatatgacttttatgttggatgaatcctcaggcctgctaaccacaacctgccccctggactacgagatgaaaacacagcatattctgaccgtactggccctggacgatggtacacccgcactgagctcatctcaaacccttaccgttaccgtgttggatgtcaatgatgaggcccctgtattcaaacaacacctgtatgaagccagcgtgaaggaaaaccagaatcccggagaatttgtgacccgcgtggaggcattggacagggactctggcgtcaacagcaagctgcagtttgaaatcatgcctggagcaagtttcgaactctttgagattaactctgacacaggagaagtggtgaccaccacgatactggatcgggagatccaggaggtgtttacgctcagggtcttggtgagagacggcggtttcccaagcttatcgagtacgaccacaatcctctgcacagtggaggacgagaacgaccacgcccctgagtttatcgtgagttcctatgatatcgaagttcttgagaatcaggagccagaggtcgtatatactgtgctggctagcgatatggatgccggaaataatcgagccgtagagtaccatatcatcgacggcaacaccgacgagtgtttcacaatcaacgagatgtccggggagttatcaactacgagggccttggaccgtgagcagatctccaactttaccctcgtgatactttgcagcgacctgggtgatccccctagatccagcgttatccatctccaggtccgcgtcctggacgccaacgatcatagccctagctttccaaccctctattatcagtccagcgttcgcgaagatgccgaagttggcaccgtggtcctagtgctatccgctgtagataaagacgaagggctgaacgggcagaccgagtactttctgactgatgaggcatccggggctttcacaattgaccctatgtctggaaccctgaaaacctctaacaccctggatagagaggcccgaagtcagcatacattctctgctgttgccagggactgctcaatccaagggtcccgaagtacaactgtgattattaaagtttacgtaactgacgtaaacgataacgatcctgtattggagcagaatccctttgatgttttcctgtcaccagagagccctacaaatcaaaccactgtgattgtgcgcgcagatgatttagacctgggaccaaacggcacggtcgtgttttcctttgctgaaacccaaagcatgttttctatcgacaaatatacaggtgaaatccagttccaacagaatcccagttctgaatattttccgatatggctgcaactcaaggtcacagatcagggcatacctgccaggactactacgggcctactggtcattcacatggagggtgaagacgtcaagatttccttcagccaccacctgtataagggactggtaacagagaactgtgaggccggtaccagtattgttaccgttaaggcgttcgcacccgattctattcaggacagcatgaaatactcgatcttttctggcaacgaagatggcgtgttgtctctctgttccaaaagcgggcagttgactgttaaggagccaaaatttctggattttgaggtgaggaacgaggtacagctgattgtactggctgaatcgtccggccaccgggcatactgcaaggtggctgtccttatccaggatgagaacgacaatagcccatgttttgagcagagtatctatcaagcttccgtttcagagagccagttgtacaacgcacacgtgatacaggtgtttgctaccgaccttgattccggtctgaatgggctgattgagtactccatcctgtctggcaaccaggaggaggcctttcagatagacgctctttctggcgtgatcactaccaaagctatcctcgattacgaacttacctccagctatagcctcatcgtccaagccactgataaaggaatgcctagactcagcaacaccaccgtgattaaggtgcaggttacagatatcaatgataatgcacctgccttcctcccaagcgaggctgtcgagatcactgaagacagtttaccaggtgtcattgtcacacatgtttccgtgcatgatgttgaccttaattcagcattcatctttagttttgccaaagagtctaatcccggaactaagtttgctattgaccagaacaccggtgtcgtcgtcctggtcaaaacattagatttcgaggaaatgacagagtacgaactgctgatccaaattagcgacagcgtccattacaccgaaggtgctctcgtggtgcgcgtactagacgtgaacgacaacccacccgtgtttagtcaggacttctaccaggtaacagtgcctgaaagcatcccagtgggatactctgtgttgacacttagcgcgaccgacctggagtctaacgaaaatatctcctatcggatactgtccagttccaaggaattttccattgatccaaaaaatgggacgatctttaccatctcaccagtgctgctgctggacaccatcagcaccacacaatttttagtagaggcttccgacggagggaatccggatctaagagccttaactcttgtagagattggcatcgaagatatgaacaattatgcgcctgagttcactgttaagagctataacctgtccttaagtgaagacgccctcgtgggaagtacactggtgactttctccaacatcgaccatgattggacaagggagaacacctatgtggaatactctattatctccggcaacagccagaataacttccatgtcgagacgaaattctttcatagcgaatacccttacaagcaggtgggctatttggtcttattgcattctctagatcgagaggcaagtgcttctcatgaactcgtaatcctggccagcgattccggctgtcctcccctcagcagtaccgctgtaatttccatacaggtgctggacgtcaatgataatccgcctaacttctcgagtttatcttaccacacacacgtcaaggagtcaacgcccttgggtagccatatcacagtagtaagcgctaacgatcgggataccggtagccacgctgaaatcatttataacattatttccgggaacgaaaaaggccatttctacttggaagagaacaccggagtcctctacctcatcaagccccttgactatgagaagatgactaaatttactctgacggtccaggcatccgacgctgagaagaagcacttctcattcgcagttgtgttcgtgtcagtgctggatgataacgaccacgccccacaatttatgttcagctctttctcctgtattgtgcctgaaaacctccccatcagcagtactatatgcagtataaatgcacttgactttgatgccggtccctacggtgagctgacctacagcattgtgagcccctgtttccttactcacgggatgtcctacgaccatgatctttttctgatcgaccccttgaccggcgacatccacgcaaagcaaattttggactatgaaaatggtaataagtattgcttaacggtgcaagctaaggacaaaggcgacgcaaccgccagtctggtggtatgggtcgacattgaaggaatcgatgagttcgaacctatctttacccaggatcaatattttttcaccctccctgagaagaataaagaccggcagcttattggaagagttgaggcctccgacgccgatgcaggtattgacggggtgattttgtattctctgggcacatcctcacccttctttagtgtaaataagactaatgggaacatatatctgattcgagccctgccgctcattaaaagtcagttaaacaaggaagataccctggaaatgaaaattatcgctcattcacctaaatcggactccaaatttgcctcctgcacagtattcgtcaatgtatcgttctctagcgaagggactccccttgcagtttttgcttcttccttttctatcagtcttgttgtgagctttctcgttttccttatcctgatctgcatcctgattgtcatgattctgaggcataagcagaaggacaccatcaacaactacgaagaaaaaaagacgagcagtctggatgccgatctgcgcgtgaccagggacgcttctgtactgaaggccttccagaaaacggacgactgtagcaatgaagtcgtgccagtggacgctactcccgaatggctcagtctcatctctatcatggagaaagatatagtgaacttgtacagacactctaattcttcgggacattgtagcgttgagggagaaacagcagaagacaaagagatacagaggattaacgagcatccgtaccgtaaatgctctgattctgctctgtctgatcatgagtcaagagtgccggactccggcatccccagggactccgatcagctgtcttgcctctcaggggagactgacgtcatggtcacagctgaaacagccgaggcaagtcagaccttcggagagggcgaccaaggcgaggggtgctcaactacctgcgcccagaacaacgtcctgcctcaaacagtgcagaaacgggaagcaaaggagtctatcctggctgacgtgcggaaggagtcggtctttattagcggcgaccaggaagtccgatgtgccgctcttagtactcaaacaacctcagaccacgacggtaaggataactaccattggaattacttgctgtcttgggagcctaagttccagcctctggcctcagtgttcaacgacattgccaaactaaaggacgaacatctgcatatgcccggaatccctaaagagaagaaatcattcgtgttccctccaccattgattaccgctgtagcccagcccggaatcaaggccgtgcctccacggatgcccgctgtcaacttggggcaggtaccacctaagcacccacgcagccccatcccatatcacctgggctccctccctgaaggaatgaccccaaacttttccccttccctttctctgctcactatgcaaccgccagctctgtctcctctgctgagagagggcgaactcttaggtacgcatatcagtggcacgtgtcacgaactgaaagctgaagacgaggtacagattta

SEQ ID NO: 220042 - DNA, 2130 bp, Artificial Sequence
  Description of Artificial Sequence: Synthetic coding sequence
atgagcccttgtggacgaaaaatgggcgaaggccgtcagcagagacgcgcacctgtcggtaaattactgctgctccctgggagaagggacacaccacatggtcggtctggttccagcggcgcacgaacacagcggtcccttctatggctgctggtccacgtttggctctgggctgcatctgggagctccgcccaattatttaatctgaccctcagtgtcgacgagggactgccacccgacacgctcgtgggagacattagggctggcctgcctgctgcacagcagcaggaaggctccggcttttttctaagcgaagacagcgacgacagtccacttctggatgattttcacgttcatcctgacactggtattatcagaactgcccgacgcttagacagagagagacgggatcactatagtttcgttgctgctacgttgttgggcgctgtggtacaggtagagatccgggtcaacgacgttaatgaccacagtcctcgttttccacttgatagtcttcagctggatgtgtcagaactgtctccgcctgggacagcatttagactgccggtggcacacgaccccgatgccggactgttcagcacgcagggctacaccctggtgcaaccgtccgacctgccgaaggacccagccggacctttctttcagctgaggtaccgtacaccaggaccactgccatccccactgttgccagggagcagctctcccttagagcctctggatttggtcctcttgcgcagactcgatcgcgaggaggccgctgcccaccgtctgcagatcgaggcttgggatggaggccgtcctaggcgaaccggccttctgtcagtggagctgcgagttctggacgaaaatgacaacccccctgtgttcgagcaggacgaatacagagctgccgtacgggaggatgcccagcctggcgcagaagtgtgccgcgtcagggctacagatagagatctgggtcccaacggattcgtcagatatagcgtaagagccaggcaggtgccaggcgctgggtccggcggaggcgctctgggcgatgcagcctacttcgctgttgaggagctgagcggggtggtgagggtttggagaccgctggatagggaagcccaggcctggcatcagctggtggtggaggctcgggatggcggagccgaaccagaggttgccacggtgcgggtttccatcgcggtgctcgacgtgaacgataatcggccagctattcacgtgctgttcctgaccgagggtggcgtggcacgggttagcgagggagctagaccaggtgactatgtagccagggtttctgtttcagatgctgacggcgactgggagaaggaagatgaggccactggagaattgggggtaggcctcggtgatggctcaattagcctgagcctggaaggtggagagggggatttcgcgctgctccccggaggccctccaggggtgttcttcctgtgcgtcgaaggccctctcgatagggagtccagggatctttatgagcttctcctggtggccacagacgcagggagtcctcccctgagtactgaggagactctgttgctgagagtcgcagacctaaatgaccagccaccacttttctcacagcagcattacaaggcttcggtgagtgaggccgcagccccaggcactgtggtcatgtgggtctctgctagcgatgcagacgaagccggaagcgatcacgcctggcttcgctatacagtcgtgcagctttcagctccctgtaatctcggttcactgcaaagcaagatggtacacacagcagagtgtggaccatcatttgccattgactctgagtctggtgccattagcacaattaggaccttagacagggaagtgcaggaggccgtggagctcaaggtggtggcccaggacttgggggaacctcccctctcagccacatgcttagtttcgattacagtggacgatgtaaacgataacgaacctatattctggaggcaggtttacaatgcaactatcgccgaacatgctccagtgggccactgtttcctgcagctgatttctgcccaagtagccttcgttaaaatcaagcagaaacagaaagagatccaggaaaagcaaaaccttgcctag

SEQ ID NO: 220043 - DNA, 2109 bp, Artificial Sequence
  Description of Artificial Sequence: Synthetic coding sequence
atgggggaaggcaggcagcaaaggcgggctcccgtcgggaaattactcctgctgcccggaaggcgtgacacgcctcacggcaggtcgggcagcagtggggctagaactcagcgttctttgctgtggctacttgtacatgtctggctctgggccgcttctggatcctccgctcaactgttcaatctgactctgagtgtcgacgaaggcttgcctcctgatactttggtgggggatatcagagcgggtctgccagccgctcagcagcaggaaggctccgggttctttctttcagaagattctgacgacagtccacttctggacgacttccacgtgcaccccgacactgggattattcgcactgccaggcggttggaccgagaaagaagagaccattactcattcgtcgccgctactctcctcggggctgtcgtgcaggtagagatccgtgtcaatgatgtaaacgaccattcaccccgttttcctcttgactccttacagttagatgtgtctgagttgagccctcctggaactgcctttcgcctgcccgttgcccacgatccggacgcaggcctcttctcaactcaaggttatacactagtgcagccctccgacctgccaaaagatccagctggtccttttttccagcttcgctaccggactcccggtcctctcccctctcctttattaccgggaagcagttcacctctggagccgctggacctggtattgttgaggcgtctcgatcgcgaagaggctgccgctcatcggctgcaaatagaagcctgggatggcggaagaccccgtagaacgggactgctgagtgtggaactgagggtgttggacgagaacgataatccaccagtctttgagcaggacgaatatcgcgctgccgtgcgcgaagacgcacagcctggtgcggaagtctgtagagttcgcgctaccgatagggatctcggccctaatggcttcgttcgctactcagtgcgcgcaagacaggtgcccggagccggatctggcggtggggctctaggtgatgcagcctattttgccgtggaagaactcagcggagtcgtgagggtctggcgcccactcgatcgggaagcgcaggcctggcatcaactcgtggtagaagcacgggatgggggtgctgagccagaagtggctactgtgagagtgagtattgctgttcttgatgtcaatgacaaccggcctgccattcacgtgctctttcttacagagggtggggtcgcgagggtgtccgaaggcgctcgcccaggcgattacgtggcacgggtgagtgtgtccgacgcagacggagattgggagaaagaggacgaggctaccggggaactaggagtgggcctcggtgacgggtcaatctcactttccctggagggcggagagggggattttgccctactgccaggtgggcctcccggagtgttttttctttgcgttgagggtccactggaccgtgagtcccgagatctatacgaactgctgctggtagcaactgacgctggaagcccccctctgtccaccgaagagaccctgctcctgcgcgtggctgacctcaacgaccagccaccattgtttagtcagcagcactacaaagcctccgtttccgaggccgcagctcccggaaccgtggtgatgtgggtgagtgccagtgacgctgatgaggctggttctgaccatgcctggctgagatataccgtggtccagctctccgccccttgtaatcttgggagcttgcagagcaaaatggttcatacagccgaatgtggaccatcatttgctattgatagcgaaagtggcgctatcagcacgattcgaacccttgatagagaggtgcaggaagccgtggagctcaaggtggtggcacaggatctaggagagccacctcttagtgccacatgtctggtcagcatcaccgtggatgacgttaatgataacgagcctatcttttggcgccaggtgtataatgctaccatcgcagaacatgccccagtgggtcactgcttcctccagctcatatctgcccaggtcgcttttgtcaaaattaagcagaagcagaaggagattcaggaaaagcagaatctggcctag

SEQ ID NO: 220044 - DNA, 4101 bp, Artificial Sequence
  Description of Artificial Sequence: Synthetic coding sequence
atgagcccatgtggccgtaaaatgggtgaaggccgtcagcagcgccgagcccctgtgggcaagctgctgctgctgcccggaagaagggatacccctcacggcaggtccggatcctctggggcacgcacccagagaagcctgctgtggctcctcgtgcatgtgtggctttgggcagcctcgggctcttccgcacagctcttcaatttaacactgtcggttgacgagggcctacctccagatacccttgtgggcgacattcgagctgggctgcccgcagctcagcagcaagaaggcagcggttttttcttgtcagaagactctgacgattccccactgttggatgacttccacgtccatccagacacaggcataatcaggaccgccagacgcttggatagggagagacgcgaccactactcttttgtggctgcaacgctgctgggcgcagtcgtccaggtggagattagggtgaacgacgttaatgaccacagccctaggtttcccctcgacagcctccagctggacgtgtccgagctttctccgcctggtaccgccttccggctgcctgtggcccacgatccagacgccggactcttcagcactcagggatacacactggtgcagccaagtgacttacccaaggatcctgctgggcctttttttcaactccgctatcgaacccctggcccattgcctagtccgcttctgcctggatcttcgtccccgcttgaacccctggatctcgtgctacttcgcaggctcgatagagaggaggcagctgcccatagacttcagatcgaggcctgggacggagggaggcccaggcggaccggtttattatccgtggaattaagagtgttggatgaaaacgataacccccctgtgtttgagcaagatgagtatagggcagccgtccgcgaggatgcacagccaggagctgaggtgtgcagagtgcgggcaacagatcgcgatttagggcctaacggcttcgtgcgatattccgtgcgggcacgccaggttcccggtgccggatccgggggtggggctctgggagatgccgcatactttgcagttgaggagctctcgggagtggtacgggtgtggaggcctctagaccgcgaagctcaggcctggcaccagttagttgtggaggcccgagatggaggggcagaacccgaagttgcgacggttagggtctcaatagcggtcctggatgtgaatgataaccgcccagccatccatgtactgtttcttacggaggggggtgtggcaagagtctctgagggtgcccgtccaggcgactatgttgctcgagtaagcgtcagcgatgccgatggagactgggaaaaggaggacgaagccactggagagctcggtgtagggctcggcgatggcagcatttcactgagtttggagggcggagaaggcgatttcgccctgctgccagggggaccaccaggcgttttcttcctgtgtgtggaaggccctctcgacagggagagcagagacctgtatgaactgctcttggtggcgacagatgctgggtcgcctccactttcaaccgaggagactcttctgctgcgcgttgccgacctgaatgatcagccgcctctcttctctcagcagcactataaagcctctgtcagcgaagcagcagccccaggcaccgtcgtgatgtgggtctctgcttctgatgctgatgaggccggttcagatcacgcttggttgcgctatacagttgtgcaattatccgctccttgtaacctagggtccctccaatctaagatggttcacaccgctgaatgcggaccctcatttgctatagacagcgagtctggtgccatcagcaccatccggactctggatagagaggtacaagaagccgtcgaactgaaagtggtagcacaggacttgggggagccccctctgtctgctacctgcctcgtgagtattaccgtggatgatgtaaatgacaacgaacctatattctggcgccaagtgtataacgcaacaattgcagagcatgcacccgtggggcattgcttcctacaggtaacagcctccgacgccgactccggactgtatggcttcatcgaatattccctgtacgatgggttcctatcttatgaggctcctcaggcatttcggatcgacccccacgatgggcaaatttgcgtcagtcaggacatcgaccgcgaacgcgaccctgctacatatgacctgctggtggaggccaaagacggaggtggcctctctgcacaggctttcgtaagggtcgacctggaagatgtgaatgataaccaccccgtcttcaatccgtccacgtacgtgacgtctatttccgatgagacccaacctggtacggaaatcatcaatgtgctcgccaccgaccaggactctggcatctacggaaccgtggcctatgagcttatcccaggaaacgtgtcttcgctgtttaccatcgattctaccacgggtatcatctacttaacgcttcctctctcccatttggagtccaccactctgagcttgatggtaagcgctcaagatggaggcggattgaccgctgtaattaacgccgatgtgactattcacatcttccagaccacattagcgcctgctgaattcgagcgcccaaaatacaccttcctggtttacgaggacgtacctgaggacagccctattggtacagtcaaagcgagagagcccctgaattcgtccgaacctatcttctacaggattagctctggggatctcgggggaaagttcagcattcaccccagacttgggaccatccgcactcggaagcccttagatcacgaaactcagcctgttgtggtcctgactgttcaggcccagctaggatctgcaccggcatgcagttcaaccgaggtgaatatcaccgtgatggacgtgaacgacaaccacccggcattcctaaggacctctgatgagattcgtatctctcagactacccctcccggtactgccctataccttgcaagggctgaggatagagactctgggaggaatgggctgatcaggtactctattgccagtccccagcccggagtgttcgcgatcgatcgtgccttgggagtcctcttccttaacggatctttaggcgctggagagcaacgggaactcacattgacattacgagcagaagaccaaggcgtgcacccacaggcagctcttctggttctcacggtcgtgatcgagaaacgcgagcacagtccgagctggacattcgaacatctggtctatcaggttgaggtttccgaatccctttcccctatgacacagatgctacagacgcaggcacacccgttaggacctcaacgcgctgctagcccactgaggtacagcttggaaccctcagtggattctgccatgttcggcatccgcccttataccggttggatctatttgcgtaggcagttcgactacgaaagcacacagacatacaatttcagagtattcgcgtggatccctgaagacgggttcctccagaacgttagcactaccgttatcgtcagagtctgggatgagaacgacaacagccccacgttcctgcatgacgtgctctttttgaaagttgaagagagcccagtgcctcaaggcgtcattggaaagattactgctattgacatggactcggggaaaaacgggcagctcctctattttttgttgtccgacggaaaattcttcaagatgaatcccaacaccggcgaactcatcaactgggtggccctcgaccgcgagcacaggggccatcacgaaatgaccgtgttggtcaccgatcggggtagcccgccacgcaacgcaacgatggccgtgtacgtgtcggtaactgacatcaacgataatagacctttttttcctcagtgtcttcctggcaaggagcttcatgtgaaggtgctggagggccaaccagtaaacatgctggttaccacagtttttgcaaaggacccggacgaaggcaacaacgccgaggtaacatactccgtgagttccgcacgtcctatgcccctcaaggggaagacagcgttcggaaagcagagttgcaagaaacagaccaataagcaaaccaagagctag

SEQ ID NO: 220045 - DNA, 462 bp, Artificial Sequence
  Description of Artificial Sequence: Synthetic coding sequence
atgctggagaagctcatgggtgctgacagtctccagctctttcgatctagatacaccttgggcaagatctacttcataggcttccaacggagcatcctcctcagcaaatccgagaattctctgaatagcatcgcaaaggagactgaggaggggagggagactgtcacccgtaaagaaggctggaaacgccgacatgaagatggttatctggagatggcccagcgacacctgcaacggagtttgtgcccctgggtctcctacctccctcagccctacgcagagctcgaggaggtgtcttcacatgtagggaaggtgtttatggcacgcaattatgagtttctggcctatgaggcctccaaagaccggaggcagccgctcgagaggatgtggacttgtaattacaatcagcagaaggatcagtcctgcaaccacaaagagattacctctaccaaggcagagtag

SEQ ID NO: 220046 - DNA, 249 bp, Artificial Sequence
  Description of Artificial Sequence: Synthetic coding sequence
atggcccagagacacctgcaacgcagtctctgcccctgggtcagctaccttccccagccttacgccgagctcgaagaggtcagtagccacgttgggaaagtcttcatggccaggaactacgagttcttagcatacgaagcctctaaagacaggcggcagcccctggaacgcatgtggacctgtaattataaccagcaaaaagaccagtcatgtaaccacaaagagataacatccacaaaagctgaatag

SEQ ID NO: 220047 - DNA, 378 bp, Artificial Sequence
  Description of Artificial Sequence: Synthetic coding sequence
atgcggaccgccatatggaaatggcatagggggatttacagggaccactacgttctgggttccctgacttttctgtccccaatgcaacgagccggtacgtccaatcagtggaatatgggcaaggtgatgaccctcgatagcggggatgaggtgacttttcataagacttggccaaccgaaacggggagcccgtataggctcgaggaggtcagcagccacgtgggcaaggtctttatggctagaaactatgagttcctcgcatatgaagcatctaaggacaggaggcagccactcgaacgcatgtggacatgtaattataaccagcaaaaggaccagtcctgcaatcataaggaaattacctccacaaaggctgagtag

SEQ ID NO: 220048 - DNA, 1725 bp, Artificial Sequence
  Description of Artificial Sequence: Synthetic coding sequence
atggaactcaaagcagaagaggaagaggtggggggagtccagccggtgtcaatccaggccttcgcgtccagttctactttacatgggctggcccacattttttcctatgagagactctctctgaaaagggccctttgggccctgtgcttcttgggatctctagccgtgttgctgtgtgtgtgcacggagcgcgtgcagtactatttccactaccaccacgtcaccaagctcgacgaagttgccgcatcacagctgacatttcctgccgtgacactatgcaatctgaatgagttccgtttctctcaggtgtctaaaaacgacctgtatcacgcaggtgaacttctggcgttgctgaacaataggtacgaaatccccgatactcaaatggccgacgagaaacagctagaaattctccaagacaaggctaacttcagaagctttaagcctaagccattcaatatgagggaattctacgacagagcgggacacgacattagggacatgctgttgtcctgccactttcgaggcgaagtgtgttccgccgaggattttaaagtggtctttacgaggtatggcaaatgttatacctttaacagcgggagagacggccgtcccagactcaaaaccatgaagggagggacgggtaacgggctggaaattatgctggatattcaacaggacgagtatcttcccgtgtggggggagaccgatgagaccagttttgaagccggaattaaggttcagatccactctcaggatgaacccccttttattgatcagctcggctttggggtcgcgccagggttccaaaccttcgtcgcctgccaagagcagcgcctaatttacctgcctcccccttgggggacctgtaaagccgtgaccatggacagcgatctggatttttttgacagctactcgattacggcctgtcgaattgactgtgagactagataccttgtagaaaattgcaattgcagaatggtccacatgcctggggatgctccttattgcacgcccgagcagtacaaggaatgcgcggaccccgcactggacttcttggtggagaaggaccaagagtactgcgtctgtgagatgccatgcaatctcacccggtatggcaaggaactgtcaatggtcaagataccaagtaaagcatctgccaagtaccttgctaagaaattcaataagtcagagcagtatattggcgagaacatcctggtactggatatcttcttcgaggtattgaactacgagacgatcgagcaaaaaaaggcttacgagatcgccggtctgcttggcgaacttctgatgaccccagtgcccttttcatgccacggccatggggtagccccatatcatcctaaagccggttgcagcctcttgtcacacgaaggcccaccaccccaaaggcccttccccaaaccttgttgcctaggagacattggcggacagatgggactctttatcggagcaagcatcctgacagttctggagttgttcgactacgcctacgaagttatcaagcacaagctttgtcgcagaggaaaatgccagaaggaagccaaaaggtcctcagccgataagggagtggctctgtccctcgacgacgtgaagaggcacaacccctgcgaatcacttcggggacatcccgcaggcatgacctatgcagcaaacattttacctcatcatccggcaagggggacttttgaagacttcacatgctag

SEQ ID NO: 220049 - DNA, 594 bp, Artificial Sequence
  Description of Artificial Sequence: Synthetic coding sequence
atgagagtggtggtcatcggagcaggagtcatcggcctatccacagctctctgcatccacgaacggtatcactctgtgctgcagccgctcgatattaaggtgtacgcagaccgcttcaccccgcttaccactaccgatgtagcagcagggctctggcagccctatctaagcgaccccaataacccccaggaagcagattggtctcagcagacctttgattacctcctatcacacgtccatagcccaaatgccgagaatctgggtctgttcctcatctccggctataatctctttcacgaggcaatccctgatcctagctggaaggacacggtgcttggatttaggaaactcacacccagggagctcgacatgtttcctgattacggctatggctggtttcacactagcctcattctggaaggtaaaaactacctgcagtggttgactgagaggctaacagaacgcggagtgaagttctttcagagaaaagtggagagctttgaggaggtggctcgggaaggggcagacgtgatagttaactgcacgggagtttgggcgggagctctgcaacgggacccccttttgcagccttag

SEQ ID NO: 220050 - DNA, 2400 bp, Artificial Sequence
  Description of Artificial Sequence: Synthetic coding sequence
atgaaaccgtcgccagccggtaccgccaaggaacttgagccccctgccccagctcgaggcgagcagagaacagcagagccggaaggccgatggagggagaaaggggaagctgatactgagaggcaacgaacacgtgagaggcaagaggcaaccctggccggtctcgctgaactagaatacctccgtcagaggcaggaattgctggtccgaggcgcactgagaggagctgggggtgccggagcagctgccccacgcgctggagaacttcttggcgaggctgctcagcggtccaggctggaggagaagttcctggaagagaacattcttttactgaggaagcagctgaactgcctgcgtcgacgagatgctggccttttaaaccagctccaggagctagacaagcagatctctgatctgcggcttgacgtggaaaaaacttctgaggagcaccttgagaccgattcaaggccaagttctgggttctacgagctgtctgacggagccagtggaagcctgtccaactccagcaattctgtgttcagtgaatgtctttctagttgccattcttccacatgcttctgtagcccacttgaggctaccctatctctgagcgatggctgtccaaaaagcgccgacgtgaacccgaaataccagtgcgatcttgtatccaagaacggaaacgacgtatatcgctatccttccccgctgcatgccgtggccgtccagagccctatgtttctgctgtgcctgacgggaaaccccttgcgtgaggaggaccgcctcggaaatcacgcgagcgacatatgcgggggatcagagctcgacgccgtcaaaaccgacagtagccttccttctccttcctcattatggagcgcatctcacccaagcagcagcaagaagatggatgggtatatactgagtctcgtccagaaaaagacccatcctgtgcgaaccaacaaaccacggacaagcgtgaacgcagaccccacaaaaggactgttgagaaatgggtccgtgtgtgtgagggcgccagggggtgtgtctcaggggaattcagtgaacctaaagaactccaagcaggcctgtttgccctccgggggtatcccaagtctgaataatggtactttctcaccccctaagcaatggtccaaggagtccaaggccgagcaggccgaatcaaagcgagtgcccctacctgaaggatgcccttccggggcagcttcagatctgcaatctaagcacttgcccaagactgctaaaccagcttctcaagaacacgcccgatgcagcgcaatcgggactggggaatcccccaaagaatctgcacagctttctggtgcctcaccaaaagaatcccctagcagaggcccagcacccccacaggagaataaggtcgtccagcccttgaagaaaatgtctcagaagaattcacttcagggcgtgcccccagccaccccacccctgcttagcactgctttccccgtggaagaaaggccagctctggacttcaagtccgaagggagctcccagtcactggaagaagcccacctggtgaaggctcagtttattccaggacagcagccatctgttcggcttcaccggggacataggaacatgggtgtggtgaaaaacagttctctgaagcatcgaggcccagcgctccagggtttggaaaacgggttacctactgtccgcgaaaaaactagagcaggaagcaaaaagtgccggttccctgatgacttagacacaaataagaagcttaagaaggcgtctagcaaaggtcggaaatctggaggtggtcccgaagccggtgtgccaggtcggccagctggtggagggcacagggccggttcccgcgcacatggacacggaagagaagccgtagtggccaagcccaagcacaaaaggactgattatcgtagatggaagtcttccgccgagatctcctacgaagaggccttgcgacgggctagaagaggcagaagagaaaacgtgggattgtatcctgctcccgtcccacttccgtatgcctccccatacgcgtacgtcgcttctgactccgagtattcagcagagtgtgaatctctgttccattctaccgtcgtggacacctcagaagacgaacagtcgaactacacaaccaattgctttggcgacagtgagtcgtctgtcagcgagggcgaatttgtaggagagagtactaccacctccgactccgaggaatcaggcggtctgatttggagtcagtttgtacaaaccctgccgatccaaacagtcacggccccagacctccataatcacccagctaagacatttgtgaaaatcaaagccagccacaacctcaaaaagaagatcctcagattcaggagcggttcactaaagctaatgacgactgtgtag

SEQ ID NO: 220051 - DNA, 2511 bp, Artificial Sequence
  Description of Artificial Sequence: Synthetic coding sequence
atgaaaccgtcccctgcgggtacagctaaggagctggagcccccagctcctgcccgaggggagcaacgtactgccgagcctgaaggccgatggcgcgagaagggagaggctgacaccgagagacagaggacacgtgaaaggcaggaggccacgctggccggactggcagagcttgagtatctacgtcagcgccaggagctgctcgtgaggggtgcgctgcggggagccggaggagcgggagccgctgcacctagggctggggagctgctgggggaggcagcacagagaagcaggctcgaggagaagttcctggaggagaacattctcctgttgcggaagcagttaaattgtcttagacgacgcgacgccggactgttgaaccagctccaagagttggataagcagatctcagatctgcggctggacgtcgagaaaacctccgaggagcatctggaaaccgatagccgtcctagctccggcttctatgagcttagtgacggtgctagcggcagtttgtccaatagctccaacagcgtttttagcgagtgtctcagttcttgccacagctccacatgtttctgttcgcccttggaagctactctgagcctgagcgacggctgtccaaagagtgccgacctgataggactgcttgagtataaagaagggcattgcgaggatcaggcttccggcgcagtctgccgctcgctgtctacgcctcaattcaattctcttgatgtcatagcggacgtaaacccaaagtatcagtgtgacctggttagtaagaacgggaacgacgtgtatcgctacccgagtccactacatgccgtagctgtccaaagtcccatgtttctgctgtgcctgacggggaatcctctcagggaggaggataggctagggaatcatgcctcagacatatgtgggggatccgaactcgacgccgtgaaaacagactcatctctccccagccccagcagcctgtggagtgcttctcacccgtcaagctctaaaaagatggatggctatatcctatcgctcgttcagaaaaaaacccacccagtgaggaccaataagccgagaacttccgtaaacgctgaccccacaaaaggattactgcggaacgggtccgtatgtgttcgggctcccggtggcgttagccaaggaaatagtgtgaacctgaaaaattccaaacaggcctgcctccctagcgggggtataccaagcctaaataatggcaccttctccccgcctaagcagtggtctaaagagagcaaagctgagcaggcagaaagcaaacgcgtacccctgccagagggttgcccttcaggcgctgcctcagacctacagtctaaacacctccccaaaactgcaaagccagccagtcaggaacatgccagatgttctgctatcggaaccggtgaatctcccaaggagagtgcacagctgagcggggctagtccgaaggaaagtccctcaagggggcctgctcctccccaagaaaacaaggtcgttcagcctctgaagaagatgtcacagaaaaactccttgcagggcgtgcctccagcgaccccccctctgctgtctactgcctttcccgtggaagagaggcctgctctggacttcaagagtgaaggcagctcacagagcctggaggaggcccacctggtgaaggcacagtttatccccggacagcaacccagcgtcagactgcaccgtggccaccgtaatatgggtgttgtgaagaactcaagcttgaagcacaggggtcccgctttacaagggttagagaatggcctgcccacagtgagggaaaagacccgagcgggttccaaaaagtgtcgctttcccgatgacctcgataccaacaaaaaactgaagaaggccagctcaaagggcaggaaatctggaggcggtcccgaggcaggggtgccaggaagaccagcgggaggaggccatagggcaggttcgcgggctcatggccatggcagagaagccgttgtggccaagcccaagcacaaaagaacagattatagaaggtggaagagttccgcagaaattagttatgaagaagcactccgaagggctagacgcggtcgtcgggagaacgtggggctgtaccctgctccggtcccacttccatacgcttcaccctatgcatatgttgccagcgactcagagtattccgccgaatgtgaaagcctgtttcactcgacagttgttgatacctctgaggacgaacaatctaattacaccaccaattgttttggcgactccgaaagctccgtgtccgagggggaattcgttggcgaaagcacaacgacatcggactctgaagagtcaggaggattaatttggtcccaattcgtacagaccctccccattcaaactgtcacagcccctgacctccataaccatccggctaaaacatttgtgaagattaaggccagccataatctcaagaagaaaattctgcggttcaggagcggaagcctgaaattaatgaccaccgtgtag

SEQ ID NO: 220052 - DNA, 2325 bp, Artificial Sequence
  Description of Artificial Sequence: Synthetic coding sequence
atgtggacccccggtggtccaccaggttcggccggttgggaccgcagacgcttaggggctcgactgcgggctgcctttgccggtctccaggaactgcaggggctgcgagccactcagcaggagagagtgaggggagccctggctctccagcctcctcccgcacccgcagcgccatgcggtccccacggtctgcacggccctgagcagcaattggaggccgctttagcagcactgcaagaacagctgagcagattaagacagcaggacatcggactgaagacacatctcgatcagttggacctgcagatcagtaaattgcagcttgatgtaggtaccgctagcggcgaggccctggactccgactctagaccctcctcaggattctacgaaatgtcagacgggggttcttgtagcttaagtacatcatgtgcttccgtatgttcagaccatatttctcctagcttaggatccctgttacccgtcgcccaggcccataaagccaggccgagcatgggtgattggcggcctagatccgtggatgaaacaacggtgccagcatggaggcctcaagcaaccgaggagggggctcgcccacctggtagcgtggaagatgccggtcagccgtggggcactttctggccacgcccagtgagcaccggagacctggatcgtgcgctgcctgccgataccggcctccagaaggcttccgcggatgctgaactcctcggcctgttgtgccaaggggtggatatccctttgcacgtccccgatcccaagtatagacaggacttagtttcgcaggggggacgggaggtctacccttatcctagccccctccacgctgtcgctctgcaatcaccactgttcgttctgactaaagagaccccccagcgcggaggaccgtcattccctagggagagcccaaggggccctgcgggtcttaatactatccaaactggaccagtcctcgaagccggtcctgcacgcgcacgagcgtatatcgatcgtctgctgcacctctggggcagagagacccccgcaaaaggtagtgagggggaacagggcccactgcgccatgcagcctcgccaagcccgcagcgacaggggggatggagtacagatggcggaggcagattgcttgtgttcgcccctgggcgtgaagatgaaggcggacctgcccagagtcgaggcgctggccgaggaggaccgcagcagcaaggatatatgccactcgaaggacctcagcagtcgggcagcctgccagaagagggtagcaagccatccaattcctgtgtgttaagagaaacgatggtccaggcctccccctccagcaaggcgcaacagactccatccgctcaggactatggtcggggtaacattatctcaccaagccgcatgctggacaaatctccttctcccgcaagcggccacttcgcacatccttccttcgccgcttcactcaagatgggtcctccgaagtcgaaagcagagaaaatcaagaggtctcccatggacaaagtgttaagattcgccagacagcccttgttgctccttgaccgcccagagggagctcatgcggctcctcagccttcgctggaatgggaccctgcacactggccaaccgggcgtggaggacttcagcgccgaccagcacttgcctgggaggccccaggacgttcctgctccgaatcaactctctatccaatgccagtcctcgtccccctggcagttgcccctcaggaatcgcaccgaacgtctgcccaggcactattcccatttgaggcctcacttctcacgagcgttgccaggcgtaaacaccgcagatggcagtctacagtggagatctctgctcgggctagactcgcttcatgccccgaatcaaacctcggaccaccacggcctgtagcgcgtcgcgcaggcggtcccctggcccgagggcgtcctagcctcgtgagacaggacgcgtacacccggagtgactccgaaccgtccaaacactctgctgagtgcgaccctcgcttcccgtccgtgattccggaaactagcgagggggagagctccgatcatacaacaaatcgtttcggcgatcgcgagtcgtcaagctcagatgaagagggtggcgctcagtctagagactgtgacctggcgctgggatatgtggctgctggtcacgccgagttggcctggacacaagaggctcccgtcagcagcgggccactgctatcacctgttccaaaactctgccgcatcaaggcgtctaaggccttgaagaagaagatcagacggtttcagcccacagcattgaaagtcatgaccatggtgtag

SEQ ID NO: 220053 - DNA, 843 bp, Artificial Sequence
  Description of Artificial Sequence: Synthetic coding sequence
atgtggacccctggcggacccccagggtccgcaggctgggaccggaggcgactgggcgcacgtctcagggcggctttcgccggattacaggaactgcagggcctgagagcaacacagcaggaaagggtcaggggtgccctagctctgcagccccctccagcaccggcagcaccatgtggccctcatggtcttcacggtcctgaacaacagttagaagctgctcttgcggcactccaagagcagctttctcggttgagacagcaggacatcgggctgaaaacgcatctggaccagctggacctgcagatcagtaagcttcaacttgatgtgggtactgcgtccggagaagcacttgattcggattcacgcccatcatccgggttttacgaaatgtctgatggcggtagctgcagcctgtcaacatcctgcgcatcagtgtgctccgaccacatcagccccagcctgggaagccttctgccggtcgcccaggcgcacaaagcgaggccatccatgggcgattggcggccaaggtctgtcgacgaaacaacggtccccgcttggcgccctcaagcaacagaagagggtgcgcgaccccctggctcagttgaggatgccggacagccctggggtacattttggccccgacctgtaagcaccgagctgtgtaacgcgcctggcgagctggacatgcacgctcccccagctggttgcaccagcagctcgttgaccggggtgggtagcgggctgcgaggaaaatgcggactctgcggttgccaattgcccttttgcagtgtgaacacgtcctctaaaactaaatctagtggcatctcgcggcagcagtag

SEQ ID NO: 220054 - DNA, 1890 bp, Artificial Sequence
  Description of Artificial Sequence: Synthetic coding sequence
atgatacgggcatttagtttcccagtgagtccagaacggggtagactcaggggttggctggagggctcacttgctgggctgtgtgagctccactggcttcgagagaggcaggagtatcgagtgcaacaagccctcaggctggcccagccaggcatggggggagctgaggcagaggacgaggaggatgccgatgaggacgaggatgcagccgctgcaagacgagccgcagcggctctggaggaacagctggaggccctgccgggactggtctgggacctcgggcagcagctcggagatttgagtcttgagtctggagggttagagcaggagagcggacgatcaagcggattctacgaagatccaagcagtaccggaggtcccgactctcctccctcaacattctgtggcgactcaggattctccggatcatcatcttatggacgtctcggtccctctgaaccgagaggtatttacgcttctgaaagaccaaagtccctgggagacgctagcccttctgcccctgaggtcgttggagccagggccgctgtgccacggagcttcagtgcgccttatcctaccgccggaggctctgctggccctgaggcttgctcctccgctgagcggagggctcgtgctggcccatttctaacacccagcccgctgcacgctgtggccatgagatccccaaggccctgcggacgcccacctactgactcacctgatgccggtggcgctggcagaccgttagacggatatatctctgcactgctccggagaagacgacggaggggtgccggacagccccgaacatcaccaggcggagctgatgggggacctaggcgccagaatagcgtgaggcagagacccccagacgcttctccctccccgggatctgctcgcccagccagagaaccctccttagaacgggtcggcggacatcctacttccccagcagcgctctctagggcgtgggcctctagctgggagtctgaggccgctcccgagcccgcagccccacctgctgccccatcccccccagactcgcccgcagaaggcaggttggtgaaggcacagtacatacccggagcacaggccgctacccggggtctccccggtcgcgctgcacgccgaaagccgccacccttgacgcggggacgatccgtggagcagagcccgcctcgcgagcgacctagagcagctggacgccgagggagaatggccgaagcatctgggcgacggggaagcccaagagcgaggaaggcctccaggagccagtctgaaactagccttctcgggcgagcttcagctgtgcccagcggcccaccgaagtatcctaccgccgagcgcgaggaaccccgacccccaaggcccaggagggggccagctcccaccctggccgcacaggccgcaggtagctgccggcgttggagatctactgcggagatagacgccgctgacggccgtagggttcggcctagggcaccggcagcgcgagtccccggacctgggccatctccaagcgctccacagcgtcgattgctctacgggtgtgcaggtagcgattctgagtgtagcgccggacgcctgggccctcttgggaggcgcggaccagcgggtggagtgggaggcggatatggtgaaagcgagagctcagcatcagaaggcgagagccctgctttcagcagcgcatcctccgactcagacggcagcgggggactggtatggccacaacaattggttgctgctaccgctgccagcgggggaggcgcaggagctggtgcacccgctggacctgcaaaggtctttgtgaagatcaaagcaagtcacgccttgaaaaagaaaattttacgcttcaggagcggctcactcaaggtgatgaccaccgtgtag

SEQ ID NO: 220055 - DNA, 2025 bp, Artificial Sequence
  Description of Artificial Sequence: Synthetic coding sequence
atgaacagtggggctatgcggattcactctaaagggcactttcagggcggaatccaggtgaaaaacgagaaaaatagaccctctctcaagagcctgaaaaccgataatcgtcctgagaagtccaaatgtaagccactctggggcaaagttttctacttggatctcccatccgttaccataagtgaaaagctccagaaggacattaaagacctgggcggacgcgtagaagaatttttgtccaaggatatatcctacctcatctctaacaagaaggaggctaagtttgctcagacactaggtcggatctccccggtgccttctcccgagtctgcctataccgcagagactacttccccccatccatcccacgacggtagctcttttaaatcccctgataccgtttgcttaagtcgtgggaaactgctggtcgaaaaggcaattaaagaccatgattttataccatcaaactcaattctctctaatgcacttagctggggtgtgaaaatacttcatatcgacgatattcgctattacatagagcagaagaagaaggagctctatctgctgaaaaagagtagcacatctgttagggacggcggaaagcgagtaggctccggagcccagaagactcgaactgggagactgaagaagccattcgtgaaggtggaagacatgtcccagctgtaccggcctttctatcttcagttgactaatatgcccttcatcaattactccatccagaagccctgcagtccgtttgatgtcgataagccatcaagcatgcagaaacagacccaggttaagctcaggatacagacggacggggataaatatggaggtacctcaattcaactacagctcaaagaaaaaaaaaaaaaggggtactgcgaatgctgtctacaaaagtatgaagatctggaaacccaccttcttagcgagcaacacagaaattttgcccaatctaatcagtaccaggttgtggacgatatcgtgtctaagttagtctttgactttgtggagtacgaaaaagacacacccaagaaaaagcgaataaagtattctgtgggctccctctcgcctgtgtcagcttctgtgctgaagaagacagaacagaaagaaaaggtggagttgcagcacataagccagaaggactgtcaggaggatgatactacggtaaaagaacagaatttcctgtataaagaaacacaggagacagaaaagaaattgctcttcatcagtgaacccatcccgcaccctagtaatgagctaagaggccttaacgaaaagatgagcaataagtgctcaatgctgagtacagctgaggatgatattaggcagaacttcacacagctccccctgcataagaataagcaggaatgtatcctcgacatctccgagcacacgttgtctgaaaacgatctcgaggagctgcgtgtggaccactataaatgcaacatacaagccagcgtgcatgtgtccgacttttccactgacaacagcggatctcagcctaagcagaagagtgatacagtgcttttcccggctaaagatctcaaagaaaaggacctccattccattttcacgcatgactccggactgatcaccattaacagttcccaggagcatctcaccgtacaagcaaaggctcccttccatactccccctgaggagcccaacgagtgcgactttaaaaatatggatagcctgccttcgggaaaaatccatcggaaggtcaagattatactggggcgtaaccgcaaagaaaatttagaacccaatgcggagtttgataagcggacagaattcatcactcaggaggaaaacaggatctgcagtagccccgtccaatcactactcgacctctttcaaacttctgaggaaaagagcgaattccttggatttaccagttacaccgaaaagagtgggatctgcaatgttctggatatctgggaagaggagaactccgacaatctcctcaccgctttttttagttctccatccacgtctacttttacggggttctag

SEQ ID NO: 220056 - DNA, 654 bp, Artificial Sequence
  Description of Artificial Sequence: Synthetic coding sequence
atgaactctggcgcaatgcgcattcattccaaggggcattttcagggtggcatccaggtcaaaaacgagaagaaccggccaagcctcaaatctcttaagactgataacaggcccgagaagagcaagtgcaaacccttgtggggaaaagtcttctacttggaccttccatcagtgaccatatctgaaaagctgcaaaaagatatcaaagacttaggcggtagggtggaggaattcctctccaaagatatctcctacctcatcagcaacaagaaggaggcaaagtttgcccaaaccttggggaggattagtcctgtgccttctcctgagtctgcttacaccgccgagaccacatccccccaccccagccacgatggatcctctttcaagtcccctgacacggtttgtctgagtcggggaaagctgctcgttgagaaggctatcaaggatcacgactttatcccaagcaatagcattctctcgaacgctcttagttggggcgtaaagattctccacattgacgacatacggtactacatagagcagaagaaaaaagaactttacctgcttaagaaatcctctacctccgtgcgagacggaggcaaacgggtgggttccggcgctcagaagaccagaaaagccctacagtccatctag

SEQ ID NO: 220057 - DNA, 1848 bp, Artificial Sequence
  Description of Artificial Sequence: Synthetic coding sequence
atgagtgagcccggaaagggggatgattgtctggaattagagtctagcatggcggaatcgcggctgcgagcacctgatctgggagtcagccgctgtctgggaaaatgtcagaaaaacagcccaggggctcgcaagcacccattttcaggtaaaagcttctacctggacttgccagccggaaaaaatctgcagtttttgactggcgcaattcagcaactgggaggggtaatagaaggcttcctcagtaaggaagtctcctacatcgtgtcatcgagacgggaggtgaaagccgagtcttccgggaagtctcatcggggatgcccttcaccatcaccgagcgaagtcagggtggagaccagtgcaatggtcgatcctaagggaagccacccaagaccttcccgtaagcccgttgacagtgtgccactgtcaagaggcaaggagctccttcaaaaggccattcggaaccagggatctatatcaggagggggatcaggcggatcttcatcccttcttacgaacgcaaggtcatggggcgttagaatcctccatgtcgacgaaatgatgatgcatgtccagcagctgtcacttgccagcctgtgtgtgaagaaacagcagccgaagaagcccgagggaacctgcccagctgcggaatctagaacccggaaagtggccagacttaaagcgccttttctaaagattgaggatgagagccgaaaatttcgtccttttcaccaccaatttaaaagttttcctgagatctccttcctgggccctaaggacgccagcccctttgaggcccctaccacacttggcagcatgcaccacacacgggaatccaaggacggggagccttctcctcgcagcgctgctcataccatgccacgcaggaagaaggggtattgcgaatgctgccaggaggcttttgaggagctgcatgtacacttacagtctgcacagcaccgaagctttgctctggaggctcacctgtacgccgaggtggataggatcatagcccagctgtcacacagcttcgccgacatcccctttcaagccggactcccaaggtggtcggggtcaccggcatctgattgtgacccactgtgtcctgaaaccctccacccacatcagccatctcaccctagggccgctagcccccgaattcgtaaagaggactcctgccaggctagcgtcacccagggcagagcagccggacaacaaagatggacggaaagcctagacggtgtgatgggaccccctgcctctcatacctgtgtaagtgccactacactcctaccagccctccctaagggatctcgggagcagggttgcctctgcccctgcccagcctccttcacccagtctcaccttgtgacaagcctggcattgcttcctggagagtggtcccccgctgaagacatgcccctccacccctcacaggagaactcattcgccccagcagatatccccgtgaaggggccacttctgttcccagaggctaggccttggctaatgtctgctcgatgttgggtgaggccattccccttcgtgacctggggttgcctcatacctcacgacactacccctctgcacgaggaggtgtcaccatgtccttgccttagattgggatacctgtacttactgttgacccagtcactgtggtgccgggtgcgtgttcccagcttgagtacagccggacccataccaagaaccagccatccatgtaccctggccttcccaagttacctgaatgaccacgatctggggcacctgtgtcaggcaaagccacaggggtggaacaccccacagcctttcctgcactgcggattcctggcagtcgactccgggtag

SEQ ID NO: 220058 - DNA, 1296 bp, Artificial Sequence
  Description of Artificial Sequence: Synthetic coding sequence
atgagtgaaccgggtaaaggcgacgattgtctggaacttgaatcatccatggccgagtcgcgactgcgggcaccagacctgggagtgtcaagatgtctagggaagtgtcaaaagaactctccaggggctaggaaacaccccttttctggcaagagtttttatttggacctgccagctggtaaaaaccttcagtttctgacgggggcaatccagcagctggggggagttattgagggtttcctgtcaaaggaggtgagctatatcgtgtcgtctagacgcgaggtgaaggcggaatcatctggcaaaagccatcggggatgtccgtccccaagccctagcgaagtacgggtagagacaagtgccatggtggacccaaagggctctcatcctcgaccatcacggaaacccgtggactctgttcccctctcacgagggaaggaacttcttcagaaggctatacgcaaccaggggtccatctctggaggtggctctgggggaagctctagcttgttgacaaacgcgaggtcctggggggtccggatattgcacgtcgacgaaatgatgatgcacgtccagcagctttcccttgcgtctctctgcgtcaagaaacaacagccgaagaagcccgaaggcacctgccctgcggctgaaagccgaacaagaaaggttgcccgactgaaagccccattcctcaagatcgaggatgagtctcgaaagttccggccttttcaccaccagtttaagtctttcccagagattagcttccttggacccaaagatgccagccccttcgaggccccaaccactctgggttccatgcaccataccagagagtctaaagacggtgagcctagtccacgctccgccgcacacactatgccacgacggaagaaaggatattgtgagtgctgtcaagaggctttcgaggaactgcatgtccacctccagtcagcacagcacaggtctttcgccttagaggctcatctctacgcagaagttgaccgcataattgcacaactgtctcactcctttgccgatatcccattccaggctgggttacccaggtggagcggaagtcccgcatcagactgtgatcctctttgccccgagacgctgcatcctcatcaaccttcccaccctcgcgcagcgtcgcctcgaattagaaaggaagattcctgtcaggcatccgtcacacaaggccgagcggcaggccaacagcggtggacagaaagtttagacggcgttatggggcctcccgctagccatacttgccacaggccctgcagactgccatag

SEQ ID NO: 220059 - DNA, 474 bp, Artificial Sequence
  Description of Artificial Sequence: Synthetic coding sequence
atgtctgaaccgggaaagggggacgattgtcttgaattagaaagttcgatggcagagagtcgactgcgagcaccggacctgggcgtctctcggtgtctcggcaagtgccagaaaaacagtccaggggcacggaagcaccccttttcaggcaagtccttctatctagacctgcctgccggtaagaatttgcagttcctgacaggggctattcagcagctgggaggcgtcattgaggggttcttatctaaagaagtttcctacatcgtgtctagccggagagaggtgaaggcggagagtagtggaaagtctcacaggggctgtccatctccgtcgccatcagaggttagagtggagactagcgctatggtggatcctaaaggcagccacccccgaccaagccggaagccagttgacagtgtaccattatcgagaggaaaagagcttctccagaaagctataagaaatcagaaatag

SEQ ID NO: 220060 - DNA, 570 bp, Artificial Sequence
  Description of Artificial Sequence: Synthetic coding sequence
atggtgggtggcggacagccttgcggacctaacatgagtgaagtgagctgtaaaaagagggatgattatctcgaatggcccgagtactttatggcggtcgcattcctctcagcacagcggtctaaagacccgaattcccaggtaggtgcctgcatcgtcaattcggagaacaagatcgtagggatcggctacaatggcatgccaaatggctgtagcgacgacgttctgccctggaggaggactgcggaaaacaaattggacaccaagtacccatatgtctgtcacgccgagctgaatgccattatgaacaaaaattccaccgatgtcaaggggtgcagcatgtatgtagcgctgttcccatgcaatgaatgtgcaaaactgattatccaggccggaatcaaagaagtgattttcatgtcagacaaatatcacgatagcgacgaagccaccgctgcacgcctgctttttaacatggccggagtcactttccgaaagttcatcccgaagtgttcaaaaatcgtaatcgactttgatagtatcaattctcggccttcacagaagctgcagtag

SEQ ID NO: 220061 - DNA, 537 bp, Artificial Sequence
  Description of Artificial Sequence: Synthetic coding sequence
atgtcagaggtgtcttgcaaaaaacgggacgactacctggagtggcccgagtactttatggcggttgcctttctgagcgcccagcgctccaaggaccccaactcccaggtgggcgcttgcatcgtaaattccgaaaataaaatagtcggtatcggctacaacggcatgccaaatggctgctccgatgatgtcctgccctggcgacggactgcggagaacaagctggacacaaagtacccttacgtatgtcacgcagagttaaacgctataatgaacaagaattccactgatgtgaaggggtgctcgatgtacgtggctttattcccatgtaacgaatgcgcaaaactgattatccaggccggaatcaaagaagtgatcttcatgtcagacaaataccatgattccgacgaggctactgccgctaggctgctgtttaacatggccggagtgactttcagaaagtttattccgaagtgcagcaagatcgtaatcgatttcgactcaataaactcacgcccttctcagaagttgcaatag

SEQ ID NO: 220062 - DNA, 510 bp, Artificial Sequence
  Description of Artificial Sequence: Synthetic coding sequence
atgagtgaggtttcttgtaagaagcgcgacgactacttagagtggccagagtacttcatggctgtcgcctttctatcggcacagagaagcaaggatcccaacagccaagtcggtgcttgtatcgtgaactctgaaaataaaatagtggggattggctacaatggaatgccaaatggatgttcagacgatgtgctgccctggcgtcggaccgccgaaaacaagctggacactaagtatccctatgtgtgtcacgccgaattgaatgccatcatgaataagaactccaccgatgttaaggggtgctctatgtacgtggcgctgttcccctgtaatgaatgcgctaaactaatcatccaggccggtataaaggaagtgatttttatgtctgacaaatatcatgactcggatgaggccacagctgccagactgttatttaatatggcgggagtgacttttcggaagttcattcctaaatgttccaagattgtgattgatttcgactccatttag

SEQ ID NO: 220063 - DNA, 222 bp, Artificial Sequence
  Description of Artificial Sequence: Synthetic coding sequence
atgtcagaggtgtcgtgtaagaaacgtgacgactacttggaatggccggaatacttcatggccgtcgcctttttaagcgcgcagcggtcaaaagatcctaattcccaagtgggtgcctgcatagtgaacagcgagaacaagattgttggcatcggttataacggaatgccaaacgggtgttccgacgacgtcctcccttggcgacgaacagcagaaaactag

SEQ ID NO: 220064 - DNA, 180 bp, Artificial Sequence
  Description of Artificial Sequence: Synthetic coding sequence
atgtctgaagtgtcttgtaaaaagcgggatgattacctggaatggccagagtacttcatggccgtggccttcctctcagcacagagaagcaaagatcctaatagccaggtgggcgcttgcattgtcaatagcgaaaacaagatcgtcggcatcgggtacaacggcatgcctaacggctag

SEQ ID NO: 220065 - DNA, 72 bp, Artificial Sequence
  Description of Artificial Sequence: Synthetic coding sequence
atgtctgaagtctcctgtaagaagagagatgactacctggaatggcctgaatatttcatggcagtcgcgtag

SEQ ID NO: 220066 - DNA, 363 bp, Artificial Sequence
  Description of Artificial Sequence: Synthetic coding sequence
atgtcagaagtttcctgcaaaaagcgggatgattatctcgagtggcccgaatattttatggccgtggcattcctcagtgctcaaagaagtaaggacccgaatagtcaagtgggggcatgtatcgtgaatagcgagaacaaaatcgtgggtattggctataatggcatgcccaacggatgttccgacgacgtactcccttggcgacgcacagccgagaacaaactcgacaccaagtatccctatgtgtgccacgctgagctgaacgccattatgaacaaaaacagcacggatgtcaagggctgttccatgtatgtcgccctgttcccatgcaatgagtgtgctaagctgattatccaggcatag

SEQ ID NO: 220067 - DNA, 537 bp, Artificial Sequence
  Description of Artificial Sequence: Synthetic coding sequence
atgtctgaagtgagttgcaagaagagagatgactatctggagtggcccgaatatttcatggctgtggctttcctatccgcccaaagaagtaaggatcccaatagccaggttggtgcatgcatcgtcaatagtgaaaataagatcgttggcatcgggtacaatggcatgcccaacggatgcagcgatgacgtcctgccttggaggcgcaccgctgaaaacaaacttgacacaaagtacccttatgtgtgccatgcggagctgaatgccataatgaacaagaatagcacagacgtcaagggctgttcaatgtatgttgccctgtttccctgcaacgagtgcgctaagctcataatccaagccggtatcaaggaggtgatatttatgagtgataagtaccacgattccgacgaggcgactgctgccaggttattattcaacatggcaggggtcactttccggaagtttatacccaagtgttcaaagatcgttatcgacttcgacagtattaattcccggccatcccaaaagctccagtag

SEQ ID NO: 220068 - DNA, 360 bp, Artificial Sequence
  Description of Artificial Sequence: Synthetic coding sequence
atgagcgaggtttcatgcaaaaaacgcgatgattacctggagtggccagagtattttatggcagtggctttcctttccgcgcagagatcaaaagacccaaacagccaggtgggggcatgtatagtgaatagcgagaataagattgtggggatcggctataatggcatgcctaatggctgttctgatgatgtcttaccttggaggcgtacagcggagaataaactggatacgaagtacccatacgtgtgtcacgcagagctcaatgcgattatgaacaaaaatagtacggacgtaaaaggttgctcaatgtacgttgccttgtttccctgcaatgagtgtgctaagcttataatccagtag

SEQ ID NO: 220069 - DNA, 297 bp, Artificial Sequence
  Description of Artificial Sequence: Synthetic coding sequence
atgtcagaagtgagttgtaaaaagcgtgatgactatttagaatggccggaatatttcatggccgtggcctttttaagtgctcagcgcagcaaagacccaaactcccaagtgggggcttgcattgtcaactctgaaaacaagatagtgggaatcggttacaacggcatgcccaatggatgctcagacgacgtgctcccgtggaggcggactgccgagaacaagttggacaccaaatatccctacgtttgtcacgcggaactcaacgccataatgaataagaattcgactgacgtgtag

SEQ ID NO: 220070 - DNA, 780 bp, Artificial Sequence
  Description of Artificial Sequence: Synthetic coding sequence
atgaacaagctgaagagttcccagaaagacaaagttcgacagttcatgatctttacgcagagtagcgagaagacagcggtatcttgcctttcacaaaacgattggaaattggatgtggctaccgacaattttttccagaatcctgagctctatatccgtgagtcagtgaaaggatccctcgatagaaaaaaactggaacaactctataacaggtataaagatccgcaggatgaaaacaaaattggaattgatgggatccagcagttctgtgatgacttggcgcttgaccccgctagcatttcagtgctgatcatcgcctggaaatttagagcggcaacacagtgcgagttcagcaagcaagaattcatggacggcatgaccgagcttggttgtgactccattgagaagttgaaggctcagattcccaagatggagcaagagctcaaggagccaggccgtttcaaagacttttaccagtttacctttaattttgccaaaaatcctggtcagaagggtttagacctggagatggccatagcctactggaatctcgttctcaacgggaggtttaagttccttgatctatggaataagttcctgctggaacaccacaaacggtccattccgaaagatacttggaacctgctgctggacttctccactatgattgccgacgacatgtccaattatgatgaggagggagcatggcctgtgctgatcgacgactttgtagagtttgctcggcctcaaattgctggaaccaagagtaccaccgtttag

SEQ ID NO: 220071 - DNA, 660 bp, Artificial Sequence
  Description of Artificial Sequence: Synthetic coding sequence
atgaataagctgaagtcctcccaaaaggataaagtacggcagttcatgatcttcacacagagcagcgagaagaccgccgtcagctgtctgagccagaatgactggaaactagatgttgccacagataacttcttccagaatccagagctgtatatccgggaaagcgtgaagggatcactggaccgaaagaaacttgaacagctgtataacagatacaaagacccccaggatgagaataaaattgggatcgacggaatgactgaactggggtgcgactctatcgaaaaactgaaggcccaaatcccaaagatggaacaggagctcaaggagcccggaagatttaaggacttctaccagtttaccttcaactttgccaagaaccccggtcagaaaggattggatttggagatggctatcgcctactggaacctggtgttaaatggtcgcttcaagttcctggatttatggaataagttcttgctcgagcatcacaagagatccattccaaaagacacatggaatctcctcttggacttcagcactatgatcgcagatgacatgtctaattatgacgaggagggcgcatggcccgtgttaattgatgacttcgttgagttcgctcggcctcaaattgcagggacaaagtcaaccaccgtctag

SEQ ID NO: 220072 - DNA, 387 bp, Artificial Sequence
  Description of Artificial Sequence: Synthetic coding sequence
atgatctttacccaaagcagcgaaaagacagccgtgtcctgtcttagccagaatgactggaaactggacgtcgctacagataatttcttccaaaatcctgaactgtacatacgggagagcgtgaagggcagcctggacagaaaaaaactcgagcagctctataaccgctataaggatccacaggatgaaaacaagatcgggatcgacggaattcagcagttctgcgatgatctggcgcttgacccggcaagtatctctgtcctaatcattgcttggaagttccgtgccgctacccagtgcgagttttcaaagcaggagttcatggacggcatgacagagctgggctgtgactctattgagaagctcaaggcccagatccctaagtag

SEQ ID NO: 220073 - DNA, 879 bp, Artificial Sequence
  Description of Artificial Sequence: Synthetic coding sequence
atgcactctgacgctgcggcagtcaacttccagctgaacagccatctgtctactctggctaacatccataaaatttatcacactctgaacaagctgaatctgaccgaggatatcgggcaggacgatcaccagacaggctcccttagatcttgttcctcgagcgattgtttcaataaggtgatgccacccagaaaaaaaaggcgtcctgcatctggggatgacttaagtgctaaaaagtcacggcacgacagcatgtacaggaagtacgactccacaagaattaaaacagaggaggaggccttcagcagtaagcgctgtctcgaatggttttacgagtacgcagggactgacgacgtggttggtccggaaggaatggagaagttctgcgaagacatcggggtggaacccgaaaacgttgtcatgttggtacttgcttggaagctcgatgcgcagaatatgggttacttcacattacaggaatggttgaagggcatgacgtccctgcagtgtgataccactgaaaaactgcgcaacacactggactacctacgctcattcctgaacgactccaccaactttaaattgatttacagatacgcctttgacttcgccagagaaaaagatcagcggtcactcgatatcaacactgctaagtgcatgctgggcctgctcctgggcaaaatttggccgctgttcccagtttttcaccagtttcttgaacaatcaaagtacaaagtgattaacaaagaccagtggtgtaatgtgttggaattcagtcgaactatcaacctggatctcagcaattacgatgaagacggggcatggcccgtactgttagatgagttcgtggaatggtacaaggacaagcagatgtcatag

SEQ ID NO: 220074 - DNA, 699 bp, Artificial Sequence
  Description of Artificial Sequence: Synthetic coding sequence
atgccgccaagaaaaaagcgacggcctgcttcaggagacgacctgagtgctaaaaagtcacggcatgacagcatgtaccggaagtatgatagtacacgtattaagaccgaggaagaggctttcagcagcaaacgttgcctggaatggttttatgagtatgctgggactgacgacgtggtcggtccagagggaatggagaagttctgcgaggacatcggtgtggagcccgaaaacgtagtaatgcttgtgctggcctggaagcttgacgcgcagaatatgggatatttcacactgcaagagtggctcaaggggatgactagcttgcaatgcgacacaaccgaaaagctgcgaaacacactggactatttgagatccttcctcaatgactctactaactttaagctaatctacaggtatgcttttgattttgccagggagaaggaccagcgctccctggatataaatacagctaagtgtatgcttggcctcctcctcggtaagatttggcccctgttccctgtctttcatcagttcctggagcaaagcaagtacaaggtcataaataaggatcagtggtgtaacgtactggaatttagtaggacaattaatctcgacctgagcaattatgatgaggacggtgcctggcctgtcctgctggatgagttcgtggagtggtacaaagataaacaaatgtcatag

SEQ ID NO: 220075 - DNA, 774 bp, Artificial Sequence
  Description of Artificial Sequence: Synthetic coding sequence
atgcattctgacgctgcagctgtgaattttcagctgaactctcacctttctacgctggccaacattcataaaatctaccacacacttaacaagcttaacctgactgaagatatcggccaggacgaccatcaaaccggaagccttcggagttgttctagctctgactgctttaataaagttatgcccccacggaagaaacggagacctgcgtctggcgatgatctgtccgccaaaaaatcaagacacgactccatgtacaggaagtacgactcaacacgaatcaaaacggaggaggaggccttttccagcaagcggtgcttggaatggttctacgagtatgcaggtactgatgatgttgtgggccctgagggcatggagaaattctgcgaagacatcggcgtcgagcctgaaaacgtggtgatgctggtcctggcatggaaactggatgcacaaaatatgggttatttcactttacaagagtggctcaaagggatgacgtcactgcagtgtgacacaacggaaaagctccgcaacacccttgattatctacgtagtttcctgaatgattccacgaacttcaagctcatttatcgctatgcctttgatttcgccagacagtccaaatataaggtgatcaacaaggatcagtggtgcaatgtactggagtttagcaggacgattaatctcgacctgtcaaattacgacgaagacggtgcctggccagtcctgttggatgaatttgtcgagtggtacaaagacaaacagatgtcttag

SEQ ID NO: 220076 - DNA, 1011 bp, Artificial Sequence
  Description of Artificial Sequence: Synthetic coding sequence
atggaagtggaagccgctctgggatgctctggccaaggaagggggtgtggcggtgttgccccagctggcaggggaagggaaagagcaagcgaaagaggcacccgcgtgagaatctctaaaggactcagcggcgcagggggaagcgtcaggaaagccgacttccagctgaattcccatctgtctacacttgctaatattcacaaaatctaccataccttaaacaagctgaatcttacagaggatatcgggcaggacgatcatcagacaggcagcctgcgctcctgctcttcaagtgactgtttcaacaaagttatgccgccacgcaaaaagaggaggcccgctagcggcgatgatctgtctgctaagaaatcacggcacgactccatgtacaggaagtatgattctaccagaatcaaaaccgaggaagaggccttctcttccaaacgatgcctagaatggttttatgagtacgcaggaacggacgatgtggtgggacccgaggggatggaaaagttctgtgaagacattggcgtggagcctgagaatgtcgtgatgttggtactagcctggaagctggacgcgcaaaacatgggatatttcacactgcaggagtggctcaagggcatgacctctctccagtgtgacaccactgagaagctccggaacacacttgactatttacggtcctttcttaatgactcaacaaatttcaagctgatttacagatacgcctttgacttcgcaagagagaaagaccagaggtccttggatatcaatacagctaaatgcatgctaggcctgttgctaggcaagatttggccgctgttcccagtttttcatcagtttttggagcagagtaaatacaaggtaatcaacaaggatcagtggtgtaatgtcctcgaattctctcgcacgatcaacttagacttgtcaaattatgatgaagacggtgcttggccagtgcttctcgacgagtttgtcgaatggtacaaggataagcagatgtcatag

SEQ ID NO: 220077 - DNA, 1854 bp, Artificial Sequence
  Description of Artificial Sequence: Synthetic coding sequence
atggctgctgttgcagctgggggactggtgggaaagggcagggacatcagcttggctgctctgcagcgacatgacccatatatcaatcgaatcgtagacgtggcttctcaggtcgctctgtacacctttggacatagggccaacgaatgggaaaagactgatgttgagggcacactttttgtgtacacaaggtctgcgtcaccaaagcacggcttcactattatgaaccgcctatccatggagaacaggacagagcccatcacaaaggatctcgatttccaattgcaggatcctttcctcctataccggaacgccaggctttctatttatggcatatggttttatgataaagaggaatgtcagcgcatcgctgagctgatgaagaatttgacacagtatgaacagctcaaagcccaccaggggacaggcgcaggcatttcccctgtcatccttaactctggcgagggaaaagaagtggacatcctacggatgttgattaaggccaaagacgaatacacaaagtgtaaaacatgttcagaaccaaagaagattacaagcagtagtgccatttatgataaccctaaccttattaagccaatccctgtcaaacctagtgagaatcagcagcaacggatcccccagcctaaccaaacattagatcctgagccccagcatttgtcgctgaccgcactgttcggcaagcaggataaggctacatgccaggaaaccgtagaaccccctcagacacttcatcaacagcagcagcagcaacagcagcaacaggagaagctgccaatacgccaaggagtcgtgaggtcgctgagctatgaagaacctcggagacacagtccccctattgagaaacagctttgccctgctatccagaagctcatggtgcggtcagccgatctgcaccccttgagcgaattacctgaaaatcgaccttgtgagaatggctcaacacacagtgctggagaattttttaccggtccagtgcagcctggctccccccacaatattggaacctcgcgtggggtgcaaaacgcgagtcgcacacaaaatctcttcgagaagctacagtcaacaccgggagctgctaacaaatgcgatccttctactcctgcccctgccagcagtgccgcacttaacaggagtcgggctcctacaagtgtgactcccgtagcccctggcaaaggccttgcgcagccaccccaggcatattttaatggatctctgccaccccagaccgttggtcaccaagctcatggtagggagcagtccactctccccagacaaacccttccgataagcggatcgcagactggctcttccggcgttatttccccacaagaactcctcaaaaaactacagatagtacagcaggagcagcaactgcacgcctccaaccgacccgctcttgctgccaagttcccggtgctagctcagagctccgggaccggcaaaccactcgagtcatggattaataaaacaccaaacacagaacagcaaacacctttattccaggtcatctcgccccagcgaatcccagctaccgcagccccatcactgctgatgtctcctatggtgtttgcacagcccacatccgtgccacccaaggaaagagaatccggtttgctcccagtgggcggacaagagcctcccgctgccgctacaagtctgttgctacccatccaatcgccggagcctagcgtgattacttccagccccctgaccaagttgcagctccaggaggccctcttgtatctcatacagaatgacgacaattttcttaatatcatttatgaagcgtacttgtttagcatgacacaggccgctatgaaaaagaccatgtag

SEQ ID NO: 220078 - DNA, 1548 bp, Artificial Sequence
  Description of Artificial Sequence: Synthetic coding sequence
atgcaaattaaggtaagcatttatggaatatggttttacgacaaggaagagtgccagcgaattgccgagctgatgaagaatctcactcaatacgaacaattgaaggctcaccagggcacaggtgccggtatttctcctgtgattttgaacagtggggaagggaaggaggtggatatcctgcgtatgctgatcaaggccaaagacgagtataccaagtgtaagacttgtagtgaacccaagaagattacatcatcctctgccatctacgacaatcccaatctgattaaacctattcccgtgaagcccagcgaaaatcaacagcagagaataccacagccaaaccagaccttagaccccgaaccccagcacttgtcactgacagctctgtttggcaagcaggacaaagcgacctgtcaagaaactgtagagccaccacaaacactccaccaacagcagcagcaacagcagcagcaacaagaaaagcttcctatccgccagggagttgtacggtctctctcctatgaggaaccacgtaggcactccccccctattgagaaacagctgtgtcctgctattcagaaactgatggtgagaagtgcagacctacatcccttgtccgaactgcccgagaatcggccatgtgagaatgggagtacccacagtgcgggtgaattctttacgggaccagtccagccaggatcgccgcacaacattgggacctctcgcggtgtgcaaaatgccagtcgaacccaaaaccttttcgaaaagttgcaatcaacaccgggagcagccaataagtgcgacccctcaactcctgcacctgcctcttccgcggctctgaataggtcccgagcccctacaagcgttacacctgtggctcccggaaaaggtctggctcagccccctcaggcatattttaatgggtccctgcccccacagaccgtaggacaccaggcacatggcagggagcagagtaccctcccccgtcagacgttacccatctctggctctcagactggaagcagcggcgtgatttctcctcaggaacttcttaagaagctgcagattgtgcagcaggaacagcagcttcatgcctcaaataggcccgcactggctgctaagttcccagttctcgcccaatctagtgggactggcaagcctcttgaatcatggattaacaagaccccgaatacagagcagcagacacctctgtttcaggtgatttcaccacaacgcatcccagcgaccgctgcacccagtctcctgatgtcccctatggtgtttgctcagcccacttccgtcccaccaaaggagagagaatccggccttttgcccgtagggggtcaggaaccacctgccgctgcaacttcactactgttgccaatccagtcgcccgagcctagcgttatcactagttccccgctgacgaaattgcagttgcaggaggctttactgtatctgattcaaaacgatgataactttctcaatattatctatgaagcttatttgttctccatgacacaggcagcaatgaagaagactatgtag

SEQ ID NO: 220079 - DNA, 1263 bp, Artificial Sequence
  Description of Artificial Sequence: Synthetic coding sequence
atggagacaaagcgcgtagagatcccaggctcagttttggacgatttctgttctcggtttatcctgcacataccctccgaagaaagggacaatgccattagggtttgcttccagatcgaactggcacattggttctacctggacttttacatgcagaacacgccgggacttccacagtgcgggattcgggatttcgccaaggcagtattttcgcactgtccattcttactgcctcagggcgaagacgtcgaaaaggttctggacgagtggaaagaatataaaatgggagtacccacttacggggcaattattctggatgagaccctggaaaacgtcctgctggtccaaggctatttagcaaagagtggttgggggtttcccaagggcaaagtgaataaggaggaggccccacacgactgcgccgcacgagaagtgttcgaagagacaggcttcgacatcaaggattatatctgtaaagatgattacatcgagctgagaattaacgaccagctggccagactgtacatcattccagggatccccaaggatacgaagttcaacccaaagactaggcgggagatccggaacatcgagtggttttccattgaaaaactcccctgccatcggaatgatatgacccccaaaagcaagctgggtctggcccctaacaagtttttcatggcaatcccctttataagacctcttcgcgattggctgtctcggcgttttggcgacagctccgactccgacaatggattcagctcaactggctctacgcccgctaaacctacagtggaaaagctgagcagaaccaaattccggcactctcagcagctgtttcccgatggctcccccggagaccagtgggtgaagcacagacaaccgttgcagcagaagccgtacaataatcacagcgaaatgagtgacttactgaaagggaagaatcagagcatgcgcggaaatggaaggaagcagtatcaggactcacccaatcaaaaaaaaagaacaaatggactgcaacctgcaaaacaacagaactccctgatgaagtgcgagaaaaagctgcatcccagaaaactgcaagataatttcgaaactgacgccgtgtatgatctgcctagctcttcggaggatcagctgctggaacatgccgaaggccagcccgtggcctgtaatggacactgtaaatttcccttcagctccagggcctttctgtcgttcaaattcgaccataacgccatcatgaagattttggatctgtag

SEQ ID NO: 220080 - DNA, 1158 bp, Artificial Sequence
  Description of Artificial Sequence: Synthetic coding sequence
atggaaactaaaagagtggaaatccctggctcagtgctcgacgacttttgttcacgctttatccttcatattccctctgaagaaagggataatgcaattcgggtctgttttcaaatcgaattggcccattggttctaccttgacttctacatgcagaacactccaggacttccccagtgcggcatccgcgactttgcaaaggcagtgttcagccactgcccctttcttttgcctcagggggaagatgttgaaaaggtgctcgatgaatggaaagagtacaagatgggtgtccccacatatggcgctatcattctggacgagaccctggagaatgttttgctggttcagggctatctggccaagtctggctggggtttccctaagggtaaagttaacaaagaagaggccccacatgactgcgcagctagagaggtgttcgaggagactggctttgacatcaaagactacatttgcaaggatgactacatcgaactaaggattaacgatcagctcgccagattgtacatcattccgggaatccctaaggacactaaattcaaccctaagactaggcgcgagattagaaatatagaatggttcagcattgagaaattaccttgtcatagaaacgatatgacaccaaaaagcaaactcggattggctccaaacaaattcttcatggcgattccatttattaggcctcttcgagactggctgagtcgcagatttggtgatagctctgatagcgacaacggcttctcgtctacaggttcaacacctgccaagcccacagtggaaaagctaagccggacgaaatttagacactctcagcagctgttccctgacgggagcccaggcgaccagtgggtgaaacaccggcaaccgctacagcaaaaaccatataacaaccattctgagatgagtgacttactcaagggcaagaagtgtgagaaaaagcttcaccctcggaagttgcaggacaacttcgagaccgatgccgtctacgacctacccagttcaagtgaggatcagcttcttgagcacgcagagggacagccagttgcctgcaacggccactgcaagtttcctttctcatctagagcttttctatcatttaagttcgaccacaacgctatcatgaaaatactggatctgtag

SEQ ID NO: 220081 - DNA, 630 bp, Artificial Sequence
  Description of Artificial Sequence: Synthetic coding sequence
atgacacccaaaagcaaactgggcctcgcccctaacaagtttttcatggcgataccgtttatcaggccccttagggattggttgtccagacggttcggggattccagtgacagtgacaatggctttagcagtactggaagcactccagctaagcccaccgtcgaaaagctatcaagaaccaagttcaggcattcccagcaattgttccccgacggatctcctggcgaccagtgggttaagcacagacagcccctccagcagaaaccatacaacaatcatagcgagatgagcgatcttctgaagggtaagaatcagtcgatgagaggcaatggcagaaagcagtaccaagacagcccaaatcagaaaaagcgaaccaatgggctgcaacccgctaaacagcagaactctctcatgaaatgcgagaaaaaactgcacccaagaaagttacaggataacttcgaaaccgatgctgtgtacgacctgccgtcttctagtgaagaccagctgctggaacacgcagaagggcagcccgtggcatgcaatgggcactgtaagtttcccttctccagtcgggcatttctgagtttcaaatttgaccacaacgccatcatgaagattttagacctttag

SEQ ID NO: 220082 - DNA, 1341 bp, Artificial Sequence
  Description of Artificial Sequence: Synthetic coding sequence
atgacagaactggggatggtcgtgttgggcatcgacaccactcatctgtggatgctgcccctgactccaggatcatggaacagcatgaggtcaaggcacaagtggaactggccacagggcagttggggcttagggggtcctcctagaagcacggcttttttagaatgttgtacatcattccttcccaatgaccttggtttcaccgactcttactcgcagaaggctttctgtggtatttatagcaaggatgggcaaatctttatgagtgcttgccaggaccagacgatcagattatatgactgcaggtacgggcgattcagaaaattcaaaagcattaaggccagagatgttggatggagtgtgttggacgtggcgttcaccccagatggcaaccattttctgtactcctcctggagtgactacatacatatctgtaacatctacggtgagggggatacccacaccgcactcgacttgaggcccgatgaacgccgatttgccgtttttagtatagccgtgtcttcagatggacgtgaggttctcgggggagctaacgacggctgcctatacgtgttcgaccgggaacagaatcgaagaactctccagattgaaagccacgaggatgatgtcaacgctgtcgcctttgccgacatctcgtctcagatcctgttctccggaggtgacgatgctatctgcaaagtgtgggacagaaggaccatgagggaggatgatcccaagcctgtgggggctctggccggtcaccaggacggcatcactttcattgacagcaagggagatgcaaggtacttgatttcaaacagcaaggatcagaccatcaaactctgggacatacgacggttctctagccgagagggaatggaagcctctagacaggcagctactcagcaaaactgggactataggtggcagcaggtgcccaaaaaggcctggagaaagctaaaactccccggagattcctccctgatgacgtacagaggccacggggtcctgcacactctcatacggtgtcgctttagcccaattcactcaacagggcagcaattcatctattccggttgtagcaccggtaaagtagttgtgtatgacctgctgtcaggacacattgtgaagaagctcacaaaccacaaagcttgcgtgcgggatgttagctggcacccctttgaggaaaagatagttagctcctcgtgggatggaaatctgcgcctatggcagtaccgccaagctgagtactttcaggatgatatgcccgagagcgaggaatgtgcatctgctccggcacctgtgcctcagagttcaacaccctttagctcccctcagtag

SEQ ID NO: 220083 - DNA, 1563 bp, Artificial Sequence
  Description of Artificial Sequence: Synthetic coding sequence
atggggtccagaaactcatcaagcgctggctcgggctctggcgacccctccgaaggcctccccagacgcggagctgggctgaggcgtagtgaggaggaggaagaagaagacgaagatgtggatcttgcccaggcactgctggacagcgaggaggagaacgaccgcgcttgggacggcaggttgggagacagatacaaccctcccgtggacgcaacacccgatacgagagagcttgagttcaatgaaatcaagacccaggtcgagctggccactggccaactcgggctccggagagccgctcaaaagcactccttccccagaatgttacatcagcgcgagagaggcctgtgtcatagaggaagcttttcgttgggtgaacaaagcagagtcattagccactttttacctaatgatcttggatttactgactcctatagccagaaagccttttgtggcatctatagcaaggatggtcagatttttatgagcgcgtgccaggatcaaaccatcaggctgtacgattgccgatacgggcgatttagaaagttcaagtctatcaaggctcgagacgtaggttggtccgtactggatgttgcgtttactccggacggtaaccattttctgtatagctcctggtctgattacatccacatctgcaacatctacggggaaggtgacacccacactgcactggacctacgccctgacgagaggcggtttgcagtcttttctattgctgtgtcttcggacggacgcgaagtcctcggcggagccaacgatggatgcctgtatgttttcgaccgggagcagaatagaaggacactgcagattgaatcacacgaagatgacgtcaacgcagtggctttcgccgacattagttcccaaatactcttttccgggggagacgacgcaatttgtaaagtgtgggaccgacggaccatgagagaggatgatcccaagccagtcggcgctctggcgggacaccaggatgggatcactttcatagactctaagggcgacgcacggtatttgattagcaatagcaaagaccagactataaagctgtgggatatccgccgattttccagtagggagggtatggaggcctcccggcaggccgctacccagcagaactgggattacaggtggcagcaggtacccaaaaaagcctggagaaagctgaagctgcctggggattcctctctgatgacctaccggggtcacggcgtactccacactctgataagatgtcgcttttcgccaattcactccacagggcagcagttcatatatagcggctgtagcactggaaaggttgtcgtgtacgatcttctgagcgggcatatagtgaagaagctcaccaaccacaaggcctgcgtaagggatgtgtcttggcaccctttcgaggagaaaatcgtctcaagttcatgggacgggaacctgcgtctgtggcagtaccggcaggctgagtatttccaggatgatatgcccgaaagtgaggaatgcgcgtccgccccagcacccgtgccccagtcttcaactcctttcagttctccacagtag

SEQ ID NO: 220084 - DNA, 1641 bp, Artificial Sequence
  Description of Artificial Sequence: Synthetic coding sequence
atgggttctaggaattcttctagcgccggttctggcagcggcgaccccagcgaaggtctacctagacgcggagctgggttacgtcggagcgaggaggaagaagaggaggacgaggacgtggatctggctcaggtgctggcctatctcctgcgtcgcggacaagtgcgacttgtccaagggggaggggctgcaaacctgcagtttattcaggccctgttggattcagaagaggaaaatgaccgggcatgggatgggcgactgggggaccggtacaatcctccagttgatgctacccccgacacccgcgagcttgaatttaatgaaataaagacccaggtggagttagctacaggacagctggggctgaggcgcgcagcccagaagcactcatttcctagaatgcttcatcagagagagcgtggattatgccaccgaggatccttttcgttgggtgaacagagcagggtcattagtcactttctccctaacgacttgggcttcaccgactcttactcccagaaggctttttgtggcatctactcgaaggacggacaaattttcatgtcggcttgtcaggaccaaaccattagactctatgattgccgatatggaaggtttaggaagttcaagagtattaaagcgagggacgtcggctggtctgttttggatgtcgctttcacgcccgatggcaaccacttcctttactctagttggtccgattacatacatatctgcaacatctatggagaaggtgacactcacacagccctggacctgaggccagatgaaagaagattcgccgtcttcagcattgccgtctcctctgacggccgtgaagtcctgggaggagcaaacgatggctgtctttacgttttcgatcgagaacaaaatcgaagaacattgcagatcgaaagccacgaggacgatgtcaacgctgttgccttcgccgacattagtagtcagatcctgttcagtggcggtgatgatgcgatttgcaaagtttgggatcggagaactatgcgggaagacgatcctaagcctgtgggcgcactcgctggccaccaggacggaatcacatttatcgacagcaagggggacgcaaggtatctaatttccaattccaaagaccagaccatcaaactctgggacatccgacggtttagctcacgtgaagggatggaagctagcagacaggccgcaacccagcagaattgggattatcgctggcagcaggtgcccaagaaggcttggaggaaacttaaactgcccggagactctagccttatgacatacagaggccacggcgtattacatactctgatccggtgtcgcttcagtcccatacactcaacaggtcagcaatttatatattctggctgctcaaccggcaaggtcgtcgtctatgacctcttgagcggccatatagtcaaaaaactcacaaaccacaaggcttgcgtgagagatgtatcatggcatccgttcgaagagaaaattgtcagtagctcctgggatggaaacttgcgcctctggcagtaccgccaggctgaatacttccaggacgatatgccagagtctgaggagtgtgcctccgcccctgctcctgtgccccaatctagtaccccttttagctcccctcagtag

SEQ ID NO: 220085 - DNA, 369 bp, Artificial Sequence
  Description of Artificial Sequence: Synthetic coding sequence
atgggttccagaaattcatctagtgccggttctggatccggggacccttccgagggcctgcctcggaggggcgcaggcctgcgcagaagcgaggaggaggaggaagaggacgaagacgtagatctcgctcaggtcctggcctatctgttgaggagggggcaggttcgtctcgtgcaggggggaggcgcagccaacttgcagtttatccaggccctcttagacagtgaagaggagaatgaccgggcttgggatgggaggcttggggatcggtacaaccctccagtcgacgccacaccagacacacgggaactggagtttaacgagatcaagacccaggtggagcttgccacaggtcaattagggctgtag

SEQ ID NO: 220086 - DNA, 222 bp, Artificial Sequence
  Description of Artificial Sequence: Synthetic coding sequence
atgggtagtaggaactcttcatccgccggatccggctcaggagacccatccgaaggcctgccgaggaggggagccggtctccgccgttcggaagaggaagaggaagaagacgaggacgtggacctagctcaagtgctcgcctacttgctcagacgcggacaagtgcggcttgtccagggtggcggagctgcaaatctgcaatttatacaagcactcctctag

SEQ ID NO: 220087 - DNA, 282 bp, Artificial Sequence
  Description of Artificial Sequence: Synthetic coding sequence
atggggtcgaggaactctagttccgcaggcagcgggtccggagaccccagtgagggattgccccgtcgtggggcagggcttcgcagatctgaagaggaagaagaagaggacgaggatgtggacttagcgcaagtgctagcctacctactccgcaggggccaggtcagactggtgcagggaggaggagccgcaaacttacagtttatccaggctcttctggactctgaagaggagaacgacagagcctgggacgggagacttggagacagatataatccctag

SEQ ID NO: 220088 - DNA, 327 bp, Artificial Sequence
  Description of Artificial Sequence: Synthetic coding sequence
atgggttcccggaattcctctagcgccggttctggaagtggagacccctctgagggactaccgaggcggggagcaggcctgcgccgaagcgaggaggaagaagaggaggatgaggatgtcgacctggcccaggttctggcgtacctgttacgtagaggacaggtgcggttagtgcagggagggggagcggctaatctccaatttatccaggctctactggatagcgaggaggaaaatgaccgcgcttgggatggaagactgggggaccgatacaacccccctgtcgacgcgacccctgataccagagaactcgaattcaacgaatag

SEQ ID NO: 220089 - DNA, 1641 bp, Artificial Sequence
  Description of Artificial Sequence: Synthetic coding sequence
atgggctctaggaactcatcctccgctggatcaggctccggtgatcccagcgaggggctgcctcggagaggcgcaggtctgagaaggtcagaggaggaggaggaggaggatgaagatgtagacctggcccaggtactcgcctacttacttaggcggggacaagtacgcctcgtgcaggggggtggggctgctaacctgcagttcattcaggctctcctggatagtgaggaggagaatgacagggcctgggacggtaggctcggagaccggtacaatccccctgtggacgcaacccccgacacccgggagttagagttcaatgaaatcaaaacccaagttgaacttgccactggtcagctaggcttgagacgggctgcacagaaacactctttccctagaatgttacaccagagggagagaggactgtgccatcgcggttccttttccctgggcgaacagtccagagtgatctctcacttcctgccaaacgatttggggttcacggactcatattctcaaaaggctttctgtggcatttatagcaaagacggccagatctttatgtcagcttgtcaggatcagaccatcagactgtatgattgtcggtacgggcgttttcggaaattcaaaagcattaaagcaagggacgtggggtggtctgttcttgatgtcgccttcaccccagacgggaaccacttcctttacagttcttggtccgactatatccatatctgcaatatttacggggaaggggatacacacacagctcttgacttgcgtcctgatgaacggcgatttgcagtcttttccattgccgtatcctcagatggcagagaggtactggggggagctaacgacggttgtctatacgtctttgaccgggaacagaaccgccgaacacttcagatcgagtctcatgaagatgacgttaatgccgttgccttcgccgacatttcaagccagattttatttagcggcggtgacgatgccatctgtaaagtgtgggaccggaggacaatgcgagaggatgatcctaagcccgtcggcgcactcgcaggccatcaggatggcatcacgttcatcgactccaagggagacgccaggtatctgatcagcaacagcaaagatcagacaatcaaactgtgggacattcggcgattttcttctagggaggggatggaggcttctcggcaggcagctacccaacagaactgggattaccgctggcagcaggtgcctaaaaaggcctggaggaagctcaagctgccaggagactccagcctgatgacctaccgcggacacggtgtcctgcacacattaattcgctgccgattcagtcctatacactccactggccaacagtttatctacagtggatgctctacagggaaagtcgtggtttacgacctgctctctggccatatagtgaagaagcttaccaatcacaaagcttgtgtccgcgatgtgtcttggcatccatttgaggagaagattgtgtcctcttcttgggatggcaacctgcgcctttggcaatacaggcaggcggagtactttcaagacgacatgcccgaaagtgaggagtgcgcgtccgcccctgcaccagtgccacagagcagcacaccgttttctagcccccagtag

SEQ ID NO: 220090 - DNA, 273 bp, Artificial Sequence
  Description of Artificial Sequence: Synthetic coding sequence
atgggtagtagaaactcgtcatccgcagggtctggttccggtgatccttccgaggggctgccacggcgtggtgctggtctgcgccgatccgaagaagaagaagaggaagacgaagacgtagacttagcccaagcactgcttgatagcgaggaagagaacgatcgggcatgggatggaaggctgggggatcgatacaaccctcccgtggatgctacgccagacacacgcgagcttgagttcaacgaaatcaagacacaagtcgagttagcgtag

SEQ ID NO: 220091 - DNA, 93 bp, Artificial Sequence
  Description of Artificial Sequence: Synthetic coding sequence
atggggtccaggaatagtagcagtgccggtagtgggtctggcgaccccagcgaggggctgccccgacggggagcaggactgcggaggtcttag

SEQ ID NO: 220092 - DNA, 429 bp, Artificial Sequence
  Description of Artificial Sequence: Synthetic coding sequence
atgggcagtcggaactcatccagcgctggctctggatcaggcgacccatcagagggactacctcggaggggagccggtcttaggaggagtgaggaggaggaggaggaagatgaagatgtcgatttggctcaagtactagcttacctacttcgcagaggccaggtacgcctggtgcagggaggaggcgcagccaatttgcagttcattcaggctctgttagactccgaagaggaaaatgatcgggcatgggacggcaggctaggtgatagatacaaccccccagtcgatgcgacccctgacacccgggagctggaatttaatgagatcaaaacacaagtcgagttggccacagggcagttgggcctgcgtcgagccgctcaaaagcattctttccccaggatgctgcatcagagagaacgcggactttag

SEQ ID NO: 220093 - DNA, 204 bp, Artificial Sequence
  Description of Artificial Sequence: Synthetic coding sequence
atggggtcccgcaactcttcttcggcgggttccggcagcggcgacccttctgagggccttccccgacgaggtgccggactgagacgttccgaggaagaagaagaagaggacgaggacgtggatctggcccagcggccatccgaggtgggagccggtaggcgatgcagcaagtttacgatccactcggggccattggggctttag

SEQ ID NO: 220094 - DNA, 321 bp, Artificial Sequence
  Description of Artificial Sequence: Synthetic coding sequence
atggggtctcgcaatagctcatctgctggatccggaagtggggacccctccgagggcctgcctcgtcgtggcgctggactgagacgcagcgaagaagaagaagaggaggatgaggatgtcgatctagctcaagtgctggcatatcttctgcggagaccgagttggactcaacgaaagcgtatgacagaactgggcatggtagtgctgggaattgacacgacccatctctggatgcttcccttaactcccggtagctggaattctatgcgcagccgacacaaatggaactggcctcagggcagctggggcttggggggatag

SEQ ID NO: 220095 - DNA, 387 bp, Artificial Sequence
  Description of Artificial Sequence: Synthetic coding sequence
atgggcagtcggaactcatcctcagccggatcagggtccggcgacccatctgaggggctcccccgaagaggagccggactgaggcggagcgaggaagaagaggaagaggacgaggacgtcgacttagcccaggccctgctggattccgaggaagaaaatgaccgcgcttgggacggaaggctgggggatcgctataacccgcctgtcgatgctacccccgatacccgtgagctcgagttcaacgaaattaagacacaagtggaactcgcgacaggccagctgggactaagacgtgccgctcagaagcacagttttcctcggatgttacaccagcgcgaacgtggactgtgccacagagggtcctttagcttgggggagcagtcttag

SEQ ID NO: 220096 - DNA, 465 bp, Artificial Sequence
  Description of Artificial Sequence: Synthetic coding sequence
atggggtccagaaacagttcctcagcaggttctggatccggggatccgtcagaaggattgccccgacggggagccggactgcggagaagcgaggaggaggaagaggaagatgaagacgtcgatctcgctcaagttctcgcctacctgttacgaaggggacaagtcagactcgtgcaaggagggggagctgccaacctgcagtttattcaggccctgcttgattcagaagaggagaacgaccgagcttgggatggcagactgggtgatcgctacaacccccctgtcgacgccactcccgatacaagggagctggagttcaacgaaattaaaactcaggtggagctggccactggacaactcggcctgcgaagggccgctcagaaacacagttttccacgtatgctgcaccagcgggagagagggctttgtcaccgagggtctttctccttgggtgagcagagttag

SEQ ID NO: 220097 - DNA, 2829 bp, Artificial Sequence
  Description of Artificial Sequence: Synthetic coding sequence
atgaagcggagagccggactgggtggctcaatgcgctcagtggtggggtttctatcacaaagaggtcttcacggagatccattacttacccaggattttcagcggagacggctgcggggatgtcgcaatttatacaagaaagatctcttaggtcactttggatgcgttaacgctatcgagttctccaacaacggcggtcagtggctcgtcagtggcggtgacgatagaagagtcttgctgtggcacatggagcaggccatccacagcagagtgaaaccaattcagctgaaaggtgagcatcacagcaacattttttgcctggctttcaacagcggaaacactaaggttttttcaggtggcaatgacgagcaggtcatcctccatgacgtggagtcaagtgaaaccctagatgtttttgcccacgaggacgctgtgtatgggctctccgtgtcgcctgtgaacgacaacattttcgccagcagctctgatgacgggcgagtgcttatctgggacatccgcgagagtccgcatggtgaacctttctgtttggctaactacccatctgcttttcattccgtaatgtttaatccagtcgaaccaaggttgcttgccacagcaaattccaaggaaggtgtggggctgtgggacatacgaaaaccacagtcttccttgctccggtatggaggtaacctttctctgcaatccgcgatgtcagtgaggttcaacagcaatgggacacagttgctcgcgttgaggagaagactaccacccgtcttatatgacattcactctcggcttccggtgttccaattcgataatcagggttactttaactcgtgcaccatgaagtcttgctgctttgctggggaccgcgaccagtatattttgtccggaagcgacgactttaatttatatatgtggagaattccggcagaccctgaagccggaggtatcgggcgagtggtcaacggcgcattcatggtcctcaaaggacatcggagcattgtcaaccaggtaaggtttaacccccatacatatatgatttgttcaagtggcgtggagaagatcatcaaaatatggtcaccttataagcaaccagggtgcactggggatcttgacgggcgtattgaggacgactcaaggtgtttatacacccatgaggagtacatcagtctggtgctcaattctggcagcggcctgagccatgactacgcaaatcagtccgtgcaggaggatccaaggatgatggctttctttgacagtctggtccgtagggagatcgaaggatggagcagtgattctgattctgatctcagtgaaagcactatcttacagctccatgcaggcgtctccgagcgctcaggatacacagattccgagagcagcgcatctcttcccaggagcccccctcccaccgtggacgaatccgctgataatgcatttcacctgggtccactgcgagtcaccactaccaacacagttgcatctaccccccctacaccaacttgcgaagacgcagcatctaggcagcagcgactgtctgctctaaggagatatcaggataagcgccttttggccctgagcaatgaatcagattcagaggagaatgtttgcgaggtggaactcgacaccgatctgtttcccaggccgcgttctccaagtccggaagacgagagcagttcatcgagttcgtcatcctcttccgaagatgaagaagagctgaacgaacggagagctagtacctggcagagaaacgcgatgagacggagacaaaagaccacacgggaggacaaacccagcgcccctataaagcctactaacacatatattggggaggacaattatgattatccccagatcaaagtggatgacctgtcttcatctccaacctctagccccgagaggtccactagcaccctggagattcagccctcccgcgctagccccacaagtgatatcgaaagtgtcgagcggaagatttataaggcgtataaatggctgcgatatagttatataagctactcgaacaataaagacggcgagacatcattggtgactggagaggccgacgaagggagggctggcactagccacaaggacaacccagcccctagttcatcaaaggaagcctgtctaaatatcgctatggcacagagaaaccaagaccttccccctgaaggctgcagcaaagatacttttaaggaggagaccccccgtaccccctctaatggcccaggccatgagcactcttctcatgcatgggccgaagtccccgagggtacatcacaggacacagggaactccgggagcgtggaacacccttttgaaacaaaaaaattaaacgggaaggccttgtcttcacgcgctgaggagccacccagcccaccggtacccaaagccagtggcagtactctcaattcaggcagcggtaattgcccacggacccaatcagatgatagtgaggagcgcagtttggaaacaatttgcgctaaccataacaacggacgactgcacccccgacctccccatcctcacaataacggccagaatttgggcgagctggaagtcgtggcatactcaagccctggccattctgatactgatcgggataactcatcgctgactggaacccttttacacaaagactgttgcgggtcggagatggcatgtgagacgcctaacgccggtactcgcgaagatcctactgataccccagcgaccgactcaagcagagctgttcacggccacagtggacttaagaggcagcggattgagctggaagatacggatagcgagaacagtagctcggagaagaagcttaaaacatag

SEQ ID NO: 220098 - DNA, 2583 bp, Artificial Sequence
  Description of Artificial Sequence: Synthetic coding sequence
atggaacaggccatccattcccgtgtgaagcctatccagcttaagggtgagcaccactccaacatattctgcctcgctttcaattccgggaatacgaaggtcttctctgggggtaatgatgaacaggttatcctccacgatgtcgagagctcagagacgctggatgtctttgcccatgaggatgcggtgtacggtctttcagtgtcacccgttaacgacaatatttttgcctccagttcagacgacggaagagtactgatctgggacatacgggaatcaccgcacggtgaacctttctgcctggccaattatcctagtgctttccactcagtgatgttcaatccagttgaaccgaggctgcttgccacagccaattctaaggagggtgtcggactgtgggacatccgaaagcctcagagctcacttctgcggtatgggggaaacctatctttgcagtctgccatgtccgtgcgattcaactccaacggcactcagctcctggccctgcgtcgtagattacctcctgtactttatgatatccattctcgcctccctgtatttcagttcgacaaccagggatatttcaactcatgcacaatgaagagctgctgtttcgccggagatcgagatcaatatattttgagtggtagtgacgacttcaacctgtatatgtggcgaatccccgctgacccagaggccggaggcattggcagagtggtgaacggagcgttcatggtgttaaaaggccacaggtctatagttaaccaggttcgatttaacccccatacctacatgatctgttcctctggagtggaaaagatcattaaaatctggagcccctacaagcaacctggttgcaccggagatctggacggtcggatcgaagacgattcccggtgcctgtacacacacgaggagtatattagcctggtgctgaattccgggtccggcctcagccatgattatgcgaatcagtccgttcaggaagaccccagaatgatggcattctttgattctcttgttcgtcgcgagatcgaaggctggtcatctgattccgactctgatctttcggagtccaccatactccaactgcatgcaggagtaagtgagcggtcaggttatactgacagtgagagttccgcctctctccctaggtcaccacccccaacagtcgatgagagcgctgataatgcatttcacctgggtcctcttcgtgttactacgaccaatactgtggctagtacccctcctaccccaacttgcgaggacgcggcaagccggcaacagcgtctatctgctttgagaaggtaccaggacaaacgccttctcgccctgagtaacgagagcgacagtgaggagaatgtttgtgaggtcgagctggatacggacctgttcccaagacctagaagcccgtcacctgaggacgagtcttcctcatcttcaagctcctcttcgtccgaggacgaggaagaactgaacgagcgccgagcaagcacatggcaacggaatgccatgaggaggaggcagaagactacccgtgaagataagccttcagcaccgataaaacctacaaacacttacatcggtgaggataactatgactaccctcagatcaaagtcgacgacctgagcagctccccaacaagtagccctgagcggagcacttcaactctcgagattcagccctctcgagcctcaccgacgagcgacattgagagcgtcgagagaaaaatctataaggcttacaaatggttgagatactcctacatttcctacagcaataacaaggacggcgagacaagccttgtgaccggcgaagcagacgaagggcgtgccggtactagtcacaaagataaccctgcgccatcctccagcaaagaggcatgtttgaacattgcgatggcccagagaaaccaggatctccctcccgagggttgttctaaggacactttcaaagaggaaactcccagaactcctagcaacggtccaggacatgagcacagctcccatgcatgggctgaggttcccgaagggacctcacaagatacggggaacagcggctctgtggagcatccttttgagaccaagaagcttaacggtaaggcgctctcaagcagagctgaggagccaccttctccgccagtccccaaggccagcggatcgacgctcaattcaggcagtggcaattgtccacgaactcagagcgatgactccgaggagcgcagcctcgaaacaatctgcgctaatcacaacaacggtcgcctccacccaagaccacctcatcctcataataatggtcaaaatctgggtgagctcgaagtggtcgcctactcgtccccaggccactcagacaccgacagggataattcctcactgacgggcaccctgctccacaaggactgttgcggatctgaaatggcctgcgaaactcctaatgctgggacacgagaggacccaaccgatacacctgcgaccgacagcagccgggcagtgcacggacactccggactgaagcggcaacgcatcgagcttgaggatacggattcagaaaacagctcctcagaaaaaaagcttaagacgtag

SEQ ID NO: 220099 - DNA, 633 bp, Artificial Sequence
  Description of Artificial Sequence: Synthetic coding sequence
atggagcaggcaatccactcaagagtgaaacctatccagctgaaaggggagcaccacagtaatatcttctgcttagctttcaatagcggcaacactaaagtgttcagcggcggtaatgatgaacaggtgatcttacatgatgtggagagcgagaccttagatgtattcgcgcacgaagacgccgtttatggccttagtgtctctccagttaacgataacattttcgcctccagctccgatgatggcagagtacttatttgggacatccgagagtcaccccacggggagccattctgtcttgccaattacccgagtgcttttcattctgtcatgttcaaccctgtcgaaccccgactgttggccacagctaacagcaaggagggtgtcggcctgtgggacatccggaagccgcagagctcacttctgagatatggcggaaacctttcactccagagtgcgatgtccgttcgcttcaactccaacggaacgcaactcctggccctgaggcggaggctccccccagtgctctatgatatccactcccgcttacccgtgtttcagttcgacaaccaagggtattttaatagttgtacaatgaagtcgtgctgttttgccggtgaccgtgaccaatag

SEQ ID NO: 220100 - DNA, 2583 bp, Artificial Sequence
  Description of Artificial Sequence: Synthetic coding sequence
atggaacaggctattcattccagagtgaagccaattcaacttaaaggcgaacatcattctaatatattttgcctcgccttcaactcgggaaacacaaaggtgttcagtggcggaaatgacgaacaagtcattttgcacgatgtggagtctagtgaaaccttagacgtcttcgcccatgaggatgctgtttacggactgtcagttagcccggtgaacgataatatcttcgcttcctcttctgatgatgggcgtgtgctgatttgggacataagagagtccccacacggtgaacccttctgcctggccaattacccctcagctttccactctgttatgtttaaccctgtcgagccccgactcctggctacagctaacagcaaagaaggcgtcggactgtgggatattaggaaaccacagagctcactcctccggtatggcggtaacctttcattgcaatcagcgatgtccgttcgctttaacagcaacggtacccagctgttggccctgaggaggcgcctgccacctgtgctgtatgacatccatagtcgcttgccagtgttccagttcgacaaccagggctattttaatagctgtactatgaaaagttgttgcttcgctggcgatagagatcaatacatcctgtccggatcagacgacttcaacctttatatgtggcgaattccagccgatcccgaagctggagggataggcagggtcgtcaacggcgcattcatggtgttgaagggccatagaagcatagttaatcaagtgagattcaacccacatacatacatgatttgttcatcgggggtcgagaaaatcatcaagatctggagtccatacaagcaacccggatgtaccggcgacctggatggcagaatcgaagatgattctcgctgcctgtatacacacgaggaatacattagtctcgtccttaactccggatcagggctgtctcacgattatgctaatcagagcgtccaggaagatcctcggatgatggcttttttcgatagtctggtacgacgcgagattgagggctggtccagtgatagcgactctgatctgagcgaaagtacaatcctgcagctccatgcaggggtcagcgagagatctggatacacggatagtgagtcctctgcctccctacccaggtcccccccacccacggtggacgaatcagccgataatgcatttcacctgggtccccttcgggtgaccactactaataccgtggctagcactcctccaacccccacgtgtgaagacgctgccagccggcagcaaaggctgtctgccctgcggagatatcaagacaaaagactgctcgctttgtccaatgaaagtgattctgaggaaaatgtgtgtgaagtcgagctggacacagatctgttccctagacctcgctctccaagcccggaggacgaatccagctcaagcagcagctctagtagttcagaggacgaagaggagcttaatgagcggcgagcgtccacctggcaacgcaatgccatgcggagacggcagaaaaccaccagggaggataagcctagtgccccaattaagcccacaaatacatatatcggagaagacaattacgactacccacagataaaggtcgacgatttatcctcctcacctacatcctctccggaacggagtacatcaacgttggagatacaaccatcacgcgcttctccaacatctgacattgaatccgtggaaagaaaaatctacaaggcttacaaatggctgcgatactcctacattagctacagtaataacaaagacggagagacaagtctggtcactggggaagcagatgagggacgtgcaggaacaagtcacaaggacaacccagccccaagctcgtcgaaagaagcatgtcttaatatcgccatggctcagcggaaccaggacctcccccctgagggttgcagtaaggacacgttcaaggaggaaacgcccaggacgcccagcaacggccctgggcatgaacattcttcgcatgcctgggctgaggtccccgaaggtactagccaggacaccggcaattctggcagtgttgaacacccctttgaaacgaagaaacttaacgggaaggccctctctagtagggccgaagaacctcctagtcctcctgttcctaaagccagcggcagtaccctgaatagcggatccggcaactgcccacgaactcagagtgacgacagcgaggagaggtccttggagacgatctgtgcgaatcataataacggacgactccaccctcggccaccccaccctcacaacaacggacagaacctaggagagttggaggttgtggcctactccagtccaggccactctgacacggaccgagacaattccagtctcacaggcactctgctgcataaggattgctgtgggagcgaaatggcctgcgagacgcctaatgcgggaacgagagaggaccccaccgatacaccagccacagactcttcaagggcagtgcacggccacagcggactcaagcgtcagaggatagaattagaggacacggactccgagaatagtagcagcgagaaaaagctgaaaacctag

SEQ ID NO: 220101 - DNA, 357 bp, Artificial Sequence
  Description of Artificial Sequence: Synthetic coding sequence
atgccttttctggagcttgataccaacctacccgcaaatcgcgtcccggctggtcttgaaaaacgcctgtgtgctgcagcggcttcgatcctaggaaaacctgctgatcgggttaacgtcacagttagaccgggattggccatggcccttagtggctcaactgaaccctgcgcgcaactctccatctcctctatcggcgtagtggggaccgcagaagataacaggtctcattctgctcatttctttgaattcctgacaaaggaactagctctgggacaggacaggatactcatcagattcttccctctcgagtcatggcaaattggaaagatcggaactgtgatgaccttcctctag

SEQ ID NO: 220102 - DNA, 357 bp, Artificial Sequence
  Description of Artificial Sequence: Synthetic coding sequence
atgcctttcttagagttggatactaacctgccagccaatcgggtgcctgccggactggaaaagcgactgtgtgccgcagccgcatcgattctcggtaagcctgcagatcgcgtaaacgtcacggttcgcccagggctagccatggccttaagcggcagcacagagccctgtgcccaactgtccatcagttctataggggttgtaggaaccgcagaggacaataggagtcatagtgcccatttctttgaattcctgactaaagagctggcactggggcaggatcgaatcttgataaggtttttcccattggaatcatggcagattggcaagatcgggactgttatgactttcctctag

SEQ ID NO: 220103 - DNA, 399 bp, Artificial Sequence
  Description of Artificial Sequence: Synthetic coding sequence
atgcagctctttctcttagctgtcagcgtgccccttcctgccatgcccttcctggagctcgacaccaacttgcctgctaatcgagtgccggcagggttggagaaaagactgtgcgcagccgctgccagcatactcggcaaaccagccgatagggttaacgtaaccgtgcgtcccggtttggcaatggcacttagtgggtctaccgaaccttgtgcgcaactctcaatctctagcattggtgtcgttggtactgctgaggacaacaggagccattcagcccacttctttgagttcttaacaaaagaactcgctctcggccaggaccggatcctcatcaggttcttccctcttgaatcctggcagatcggaaaaataggaacagtaatgacatttctttag

SEQ ID NO: 220104 - DNA, 348 bp, Artificial Sequence
  Description of Artificial Sequence: Synthetic coding sequence
atgcccatgttcatcgtgaacaccaacgtgccccgagcctccgtacccgacgggttcctgagcgaactgacacagcagctggctcaagccaccgggaaacctcctcaatacattgctgttcacgtagtacccgaccagctcatggcttttggaggttcctcagagccatgcgccctgtgctcgctgcacagcatcgggaagattggaggggcacagaacaggagttactcgaaacttttgtgcggtttgctcgctgagagacttagaatatctcccgatcgcgtctacattaattactacgatatgaacgccgcaaatgtgggctggaataacagcaccttcgcttag

SEQ ID NO: 220105 - DNA, 1224 bp, Artificial Sequence
  Description of Artificial Sequence: Synthetic coding sequence
atgaataacagtggtgccgacgaaattggaaaactttttgtcggtggtctggactggtccacgacacaggagacgctgcgttcctacttctcacagtatggcgaggtcgtcgactgtgtgattatgaaggacaaaactaccaaccagtcccggggatttggttttgtaaaattcaaggaccccaactgcgtgggcacagttctggcctctcgaccgcatacgctggatggcagaaacatcgatcctaaaccctgtactcctagaggtatgcagcccgaaaggacacgcccaaaagaaggatggcagaaaggtcccaggagtgataacagtaagtcgaacaagattttcgttggtggtattccccataattgcggcgagaccgagctgcgggaatattttaaaaagtttggcgtcgtgacagaggtcgtcatgatatacgacgcggagaaacagcgcccaagaggattcgggttcatcacttttgaggacgagcagagtgtcgatcaggctgtcaacatgcattttcacgacatcatgggaaaaaaggtggaggttaagcgtgctgaacccagggattctaaatctcaggcgccaggacaacccggtgcgtcacaatggggatcacgcgttgtgcccaacgccgctaatggttgggctggacagcctccacctacttggcagcaaggatatggtcctcagggcatgtgggtgccggctgggcaagctatagggggttatggacccccacctgcgggacgtggcgctccgccacccccaccccctttcacatcatacattgtcagtactccacctggcggttttcccccaccccaggggttcccccagggctatggagccccaccccagttcagctttggttatggccctcctcctccccctcctgaccagtttgcaccgccaggcgtaccgccaccccctgcaacccccggagcggcaccccttgcgtttccccctccaccctcacaagcggcacccgatatgtccaagccaccaaccgcccagcccgacttcccatacggtcagtacgccggttacggtcaggacctgtccgggtttggccaaggtttctccgaccccagccaacagccaccatcttatggtggacccagcgttcccggaagcggcggacctcctgcaggaggcagcggattcggccgtgggcagaaccataatgtccagggctttcacccctaccgacggtag

SEQ ID NO: 220106 - DNA, 2223 bp, Artificial Sequence
  Description of Artificial Sequence: Synthetic coding sequence
atggccgctttctctgagatgggcgtgatgcccgaaatagctcaagccgtagaggagatggactggctgttgcctaccgatattcaagccgaatcaatcccacttatactgggcggaggagacgtgctgatggccgctgagacaggctccggtaaaacgggcgctttcagtatccctgtcatccagattgtatatgaaaccctgaaagaccagcaagagggtaagaagggaaaaaccactattaagactggtgccagtgtcctgaacaagtggcagatgaatccctacgaccggggaagcgcattcgctatcgggagcgacgggctctgctgtcagagccgggaagtgaaagagtggcatgggtgcagggctacaaaaggccttatgaaaggcaagcattactacgaagtatcttgccatgaccagggcctgtgtagggtggggtggtccaccatgcaagcatccctcgacctgggtaccgataagtttggttttggctttgggggaaccggcaaaaaaagccacaacaagcagtttgataattatggggaagagtttaccatgcatgataccatcgggtgttatctggatatcgacaaaggacacgtgaagttttccaagaacggaaaagacctcggcttagctttcgaaatccctccccacatgaaaaatcaggcactttttccggcatgtgtgctgaagaatgcagaactgaaattcaatttcggtgaagaagagtttaaattcccacccaaggacggattcgtagccttgagtaaagcacctgacgggtacatcgtcaagtctcaacattccggcaacgcccaggtcacacagacgaaatttctccctaacgccccaaaagctctcatagttgagccatccagggagctggctgaacagacgctgaataacataaaacagtttaaaaagtacatcgacaacccgaagttgcgagagctgttgattatcggcggtgtcgccgcacgtgaccagctgtctgtcctggaaaacggggttgacattgtggtcggaacacctggcagacttgacgaccttgtctcaacgggcaagctgaatttatcacaagttaggttcttggtgctcgacgaggcagacggtctcctcagccagggctactcagatttcataaaccgaatgcacaatcagatcccccaggtaaccagtgatggaaagcggctgcaggtcatagtttgcagtgcaacactccactcgtttgacgtaaagaagctgtccgaaaagataatgcattttccaacgtgggtggatctgaaaggtgaggatagcgttccagataccgtccaccatgtggtcgtccccgtgaatcctaaaactgatcgcctgtgggaaaggctagggaagagccacattagaaccgatgacgtacacgccaaagataacaccaggccaggagccaacagccccgagatgtggagcgaagccataaagatcctcaaaggggagtatgcagtaagggctatcaaagaacacaagatggatcaggccatcattttttgtcgaacaaagatagactgtgacaacctggaacagtatttcatccagcagggaggcggtccagacaagaagggccaccagttcagctgcgtttgcctgcacggggacaggaaaccccatgagagaaagcagaatctcgaacgcttcaaaaagggcgatgtgagattccttatctgcacagacgtcgctgcgaggggaattgacatccacggagtaccttatgtgataaatgttactcttcctgacgaaaagcagaactatgtgcacagaattgggagggtcggtcgggcagagagaatggggctggccatttctctggtggctaccgagaaggagaaggtctggtaccacgtgtgttcttcccggggaaaagggtgctacaacaccaggcttaaagaggatggcggttgtacaatctggtacaacgagatgcagttgctgagtgaaatcgaagaacacctaaactgtactatatctcaagtggaacccgatatcaaggttccggtggatgagtttgatgggaaggtcacatatggccagaaaagagctgcgggagggggatcctacaagggccatgtggatatactggccccaacagtgcaagaactagcagcgttggaaaaagaagcccagacatcgttcctccacctcggttacctgcctaaccaactgtttcgaactttttag

SEQ ID NO: 220107 - DNA, 51 bp, Artificial Sequence
  Description of Artificial Sequence: Synthetic coding sequence
atggcagcctttagtgagatgggggttatgcccgagatagcgcaagcgtag

SEQ ID NO: 220108 - DNA, 1869 bp, Artificial Sequence
  Description of Artificial Sequence: Synthetic coding sequence
atggctgcctttagcgaaatgggagtcatgccagagattgctcaggcagttgaagagatggactggctgctgcctactgacatccaggccgaaagtattcctctcattctcggcggtggggatgtgctgatggcagccgagaccgggagcggtaaaacaggagctttcagcattcctgtgatccagatcgtgtatgaaactctaaaagaccaacaagagggcaaaaaagggaagactaccatcaagaccggagctagcgtgttgaataagtggcagatgaacccttacgaccgcgaggtgaaagaatggcacggatgccgcgctacgaaaggcctgatgaaagggaagcattactacgaggtgtcgtgtcatgaccagggtctgtgccgcgtcgggtggagcaccatgcaggctagtctggatctcggcacagataagtttggctttggtttcgggggtactgggaaaaaaagccacaacaagcaatttgataactatggagaagaattcacaatgcacgataccattggttgttacttggacattgataagggccacgtgaaatttagcaaaaatggcaaagatctcgggctagcattcgaaattcccccacacatgaaaaatcaggccctcttccctgcatgtgtgctcaagaatgccgagctgaaattcaactttggagaggaggaatttaaatttccaccgaaggatggctttgtcgcgctgtctaaggcccctgacgggtacatcgttaaatcccaacacagcgggaacgctcaagttacacaaacaaagttcctaccaaatgcccctaaagctcttatcgtcgagccttcaagagagttagctgaacagacactcaataatatcaagcagttcaagaagtacatcgacaatcctaagctgcgggaacttctgataataggcggagttgcagcacgggatcagctttcagttctcgagaatggtgtagacatagtggtgggcacgcctggtaggctcgatgacctggtgagtacaggcaagctgaacctgtcacaagttcgcttcctggtgctggacgaagccgacggcctgcttagtcaaggatattccgactttatcaacaggatgcataatcagatccctcaagtaacttccgatggcaaaaggctgcaggtgattgtctgttctgcgaccctccattccttcgacgtgaagaaactgtcagaaaaaatcatgcacttcccaacatgggtcgatctgaagggggaagacagtgtgcccgatacggtgcatcatgtcgtggtgcccgtgaacccaaaaaccgaccggctatgggagcggctcgggaagtcacatattagaaccgacgatgtgcacgctaaggacaacaccagaccaggcgcaaactcgcctgaaatgtggtcagaggccattaagattttaaagggggagtacgccgtgcgcgcaattaaagagcataaaatggatcaggcaattatcttttgtcgcaccaagattgactgcgacaatctcgagcagtattttatccaacagggcggaggcccagacaaaaaaggacaccagtttagctgtgtatgcttgcatggcgacaggaagccccacgagcggaagcagaacctcgaacgcttcaagaaaggggacgtcaggttccttatctgtacagacgtcgccgcaagaggcatcgacatccatggagtcccctacgtgattaatgtgacactccctgacgagaaacagaattacgtgcaccgcatagggcgagtgggcagagcagagcgcatgggattggcaataagcctcgtggctactgagaaagagaaagtgtggtaccacatggtccagcgagacgcagtgaccatttag

SEQ ID NO: 220109 - DNA, 2628 bp, Artificial Sequence
  Description of Artificial Sequence: Synthetic coding sequence
atgggtaagacggccaactcacctggctccggcgcacggccagatccagtgcgtagtttcaatcggtggaagaaaaaacattcgcataggcagaataagaagaaacaactgcggaagcaactcaaaaagcccgagtggcaagtggaaagggaaagcatttcccgactgatgcagaattacgagaaaattaacgtcaatgagatcacaaggttttcggattttccgctctcaaagaaaactttgaaaggtttgcaggaagcacaatacaggctagtgacagaaatccaaaaacaaaccatagggctggccttgcaggggaaggacgtactcggcgcagctaaaaccggatccggcaagactctggcatttctcgtgcccgtattggaagccctctatcgcctgcaatggacgagtacagatggattaggcgtgctgattatcagcccaacacgagaactggcttatcagacttttgaggtgctccggaaggtaggaaagaaccatgatttttcagctggactgatcatcgggggtaaggacctcaagcacgaggcggagcgcatcaacaacatcaatattctggtttgcacacccggacggcttctccagcacatggatgaaaccgtaagtttccacgcaaccgatttgcaaatgctagttttggatgaggctgacagaattctggatatgggattcgcagacactatgaatgccgtaattgaaaatctgcctaagaagcgccagaccctcctgttttctgcaacccagacaaagtcggttaaagacctagccaggctaagtctaaagaacccagagtatgtctgggtccatgaaaaagcgaaatatagtacccctgcaacgcttgaacagaattatatagtgtgtgagctgcagcaaaagatttccgtgctgtattcctttctgcgatcccacctgaagaagaagtcaatagttttcttctcgagctgcaaagaggtacaatatctgtaccgcgtattctgtcgcctccgaccaggggtgtccatactcgccctgcacggtcggcagcagcaaatgaggaggatggaagtgtacaacgaatttgtgcggaaacgcgcagccgtcctgtttgccaccgacattgctgccaggggtctggactttcccgctgtgaattgggtgctgcagttcgactgcccagaggacgcaaacacgtacattcatcgcgctggcagaaccgcccgttataaggaagatggagaagctttgcttatcctcctgccatcagagaaagcgatggtccagcagctcctgcaaaagaaggtgcccgtgaaagagattaaaatcaaccccgagaagctcattgacgtccagaaaaagctagagtccatcctagcacaagaccaagatctcaaggagagagctcagaggtgttttgtgtcttatgtgcgctccgtgtatctaatgaaggataaagaagtgtttgatgtctcaaaactgcctatcccagagtacgccttgtctcttggcctcgccgttgctcctagggtccgcttcctgcagaagatgcagaaacagccaacaaaggaacttgtccgaagtcaggctgataaagtaattgagccgcgtgcacccagcctaaccaacgacgaggtggaggaatttcgggcttattttaacgagaaaatgtcgatccttcagaaaggcggaaagcgattggagggtacagagcataggcaagacaacgacactgggaacgaggagcaggaggaagaagaagacgacgaagaagaaatggaggaaaaactggcaaaggctaaaggttcccaggctcccagtctgccgaacacgagtgaagcgcagaagatcaaggaagtgccaactcagttcctggatagggacgaggaagaggaggacgccgactttctcaaagtcaagaggcataacgtcttcggactggacctcaaggacgaaaagacattacagaagaaagaacccagcaaatcatccatcaagaaaaagatgactaaggtagctgaagccaaaaaagtgatgaagcgtaattttaaggtcaataaaaagataaccttcaccgacgagggcgagctggtccagcagtggccacagatgcagaaaagtgccatcaaggacgccgaagaggacgacgataccggtggaatcaacctgcataaagccaaggaaaggcttcaggaggaagacaagtttgataaggaggagtaccgaaaaaagatcaaggccaaacatagggagaagcgcctgaaagagagggaggcacgcagagaggctaataaacgccaggctaaggcaaaggatgaagaagaggcttttctggactggagtgacgacgacgatgatgatgatgacggatttgacccttccacgcttcccgaccctgacaagtatcgatcatctgaggactccgatagtgaagacatggagaataagattagcgacaccaaaaagaaacaggggatgaaaaagcggagcaactcagaggttgaggatgtgggacccaccagccacaaccggaaaaaggcacgttgggacaccttggaacccttggacaccgggctgagcctcgctgaagacgaggaacttgttcttcacctccttcggtctcagagctag

SEQ ID NO: 220110 - DNA, 2346 bp, Artificial Sequence
  Description of Artificial Sequence: Synthetic coding sequence
atgggcaagacggccaatagcccaggcagcggcgcaaggcccgatcctgtccgcagcttcaaccggtggaagaaaaaacactcccaccggcagaacaagaagaaacagctcaggaagcagctcaaaaagccagaatggcaggtcgaacgggagtccatctctagactcatgcaaaactatgaaaagatcaacgtgaatgagattacaagattttccgatttccctctgtctaagaagacactgaaaggactgcaggaagctcaatacaggttagtaactgagatccaaaaacagacaattggtctggcactccagggcaaggacgtgttaggggctgccaagaccggatcgggcaaaaccctggcctttttggtaccggtgaacgaagctgatcggatcctggatatgggatttgcagataccatgaatgccgttattgagaaccttcctaagaaaagacagacattgctcttctctgctacccagacaaagtctgttaaagatcttgcgcgtttaagcctcaaaaatcccgagtacgtttgggtacacgagaaggcgaaatattcgactcctgctacgctggaacagaactatatcgtatgcgagttgcagcagaaaataagcgtgttgtattcattcctgcgctcccatctgaaaaagaagtcgatagtgttcttttccagctgtaaagaagttcaatacctctaccgtgtgttctgcaggctgaggcctggcgtctccattttggccctgcacggcaggcaacagcagatgcggaggatggaggtgtataatgaattcgtgcgaaagagagccgcagtgctgtttgcgacagatatcgccgcacgaggcctggatttcccagccgtgaactgggtactgcagtttgactgtccagaagatgcgaatacgtacatccaccgcgcagggaggaccgccagatacaaagaggatggggaagcactccttattcttctgccatctgagaaggctatggttcagcagttacttcagaaaaaagtcccagttaaggagatcaaaattaacccggaaaagctaatcgacgtgcaaaaaaagctggaatctattctggcacaggaccaagatctgaaagaacgggctcaacgctgctttgtgtcttatgtgagatcagtgtacctgatgaaagacaaggaggtgtttgacgtcagtaagttaccgattcctgagtatgcattatccctgggcctggctgtcgctcctagagtgcggtttctccaaaaaatgcagaagcagcccacaaaggagctggtgcggtctcaggctgacaaagtgatcgaaccccgagctcccagtctgaccaacgacgaagtggaagagtttcgggcatattttaacgagaagatgtccatcctccagaaaggaggcaagaggctggaaggcactgaacatcgccaggataacgatactgggaatgaggaacaggaagaggaggaggatgatgaggaggaaatggaggagaagctggccaaggccaaagggagccaggccccaagcctacccaatactagcgaggctcagaagattaaggaagttcccacacagttccttgatcgcgacgaggaagaggaagatgctgacttccttaaggtgaaacggcacaatgtgtttggactggatttgaaggatgaaaagactttacaaaagaaagaacccagtaagagctcgatcaaaaagaagatgactaaggtggcggaggccaaaaaggtcatgaaacgtaacttcaaagtgaataaaaaaatcactttcacagacgaaggtgagctggtacaacagtggccgcagatgcagaagtcagctatcaaagatgctgaagaagacgatgacacggggggtataaacttacacaaagccaaggagagactgcaggaggaggacaaattcgacaaagaagaatacaggaaaaaaattaaggcaaaacatagggaaaagcggctcaaagagcgcgaagcacggcgagaggcgaataagcgacaggccaaagccaaggatgaggaagaggcgttcttggattggagtgatgatgatgacgatgatgatgatggcttcgatcctagcacgctccctgacccagataaatatcggagtagcgaggactccgatagcgaggatatggagaacaagatttctgataccaaaaaaaaacaagggatgaagaagaggtctaattccgaggtcgaggacgtgggccctacatcccacaacaggaagaaagctagatgggataccctagagcctttggatacaggtttgtcccttgccgaagacgaagaactagttctgcatttacttcgctctcagtcctag

SEQ ID NO: 220111 - DNA, 1959 bp, Artificial Sequence
  Description of Artificial Sequence: Synthetic coding sequence
atgagaggcggaggctttggagaccgagacagggatagagaccggggaggcttcggtgccagaggcggtggcggactcccccctaaaaaattcggcaaccctggagagcgcctccgtaagaagaagtgggacctgtctgagctgcccaagtttgaaaagaacttttatgtggagcacccagaggtggccaggttgaccccttacgaagtggatgaactgagacgaaagaaagagatcacggtaagaggaggagacgtttgccctaaaccagttttcgcattccaccacgctaattttccacagtatgttatggacgtactcatggaccagcattttacagagcctacacctatccagtgtcagggcttccccttagccctttccggacgagacatggtgggcattgctcagaccggctcaggcaagacgctcgcctaccttctgcccgctatcgtccacataaatcatcagccctacctggagcgcggagacggccctatctgtctggttctggccccaactagagagctggcccagcaggttcagcaggtggcggatgactacggaaagtgctctcgactcaaatctacttgcatttacgggggtgctcctaaaggccctcaaattagggatctggagcgcggtgtggagatttgcattgctacgccaggacggttgattgattttctcgagtctggcaagaccaatctgagacgatgcacatatctggtgctggacgaggcggatcgaatgctcgacatgggcttcgagccacaaattcgaaaaatcgtggaccagatcaggcccgacagacagactcttatgtggagcgccacttggccaaaagaagtccgacagctcgcagaggatttcttaagagactatacccaaatcaacgtgggcaacctggagttatccgccaatcataatatcctgcagatagtcgatgtgtgtatggaaagtgaaaaggaccataaactcatccagttgatggaggaaatcatggcagagaaggaaaataagacgatcattttcgtagaaacgaaacgcagatgcgatgatttgacaaggcggatgcgtagagacgggtggcctgccatgtgtatacatggcgacaagtcacagcccgagcgggactgggtgttaaatgagtttcgaagcggcaaagctcctattctgattgccacagatgtcgcttcacggggacttggcttcgatgtcgaggatgttaagttcgtaattaattacgattaccccaattcaagcgaggactacgtgcacaggatcggccgtacagcaagaagcacaaacaaagggactgcatacaccttcttcacccccggaaacctcaagcaggctcgcgagctgatcaaagtgctggaagaggcgaaccaggcaataaatcctaaattgatgcaactggtggaccatagaggaggaggtggtggtggtgggggaagatctagatataggacgacttcctcagcaaataatccaaatttaatgtaccaggacgaatgcgaccgacggttgagaggagtgaaggatggagggagaagggactccgcctcttacagagatagatcagagacagatcgggctggctacgccaacgggtcaggatatggatcacctaatagtgcatttggcgctcaggccggacagtacacgtatggccagggcacctacggggcagcagcgtatggtacctcttcttatacagcacaggaatacggtgcgggaacctacggtgcaagttcgacaacaagcacaggtcgttcgtcccagagctcttctcagcaatttagcggcatcggacggtctggccagcaaccgcagccactgatgtcccagcagttcgcccagcctcccggagcgacaaacatgattggctatatgggacagacggcctaccagtatcctccaccccctcctccccctcccccatccaggaagtag

SEQ ID NO: 220112 - DNA, 2196 bp, Artificial Sequence
  Description of Artificial Sequence: Synthetic coding sequence
ctgcctaccgggttcgtggcacctatcctctgtgtcctgctgccttcccccacccgggaagccgctacagttgcctcagctaccggcgactctgcgtcagagcgcgaatctgcagcacccgcagccgctccgaccgcagaggcaccaccccctagtgtcgtcacgcgacccgaaccacaggcacttccctcccctgctatccgcgctccactgccagacctgtacccatttggtaccatgcgcggtggtggcttcggggatcgggaccgagatcgggaccgcggagggttcggcgcacgcggtggtgggggactccccccaaagaagtttggcaacccaggggaacggctgcggaaaaagaaatgggacctatcagagctgcccaagttcgaaaaaaacttctatgtggaacacccagaggttgctcggttgacaccatatgaagtagatgagctgcgcagaaaaaaggagatcactgtgagaggtggtgatgtctgtcctaagccagtgttcgcatttcaccacgccaactttccgcagtatgtcatggacgtactcatggaccagcactttacagaacctacacccatccagtgccagggtttccctctggccctcagcggtcgcgatatggtggggatcgctcagactggatctggtaagacattggcctatttgttgcccgcaatcgtacacatcaaccaccagccctacctcgagagaggggacgggccaatctgtttggtcttagcaccaaccagagagctggcacaacaggtgcagcaggttgcggacgattatggcaaatgttctcggctcaaaagcacctgtatttatggaggggcacctaaaggaccgcagataagagatcttgagcgaggggtggagatttgcatcgccacacccggacgactgattgactttctcgaatcaggcaagaccaatctcaggaggtgcacgtacttggtgcttgacgaggccgacaggatgctggatatgggatttgagccgcaaatacgtaaaatcgttgaccagattcgacccgacaggcagaccttaatgtggtcagctacatggccgaaggaggtcagacagttggcagaggacttcctacgagactatacccagatcaacgtcgggaatcttgaactctccgccaatcataacatccttcagatcgttgatgtttgtatggaaagcgaaaaagatcacaaactgatccagctgatggaagagattatggccgaaaaggagaacaagactattatattcgtggagacgaagcggcgatgcgatgatttaacacgcaggatgagaagagatggttggccggcaatgtgcattcatggtgacaaatcacagccggagcgagactgggtgcttaatgaattccgtagtggcaaagcaccaatactcatagccacagacgtcgcaagcagagggctcgacgtggaggatgttaaattcgtgattaactatgactaccctaacagttccgaagactatgttcatcggattggcagaactgcccgttccacaaataaaggaaccgcatatacatttttcactccagggaacctaaaacaggcccgagagctgatcaaggtcttagaagaggcaaaccaagccataaaccccaaactgatgcaactcgtggaccaccggggtggcggaggaggtggaggcaaagggggtcgcagtcggtacaggactaccagtagtgcaaacaaccccaatctgatgtatcaggacgagtgtgatcgcagactccggggtgtgaaagacgggggtcgacgagactctgccagttatcgtgaccgctccgaaacagatcgagccggatacgccaatggatcaggatacgggagtcctaattccgcttttggtgcccaagctggtcagtacacatatgggcagggtacttacggggcagccgcttatggaacctcaagctatacagcacaggaatatggcgcaggtacatacggagcctccagcaccacttcgacaggacgctcaagtcagtcttccagccagcagttcagtggaataggtagaagcgggcagcagccccaaccactcatgtcacagcagtttgcacagcccccaggggctacgaatatgattggatatatgggccagactgcttaccagtacccaccaccccctcccccacctcccccaagccgcaaatag

SEQ ID NO: 220113 - DNA, 2190 bp, Artificial Sequence
  Description of Artificial Sequence: Synthetic coding sequence
ttgcctaccggttttgtggctcctattctctgcgtgcttttaccgagccccacgcgggaggcagcaacagtcgcatctgctaccggggatagtgcgtcggaacgagagtctgccgcacctgccgctgccccaacggccgaagctcctcctccctccgtggtgaccaggcctgagcctcaagcgttaccatcacccgctattagagccccactccccgacctctacccattcggaactatgaggggcggagggtttggagatagggaccgcgatcgagatcggggtggttttggtgcccgtggaggtgggggtctaccccctaaaaaatttggaaacccaggggaaagattgcgaaagaagaaatgggatctgtctgagctgccaaaattcgaaaaaaacttttacgtggagcacccagaggttgccaggctgactccttacgaagtcgacgagttgcgtcgaaaaaaagagatcacagttagaggaggcgacgtgtgccccaaaccggtatttgccttccaccatgctaacttcccgcaatacgtaatggacgtcctgatggatcagcacttcacagagcccaccccaatccagtgccaagggttcccgcttgccctgtctggaagggacatggtggggatcgcccagacagggagtggaaagacattagcctatctactgccggcaatcgtgcatatcaatcaccagccttacctagagcggggagacggcccaatttgtttggtgctcgcacccaccagggaactcgcccagcaggtccagcaggtggccgatgactacggaaaatgtagcagactgaaatcaacttgtatctacggcggtgccccaaaggggcctcagattcgggatttagagcggggagtagagatatgtatcgccaccccaggacgacttatagatttcctggagagcggaaaaactaatcttcgaaggtgtacgtacctggttctcgatgaggcagatcggatgctggacatgggattcgagccccagatcaggaagattgttgatcaaatcaggccagataggcagactctaatgtggagtgcaacgtggcctaaggaagtccggcagttagcagaggattttttgcgagattatacccagatcaacgttggcaatctggaactcagtgccaatcataatatcctgcagattgttgatgtttgtatggagtccgagaaagaccataagcttatccagctaatggaggaaatcatggccgagaaagaaaataaaactattatctttgtcgagactaaacgtagatgcgatgacctcactcgcagaatgaggagagacggctggcctgcgatgtgtattcacggcgacaaaagccaacccgagcgcgattgggtgttaaatgaattccgtagtggcaaggctccaattctcatcgccactgatgttgctagccggggactggatgttgaagacgtaaagtttgtgattaattacgattaccccaattcgagtgaggactatgtgcatcgcattggtcggacggcaagatctaccaataaggggacggcttacactttttttaccccagggaatttgaagcaggccagggagctgataaaggtcctagaagaagctaaccaggccatcaatcccaagctcatgcagctggtcgatcaccggggtggagggggagggggagggggacgatcacggtaccgaacaacttcttcggctaacaacccaaaccttatgtaccaggatgaatgtgatcggaggctccgaggagtcaaggacggcggtagaagagattccgctagctaccgggataggagtgaaaccgatcgcgctggttatgccaacggatcagggtacggtagtccaaactctgcctttggtgcgcaagccggtcagtacacctacggtcagggtacctacggcgcagccgcatacggaacatcctcctacaccgctcaggagtacggcgcaggcacttacggggcatcttctaccacctcaaccggacggtcaagtcaaagttctagccaacagttcagtgggatcggtagatcagggcagcagcctcaacctctcatgtcacagcaattcgcacaaccaccaggggcaacaaatatgattggctatatggggcagactgcctaccagtacccgcctcccccaccgcctccccctcctagcaggaaatag

SEQ ID NO: 220114 - DNA, 2214 bp, Artificial Sequence
  Description of Artificial Sequence: Synthetic coding sequence
cctaacctacctacgggatttgtggcgccaatcctgtgtgttctgcttccatcgcctacgagagaggccgcaactgttgcctcggcaacaggcgatagcgcgagcgagcgcgagtctgctgccccagcggctgcgccaacagcagaagcgcctcccccttctgtggtgacaaggcccgaaccacaggctctgccatcccccgcaattcgcgcaccactgccagatctttacccatttggcactatgaggggcggagggtttggcgatcgagaccgggaccgcgataggggcggattcggcgctcgcggaggcggaggattaccgcctaagaagtttggtaaccctggggagcgactgcggaagaaaaagtgggacttatcagaactccctaaattcgagaagaatttttatgtggagcaccctgaggtcgctcgcctgacgccttacgaagtggacgagctgaggagaaagaaggagataactgttagaggcggagacgtgtgtcctaagcctgtcttcgccttccaccatgccaacttcccccaatacgtcatggatgtgctcatggaccagcatttcacagaaccaacacctatccagtgccaggggtttcctctggccctatccggaagggacatggtggggatagctcagactggcagtggcaagacgttagcatacctcctgccggctattgtccatatcaatcaccaaccctacctggaaaggggcgacggccctatttgcctcgtcctcgcccctacaagggagctggctcagcaagtccagcaggtggctgatgattacgggaaatgtagtaggcttaaatcaacctgcatttatgggggtgctccaaaaggaccgcagatcagagacctggagagaggggttgagatctgtattgcgaccccgggtcgtttgattgacttcctggagagtggaaaaaccaatctgcgcaggtgtacctacctggtgctggacgaggctgaccgtatgctggacatgggctttgagccgcagatccgcaaaatcgtggatcaaattaggcctgacagacaaactctgatgtggagtgctacatggcccaaagaggttcgtcaactggctgaggactttcttagggactacacacagatcaacgtgggaaatctcgaactgtctgctaatcataacatattgcagattgttgatgtgtgcatggaaagtgaaaaggaccataaactgatccagctgatggaggaaatcatggccgaaaaagagaataaaaccatcatattcgtagaaaccaagaggaggtgtgacgacctcactaggcggatgagacgcgacggctggcccgcaatgtgcatccacggagacaaaagccaacccgagagagattgggttttgaatgaatttaggtccgggaaagcccctattctgatagcgactgacgtggcgtcaagaggactggatgtagaagatgttaaattcgtcatcaactacgattatcccaacagcagcgaggactatgtgcacaggatcggtcgtaccgcaagatccaccaacaagggcaccgcctataccttttttactcccggtaatcttaaacaggctagagagttgatcaaagtgctcgaggaggccaaccaggccatcaatcccaaactgatgcagcttgtagaccaccgcggtggtggtggaggcggaggcaagggcggaagatcacggtatagaacaacaagttccgccaacaaccccaatctgatgtatcaggacgagtgtgataggcgcctgcggggagtgaaggatgggggtcgaagagactccgcctcctacagagatcggtctgagacagaccgtgccggatacgccaacgggagtggctacggctctcccaattcggctttcggtgcgcaggcaggtcaatacacctacggacaggggacctacggggcagccgcttacgggacctcttcctacacggcccaggaatacggagccggaacatacggggcttcatcaactacgtcaaccgggcgttcgagccagagctcatcacaacaattttccggcatcggacgcagtggacagcagcctcaacctctgatgtcccagcaatttgctcaacctcctggtgcaacgaatacactgcttctcctgcccctccttctgctccatgtgaacgaaaccacccaagtcgttgtcacaccagcagacctgatcactttctag

SEQ ID NO: 220115 - DNA, 546 bp, Artificial Sequence
  Description of Artificial Sequence: Synthetic coding sequence
atgcaactggtcgaccaccgcggtgggggaggcggagggggaggcaggtcccggtaccgaacaacaagctctgcaaacaaccctaatttgatgtatcaggatgagtgcgacagacgcctgcgcggagtgaaagatggcggtcggcgagattcagcctcataccgcgatagatcggagaccgatcgcgcaggatatgctaacggctcaggctatggttcccccaactctgccttcggggctcaggctggtcagtacacatacgggcagggaacttacggcgctgccgcatacggcacaagctcgtatacggctcaggagtatggggcaggcacttatggcgcatccagcacgacttccacgggccgaagttctcagtcttctagtcaacagttttctggtatcggtcggtctggacaacagccacagcccctcatgtctcaacaattcgcacagcctcccggtgccactaacatgatcgggtacatggggcagacagcttatcagtatccaccaccccctccgcctccgcctccctcccggaaatag

SEQ ID NO: 220116 - DNA, 2013 bp, Artificial Sequence
  Description of Artificial Sequence: Synthetic coding sequence
atgtcccacctgccgatgaagctgctacgaaagaagatagaaaaacgcaatcttaagctgcgccagcgaaacctgaaattccagggcgcatctaatctgacactgtccgaaactcagaacggtgatgtctcagaggaaacaatgggctctcgcaaagtcaaaaagagcaagcagaaacccatgaacgtgggtctctctgagacccagaacggcggtatgagccaggaggcagtgggaaacatcaaggttacaaagtcaccgcaaaaatcaactgtgttgaccaacggggaggccgcaatgcaaagctcaaattcagaatccaaaaaaaaaaaaaaaaaaaaacgaaaaatggttaacgatgccgagccagacaccaaaaaagcgaaaaccgaaaacaagggaaagtccgaggaagaatctgcagagaccacaaaagagacagaaaataacgttgaaaagccagacaacgacgaggatgagtcagaagtaccttccctacctctgggcctgaccggcgcattcgaagatacttcattcgcctcactatgtaatctcgtgaatgaaaacacccttaaggcaatcaaggagatgggatttactaacatgactgagatccagcacaaatcaattcggcctcttttggaaggaagggacctgctggcagcagctaagactggatcaggtaagaccttggcgttcttaatacctgcagtcgaactcattgtaaagctgcgcttcatgcctcggaacgggactggagtgctgatcctctcccccacaagggagctggcaatgcagaccttcggagtgctgaaggagcttatgacgcaccacgtgcatacctacggtctgatcatggggggttccaaccggagtgcagaagcgcagaaattgggaaacgggatcaatatcatcgtagccacgccagggagactgttggatcacatgcagaatactcctgggttcatgtacaagaatctgcagtgcctggtgatagacgaagccgacagaatcttagacgtgggcttcgaggaggagctgaaacagatcattaagctcctgcccactcggaggcagaccatgttgtttagtgcaacgcagaccaggaaggttgaagaccttgcccgaatctccctaaaaaaagaaccactctacgtaggcgtcgacgatgacaaggcaaatgcgaccgtcgacggactggagcaggggtacgttgtctgcccttcagaaaagcgttttttgcttttgttcacctttctgaaaaaaaataggaagaagaaactgatggtcttttttagctcatgcatgtccgtgaaatatcattatgaactgcttaattacatcgatctgccagtcctagccattcacggcaagcagaagcaaaacaagcgcaccaccacgttttttcagttctgtaacgccgattcaggcacattactgtgtactgatgtcgcggcacgcggactggacatacccgaagtggattggattgtgcagtatgatcctccagacgatcctaaagagtacattcatagagttgggcgaacagcccgtgggctcaatgggcgtggccatgcactgttgatactccggcctgaagaactgggcttcctgcgatatcttaagcaatccaaagtaccactgtcggagttcgatttctcatggagtaagatttccgatatacagagccagctggagaagctgatcgaaaaaaactatttcctgcacaaaagtgcccaggaagcttataagtcttacattcgagcttatgattcccacagtctgaagcaaatattcaacgttaacaacttgaacctgccgcaggtggccctgagctttggcttcaaagtgcccccatttgtggatttaaacgtgaactctaatgaaggtaaacagaagaaaagaggcggaggaggagggtttggctaccagaagacaaagaaggtagagaagagcaagatctttaagcacataagtaagaagtcctctgatagtagacagttttcacactag

SEQ ID NO: 220117 - DNA, 1230 bp, Artificial Sequence
  Description of Artificial Sequence: Synthetic coding sequence
atggaacaggaacaaacatttggggttcttaaggaactgatgacacaccacgtgcacacatatggtctgatcatggggggatccaaccgctcagccgaggcacagaagttaggcaacggtatcaatataattgtcgctacgccgggaagattactcgaccatatgcaaaacacccctggattcatgtacaagaatcttcagtgtctggtgatcgacgaggccgatagaatactggacgttggcttcgaggaagagctgaaacaaatcataaagctgctccccacgaggaggcagactatgctcttctctgccactcagacgcggaaagttgaagatctggcccgaattagcctcaagaaagaaccgctgtatgtcggggtggacgacgacaaagccaatgccaccgtcgatggattggaacaggggtatgtagtatgtccaagcgagaaaagattcctgcttctgtttaccttcctgaagaagaaccgaaagaaaaagctgatggtgtttttcagcagctgtatgtcagtcaagtaccactatgagctgctgaactatatcgacctgcccgtgctggccattcacggcaaacagaaacagaataagcggaccaccactttttttcagttctgtaacgctgactccggcaccctgttgtgcacagacgtggccgctagaggcctggatatcccagaagtggactggattgtgcagtacgacccaccggatgatccaaaagagtacatacatagagtaggcaggactgcccgaggcttgaacgggaggggccacgcactgttgatcctgcgaccggaagagttagggtttcttcgctacttaaaacagagcaaggtgccgctttcagaatttgatttctcctggtcaaagataagtgatatccaatcccagctggagaagttaattgaaaagaactattttctgcacaagagtgcacaggaggcctataagtcttacattcgggcttatgacagtcatagtctgaaacaaatctttaacgtgaataatctgaatctgcctcaggtggcactgtcgtttgggtttaaagttcccccattcgtggacctaaacgtcaactccaacgaggggaagcaaaagaagcgcggaggtggcggaggctttggctatcagaagaccaaaaaggtcgaaaagtcaaagatctttaagcacatatcaaaaaagagtagcgattcaaggcagttctcccattag

SEQ ID NO: 220118 - DNA, 2475 bp, Artificial Sequence
  Description of Artificial Sequence: Synthetic coding sequence
atggctgcagcctttgaggcctcaggcgctctggctgccgtggccaccgcgatgcctgccgaacacgtggcggttcaggtccccgcacccgagcctactcctgggcctgtgagaattctcaggacggcccaagacctgtcatcgcccaggactcgcacaggagatgtgcttctcgcagagcccgctgattttgagagtctgctccttagccggcctgtcctggagggtctcagggccgctggcttcgagcgaccgagccccgtgcagctgaaggcgattccccttgggcgatgcgggctggacctcatcgtccaggccaagagtggcacagggaagacgtgcgtctttagcaccattgcactcgactctttagtattggaaaacctctccacgcaaattttaatcttggctcccacaagagaaattgccgtgcagattcacagcgtgatcacagccatcggaattaaaatggagggccttgagtgtcatgtgtttatcgggggaacaccacttagccaggataagacacgcttaaaaaaatgtcacatcgctgttgggtctccaggtagaatcaagcaattgatcgaactggactacctgaatccaggatcaatcagactcttcattctcgatgaggctgacaagctcctggaagagggctcttttcaggaacagatcaactggatctactcgagccttcccgcttctaagcaaatgctggccgtcagtgccacctatcccgaatttctggccaacgccctaactaaatacatgagagatcctactttcgttagactaaactctagcgacccaagtttgatcggcctgaaacagtattacaaagtggtcaactcttatcctcttgcccacaaggtttttgaagagaagacccagcacctgcaggagctgttctctagaatccctttcaaccaggctcttgtgttctctaatctgcattcaagggcccagcacctcgcagacattctgtctagcaaggggtttcccgcagaatgcatctcaggaaacatgaatcaaaaccaacgattagatgccatggccaagctgaagcacttccattgtagagtcttaatcagcactgatttgacttccagaggtatcgatgcagagaaagtgaacctggtggtgaatttggacgtgcccttggactgggaaacctacatgcatagaatcggtagagctgggagatttgggacattagggctaactgtcacttactgttgcaggggagaagaagaaaatatgatgatgcggatcgcccagaagtgtaacataaatctgctccctctgcctgaccccattccatctggcctgatggaggagtgcgttgattgggacgtcgaggtgaaagcagcggtccacacatacggtatagcttccgtcccgaaccagcctctgaagaaacagatccaaaaaatagaacggaccctacagatccagaaagctcatggtgaccacatggcatctagccgaaacaactccgtgagtggactgagtgtcaagtctaaaaacaacacaaagcagaagctgccagtcaaatcacactccgaatgtggcattatagaaaaggccactagcccaaaagagctgggttgtgataggcagtccgaggagcagatgaagaacagcgtccagactcccgtggaaaactcaacgaattcacaacaccaggtgaaggaagctttgcccgtgagtctgcctcaaatcccctgtctctcatcatttaagatccatcagccttacaccttgaccttcgcagagctcgtcgaagattatgagcattatattaaggagggtctggagaagccggtcgagataattcgccattacacaggaccaggcgaccagaccgtgaatcctcagaatgggttcgtgcggaataaggtcattgagcagagggttccggtgctggccagctccagccaaagtggggacagcgagtccgattctgacagttacagctcaagaacctctagccagtctaaagggaacaagtcttacctggaaggatccagcgataatcagctgaaagactccgagtcaacacctgtcgatgaccgcattagtctcgagcaacctccaaacggatccgatactcccaaccctgagaaatatcaagagtcccctgggattcaaatgaagactagactgaaagagggtgcttcgcaacgggcaaagcagagccgccgtaaccttccaaggcggagctcttttagactgcagaccgaagcccaagaagacgattggtatgattgccatcgggagatccgtctgtccttttcggacacctaccaggactacgaggagtattggcgcgcttattaccgggcatggcaggagtattatgccgctgcaagccatagttactactggaacgcacagcgccacccaagctggatggctgcttaccatatgaacacaatctacctacaggagatgatgcatagtaaccaatag

SEQ ID NO: 220119 - DNA, 417 bp, Artificial Sequence
  Description of Artificial Sequence: Synthetic coding sequence
atggccgctgcttttgaggcctctggggcactggccgcagtcgctaccgctatgcccgctgagcacgtagctgttcaagtacccgcacctgagcccacccctggcccagttcgcatactgaggacggcacaagacctatcttcacccaggacacggacaggcgatgtattactcgctgaaccagccgatttcgaaagccttctgctgtcgcggccagtcctggagggtttgcgtgccgcaggctttgagcgtccctccccagttcaacttaaggccattcccttagggaggtgcggtttggacctgatcgtgcaggccaaaagtgggactggcaagacttgcgtgttttcgacaattgcattagatagccttgtccttgagaacctctctacccaggccgagctctcaaattcttag

SEQ ID NO: 220120 - DNA, 2352 bp, Artificial Sequence
  Description of Artificial Sequence: Synthetic coding sequence
atgcctgggaagctgaggtccgatgcaggcctagagtccgacaccgctatgaaaaagggcgaaactctcaggaaacagacagaggagaaagaaaagaaggaaaagccgaagtcggacaaaaccgaagagattgctgaagaggaagagacggtatttcccaaggcgaagcaggtaaaaaagaaggccgagccctccgaggtggacatgaactcccccaagtccaagaaagctaagaaaaaggaggagccctcgcaaaacgatatttcgcccaagactaagtcgctccggaaaaagaaggagcctatcgaaaaaaaagtagttagctcaaaaaccaaaaaggtgaccaagaacgaggaaccttcagaagaagaaatcgacgccccaaagccaaagaaaatgaaaaaggagaaggagatgaacggtgagacccgggagaaatctcctaaactcaagaacggcttcccacaccctgagccagattgcaacccatcagaggccgcaagcgaggagagcaacagcgaaatcgagcaggagatcccagtggagcagaaggaaggtgcattctctaacttccctataagtgaagagactattaaactccttaaagggagaggcgttacattcctgttcccaattcaggccaaaacgttccaccatgtatacagcggtaaagatctcatagcacaggcgcgaacaggtacaggaaaaaccttcagcttcgccataccactgattgaaaagcttcacggggagctgcaggaccgcaaaaggggaagagccccacaggtacttgtgttagcacccacacgcgagctagccaaccaggtatcgaaggatttctcggacattacaaagaaactgagcgtagcctgcttctatggtggcaccccttacgggggacagttcgagcggatgcggaatggcatcgatatcttggtcggaacacccggaaggatcaaggatcatatccaaaacgggaaactggatcttaccaagctgaaacacgtagtactcgacgaggtcgatcaaatgctggatatgggctttgccgaccaggtcgaagaaatcctctcagtggcctacaagaaagactctgaagataacccccaaaccctactatttagtgccacatgcccccactgggtgtttaacgtagccaaaaagtatatgaagagtacttacgagcaggtggatttgattggtaaaaagacccagaagacagccataaccgttgaacacctcgctattaaatgtcactggacgcaaagggccgctgtgattggggatgtgattagggtgtactccggacaccagggcaggacaataatcttctgcgagacaaaaaaggaggcacaggagttgagtcagaacagtgcaattaagcaagacgcccagagcttgcatggagatataccccagaagcaaagggagatcacacttaaaggttttcgtaacggtagttttggggtgctggtggctaccaacgttgctgcgagaggcctcgatatcccagaggttgacctcgtgattcaatcttctcccccaaaagatgttgagtcctacattcaccggtctggcaggacaggaagggcaggtcggactggagtttgcatttgtttttaccagcataaagaggagtaccagttagtccaggtggagcagaaagccggtattaagttcaaaagaattggagttccatccgcaaccgagatcatcaaagctagctctaaggacgcgatcagattgctggattccgtgcctccaaccgccatctcccacttcaaacagtcagccgaaaaactcattgaggaaaaaggggcagtcgaggcgctggctgccgctctcgctcacattagcggcgctacctcagtcgaccagaggtcactgatcaactctaatgtaggcttcgttaccatgatactgcagtgtagcattgaaatgccaaacatcagctatgcgtggaaggaactgaaagagcagttgggcgaagagatcgattccaaggtcaaggggatggtgttcctgaaggggaagctcggagtctgctttgatgtccccacagcgtccgtcacagagattcaagaaaagtggcacgattcgaggaggtggcaattatctgtggccactgagcagccagagctcgaaggccctagggaggggtacgggggatttaggggccagagagagggaagccgtgggttccgcggacaacgcgatggcaacaggaggttccgtggccagagggaaggtagcagaggtcctaggggacagagaagcggaggaggcaataaatccaatcgatcccagaacaagggacagaaacgaagcttcagcaaagcatttgggcaatag

SEQ ID NO: 220121 - DNA, 249 bp, Artificial Sequence
  Description of Artificial Sequence: Synthetic coding sequence
atgccaggtaaacttcggtcagacgccggacttgagtccgacactgcaatgaaaaagggggaaactctgcgtaaacaaactgaggagaaggagaaaaaagaaaagcccaagagtgacaaaactgaggagatcgccgaagaagaggaaaccgtgttccccaaggccaagcaggtgaagaaaaaggccgagccgagcgaagtggacatgaacagcccaaaaagcaaaaagaagaagaagaagaagaagtag

SEQ ID NO: 220122 - DNA, 2463 bp, Artificial Sequence
  Description of Artificial Sequence: Synthetic coding sequence
atggccggtgagctggcagacaagaaggacagagacgcttcgccttccaaagaggaaaggaaacgcagtaggacccccgatagagaaagggatagggaccgcgacaggaagtcaagcccatctaaagacaggaaacgtcaccggtcgagggaccgcagacgcggaggatctaggtccagaagccgaagccgaagcaagtccgctgaaagggagagaagacataaggaaagggaacgtgataaagagcgggatcgcaataagaaagatcgggacagagataaggatggccaccgtagagataaagatcgcaaacgtagcagcctgtcaccagggcgtggcaaggattttaaatccagaaaggaccgggacagcaaaaaagatgaagaggatgagcatggcgacaagaaaccaaaagcccagcctctttcattggaggaactgctagctaagaaaaaggctgaagaggaggcagaagcgaagccgaaattcctgtcaaaagccgagcgagaggccgaggcgctgaaaaggaggcagcaggaagtcgaggagagacaaagaatgctggaagaggaaaggaagaagcgaaagcagttccaggatctgggcagaaagatgttggaagatccacaggaacgggagcgtcgggagcggcgtgagaggatggagcgcgaaacgaacggaaatgaggacgaagaaggcagacagaaaatccgtgaggaaaaagacaagtctaaggagctgcacgcaataaaagagcgctacctggggggtataaaaaagcgcagacgcacgagacacctcaatgacagaaagttcgtgttcgagtgggacgcttccgaggatacatcaattgactacaaccccctgtataaggaaagacaccaggtccagttattagggagaggcttcatagctggtatagacctgaagcagcagaagagagaacagagtcgcttttacggggacctgatggaaaaaagaagaaccctggaggagaaggagcaagaggaggcacgccttagaaagctccggaagaaggaagccaaacaacggtgggatgaccgccactggtctcagaagaaattggacgagatgaccgaccgtgactggaggattttcagggaggattactctataactactaaggggggtaagattcccaatccaatcaggtcttggaaggactcttcactacctccacacatccttgaggttattgacaaatgcggatacaaggaacccacccctattcaacgacaggccatccctatagggctgcaaaatcgggatattattggcgttgccgaaaccggctccggaaagacagcagctttcctgattcctctgttggtgtggattacaacattgcccaaaatcgatcggattgaggagagtgaccagggaccgtatgcaattatcctggcccctaccagggagcttgcccaacagatcgaggaggaaaccattaagtttggcaagccactgggcatacgtaccgtggctgtgattgggggtatatctagggaggaccagggatttaggttacggatggggtgtgaaattgtcatcgccacaccgggacggctgattgatgtgctcgagaatagatacctggtgctatctcgatgtacctacgttgtcctggacgaggctgataggatgattgacatgggttttgagccagatgtgcagaaaattctggagcacatgcccgttagcaatcagaaaccagacacggacgaagccgaggacccagaaaaaatgcttgctaactttgaatccgggaaacataaataccggcaaaccgtcatgtttaccgccactatgcctccagccgtggagcgcctggctaggtcttacttgcggcgtcccgcagtggtgtacattgggtccgcgggaaagccacacgagcgagtggagcagaaagtttttctgatgagcgagtccgaaaaaagaaagaaactgctggcgatcctcgaacaaggattcgatccaccaattatcatattcgtgaatcagaagaagggatgtgacgtgcttgcgaagtcactggagaagatgggctataatgcctgtacactacacggcggtaagggtcaggagcaacgggagtttgcattgtcgaaccttaaagccggagcaaaggatattctggtagcaaccgatgtcgccggtagaggcattgatatccaggacgtgagcatggtggtgaattatgacatggcaaagaacatcgaggactacatccaccggataggacggacaggacgcgcaggaaaaagcggagtcgccatcacgtttcttactaaagaggactctgcggtgttttacgaacttaagcaggcaatccttgagagccccgtctcttcttgcccacctgagctggccaaccatcctgatgcccagcacaagcccggaaccattctgactaagaaacgccgtgaggagaccatcttcgcctag

SEQ ID NO: 220123 - DNA, 417 bp, Artificial Sequence
  Description of Artificial Sequence: Synthetic coding sequence
atggcgggagaattggcagacaaaaaggatagagatgccagtccttcaaaggaagagaggaagcgctcgcgtactcccgaccgggaaagagaccgagacagagaccgcaagtccagtccaagtaaagatagaaaacgacacaggagcagggatcgacgacgcggtgggtcccggagcagatcgcggtctaggtcaaaatctgcagaacgcgagaggcgccataaagaacgggaaagggataaagaacgcgaccgcaacaaaaaagatagggatcgcgataaggatggtcaccggagggacaaagatcgtaaacgctcctctctgagcccaggacgcggtaaggacttcaagtctcgaaaagaccgggactccaagaaagatgaggaggacgagcacggcgataaaaagccaaagtag

SEQ ID NO: 220124 - DNA, 549 bp, Artificial Sequence
  Description of Artificial Sequence: Synthetic coding sequence
atggcgggtgagttggccgataaaaaggatagagacgccagtcccagcaaggaagaacgcaaaaggtcgcgaactcccgaccgggagcgtgacagagatagggacagaaaatcctccccctcgaaagatcgtaagaggcatcggtcccgggacagacggcgaggcggttcgcgcagccgcagtcgcagccggtctaaaagtgcggagagagagcggagacataaggagcgtgagcgggacaaggaacgtgatcggaataaaaaggacagggatcgagataaggacgggcacaggagagacaaagacaggaagagaagctctctaagccctggcagaggcaaggacttcaaatcacggaaggatagggattccaagaaggatgaggaagatgagcacggtgacaaaaagccaaaggcccagccattgagcctggaagagctcctggccaagaaaaaagctgaggaagaagccgaggcaaaacctaagtttctgtccaaagcagagcgagaagcagaagcgctgaagaggagacagcaggaagttgagtag

SEQ ID NO: 220125 - DNA, 2580 bp, Artificial Sequence
  Description of Artificial Sequence: Synthetic coding sequence
atgaaactcaaggacaccaaaagtaggccaaagcagagtagctgcggtaaatttcagacgaagggcatcaaggtcgtgggaaagtggaaagaggtaaagatcgacccaaatatgttcgccgatgggcagatggatgacttggtgtgtttcgaggagctgactgactaccagctcgtgtctccagcaaaaaatccttctagtttgttttccaaagaggcgcctaagcgcaaagcacaagcagtctccgaagaggaggaagaggaggaggggaaaagtagttcacccaagaaaaaaattaagctcaagaagagcaaaaacgtagccaccgaagggacgagcacacagaaggagttcgaagtgaaagacccagaactcgaggctcagggggacgacatggtgtgtgatgaccccgaagcaggggaaatgacttccgaaaacctcgtacagactgcccctaaaaagaagaaaaataaaggaaagaaaggactggagccttctcagtccacggccgcaaaggtccccaagaaagctaagacttggatcccagaggtgcatgaccagaaagctgacgtatccgcttggaaagacctgttcgtccctcgcccagtgctccgggctctgtcattcctaggcttctccgccccaacccccatccaagccctgaccctggctccggcaatcagggataagctcgatatcttaggagctgccgagacaggcagcggcaaaaccctagcgtttgcgataccgatgattcacgcggtcctgcagtggcaaaaaagaaatgctgccccaccaccttctaacactgaggcaccccctggagaaacaagaactgaggctggggctgagacacgctctcctggtaaagcagaggccgagagtgatgccctgcccgacgatacggtgatcgaatcagaagcactccctagtgatatcgcagcagaggccagagccaaaacggggggaactgtcagcgaccaagcccttctgtttggcgacgatgatgctggggagggcccaagcagtcttatccgtgaaaaacctgtccccaagcagaatgagaatgaggaggaaaaccttgataaagagcagacaggaaatttaaagcaggagctggatgataagagtgccacctgtaaagcgtaccctaagagacccctcctgggtctggtactcacaccgactcgggaattggccgtgcaggtgaagcagcacattgatgcagtcgcgaggttcaccgggattaaaactgccattctggtgggcggtatgtccacacagaagcagcagagaatgctgaaccggagaccagagattgttgtggccactccagggcgactgtgggaactgataaaagagaagcactaccacctccggaacttgcgccagttacgatgcctggtcgtagacgaagccgatagaatggtggaaaagggacattttgctgaactgagtcagctgctggagatgcttaacgatagccagtacaatcctaagcggcagaccctggtgtttagcgccactttgacgcttgttcaccaggcacctgccaggattctgcataaaaagcacaccaagaagatggacaaaaccgcaaagttggacctcctaatgcagaagatcggaatgagagggaaacccaaagtaattgacctaaccaggaacgaggcaactgtagagaccttaacggagaccaagatccattgtgaaacagatgagaaagatttctacctttattactttctgatgcagtatcctggacgcagtcttgtgttcgctaactccataagctgcatcaaacggctctctggactgttaaaggtgctggatatcatgccccttactctgcatgcctgcatgcaccaaaagcagagactgaggaaccttgaacagtttgcccgattggaagactgtgtgctgctcgctactgacgtagccgctagagggctggatatcccaaaagtacaacacgtgatccattatcaggtgcctcgcacttccgagatctatgtgcaccggtcaggtcggactgccagagcaactaacgagggcctgagtctgatgctgattggccctgaggacgttattaattttaaaaagatctataagacattaaagaaagatgaagacatacctctcttccctgtacagacaaaatatatggatgtcgtcaaagagcgcatccgcctcgccaggcagatcgagaagtctgaatatcggaatttccaggcctgtttacacaattcctggatcgagcaggccgcagcagctttagagattgagttagaagaggatatgtacaagggtggcaaggctgaccagcaggaggagcgccgaaggcagaagcagatgaaggtcttgaagaaagagctccggcatcttttaagccagccactgtttaccgaaagtcagaagactaaataccctacacagagcggcaaacccccattactcgtttctgccccatcaaagagcgagtcggcactctcctgcctgtcaaagcagaagaaaaaaaagaccaagaaacccaaagaaccccagcctgagcaacctcaacccagcacaagtgcgaattag

SEQ ID NO: 220126 - DNA, 2415 bp, Artificial Sequence
  Description of Artificial Sequence: Synthetic coding sequence
atgaaattgaaggacaccaaatcgcgacctaaacagagcagctgcggcaaatttcagaccaaggggatcaaagtggttggtaaatggaaagaggttaaaattgatccgaatatgtttgccgatggacagatggatgatcttgtctgcttcgaggagttgacagactaccagctcgtgtcaccagctaagaatccttctagcctattttcaaaggaggcccctaaaagaaaagcgcaggcagtgagtgaagaggaagaagaggaggaaggtaaaagctcaagtccaaaaaaaaagatcaagctgaagaaaagtaagaacgtcgccaccgagggaacatctacacagaaggaattcgaggtgaaagatcctgaacttgaagctcagggagacgacatggtttgcgacgacccagaggccggtgagatgacgtctgagaacctcgttcaaactgcccctaagaagaagaaaaacaagggcaagaagggtttagaaccgagccagtctactgcagctatccgtgataaactcgacattctgggtgctgcggaaacaggaagcggtaaaacattggcattcgctatccccatgattcacgctgtgctccaatggcagaaaagaaacgccgcacccccaccgtctaatactgaagctcccccaggggaaaccaggacagaggctggtgccgagactagatcacccggaaaggccgaggcagagtcggacgctctcccggatgatactgtcatcgaatctgaagcgctgccaagcgatatagccgctgaggcccgtgcgaaaaccggaggaaccgtatctgatcaggcactgctgtttggcgatgacgatgctggcgaaggaccttcctcactgattcgcgagaagccagtacctaaacagaatgagaatgaggaggaaaacctcgataaggagcagaccggaaacctgaaacaggaactggacgataaatcagcaacgtgcaaagcgtatcctaagcgacccctgctgggtctggtactcacgcctactcgggaactggccgtccaggtgaagcagcacatcgacgctgtggcaaggttcactggaatcaagacggccattctggtgggcggaatgtcaacccagaaacagcaacgcatgctcaacaggagacctgaaattgtcgtggccactcctggtcggctttgggagctcattaaggaaaaacattatcacctacgcaatttgaggcagttgcggtgccttgtggtcgacgaggctgaccggatggtcgagaaagggcacttcgcagaattaagccaacttcttgaaatgctgaatgactcccagtataatccaaaacgccagacactggttttctcagccacactgaccctcgttcaccaggcaccagcccgaattctgcataaaaagcacaccaaaaagatggacaaaaccgcgaagttagatttgctcatgcaaaaaataggcatgaggggaaaacctaaggttattgacctgacaaggaacgaggcgacggtggaaacgcttacagagacaaagattcattgcgaaacagatgagaaggacttctatctgtactacttcctgatgcagtacccgggaagatcacttgtctttgccaactccatctcatgtatcaagagattgagcggcctgctcaaggttttggatataatgccccttaccctccacgcttgcatgcaccagaagcagcgacttcgcaatctcgaacagtttgcgcgtttggaggattgcgtactgctggctacagatgttgccgctagagggcttgacattcccaaggtgcagcatgtaattcactaccaggtgccaaggactagcgagatttacgtccaccggagcgggaggaccgcacgggctaccaacgagggactgtcattaatgctcattggtcctgaagacgtgattaattttaagaagatatataagaccctcaagaaggatgaggacatcccgttgtttcctgtgcagaccaagtacatggacgtagtgaaagagcgcatcagactggctcgccagattgagaagtcagagtataggaacttccaagcttgtctccacaatagctggatcgaacaggcggcagccgctctggagatcgagcttgaagaagatatgtataaaggcggaaaggccgaccagcaggaagagcggagaaggcagaagcagatgaaggtgctaaaaaaggagctgcgccacctgctgagccaacctctgttcacggagtcgcagaagaccaaatacccaacccagtccgggaagccccctcttctggtgagcgctccgtccaaaagcgaaagtgcactgtcctgcctatccaaacaaaagaagaaaaagacaaaaaaacccaaggaaccccagccagaacagccgcaaccttcgaccagcgccaactag

SEQ ID NO: 220127 - DNA, 2292 bp, Artificial Sequence
  Description of Artificial Sequence: Synthetic coding sequence
atggatgatctggtctgcttcgaggaattgactgactaccagctggtgagtccagctaagaatccatcatctctgttcagcaaggaggctcctaagagaaaggcccaggccgtcagcgaggaggaagaagaagaagaaggcaaaagctcttctccaaaaaagaaaatcaaactgaaaaaatctaagaacgtggctacggaagggacgtccactcagaaagaatttgaggtaaaggacccagaactggaggctcagggtgatgacatggtgtgcgatgaccccgaggcaggcgagatgacctcggagaacctggttcagaccgcccctaagaaaaagaaaaataagggaaagaaggggctcgaaccatcacagagcacagccgctaaagtgccgaaaaaagccaaaacctggatcccagaagttcatgaccagaaggcagacgtgtccgcctggaaagatctcttcgtgccacgcccagtattaagagctttgtctttccttgggttctccgctccaaccccaattcaggctctgaccctcgcaccagccatccgtgataagctggatatcctgggcgctgcggaaacaggaagtggcaaaacccttgcatttgccatcccgatgatacatgctgttctgcaatggcagaaacgcaacgccgctcctccacccagtaacacagaggctcccccaggtgagacaaggaccgaagcaggggcagaaacacgttcacctgggaaggctgaggctgaaagcgacgccttgcctgacgacaccgttatcgaatccgaggctcttcctagcgatattgccgcagaggcacgggcaaaaaccggaggaactgtgagtgaccaggccctcctgtttggggatgacgacgcaggagaaggtccctccagtctgattcgtgaaaaacccgtgcctaagcagaacgagaacgaagaagagaatcttgacaaggagcaaacaggcaacctgaaacaggaactcgatgataaaagcgctacttgtaaggcatatccaaaaaggccactgttgggccttgtcctgacccctacacgggagctcgcagtgcaggtgaaacagcacatcgatgccgttgcaagattcacaggcatcaagactgccatcctggtgggtgggatgagtacccagaaacagcagcggatgttaaaccgcagaccagaaattgtcgttgcaactcctggccgtctttgggaactcataaaggaaaagcactatcacctgagaaacctccgccagctgcgctgcctggtcgtggatgaagctgacagaatggttgagaagggtcatttcgctgaactttcccagcttctcgaaatgttaaatgactctcaatataatccaaaaaggcagacacttgtgttctcagccacactgacactggtgcaccaagctccagctagaattcttcacaagaagcatactaaaaagatggacaagacagccaaactagatctgttgatgcagaagatcgggatgcggggaaagccaaaggtgattgatctgacgaggaatgaggccacagtggagacactgactgagacaaagattcactgcgaaacggacgaaaaggacttttacctgtactactttttaatgcagtatcccggacgctccctggtgtttgcaaatagcatctcttgcataaaaagactctccgggctgctgaaggtgctcgatattatgccactcaccctgcacgcttgtatgcaccagaagcagcggctgcgtaacctcgaacaatttgccaggttggaggactgcgtattattagccaccgacgtcgccgcacgcggtctggacatccccaaggtccagcatgtgattcattaccaagttcccagaacatccgagatatacgttcataggagtggtcgaactgcaagagccaccaacgagggattgagcctcatgctcatcggtcctgaagacgtcattaactttaaaaaaatttacaagacactcaaaaaagacgaggatataccgctgttccccgtgcagaccaaatatatggacgttgttaaggagcgcatccgacttgccaggcagatcgagaagtctgagtatcggaacttccaggcgtgcctgcacaactcttggatcgaacaagccgcagctgccctggagattgagctggaagaggatatgtacaaaggaggcaaggcagatcagcaggaagagcgtcgaagacagaaacagatgaaagtgctgaaaaaagagcttagacacttgctgtcccagcctcagcccagcacaagcgctaactag

SEQ ID NO: 220128 - DNA, 1458 bp, Artificial Sequence
  Description of Artificial Sequence: Synthetic coding sequence
atgaccaaggccccttgtaaagcgtacccaaaacgccctttactgggccttgtccttaccccgactcgcgagctggctgtgcaggtgaaacagcatattgacgcagtggcacgctttactggcataaagacagcaattcttgtcggagggatgagtacacagaagcagcagcggatgctcaaccggcgacccgaaattgtggtggccacacctggaagattgtgggagctgatcaaggaaaagcactatcatttgcggaatctgaggcagctgcgctgccttgtcgtggacgaggccgacagaatggtcgagaaaggccactttgctgaactctcacagctgctggagatgctgaatgactcacagtataaccctaaaagacaaacactcgtcttctcggcgaccctgactttggtgcatcaagcccctgcccgtatcctgcacaaaaagcatacaaaaaagatggataaaactgctaagcttgacctgcttatgcagaagatagggatgcgagggaagcccaaagtaatcgatctgaccaggaatgaggccacggttgaaaccctgaccgaaacgaagatacattgcgagacagatgaaaaggacttctacttatactattttctgatgcagtaccccggacggtccctggtatttgcaaatagtatctcctgcattaagcgactgagcgggctgcttaaagtccttgacatcatgcctttgacattgcatgcctgcatgcatcaaaagcagcggctccgtaatttagagcaattcgcccgactcgaagactgtgtgctcctggctaccgacgttgccgcaagaggcctggacattccaaaagtgcaacatgtgatccattaccaggtgcctaggacaagtgagatttatgttcatcgatctggcaggacagcacgagcgaccaacgagggcctgtccctcatgctgatcggaccagaagacgttatcaatttcaaaaagatttacaagacgctgaaaaaggacgaggatatacctctgttcccggtccagaccaaatatatggatgtggtaaaggagcgaatcagactcgccaggcagattgaaaaaagtgagtatcgcaactttcaggcatgtctccataattcctggattgaacaggctgcagccgcactagagattgaactagaggaggatatgtataaaggaggaaaagccgatcagcaagaggaaaggcgccgacagaaacagatgaaggtgttgaaaaaagagctcagacacttgctgagccagccactgtttacagaatctcagaaaaccaaatatcctactcaatctggcaagcccccactcttggttagcgccccaagcaaaagcgagtcagccttgagttgtctgtctaagcagaagaagaaaaaaaccaagaaaccgaaagagccccaaccagaacagccgcaaccgagcacttcggctaattag

SEQ ID NO: 220129 - DNA, 1623 bp, Artificial Sequence
  Description of Artificial Sequence: Synthetic coding sequence
atggccctgacccgccctgttcggctgttttccctcgtgacgcgactcctgctggcacctcgccgaggcctgaccgttcgatccccagacgagcccctgccggttgtgagaataccagtggccctgcagagacagctggagcagagacagtcacgcaggaggaacctaccaagacctgtcctagttaggcccggacctctgttggtatccgcccgtcgtcccgagctgaaccagccagcccgtctgacacttggcaggtgggagagggccccactggcttctcagggttggaaaagtcggagagccagacgtgaccacttttcgattgagagagcccagcaggaagcccctgcagtgaggaaattgagttcaaagggctcatttgcggatctgggactggaacccagagttctccacgccctgcaggaggcggctcctgaggtggtgcagccaactaccgtccaatcatcaactattccctcactgctgcgcggacgccacgtagtctgtgccgctgagaccggcagtgggaaaacactaagttacctgcttcccttactgcagaggttactgggacaaccatccctggatagtttacctattcctgccccaagagggctcgttctggtgccatcccgggagctggcccaacaagtgcgtgccgttgcccagcccctggggcgatccctgggattgctagtgagagaccttgagggtgggcacgggatgaggcggatccggcttcagctttcgcgccaacccagtgctgatgtgctggttgctacgcctggcgctctgtggaaggctttgaagtcccggctaatttctctcgaacagctctcctttcttgtgctggatgaggctgatacactgctggatgaatccttcttggagctcgttgactatattttggaaaagagccacatcgccgaaggtcccgctgacctggaagacccttttaatcctaaggcacagcttgtcctggttggggcaacgtttcccgaaggagtgggacagcttctgaataaggtcgcgagcccagacgcggtgacgacgattacatctagcaagctgcattgcatcatgccccacgtgaagcagacatttttgcgcctgaagggggcagataaggttgccgagcttgttcatattctaaagcaccgggatcgggcagagcgaacaggtccaagtgggacagtgctggtgttttgtaacagttcatccactgtgaattggctgggttacatcctggacgatcacaagatccagcacctacgactgcagggacagatgcccgctctgatgcgggtcgggatttttcagagtttccagaaaagcagccgggacattttgttgtgcaccgatatcgcctccaggggtcttgactccacaggcgtcgagttggtggtcaactatgatttcccccctactcttcaggattatatccaccgcgctggacgcgtcgggcgtgtgggtagcgaggttcccggtacagtcatcagcttcgtcacccatccctgggacgtgagcctggtccaaaaaatcgagctagccgcaaggcgacgaaggtccctgcctgggctcgcttcaagcgtcaaggagccgctcccccaggccacatag

SEQ ID NO: 220130 - DNA, 1989 bp, Artificial Sequence
  Description of Artificial Sequence: Synthetic coding sequence
atgtctcacgtggcagtggagaatgcccttggcctggaccagcagttcgccggtctggatctgaattcatctgataatcagtctgggggaagcactgcttccaaggggagatacatcccccctcacctgcggaaccgtgaggccactaagggcttctacgataaagatagtagcgggtggtccagcagtaaggacaaggatgcttatagcagtttcggttcacgctctgactcccggggaaaaagttccttctttagcgatcgaggtagcggcagccgtggccgattcgacgacagaggacgatcagattacgacggcattggttcacgaggggataggagcggtttcgggaagtttgaacgtggagggaactccaggtggtgtgataagtccgacgaagacgactggtccaaaccactgcccccatccgagcggctagaacaggagctattttccggtggcaataccggaatcaattttgaaaaatacgatgatatccctgtcgaggctacaggaaacaattgtccaccacatatcgaatctttttctgacgtcgaaatgggcgagatcataatggggaatattgagctcactcggtatacgcgacccactcccgtgcagaagcatgctattcctataattaaagaaaaacgggatctgatggcctgtgcacagacagggtccgggaagacagcagcattcctgttacccattctttcacaaatctatagcgacggccctggggaggctctgagggcgatgaaagagaacgggagatacggaaggcggaagcagtacccaatctccctagtcctggcaccaaccagggagttggctgtccagatttacgaagaagccagaaaatttagctatagaagcagggtgcgcccttgcgtagtttatggtggcgcagacattggtcaacagatcagggacttagagcggggttgccacctgctggtcgccacccctggcaggttggtggatatgatggaacgcggtaagattgggctagatttctgcaagtacctggtgctagatgaggctgaccgtatgttagatatgggatttgagcctcagattcgtcgtattgtagaacaggataccatgccccctaagggtgttaggcataccatgatgttcagcgcaacttttcctaaagaaatccagatgctagccagggactttctggacgagtacatcttcttggccgttgggagagttggttccactagcgaaaacattacgcagaaggttgtgtgggtggaagagtcagataagcggtctttccttctggacctcctcaatgctaccggcaaggattcgttgaccttggtcttcgtggagaccaagaaaggcgctgacagcctggaagactttctgtatcatgaaggttatgcatgtacttctattcacggagaccgatctcagcgcgacagagaagaggcgctccatcagttcaggtctggaaagtctcctattctggtggccacagccgtggcagccagggggctcgacatctccaacgttaagcatgtgataaattttgatttgcctagcgatatcgaagagtacgtgcacaggatcggaagaacaggaagggtcggaaacctgggccttgcaacaagcttttttaacgagcggaacatcaacattacgaaagacctcctcgatcttctggtcgaggccaagcaagaagttccatcttggctggaaaacatggcttacgagcaccactataaggggtccagtaggggccgttctaagagttcccggttctctggaggcttcggcgcacgagattatagacagagcagtggggcttcttctagctcattttccagctctcgggcaagcagtagtaggtcagggggtggtggtcatggatcctcaagaggcttcggcggaggcggatatggcggattttataacagcgacggttacggcggaaattacaattcacagggcgtagattggtgggggaattag

SEQ ID NO: 220131 - DNA, 420 bp, Artificial Sequence
  Description of Artificial Sequence: Synthetic coding sequence
atgtcacacgtcgcagttgagaatgcattgggcttagatcagcagttcgccggtctggacctgaattcgtctgacaatcaaagcggcggatccacggcttctaaggggaggtacatccccccacatctccgaaatagggaggcaacaaaagggttctacgataaagatagcagcggctggagcagtagcaaagacaaggacgcatacagcagttttggctcaaggtcagatagcagaggaaaatctagttttttttctgaccgcggatcaggctcgcggggacgctttgatgatcggggtagatcagactacgacggaatcggctcaaggggcgatcgttcgggctatgggggattttacaactcagacggctacggcggaaactacaacagccagggagtggactggtggggaaattag

SEQ ID NO: 220132 - DNA, 1941 bp, Artificial Sequence
  Description of Artificial Sequence: Synthetic coding sequence
atgtcacatgttgcggttgaaaatgctctgggcctggaccagcagttcgctggtctggacttgaattctagtgataatcagagtggaggcagcacggcttcgtctttctacgataaagatagtagcgggtggagctcaagtaaggataaggacgcctactcttcttttgggtctagatccgatagtcggggtaagagttctttcttttcagacaggggttctgggagccgcggtagattcgatgaccggggaaggtcggattacgacggtatcggcagcagaggagacagatccgggttcggcaagttcgagaggggcggtaacagtaggtggtgcgataaatccgatgaagatgactggtccaagcccttaccaccgagcgagcggctggagcaagagcttttcagtggtggaaacaccgggatcaactttgaaaagtacgacgacatccctgtggaagccactggaaataattgtcctccccatatcgagtcgtttagcgatgtcgagatgggggagatcataatgggaaacatcgagttgacaagatacactcgtccgacacccgttcagaagcatgcaatccccataatcaaggagaaacgggacttgatggcctgcgctcagaccggtagcggaaaaacagctgcattcctgctgcccatactgtctcagatttacagtgatggaccgggtgaggctctgcgggcaatgaaagagaatgggagatacggcaggagaaagcagtaccccattagcctggtcttagcacccacccgcgaattggcggtgcagatttatgaggaagcaaggaagttctcctaccggagccgagtgagaccctgcgtcgtgtacggaggagccgacattggacagcagattcgcgatctggagcgaggctgccaccttctggttgcaacacctgggagactggtagatatgatggagcgaggaaagatcgggttagatttctgtaagtatctggtgctggatgaagccgataggatgctggatatgggcttcgagccacagatcaggcggatcgtcgagcaggacactatgcctcccaaaggggttaggcacaccatgatgttttctgctacatttccgaaagagatccagatgttggcgagggactttttggatgagtacatcttcctggcagtcggtagagtgggcagcacctcagaaaatattacccagaaggttgtgtgggttgaagaaagtgataaacgctcctttctcctggatctgctcaatgctacgggcaaggattctctgaccctcgtgtttgtggagacaaaaaagggagccgactcacttgaggattttctctatcacgagggctacgcttgtacttccatacatggtgatagaagccagcgcgaccgagaggaggcgttgcatcaatttagatctggaaagtccccaatcctggtggcgacagccgtagccgcaagggggctggatattagcaacgtaaagcacgtgataaacttcgaccttccatcggatatcgaagagtacgtgcaccgtatagggaggactggacgtgtgggcaacctcggtctcgcaacctctttcttcaatgaacgtaacattaatatcacaaaggatctcctggatcttctcgtagaggccaaacaagaggttcctagttggctggagaacatggcatacgaacaccactataaaggctctagtcgaggacggtctaagagtagtaggttctccgggggattcggagcaagagattaccgccagagttccggcgctagctctagctctttctcttccagccgcgcttcaagtagccgcagcggtggcggaggccacggcagctctcgcggattcggcggaggtggatacggtgggttttacaatagtgatggttacggcggaaattacaattcccagggcgtggactggtggggaaactag

SEQ ID NO: 220133 - DNA, 927 bp, Artificial Sequence
  Description of Artificial Sequence: Synthetic coding sequence
atgcgggagtcacggttgatcagcgaccttggaggattcgcgggtgtccgttctgcagctgggagggactggcgaccattttggctcgggggtctgcgcccatctcgactcgcccagccgggatttccctccggcggtcccggaggtacgcgctgtctgagagcctgcgagcaaggcttcgctggtctggatttgaatagttccgacaaccagtccggtggttctaccgcctctaaaggaaggtacattccaccccacctgcgcaatcgagaggcaacgaagggattttacgacaaggattctagtggctggagctctagcaaggacaaggacgcctattcatcctttgggtctcgcagcgatagtcggggtaagtcctctttcttctctgaccgaggaagtggttctcgtggcaggttcgacgaccgcggaagatctgattacgatgggatcggcagccggggagataggtccggcttcggcaagtttgagagaggaggtaactctcggtggtgcgataaatccgatgaggatgattggtctaaacccctgcctccgagtgaaagactggagcaagaattgttctccggcggaaacaccgggatcaatttcgagaagtatgacgacatacctgtcgaagcaactggcaacaactgtcctccacatattgagtccttctcagatgtggagatgggggaaattatcatggggaacatcgagctgaccaggtatacgcgccctacccctgtgcagaagcacgccattccgatcataaaagagaaacgcgatctcatggcttgcgctcaaacgggcaagtggaaggtatgggcaccccagacaatacctaatctcctaggcatatccaccaatgagcgcgttgggtctaccgacttaaggggttcccagaagatttttatccctatttag

SEQ ID NO: 220134 - DNA, 1983 bp, Artificial Sequence
  Description of Artificial Sequence: Synthetic coding sequence
atgagccacgtggtcgtcaagaacgacccggagctggaccagcagctagccaatcttgacttaaattccgaaaagcaaagtggcggtgcctctaccgcttctaagggccgttatatacccccacatttgcgtaatcgcgaggcctccaaagggtttcacgataaggatagcagcggatggagctgcagtaaggataaagatgcctatagcagctttggctcaagggattccagagggaagcccggatatttcagtgaacgcggatccggatccagggggagattcgatgatagaggaagatccgattacgatggaattggcaatcgggagcggcctgggttcggaagatttgagcggtccgggcattcaagatggtgcgataagtccgtggaagacgactggagcaagccactgccaccgagtgaacgtctggaacaggagctgttctcgggcggaaacacaggtatcaactttgagaagtatgacgacattccagtcgaagcaacagggagtaattgcccaccacacatcgaaaacttttcagatattgacatgggggagattattatgggtaatattgagcttactaggtataccaggcccactcccgtgcagaagcacgcaattcccatcatcaagggaaaaagagatcttatggcctgtgcccagactggatccggaaagaccgccgctttcttactgcctatattgtctcagatttatactgatggaccgggagaggcacttaaagctgtgaaagagaacggaaggtatggtcgcagaaaacagtatcccatttccttggtactcgcaccaaccagggagctggccgttcagatatacgaagaagccagaaaattttcctatagaagccgagtccgaccttgcgttgtttatggaggcgcagatatcggtcagcagattcgcgatcttgagcgcggatgccacttattagtagccacccccggacgcttagtggacatgatggagcgcggaaagatcggcttagacttctgcaaatacctcgtgttggatgaggctgatcggatgctcgatatggggttcgagccacaaattcgtcgcatcgtggagcaggatactatgccacccaagggtgtgagacatacaatgatgttttccgcgacgtttcccaaggagattcaaatgctggccagggactttctggatgaatacatctttttggcagttgggagggtgggttccacctcagagaacatcactcagaaggtggtgtgggtagaggacctggacaaacggagcttcctgcttgatatcctgggggctacggggtctgattcactcacactcgtcttcgttgagactaaaaagggggcagattctctggaggatttcttgtaccacgagggttacgcctgtacctctatccacggggaccggagccagagggatcgggaagaagccctgcatcagtttagatctgggaagagtcctatcttggtcgctacagcagtcgcagcccgaggcctagacatctcaaatgtgcgccacgtcatcaattttgatctgccatctgatattgaggaatacgtacacagaattggacggacgggaagagtgggtaaccttggcctcgccaccagctttttcaacgagaaaaatatgaatatcaccaaagaccttctggatcttctggtcgaggctaagcaggaagtccccagctggttagaaaatatggcctatgagcatcattacaagggtggttcaagagggagatccaagagcaatagattctcgggcggatttggggcacgggactaccgacaaagcagtgggagtagttcaagcggcttcggcgcatcgcggggatcaagttcccgctccggaggcggaggttacggaaactccagagggttcggaggcggtggttatggtggattctacaacagcgacgggtacggcggaaattataatagtcagggggtcgactggtggggcaattag

SEQ ID NO: 220135 - DNA, 1983 bp, Artificial Sequence
  Description of Artificial Sequence: Synthetic coding sequence
atgtcacacgtcgtggtcaagaacgaccccgaattagatcaacagctagccaatcttgacctcaactccgaaaagcagagcggtggggcttccactgcttcaaaaggtagatacatccccccacatctcaggaaccgtgaggcgagcaaggggttccacgacaaagacagctctgggtggagctgctctaaggacaaagatgcttacagttcgttcggaagccgagactccagggggaagcccggatacttttccgagcgtggctccggaagcagagggagattcgacgatcggggtagatcagactacgatggaatcgggaaccgagaacgtccaggatttggcagatttgagagatccggccattccaggtggtgcgacaaaagtgtcgaggatgactggtcaaaaccactccccccaagcgagcgcctggaacaggagttattttcgggaggcaacaccgggattaactttgagaagtatgacgatatcccggtcgaagcgacgggcagtaactgtcctccgcacattgagaacttcagtgacattgatatgggagaaataatcatgggaaacatagaactaaccaggtacacccgccctacccccgtgcagaaacacgcgatccctattattaaaggcaaacgtgatttaatggcgtgcgcccagaccggcagcggaaaaactgctgcctttctgctgccaattctatctcaaatctacactgacggtccaggcgaagcgctcaaagcagtcaaggaaaatggacggtacggcaggcggaagcagtatcctatctccctggttcttgccccaacccgggagctggcggtccagatttatgaggaagccagaaagttcagctatcggtcccgtgttcgaccgtgcgtggtttacggtggagcggacattggacagcagatccgtgacctggaaagaggatgccacctgctggtggccactcccggtcggttggtggacatgatggaacgcggaaaaatcggactcgacttttgtaagtatcttgtattagatgaagccgaccgaatgctggacatgggcttcgagccccagatccggcgaatcgtggagcaggacacaatgccgcctaaaggggtccggcatacaatgatgttttcagccacttttcccaaagaaatccagatgctcgcacgcgactttctcgacgagtacatcttcctcgccgtcggccgtgtggggtctacctctgagaacatcacacagaaagttgtgtgggtggaggatcttgacaaacgatcctttctgctggatattctgggggctaccggatccgatagtttgacccttgtgtttgtcgaaaccaagaagggggctgacagcttagaagacttcctctaccacgaaggatacgcgtgtacaagcatccacggtgacaggagccagcgtgacagggaggaagccttacaccagttccggagcggaaagtcgccgatcctcgtggccacggccgtggccgctagaggactcgacattagcaatgtcaggcatgtaataaactttgatctgcctagtgatatcgaagaatacgttcatagaattggcagaactgggcgagtgggcaatttgggccttgcaaccagcttcttcaatgaaaaaaatatgaacatcacaaaagacctgcttgatctgcttgtcgaagctaagcaagaagtgccttcttggctagagaacatggcttatgagcatcactacaaaggcggatccagaggacggtccaagagcaatcgcttctcaggcggatttggggctagggattataggcagtcaagtgggtcctcctccagtggattcggggcatctagaggatcctctagccgaagcggtggcggaggctacggcaacagcagaggtttcggaggaggtggctacggaggattctacaatagtgacgggtacgggggaaactataactcccagggggtcgactggtggggcaactag

SEQ ID NO: 220136 - DNA, 753 bp, Artificial Sequence
  Description of Artificial Sequence: Synthetic coding sequence
atggagataggccgacctcggaaagacacatggaagctcgccaacctcgatctgaactccgaaaagcagagtgggggagcgtccactgcatctaagggcagatacatccctccccatctgcgcaaccgcgaggcctctaaagggttccatgataaagactccagtggctggtcttgcagcaaagacaaagatgcatactcctcattcgggagccgcgatagccgtggtaagcctggatactttagcgaacggggttccggcagcaggggtcggttcgatgatcgcggtcggtccgattatgatgggattggcaaccgggaacggccaggcttcggacggttcgaacggagtggccattcccgctggtgtgacaaatccgtcgaggacgattggtctaaaccgctcccaccatcagaaaggctggaacaagagctgttttctgggggtaacactgggatcaacttcgaaaagtacgacgacattcctgtggaggccaccgggagcaattgtcctcctcatatagagaatttttccgatatcgacatgggagaaatcatcatgggaaacatagagctaactcggtacacacgacctaccccggttcagaagcacgccattccaatcattaaggggaaaagggatctgatggcatgtgcgcagaccggaagtgggaagactgctgcattcctgctgcccattctctctcagatttacaccgatggaccaggcgaggccctaaaggctgtgaaatag

SEQ ID NO: 220137 - DNA, 675 bp, Artificial Sequence
  Description of Artificial Sequence: Synthetic coding sequence
atgtcacacgttgtggtgaagaacgacccggaactggaccagcagctggccaacctggacttgaattctgagaagcaatctggaggggcatctactgccagcaagggtcgttacatccccccacacttgcgcaacagggaggcttctaaaggattccacgacaaagactcctccggatggtcgtgcagtaaggataaggacgcctatagttctttcggctccagggactcgcggggtaagccgggatacttctctgaaagaggatccggcagcagaggacggtttgacgataggggaagatctgactacgacggaattgggaacagagaacggccaggctttggtaggttcgaaaggagcggtcactcgaggtggtgcgacaaatccgtagaagatgactggagtaagcccttgccacctagcgaacgactggaacaggagctgtttagtggaggcaataccggcattaattttgaaaaatatgatgacattccagtggaagccaccggcagcaactgcccaccacacattgagaatttcagcgacatagacatgggtgagataatcatgggtaacatcgagttgacccggtatactcgtccaaccccggtccagaaacatgccattccaatcataaaaggcaagagagacttgatggcatgcgcccagacctag

SEQ ID NO: 220138 - DNA, 1974 bp, Artificial Sequence
  Description of Artificial Sequence: Synthetic coding sequence
atggagattgggaggcccagaaaagacacatggaagcttgcaaatctggacctgaattccgagaagcaatctggcggtgccagcaccgcatccaaggggaggtatatccctcctcatttgcggaatcgggaggcctccaagggctttcatgacaaggactcatctggctggagctgttctaaagataaggacgcttatagcagcttcggatcgcgggactctcggggtaagccaggttatttttccgaacggggttctggatccagagggagattcgacgatcgagggcgaagcgattacgatggtataggaaaccgggagaggcccggtttcggccgtttcgagaggagtggtcacagtagatggtgcgataagtctgtggaagacgattggtccaaacctctcccaccaagtgaaaggctggaacaagagctgttcagcggaggcaatacagggattaactttgagaagtacgacgacatcccagtagaggctactgggagtaactgcccgccacatatcgaaaacttctccgacatcgatatgggagaaatcatcatgggcaacattgaactgacacgatacaccagacccactcccgtgcagaagcatgccattccaattatcaaggggaaacgagatctgatggcctgtgcccagaccggatccggcaaaactgcggctttcctgcttccaatactgtcccagatatatactgacggtcccggtgaagctctaaaggccgtgaaggagaacgggaggtatgggagacggaaacagtatccaatatccttagtgctggcacctacaagggagctggcagtgcaaatatatgaagaggccaggaagttctcctacaggtcaagagtcagaccttgcgttgtgtacggcggtgcggatattggacagcagattagggatttagagcgaggttgccacctcctggtggccacgcctgggagactggttgacatgatggaaagagggaagattgggttggacttttgtaaatacttagtgctggacgaagctgatcggatgctggacatgggcttcgagcctcaaatccgcaggattgtggagcaggacacaatgccacccaagggagtgcgtcatactatgatgttttccgcaacttttcccaaagaaattcaaatgctggcacgcgatttcctggacgagtacattttcctggcagtggggagagttggctctactagtgagaacattacacaaaaggtggtgtgggttgaggatctggataagagatcttttctgctggacattttgggcgcaacaggttctgattctctgacattagtttttgtggaaactaaaaagggagccgactccctggaagattttctgtatcacgagggctatgcctgtacaagtatccacggcgatcgtagccagcgggatcgggaagaagctctgcatcagttccggtccggcaagtcgcccattttggttgccacagcagtggcagccagagggctggatatatccaacgtgcgacacgttatcaatttcgatcttcctagtgatatagaggaatatgtgcatcggattggccgaaccggaagagtgggaaacctgggcctggccacttctttctttaacgagaaaaatatgaacatcaccaaagacctgctcgacctactggtagaagcaaaacaggaggtgcctagctggctcgagaacatggcgtacgagcatcactataaaggcggaagccgcggaagaagtaagagtaatcgtttctccgggggttttggggctcgggattacagacagagcagcgggtctagcagctctggtttcggtgccagtcggggtagcagctcccgcagcggcggaggagggtacgggaactctaggggattcggaggcggtggctacggaggcttctataattctgatgggtatggcggaaattacaacagccagggtgtagattggtgggggaactag

SEQ ID NO: 220139 - DNA, 1278 bp, Artificial Sequence
  Description of Artificial Sequence: Synthetic coding sequence
atggcagagaatgatgtggacaacgaacttctagactatgaagacgatgaagtcgagactgccgctggaggtgatggggctgaggcaccagctaaaaaagatgtgaaaggctcctacgtttccatccacagctcagggttccgagatttcctgctaaaacccgaacttttgcgcgctattgttgactgcgggtttgaacatccttcagaggtccagcatgaatgtatcccacaggctatcctgggcatggacgtcttgtgtcaggccaaaagcggtatgggaaaaaccgcagtgttcgtgctggccacgctgcagcagctcgagccagtcactggccaggttagcgtactagtcatgtgccatacacgcgagctcgctttccagattagcaaagaatatgagagattctctaagtatatgcccaatgtcaaagtagcggtattttttgggggtctgtctattaagaaggatgaggaagtgctgaaaaagaattgccctcatatagtagtgggcaccccaggtcgaatccttgcactcgcgaggaataaaagcttaaatcttaaacacattaaacacttcatccttgacgaatgtgataagatgctggaacagttagacatgagaagggacgtgcaagaaatctttaggatgacaccccatgaaaagcaagtgatgatgttcagcgcgactctcagcaaggaaataaggccagtatgcagaaaatttatgcaggatcctatggagattttcgtggacgatgagacaaagctcactctccacggacttcaacagtattacgtgaaactcaaggacaatgagaaaaatcgaaagctgtttgatctgctggacgtacttgaattcaatcaagtcgtgatctttgttaaaagtgtgcagcgttgcatcgccctcgctcagctgctggtggagcagaattttcctgcgattgcaatccaccgcggaatgccccaggaagagagactcagtcggtaccagcagttcaaagatttccaacgtaggattttggtggctacaaacctgtttggcagagggatggatatcgaacgggtgaacatcgctttcaactatgatatgcctgaagacagcgatacctacctgcacagatgttatcctctgtcacccagcaggtggcctgaacaggctggcctggccccacgggcttggctcagccacctgtgtcctatgcgaatgatgccaaggagcagcatgatgtgtcgcattgctcttaggtccatccttgtgtcatgtcttatgcggtag

SEQ ID NO: 220140 - DNA, 1287 bp, Artificial Sequence
  Description of Artificial Sequence: Synthetic coding sequence
atggccgaaaacgatgttgacaacgaactcctcgactacgaagatgatgaggtggagactgcagctgggggtgatggcgctgaggcccctgctaagaaggatgtaaagggcagctacgttagcatccactcctccgggttccgcgatttcttattgaagcccgagcttcttcgcgctatcgtggactgcggcttcgagcatccttcagaggtgcaacatgaatgcatcccccaggccatcctgggaatggatgtcctgtgccaggccaagagtggcatgggcaaaacagccgtgtttgtattggccaccttgcagcaactcgaacctgtgacaggacaggtatcagtactcgtcatgtgtcacacccgggaattggcatttcagatatccaaggagtatgaaagattttctaagtacatgcccaatgtcaaggtcgcagtctttttcggaggcctgtcaatcaaaaaagacgaggaagtcctgaagaagaactgtcctcatattgtggtgggtactccaggaaggattctggccctggcgaggaataagtccctaaacctgaagcacattaagcatttcatcctggacgaatgtgacaagatgctggagcagctcgacatgcgtcgcgacgtccaagagatattccgcatgactccccacgaaaagcaggttatgatgttcagcgctaccctaagcaaagagatcaggcccgtttgtagaaagttcatgcaggatcctatggagattttcgtagatgacgagactaaactgaccctgcacggccttcaacagtattatgtcaagcttaaggataacgagaagaaccggaaattgtttgatctgctcgatgtcctagaattcaaccaggtggtgattttcgtgaaaagtgtccagagatgcatcgccctcgcacagctactcgtggaacaaaatttccctgccattgccattcaccgcggaatgccacaagaggaacgacttagccgctaccagcagttcaaagatttccagaggcgcatcctggttgctaccaacttatttggacgcggaatggacatagagagggtgaatattgctttcaactacgacatgcccgaagattctgatacctacctccatagagttgcacgcgctggacgattcgggaccaaaggcctggccatcacttttgtgtccgatgagaacgatgcaaagatcctgaacgacgttcaagataggtttgaggttaatatctcagagttacctgatgaaattgatatcagtagttatatagagcaaacccgctag

SEQ ID NO: 220141 - DNA, 1287 bp, Artificial Sequence
  Description of Artificial Sequence: Synthetic coding sequence
atggcagagaacgatgtggataatgaactattagattacgaggatgacgaggtcgagacggcagccggaggcgatggtgccgaagctccagcaaagaaggatgtgaagggatcctacgtttccattcattcctccggtttcagagactttcttctgaaacccgagctgctacgggctatcgtggactgtggctttgagcatccctctgaggtgcaacacgaatgcatcccacaggcaatcctaggcatggacgtcctctgtcaggccaagtcaggcatgggaaaaaccgcagtgttcgtgctcgcaacccttcagcaactagaaccggtgactggccaggtttctgtcctggtcatgtgtcacaccagagagcttgccttccagatcagcaaagagtatgaacgattttctaagtatatgcccaatgtgaaggtggccgtcttcttcgggggtctgagcatcaagaaggacgaagaggtcctgaaaaaaaactgccctcacattgtggtagggacacctggtcgtatcctcgcccttgctaggaacaagagtctgaacctgaagcacatcaagcatttcatccttgacgaatgcgataagatgcttgagcaattggatatgcgccgagacgtgcaggaaatattcaggatgaccccccatgaaaagcaagtgatgatgtttagcgccactctctccaaggagatccgacccgtttgcaggaaattcatgcaggaccctatggagatcttcgtcgacgacgaaactaaactcactctgcacggcctgcagcagtattacgtgaaactgaaggataacgagaagaacagaaaactattcgatctgttggatgtcctggagtttaaccaggtagttatcttcgtgaaatccgtccagcggtgtatagcactggctcagttactggtcgaacaaaacttcccagccattgctatccaccgcggaatgccacaggaagaacgactcagccgctatcaacagttcaaagattttcaacgcaggatactggttgctactaacttatttggacgcggtatggatattgaacgcgtgaacatagcattcaattatgacatgcctgaggactccgatacctaccttcacagagtggctagagccggaaggtttggtaccaaaggtctggccatcacttttgtgagcgatgagaacgacgctaaaatccttaatgacgtgcaggaccggttcgaagtaaacatcagcgaattgcccgacgagatcgatatctcgtcttacattgagcagacacggtag

SEQ ID NO: 220142 - DNA, 1278 bp, Artificial Sequence
  Description of Artificial Sequence: Synthetic coding sequence
atggctgagaatgatgtcgataatgagcttcttgactatgaagacgatgaggtcgagacagcagctggcggagacggcgctgaggctcccgcaaagaaggatgttaaggggtcctatgtgagtatccactcctcagggtttcgcgactttctcctcaagcccgagctactgagagcgatcgttgattgcggtttcgaacatccctcagaggtgcagcacgaatgcattcctcaggccatcttgggtatggatgtcctctgccaggctaaatctggaatggggaagacagccgtttttgttctcgccactcttcagcagttggagccggtcaccgggcaagttagcgtcttggtaatgtgtcatacacgagaattagccttccagatatccaaggaatacgagcgcttttccaagtacatgcccaacgtcaaggtagcagttttctttgggggactctctataaaaaaagacgaggaggtattgaagaagaattgcccacatatcgtggttgggaccccaggccgtattctggcactggcccgaaataaaagcctcaacctaaaacacattaagcactttattttagacgagtgcgataagatgctcgagcaactcgatatgcgcagagacgttcaggagatatttcgtatgacgccccacgagaaacaggtgatgatgttttccgctaccctgagcaaggagattaggccagtatgtagaaaatttatgcaggatcccatggaaatttttgtggacgacgagacgaaactgactctgcacgggctgcaacaatactacgtgaaattaaaggataacgagaagaatagaaaattgttcgatctgttggacgttctggaattcaaccaggtcgtgatatttgttaaaagtgttcagaggtgtatagcgttggcccagctgttagtagaacagaatttccctgcgatcgccattcatcggggaatgccacaggaggaacggctttctcgctatcaacagtttaaagattttcagagacggatattggtcgccacaaacctatttgggagggggatggatattgagagagtcaatatcgcctttaactatgacatgcctgaagacagcgatacgtatttgcaccgctgttatcccctgagcccatcacggtggcctgaacaggcgggtcttgcgcctcgtgcctggctgagccatctgtgccctatgcggatgatgccgaggtcaagcatgatgtgccggatcgccctgagaagtatccttgtgagctgcctgatgcgatag

SEQ ID NO: 220143 - DNA, 1287 bp, Artificial Sequence
  Description of Artificial Sequence: Synthetic coding sequence
atggctgagaacgacgtggataatgaacttttagattatgaagatgatgaggtggaaacagcagctgggggagacggcgcagaggctcctgcaaagaaagacgtgaagggctcttatgtatccattcactcaagtgggttccgagactttttacttaagcctgagcttctccgggcaattgttgactgtgggttcgagcacccatctgaggttcagcacgaatgcatccctcaggcgatactgggcatggacgtgttgtgccaggctaagagcgggatgggcaaaacggccgtgttcgtcctggccaccctgcagcaactcgagccggtgacaggccaggtatcagtgctcgtgatgtgtcatacccgcgaacttgcttttcagataagtaaggagtatgaaaggttcagcaagtacatgccgaatgtgaaagtagccgtgttctttggcggattgtccatcaaaaaggatgaggaagtgttaaaaaagaactgccctcacatagtggtgggaacccccggacgcatactggcactggctcggaacaagtccctgaatctgaagcatataaagcattttatcctggatgagtgtgataagatgctagaacagctggacatgcggcgagatgtgcaggaaatattcagaatgacaccgcacgaaaagcaggtcatgatgttttcagcaaccctgagcaaggaaattcgccctgtatgtagaaaattcatgcaggaccccatggaaatctttgtggatgacgaaaccaaactgacactgcacggactgcagcagtattacgtgaaactgaaagataacgagaaaaaccggaagctgttcgatctgttagacgtcctcgagttcaaccaggtcgtgatctttgtgaagtctgtgcagcgctgtattgccttagcacaactgctggtggagcagaattttcccgctatagcaattcataggggtatgcctcaggaggagcggctgtccaggtaccagcagttcaaggattttcagcggcgaatcctggtggcaaccaacttgtttggaagaggtatggacatagaacgagtgaatatcgcttttaattatgacatgcctgaggattctgatacatatttgcaccgggtggcacgcgcagggaggttcggaactaagggactggccatcacgtttgtgagcgatgaaaacgacgccaagatccttaacgatgtccaggaccgctttgaggtcaatataagtgagctccctgatgagattgacatctctagctatatcgaacagactaggtag

SEQ ID NO: 220144 - DNA, 1287 bp, Artificial Sequence
  Description of Artificial Sequence: Synthetic coding sequence
atggcagaaaacgacgttgacaatgaacttctggattacgaggacgatgaggtggaaactgccgctggtggggacggagctgaggcccctgccaaaaaggacgttaagggaagctatgtcagcatccattctagcgggtttagagactttctcttgaagccagaactgctacgggcaatagtagattgcggttttgaacatccatctgaggtgcaacacgaatgcatcccccaagccatactcggtatggatgtgctctgccaggctaagtccggaatgggtaagaccgccgtgtttgtgctggccacactgcagcagctggagccagtaactggccaggtgtccgtgcttgtcatgtgccacactcgggagctggcttttcagatttctaaagagtacgaacgtttcagcaaatacatgcctaatgtgaaggtggccgtgtttttcgggggactctccattaagaaggatgaggaggttctcaaaaaaaattgcccccacatagtggttggtacaccagggaggatcctggcgcttgctcgcaacaagtctctgaaccttaaacatattaagcacttcattctggacgagtgtgacaagatgttggagcagctcgatatgcgcagagatgtgcaggaaattttccgcatgacaccccacgagaaacaagttatgatgtttagtgcaacgctttctaaagagatcagaccggtgtgtaggaaattcatgcaggatccaatggaaattttcgttgatgatgaaacgaagctgactcttcatggtctgcagcagtactacgtgaagttaaaggacaacgagaagaatcggaagttattcgacctactcgatgtactggagttcaaccaggtcgtgatctttgtcaaaagcgtgcagaggtgcatcgctctggcccagctactggttgaacagaatttcccggcaatcgcaatacatcgcggaatgccccaagaagagaggctttcacggtatcaacagtttaaggatttccaacgcaggattctggtcgcaacaaacctgtttggtcgtgggatggatatcgagcgagttaatatcgcattcaactacgacatgcctgaggacagtgacacgtacctgcaccgcgtggcgagggcagggaggtttggaacgaaaggcttggccatcacctttgtgtctgatgagaacgacgccaaaatcctgaacgacgttcaggacaggttcgaggtcaacatttcagaacttccggacgaaatcgatattagttcctatattgagcagactcggtag

SEQ ID NO: 220145 - DNA, 564 bp, Artificial Sequence
  Description of Artificial Sequence: Synthetic coding sequence
atgggatcctcacatattgggggactgtccatcaacgagcgcagatgtagcgcaagcttgggactggtaatggctgaaaatgatgtggacaatgaattacttgactatgaagatgatgaagtggagaccgccgctgggggagatggagccgaagcaccagcaaagaaagacgtgaagggctcctatgtgtccatacatagctcagggttcagggactttctgcttaagcccgagttactgcgtgctatcgtagactgcgggtttgagcatcccagcgaggtccagcacgagtgtatccctcaagccatcctgggcatggacgtgctgtgtcaagccaagtctggcatgggaaagaccgcagtcttcgtcttggccacccttcagcaactagagcccgtgaccgggcaagtatctgtactggtgatgtgtcacacgagggagctcgccttccaaattagcaaagaatatgaaagattcagcaagtacatgcctaacgtcaaggtcgccgtgttctttggaggactatctataaaaaaggatgaggaggtgcttaagaagaattag

SEQ ID NO: 220146 - DNA, 1287 bp, Artificial Sequence
  Description of Artificial Sequence: Synthetic coding sequence
atggctgagaatgatgtcgacaatgaactcttggattacgaagatgatgaagtagagacggccgcagggggtgatggagctgaggccccagccaagaaggatgtgaaaggtagctacgtgtctatccactcgagtggtttccgggattttctgcttaaaccagagcttcttcgcgctatcgttgactgtggattcgaacatccttcagaagtgcaacatgagtgcatcccacaagctatcttgggcatggacgtactctgtcaggctaaatcaggcatgggaaagacagcagtgttcgtcttagccaccctccagcagctggaacccgttaccggtcaagtgagcgtgctggtgatgtgtcatacacgcgaactggccttccagatctcgaaggaatatgaaaggttttctaagtatatgccaaatgtgaaggtcgccgtgttcttcggcggattgtctattaagaaagatgaagaggtcctgaagaaaaactgcccacacatcgtggtaggaacccccggtcggattttggcccttgctcgcaataagtcgctaaatctgaagcatattaagcatttcattttagatgaatgcgacaagatgcttgaacagctcgatatgagacgagacgtacaggaaatttttaggatgacgccccatgaaaaacaggtgatgatgtttagcgctaccttatcaaaggagatccggcctgtgtgcaggaagtttatgcaggacccgatggagattttcgtggacgacgaaaccaagctgaccctccacggcctgcagcagtattatgtaaagcttaaggataacgagaaaaaccgcaagctgtttgacttgctcgacgtgctggagtttaatcaggtcgtgatttttgtcaaatctgtgcagcggtgtattgccctcgcccaattgcttgtcgaacagaacttcccagcgatcgccatccataggggaatgccccaggaggagcggctcagtcgttaccaacaatttaaggactttcagcggcgtattctggtcgctacgaatctgttcggacgaggcatggacatcgagagggtaaatatagcctttaactatgatatgcccgaggactctgacacctatcttcaccgcgtggcacgggcagggagattcgggactaaaggcctggctatcacttttgtcagtgatgagaatgatgccaaaattttaaacgatgttcaggatcgattcgaggttaatattagcgagctgcctgacgaaatagacattagtagttacatagagcagactcgctag

SEQ ID NO: 220147 - DNA, 378 bp, Artificial Sequence
  Description of Artificial Sequence: Synthetic coding sequence
atggcggaaaacgatgtggataatgaactgctggactacgaagacgatgaagtggagaccgctgctggcggagacggggctgaagccccagccaaaaaggatgtaaagggctcgtacgtgtccattcattccagtggctttagagattttcttctgaagcctgagctcctgcgggcaatcgtcgactgcgggtttgagcacccatccgaggttcaacacgaatgcattccgcaggcaattctcgggatggacgttctgtgccaagcaaagagtgggatgggcaagacggccgtgtttgtcctggctaccctgcagcagcttgaacccgtgaccggccaggttagcgtcctggtgatgtgccacaccagggagttgtag

SEQ ID NO: 220148 - DNA, 1287 bp, Artificial Sequence
  Description of Artificial Sequence: Synthetic coding sequence
atggctgaaaatgacgtggacaacgagttgctcgactacgaagatgacgaggtagaaactgctgccggaggcgacggcgcagaggcccctgccaaaaaggacgttaagggaagttatgtatcaatacactctagtgggttcagggacttcctcctgaaaccagaactgctacgtgctattgttgattgtgggtttgagcacccctcggaggtgcagcatgagtgtatacctcaggctatcctcggtatggacgtgctgtgccaagccaagagcggcatgggaaaaaccgccgtgtttgtgttagcaacacttcaacagctggaacccgtcacagggcaggtctccgtgctggtgatgtgccatacaagagagctcgccttccaaattagcaaggaatacgagagattttctaagtatatgcctaatgtaaaggtcgctgtgttcttcggcggattgagcataaagaaggacgaggaggtgttaaaaaaaaactgcccgcatattgttgtgggtacaccaggcagaattctcgctctcgccaggaacaagagtctgaacttaaaacatattaaacactttatccttgacgagtgtgataagatgctggaacagctcgacatgcgcagggatgttcaagagatctttaggatgactcctcacgaaaagcaggtgatgatgttttctgctacgctctcaaaagaaattcggcctgtgtgcaggaaatttatgcaggaccctatggagatctttgttgatgacgagactaaactgactttgcatgggctgcaacagtactatgtgaagctgaaagataatgaaaagaatcggaagttgttcgatttactcgatgtactcgaatttaaccaggtggtgatctttgttaaatctgtccagagatgtatagccttggctcagctcctggttgaacaaaactttcctgcaatagccattcacaggggtatgcctcaggaggagcgactgtcaaggtatcagcagttcaaggacttccagagacgcatcctggtagccacaaatctttttgggcgtggaatggatatcgaacgggtcaacatagcattcaactacgacatgcctgaagatagtgatacctacttgcacagggtggcccgtgccggacggttcggaaccaaaggtctggcaatcacattcgtctctgatgaaaatgatgccaaaattcttaatgatgtacaggaccgtttcgaagtgaacatctccgagttgcctgacgaaattgatataagtagctatattgaacaaacccgctag

SEQ ID NO: 220149 - DNA, 564 bp, Artificial Sequence
  Description of Artificial Sequence: Synthetic coding sequence
taatccgaagaaagggatattggcaaacctatggagattttcgtggacgatgagacaaaattgaccttgcatggactgcaacaatattatgtgaagctgaaggacaatgaaaaaaatcgaaagttgttcgatttgctggacgtgctggagttcaaccaggtggtgatattcgtgaagagtgtccaacggtgcatcgcactcgctcaattgctcgtggagcagaattttcccgcaattgcgatccacagggggatgccccaggaggaacgcctgtcaaggtaccagcagtttaaggatttccagaggcgaattttagtggcaaccaatctcttcggcaggggcatggacatcgagcgggtaaatatagctttcaattatgatatgccagaagatagtgatacctacctccaccgtgtggcgcgagccggaaggtttgggactaagggcctcgctattacgtttgtgtcagatgagaacgatgcgaagattctgaatgacgttcaggatcggtttgaagtcaatatcagcgagctcccagatgagattgatataagctcatattag

SEQ ID NO: 220150 - DNA, 378 bp, Artificial Sequence
  Description of Artificial Sequence: Synthetic coding sequence
atggcggaaaacgacgtggacaatgaactgctggattacgaagatgacgaagttgaaacagccgcaggcggtgacggtgctgaggccccagctaagaaagatgtgaagggtagttacgtgtccatccattcatcagggttccgtgactttttactgaaacccgaactgcttcgggctattgtggattgcgggtttgagcaccctagcgaagtgcagcacgagtgtatacctcaggcgatactcggcatggacgttctctgccaggcaaaatccggtatgggtaagactgccgtttttgtgctggctacgctgcagcagcttgagccagtgacaggacaggtgtccgtgcttgtgatgtgtcatacacgagagctgtag

SEQ ID NO: 220151 - DNA, 1287 bp, Artificial Sequence
  Description of Artificial Sequence: Synthetic coding sequence
atggcagagaatgacgtcgataacgaactccttgattacgaggacgatgaagtagagacagcggctggtggcgacggcgctgaggcaccagcaaagaaagatgtcaaggggtcgtatgtaagcattcacagtagtgggttccgggactttctactgaaaccagagctcctgagggccattgtcgattgtggcttcgagcaccctagcgaagtgcagcacgagtgcatccctcaggcaatcctgggaatggatgtgctgtgtcaggccaagagcggcatggggaagacggctgtgtttgtgctcgcaaccctgcagcagctggaacctgtgaccggacaggtttctgtcttggtcatgtgccacactagggaacttgcattccagatttctaaagaatatgagcggtttagtaagtacatgcccaatgttaaagtagcagtttttttcgggggattgtccatcaaaaaggatgaagaagttcttaagaagaattgcccccacatcgtggtgggcacacccggaagaatcctcgctttggcaagaaacaagagtctgaacctgaagcacatcaagcattttatcctggacgagtgtgacaagatgctggagcagcttgacatgcgacgggatgtgcaagagattttcaggatgactccacacgaaaagcaggtgatgatgttttccgcaaccctgtctaaagagatacgccctgtctgtcggaaatttatgcaggaccctatggaaatcttcgttgacgacgagactaagctgacactgcatggactccaacagtactacgtcaaactcaaagataacgagaaaaatcgtaagcttttcgatctgctggatgtactggagttcaaccaggtcgtgatttttgtaaagtcagtacaacggtgcattgccttggctcaactgctagtcgagcagaacttcccagcaattgcaatccatagaggcatgccccaggaggagagacttagccggtatcagcaattcaaggactttcagaggcgaatcctcgtcgccaccaacttgtttgggagagggatggacatagaaagggtgaatatcgcgtttaattacgacatgcccgaggactcagacacgtatctccaccgggtcgctagggccggacggtttggcacaaaggggctggctatcacgtttgttagtgatgagaacgacgcaaaaattctcaacgacgtccaagacagattcgaagtgaacatttctgagcttcctgatgagattgacatatcttcgtatatcgagcagacaagatag

SEQ ID NO: 220152 - DNA, 870 bp, Artificial Sequence
  Description of Artificial Sequence: Synthetic coding sequence
atggccgaaaacgacgtggacaacgaactgctggactatgaggacgatgaggtagagaccgccgctgggggtgatggggctgaagctccggcaaaaaaagacgtgaaagggagctacgtgagtattcatagtagcggtttccgggactttcttctcaagccggaactgttgagggctattgtcgattgtggttttgaacatccgagcgaggttcagcacgagtgtatcccccaggccatcctgggaatggacgtgctgtgccaggccaaatctggcatgggtaagacagccgtgtttgttctggcaacactccaacagctagaacccgtgacagggcaggtgagcgtgctggtcatgtgtcatactagggagctggcattccagatctctaaagagtacgagcgcttttcgaaatatatgccaaatgtcaaggtggctgtgtttttcgggggtttgtcgataaaaaaggatgaggaagtgctgaaaaaaaattgcccacacatagttgtggggacaccgggtcgaatcctcgctctcgccagaaataagagcttgaaccttaaacacatcaagcacttcatcttagacgagtgtgataaaatgctcgagcagctggacatgagacgagatgtgcaggaaattttcagaatgacaccccacgagaagcaagtgatgatgtttagtgccaccctgagcaaggagatcaggccggtgtgtcggaaattcatgcaggacccaatggaaatctttgtggatgacgaaacaaaactaacccttcatggacttcaacaatactacgtgaaattaaaggataacgaaaaaaaccggaagttgttcgatttacttgatgtgctcgagtttaaccagtag

SEQ ID NO: 220153 - DNA, 1287 bp, Artificial Sequence
  Description of Artificial Sequence: Synthetic coding sequence
atggccgaaaatgacgtagacaatgaactcctcgactatgaggatgacgaggtcgagacggctgccggaggggatggggctgaagctcccgctaaaaaggacgtgaaggggagttacgtgtctatacactcgagcggcttcagagacttcctgttaaaacccgagctgttacgcgcaatcgtcgattgtgggtttgagcaccccagcgaggtgcagcacgaatgcatccctcaggcgatcctcggcatggacgtgctgtgtcaggccaaatcagggatgggaaagactgcggtttttgtgcttgccacattacagcagttggaacccgttacagggcaagtgtctgtgctggtgatgtgtcatacaagggagctggcatttcagattagcaaggaatatgagcgcttttccaaatacatgccgaacgtcaaggttgcagtattctttggcggactctccatcaaaaaggatgaagaggtgctgaagaagaattgtcctcatatagtcgttggaacgccagggaggattctggccctagcgcgtaataaatctctgaacctgaaacacatcaaacatttcatcctggacgagtgcgacaaaatgctggagcagctggacatgcggagggacgtccaggaaatatttcggatgaccccccatgaaaaacaagtcatgatgttcagcgcaactctcagcaaagagatcaggcccgtctgcagaaaattcatgcaagatcccatggagattttcgtcgacgacgaaacaaagttaacacttcatggcctccagcagtactacgtcaagctcaaagataacgaaaaaaaccggaagctgttcgatttactcgatgtgttagagttcaaccaggttgttatattcgtcaagtccgtgcagagatgtattgccttagcgcagctgctggttgagcagaattttcccgctatcgctatccaccggggtatgcctcaggaggaacggctctctaggtaccaacagtttaaggattttcagcgtcgcatcctcgtggccaccaacttgttcggcagagggatggacatcgagcgagttaatatagcgttcaactatgatatgcctgaggacagcgacacctaccttcatagggttgcgagagcaggccgttttggcaccaagggccttgccatcacttttgtgtctgacgagaacgatgctaagatactcaatgatgtgcaagatcgatttgaggtgaacatttcggagttgcccgatgagatagatattagcagttatatagagcagaccagatag

SEQ ID NO: 220154 - DNA, 291 bp, Artificial Sequence
  Description of Artificial Sequence: Synthetic coding sequence
atggcagaaaatgacgtggacaatgagttgttagattatgaagacgatgaggttgaaacagctgctggaggggatggagcagaggcacctgcaaaaaaggacgtgaaaggtagctacgtttctatccactcctcaggatttcgggactttttgttgaaaccagagctgctgcgggctattgttgattgcggtttcgaacacccctctgaggtccagcacgagtgtatcccccaggcgattctcggcatggatgtcctttgccaggctaaatccgggatgggaaagacgtag

SEQ ID NO: 220155 - DNA, 378 bp, Artificial Sequence
  Description of Artificial Sequence: Synthetic coding sequence
atggccgagaacgacgtcgataacgagctgcttgactacgaagatgacgaggtggagaccgccgctggcggtgacggagctgaggctcctgcaaaaaaggacgtaaaaggctcatacgtatctattcactcctctgggttccgggacttcctgttaaaacccgagcttttacgcgcaatcgtggattgcggttttgagcaccctagcgaggttcaacacgagtgcatacctcaggctatattgggaatggatgtactatgtcaggctaagtccgggatgggtaagaccgctgtattcgtgctggccaccttgcagcagcttgagccggtcaccggccaagtgtcagttctagtcatgtgccatacccgagaactctag

SEQ ID NO: 220156 - DNA, 696 bp, Artificial Sequence
  Description of Artificial Sequence: Synthetic coding sequence
atggcggagaatgacgtcgataacgaactgctggactatgaggacgacgaggtcgagaccgctgccggaggcgatggtgctgaggcacctgctaagaaggacgtgaagggctcctatgtgtctattcacagctcagggttcagagatttcctgcttaaaccagagttgctcagagccatagtcgattgcggcttcgaacatccatcggaggttcagcatgaatgcattcctcaggccatcctcgggatggacgtactgtgtcaagctaagagcgggatgggcaaaacagcagtgtttgtcttggctaccttacagcagctagaacctgtgaccggccaggtctccgtgctggtgatgtgccacacccgcgagctcgcctttcaaatcagcaaggagtacgagcgatttagcaaatacatgccaaacgtcaaggtggctgtgttcttcggtggcttaagcatcaagaaggatgaggaggtgctgaaaaagaattgtccacacatcgttgtgggcacacccggacggattctggctctagcacgaaacaagagtctcaatttgaagcatatcaaacactttattttggatgagtgcgataagatgctggagcagcttgatatgcgcagggatgtacaggagatctttagaatgacccctcatgaaaaacaagtcatgatgtttagcgcgacattgtag

SEQ ID NO: 220157 - DNA, 399 bp, Artificial Sequence
  Description of Artificial Sequence: Synthetic coding sequence
atggccgagaatgatgtcgacaatgagctcctagactacgaggatgacgaggtggaaaccgccgctggaggtgatggcgcagaggcaccggcaaagaaggatgtgaaagggtcctatgtctctatccatagctcaggcttccgggattttttactgaagcccgagctgctcagagctattgtagactgcggtttcgaacatccttcggaagtgcaacacgaatgtatccctcaggccattctaggaatggatgtcctctgccaggcaaaatctgggatgggtaagacggcagtgtttgtcctggcaaccctccagcagctcgagccggttacaggacaggtgtgcttttgcgatagccacttcccaagaggggataatgaagagttacacctaccctag

SEQ ID NO: 220158 - DNA, 1053 bp, Artificial Sequence
  Description of Artificial Sequence: Synthetic coding sequence
atgtggaccatgtcatcctggacaatgaaaatgatgcgatggcggcagcagctaggcgaaatgggattacgccctcttccacgtcgcatgtcacgcgcaccaatgagtccatctacagcgctcgcctttgtgacttcgtgctcctctcagagttgtagcggcccactgagtacagtggccctctctattcggcagaaagtggctgtctttttcgggggactgtctatcaagaaggacgaggaagtgctcaagaagaactgcccgcatatcgtggtcgggacccccggtcggatcttggccctggctcggaataagagtctgaatctcaagcacatcaagcactttattttagatgaatgtgataagatgttggaacagttagacatgaggcgagatgtgcaagagatctttaggatgacaccacacgaaaagcaagtgatgatgtttagcgctactttgagcaaggaaatcaggcccgtatgccgcaagttcatgcaggatccaatggagattttcgttgatgatgagaccaagctgactctgcatggcctgcagcagtactacgtgaagttgaaggacaacgagaaaaatagaaaacttttcgatctgctcgatgtattagagttcaatcaagtggtaatctttgtgaagtcagtccagcgctgtatcgctctggcgcagcttttggtcgaacagaacttcccagccatcgccatccatcgaggcatgccccaagaggaaagactctcgaggtaccagcagtttaaggactttcagaggagaatcctcgtggccacaaacctgtttggcagagggatggacatcgagagggtaaacatagcttttaattacgatatgccagaggactccgatacatatctgcatagggtggcaagggccggaaggtttgggacgaaaggcttggccataacttttgtctccgacgaaaatgatgccaagatcctgaatgatgtccaggacaggtttgaggtgaatatctctgaattaccagacgagatcgatatatcatcttacattgaacagacacgatag

SEQ ID NO: 220159 - DNA, 738 bp, Artificial Sequence
  Description of Artificial Sequence: Synthetic coding sequence
atgtggactatgagctcctggaccatgaagatgatgcggtggaggcagcaattgggtgagatggggctccgccctctacctagacgcatgagtagagccccaatgtcaccatcaaccgctctggcctttgttacttcatgcagctcacagtcatgctccgggcctttaagcactgtcgcactatcaattcgacagaaagtcgccgtatttttcggaggactcagcatcaaaaaagatgaagaggtgctgaaaaaaaactgcccacacatcgttgtggggacccctggaaggatcctggccctcgcgcgtaataagagccttaaccttaagcacattaaacacttcatactggacgagtgcgataagatgctggagcagctcgatatgcggagagatgtccaggagatcttccgaatgactccgcatgaaaaacaagtgatgatgttctctgctaccctgagcaaggaaattaggcccgtctgcaggaagtttatgcaggaccccatggaaatcttcgtggacgacgagactaagttgaccctccacggattgcaacagtattatgtgaagctcaaggacaacgaaaagaatcgaaaactgttcgatttattggacgtactcgaattcaaccaggttgtgatctttgtgaagtctgtgcagagatgcatcgccttggcacagctcctagtggagcagaatttcccggcaattgctattcacagaggtatgccacagtag

SEQ ID NO: 220160 - DNA, 411 bp, Artificial Sequence
  Description of Artificial Sequence: Synthetic coding sequence
atgggcggtggcaggcgaccctacgatgtcttcttctccaaagtgatggctgagaatgacgtggacaacgagcttctggattacgaggacgacgaggttgagaccgcggctggcggagacggagccgaagccccagccaagaaggatgttaaaggctcctacgtcagtatccacagtagcggctttagagacttcctcttaaagcccgagctgctccgtgcaatcgtcgactgtggcttcgagcacccatcagaagtccagcacgaatgcatcccccaggctattctgggtatggacgtattgtgtcaagccaagagcgggatgggaaagactgcagtgtttgtacttgcgaccctgcagcagttggagcctgttaccgggcaagtgtctgttctggtgatgtgccattag

SEQ ID NO: 220161 - DNA, 1287 bp, Artificial Sequence
  Description of Artificial Sequence: Synthetic coding sequence
atggccgaaaatgatgtcgataacgagctactcgactacgaagacgatgaggtggaaacagcggctggtggagacggggcagaagcgccagcgaagaaagacgtgaagggttcttacgtgtccatacattctagcgggtttagagactttcttttaaaacccgagctgctgcgagctattgtggactgtggctttgaacacccctccgaagtgcaacacgagtgcatccctcaagcaatattggggatggacgtgctatgtcaagctaaatccggtatggggaaaacggctgtgttcgttctcgctacgcttcagcagctcgagcctgtgactggacaagtgtcagtgctcgtgatgtgtcacacccgagaactggccttccaaatttccaaagagtatgaacggttctctaagtacatgccaaatgtaaaagtggccgtttttttcggtgggctgagcataaaaaaggacgaggaagtgttaaaaaagaactgtcctcatattgtcgtggggactcccggtaggatcctggccctagcgagaaacaagagcctgaacctcaagcacattaagcactttattcttgacgagtgtgacaagatgcttgaacagctggacatgaggagagacgttcaggagatttttcggatgacgccccacgaaaagcaagtgatgatgtttagcgccactctaagcaaggagatcaggccagtatgcagaaaatttatgcaggatcctatggagatttttgtggacgacgaaactaaactcacgcttcacggcttgcagcagtattatgtaaaactgaaggataacgagaaaaacagaaagctcttcgacctgctagacgtgctcgaatttaatcaagtagtcatatttgttaagtcagtgcagaggtgtatcgctctggcccagctactcgtagaacagaacttcccggctatcgccattcaccggggtatgcctcaggaggaacgccttagtcgctatcagcaattcaaggacttccaacgcaggattctcgtggccaccaacctgttcgggaggggcatggatatcgagcgggttaatatagccttcaattacgatatgccagaagattccgatacgtacctccacagagtggcgagggcagggagattcggcacaaagggcttggcaattaccttcgtcagcgatgagaacgatgccaagatactgaacgatgtgcaggataggtttgaggtgaacattagcgagctccccgacgaaatcgacatttcatcctatattgagcaaacccgatag

SEQ ID NO: 220162 - DNA, 594 bp, Artificial Sequence
  Description of Artificial Sequence: Synthetic coding sequence
atggctgagaacgacgtcgataacgaactgctggactacgaggacgatgaagtggaaacggccgcaggaggggacggggcagaggcgcctgctaagaaagacgtgaagggtagctacgtcagtattcactccagtggctttcgagatttcctgcttaaaccagagctgttaagagcaattgtggactgcggattcgagcatccatcggaagttcagcatgagtgtatcccacaagccattttaggaatggatgttctttgtcaagccaaatctggcatgggtaagacagctgtattcgtactcgcaaccctgcagcagctggagcccgtgacaggtcaggtctgcttctgtgacagtcactttcccagaggtgataacgaggagctgcatctgccctacgtcagcgtatactttctccctaaggtgtccgttcttgtaatgtgtcacacacgggaacttgccttccagatttcaaaggaatacgagcggttctctaaatatatgcccaatgttaaggtggctgtttttttcggcggattaagcataaagaaggacgaggaagtgcttaagaaaaattgcccccacattgtgtag

SEQ ID NO: 220163 - DNA, 570 bp, Artificial Sequence
  Description of Artificial Sequence: Synthetic coding sequence
taggctaccttacagcagctcgagcccgtgacgggtcaggtcagcgtcctggtcatgtgtcacacaagggagcttgcctttcaaatctctaaggaatacgagcggttctcaaaatacatgcctaatgtgaaagtagccgtgttttttggcggattgagtatcaaaaaggatgaggaagtgctgaagaagaattgtccccacatcgttgtgggcactcctggccgaattctggctctggccaggaacaaaagtctgaacctgaagcatataaaacatttcattctggatgagtgcgacaaaatgcttgagcagctggacatgcgaagggatgtgcaagaaattttccggatgacgcctcacgagaagcaggttatgatgtttagtgccacactctccaaagagatccgtccagtctgccgcaaattcatgcaggaccccatggaaatcttcgttgatgatgagaccaagctcaccctccatggtctgcagcagtattatgttaagctcaaggacaatgaaaagaatagaaaactcttcgacttgctcgacgtgctggagtttaaccagtag

SEQ ID NO: 220164 - DNA, 1287 bp, Artificial Sequence
  Description of Artificial Sequence: Synthetic coding sequence
atggccgaaaatgacgtggacaatgaactgctggactacgaggacgacgaagtggagactgccgctgggggtgatggcgctgaggctcctgcaaaaaaggacgtcaagggcagctacgtgagtatccattcctccggattccgggacttccttctcaagcccgagctgctgcgggctattgtggattgcggcttcgagcacccatccgaggtgcagcacgaatgtatcccacaggccattctagggatggatgtgctgtgtcaagcaaaatctggaatgggaaagacagccgtattcgttctcgcgaccctgcaacaactggagccagttacggggcaggtctcagtgctcgtgatgtgtcataccagagagctggcctttcagatatccaaagagtacgagcgcttcagcaagtacatgcccaatgtgaaggtggctgtgttcttcggtggcctgtctatcaaaaaggacgaagaagtactaaagaaaaattgcccacacatagtggttgggactcctggcagaatcctagccttagccagaaacaagtccctgaatcttaaacacattaaacacttcattctggacgagtgcgataagatgctcgagcagctagatatgcgcagagatgtgcaggagatctttcgcatgactccacatgagaaacaggtgatgatgttttcggcaaccctgtcaaaggaaatcaggcccgtttgtcggaagttcatgcaagacccaatggaaatcttcgtggacgacgagacaaagttaactctacacggcctacagcagtactacgtaaagctaaaggacaatgagaaaaatagaaaactcttcgacctgttggatgtgttagaattcaatcaggtcgtgatctttgtgaagagcgtgcagagatgcatcgcattagcccaattgttggtggaacaaaacttccctgccatcgcgatccatagaggcatgccacaggaagagaggttgtctagataccaacagttcaaagactttcaacggagaatcctagttgccactaacctcttcggtcggggtatggacatcgaacgggtgaacattgcattcaattacgacatgccggaagattccgacacctacctgcacagagtggctagagccggtcgtttcgggactaagggactagctatcaccttcgtttccgacgaaaacgacgccaaaatcctgaatgatgtgcaggacaggttcgaagtgaatatcagcgagctgccagatgagatcgacatctcaagctatattgaacagacccgctag

SEQ ID NO: 220165 - DNA, 711 bp, Artificial Sequence
  Description of Artificial Sequence: Synthetic coding sequence
atggctgaaaatgacgttgacaatgaactcttggactatgaggacgatgaagttgagacagcagctggtggtgatggagcagaggcccctgcaaaaaaggacgtcaaaggcagttacgtttccatccactcgtcgggctttagagattttctcctcaaacctgaacttctgcgtgctatcgtggactgtggattcgaacacccttcagaggttcaacacgaatgtattccacaagcgatcctcggcatggatgttttatgccaggccaagtcgggaatgggcaaaacggccgtgttcgtcctcgccacacttcagcagctggagccggtaaccgggcaagttagtgtgttggtcatgtgccacacacgcgagctggcattccagattagtaaagaatacgaacggtttagcaaatatatgccgaacgtgaaggtggccgttttctttggcggattgagtatcaagaaagacgaggaagtgctcaaaaagaactgtccacatatagtcgtggggactcctggaagaatcttagccctcgccagaaataaatcgctcaacttaaagcacattaagcactttattttggatgaatgcgataagatgctcgagcagctggacatgcgcagagacgttcaggaaatattccggatgactccacatgaaaagcaagtcatgatgttcagcgccacattatcgaaagagatccggtag

SEQ ID NO: 220166 - DNA, 564 bp, Artificial Sequence
  Description of Artificial Sequence: Synthetic coding sequence
atgggttcctcacatatcggtggactatcaatcaatgagaggcgacggagtgcctctcttggtctggtaatggccgagaatgacgtcgataatgaactgctggattatgaggacgatgaagtagagacggccgcaggaggagatggagcggaagcgcctgctaaaaaggacgtcaaaggatcctatgtttccatccattcctctggcttccgtgacttcctcttaaagccggagctgttgagagctattgtggactgcggattcgaacacccgagtgaggtgcaacacgagtgcataccccaagccatcctcgggatggatgtgctctgccaagcgaagagcggcatggggaagaccgccgtgtttgtcttggccacgttacagcagctggagcccgtgaccggacaggtgagcgtactggttatgtgccatacaagagagttggctttccaaatcagtaaagagtatgaacggttcagcaaatacatgcccaatgtgaaggttgcagtcttctttgggggactgtccatcaagaaagacgaggaggtgctgaagaaaaattag

SEQ ID NO: 220167 - DNA, 399 bp, Artificial Sequence
  Description of Artificial Sequence: Synthetic coding sequence
atggcggagaatgacgtggacaacgaattgctcgactatgaggacgacgaggtggaaacggctgctggcggagacggagccgaggccccagccaagaaggacgtgaaagggtcatatgtgagcatacactcttcaggctttagagacttcctactgaagcccgagctgctacgtgccatagttgattgcggcttcgagcacccgagcgaggtgcaacacgagtgcatccctcaagccatcctcggaatggatgtgttgtgccaggctaagagtgggatgggcaagacagccgttttcgtgttggccacacttcagcaactggaaccagtgactggccaagtgtgcttttgcgacagtcactttcctcgcggagacaacgaggagctccatctgccatag

SEQ ID NO: 220168 - DNA, 1332 bp, Artificial Sequence
  Description of Artificial Sequence: Synthetic coding sequence
atggcggaaaacgacgtagacaacgagttgctggattacgaggacgatgaagtggagactgccgctggcggtgacggtgccgaggcccctgcgaagaaggatgtgaaagggtcttacgtctcaatccacagcagtggatttcgagactttctgctgaagccagagctgcttagggccattgttgactgcggcttcgagcacccttctgaagttcagcacgagtgcataccgcaggcaatcttagggatggacgtcctgtgtcaggcaaaatcaggaatgggcaagacggctgtctttgtcctggccaccctccaacagttggagcctgtaacagggcaggtgtacctcggtcgagtccttgggcgtggattctggtgcgtgtttgtgagcgtgttggtgatgtgtcatacgagagaactggcgttccagatctcaaaagagtatgagcggttctctaaatatatgccaaacgtgaaggtggcagtttttttcggcggattgagcatcaagaaagacgaggaggtgttgaaaaaaaattgccctcacattgtggtcggaacacctgggagaatcctggccctagccagaaataaaagcctcaatctcaagcacataaagcacttcattctggatgaatgcgataaaatgctggaacagctcgacatgaggagggatgtccaggaaatcttccgcatgactccccacgagaagcaggttatgatgttcagcgcaactctcagcaaggagatccgacccgtgtgccggaagtttatgcaagatcctatggagatattcgtggacgacgaaacaaagctgactctgcatgggctgcaacagtactatgtcaagctgaaagataacgaaaagaaccgcaaactgtttgatctcctggacgtgttagagtttaaccaggtcgttatttttgttaaaagcgtgcagaggtgcatcgccctcgcccagctcctagtggagcaaaactttcccgctatcgctatccatcggggaatgccccaggaggaacgcctttctcgctaccagcagtttaaggactttcagagaagaattctcgtggccactaatttattcggacggggtatggacattgaacgggtgaacattgccttcaactacgatatgccggaagatagtgacacctatctacaccgcgtcgcaagagcagggaggtttgggactaaggggctagcaataacttttgtttccgatgaaaatgacgccaaaatcctgaatgacgtgcaggataggtttgaggtgaacataagtgaacttcccgatgagattgacatctcaagctatatcgagcagactcgctag

SEQ ID NO: 220169 - DNA, 870 bp, Artificial Sequence
  Description of Artificial Sequence: Synthetic coding sequence
atggccgagaatgatgttgacaacgagctgttagattacgaggacgacgaggttgagaccgctgccggaggcgatggggcagaggcaccggctaagaaggatgtcaaaggatcttatgtgtccatccacagctcgggtttcagggatttcctgctgaagccagagctactccgggctatagtggattgcgggtttgagcacccatcggaagtacagcacgagtgcatacctcaggcaattctgggaatggatgtgctttgccaggccaaatccgggatggggaagaccgcagtttttgttcttgccactctccagcagttggagccagtgaccgggcaggtctcagtgctggtgatgtgtcatacccgtgagctcgcttttcagatatccaaggaatacgaaagatttagcaagtacatgccaaatgtcaaagtcgcagtcttttttggaggcttgtccattaagaaggatgaagaagtgttaaagaaaaattgcccacatatcgtggtgggaacgcctgggcgaatcctagcgctcgcccgtaataagtctctgaatctgaagcatataaagcacttcattctggatgaatgcgacaaaatgctggaacaattagatatgaggcgtgacgttcaggagattttcaggatgaccccccatgaaaaacaggtgatgatgttctccgcgacactatcaaaagaaatacgccctgtgtgtaggaagtttatgcaagatcccatggagatcttcgtcgatgacgaaaccaaactcactctgcacgggctgcagcagtactacgtgaaactcaaggacaacgagaagaatagaaagctctttgacctgttggatgtgcttgagttcaaccagtag

SEQ ID NO: 220170 - DNA, 564 bp, Artificial Sequence
  Description of Artificial Sequence: Synthetic coding sequence
taatcagaagagagggatatcggcaagcccatggaaatatttgtggatgacgaaaccaagttaacgcttcacggtctgcaacagtactatgtgaaactgaaggataacgagaaaaatcgcaaactgttcgacctgctggacgtcttggaatttaaccaggtcgtcattttcgtgaagtccgtgcagagatgcattgcactggctcagcttctggtggaacagaacttcccggctattgctattcaccggggaatgcctcaggaggagcgcctgtcacggtaccagcaatttaaagactttcagcgcaggatattggtggcgacaaatctcttcgggaggggtatggacatagagcgagtcaatattgccttcaactacgacatgccagaagattccgatacttacttgcatagggtggcacgcgcaggaaggttcggaacaaagggtttagccattacatttgtttctgatgaaaacgacgccaagatcttgaacgacgtgcaagacaggtttgaggtaaacatcagcgagctacctgacgaaatcgatatatctagctattag

SEQ ID NO: 220171 - DNA, 411 bp, Artificial Sequence
  Description of Artificial Sequence: Synthetic coding sequence
atgggaggtggtaggcggccttacgatgtgttcttctctaaggtgatggcagaaaacgatgtggataacgaactactcgactacgaggacgatgaagttgagacagccgcagggggagatggagcagaagcgcctgctaagaaagatgtcaaaggaagctacgttagcatccatagcagtggctttcgagatttcttgctgaaacccgagctcctgcgggctattgtcgattgcggtttcgaacacccttctgaggtgcagcacgaatgtattccacaggctattctcgggatggacgttttgtgtcaggccaaatccgggatgggaaaaacggctgtctttgtgttggcgaccttgcagcagctggagcctgtgacaggtcaggtctcagtcctggttatgtgtcactag

SEQ ID NO: 220172 - DNA, 411 bp, Artificial Sequence
  Description of Artificial Sequence: Synthetic coding sequence
atgggcggtggaaggaggccgtatgatgtttttttttcaaaagtgatggccgagaacgacgttgataatgaactactggattatgaggatgatgaagtggagacagcagctggaggcgatggagccgaggccccagctaagaaagacgtgaagggctcatatgtgtcaatacactcttcaggctttcgagatttcctgctgaagcctgagctgttacgcgcaattgttgactgtgggttcgagcatccttctgaggtccagcacgagtgcatccctcaggctatcctgggcatggacgtgctgtgtcaggctaagtcgggcatggggaaaacagccgtgtttgtgctggccaccctccagcagctcgagcccgtcacaggccaggttagcgtgctcgtgatgtgccactag

SEQ ID NO: 220173 - DNA, 399 bp, Artificial Sequence
  Description of Artificial Sequence: Synthetic coding sequence
atggctgagaatgacgtcgataacgaactgttagactacgaggacgatgaggtggaaaccgccgcaggcggtgacggcgctgaggccccagcgaagaaagatgtgaagggttcttacgtgagtatccacagctcaggattcagagacttcctgctgaaaccagagctgctgagagcaatcgtggactgtggattcgagcacccttccgaggtgcaacacgagtgtattccccaggctatacttggaatggacgtactctgccaagcaaaaagcgggatgggtaaaaccgcggtcttcgtgctggcaactctacagcagctcgagccagttactgggcaggtttgcttctgtgactcccatttccctcggggagacaacgaggaattgcacctgccctag

SEQ ID NO: 220174 - DNA, 711 bp, Artificial Sequence
  Description of Artificial Sequence: Synthetic coding sequence
atggctgagaacgacgttgataatgaactcctggactacgaggacgacgaggtggaaacagcagccggtggcgatggcgcagaagcacccgcaaaaaaagacgtcaagggaagttacgtctccatccactcctcaggctttcgcgacttccttctcaagccggaacttctccgagctattgtcgattgcggcttcgagcacccttcagaggtacagcacgaatgcattccacaagccatcctgggaatggacgtcctgtgccaggccaaatccggaatggggaaaaccgccgtttttgttctagccaccttacagcaactggagccagtcacagggcaggtttctgtactggttatgtgccacacacgagaacttgctttccagatctcaaaggagtacgagagatttagcaagtatatgcctaatgtgaaagtggccgtcttcttcggaggcctttcaattaaaaaggatgaggaggtcctaaagaaaaattgtccccacattgtcgtggggacacccggtagaatcctcgctttagcgcgtaataagagtctcaacctgaagcacatcaagcactttattttagatgaatgcgataagatgctggagcagctggatatgcgtagagacgtccaagagatctttagaatgacaccacacgaaaagcaagttatgatgttttctgctactctgtccaaggagatccggtag

SEQ ID NO: 220175 - DNA, 378 bp, Artificial Sequence
  Description of Artificial Sequence: Synthetic coding sequence
atggctgaaaacgatgtagataacgaactgcttgactatgaggacgacgaggtcgagaccgcagcgggtggcgacggtgccgaagcgccagcaaagaaggatgtcaaggggtcctatgtttccattcatagctctggttttcgcgattttctgctgaagccagagctcttaagggctattgtggactgtggcttcgagcatccctccgaagttcaacatgagtgcatccctcaggccattctgggaatggatgtgctttgccaggcaaaatccggcatggggaagactgccgtcttcgttctcgccactctgcaacaacttgaacctgtcactggacaggtttctgtgctggttatgtgccacacccgggaattatag

SEQ ID NO: 220176 - DNA, 987 bp, Artificial Sequence
  Description of Artificial Sequence: Synthetic coding sequence
taagcgactttacagcagctagagccagtcacaggacaggtctcagtgctggtcatgtgccacactcgcgagctcgccttccagatatccaaagagtatgagcgcttcagtaaatatatgccaaacgttaaggtggccgtgttttttggcggtctctctatcaagaaggatgaagaggtcctcaaaaagaattgtccccacattgtagtggggacacctggacggattctggcactggcccgaaataagagcttgaacctcaaacatattaaacacttcatcttggatgagtgcgataaaatgttggaacagctcgacatgaggcgggatgtccaggagatctttcggatgacaccacacgagaaacaggtgatgatgttctccgctaccctctccaaagagatccggccagtgtgccgcaagtttatgcaggaccccatggagatctttgtggatgacgagacaaaactgacactccacggcctgcagcaatattatgttaaactgaaggacaatgaaaagaataggaagctgtttgacctgcttgacgtcctggagttcaaccaggtggtcatcttcgtgaaatcagtgcagcgctgcattgccctggcacagctgcttgtggagcagaacttccctgcgatcgcaatccatcggggaatgccgcaagaagagcgtctgtcacgctaccagcagttcaaagacttccagcggaggattttggtcgccactaacctgtttggaagaggcatggacattgagagggtgaatattgcattcaactacgacatgcccgaggatagcgatacatatctgcatcgggtagccagagccggacggttcggaaccaaaggattggctatcacattcgtgtcagacgaaaatgacgcaaagatcttaaacgacgtgcaggacaggtttgaggtaaatatcagtgaactcccagacgagatagacatcagtagttacatcgagcaaactcggtag

SEQ ID NO: 220177 - DNA, 711 bp, Artificial Sequence
  Description of Artificial Sequence: Synthetic coding sequence
atggccgaaaacgacgtagacaacgagctgcttgattacgaggatgacgaggtggagacggcggcaggcggagacggggcagaggcaccagcgaagaaggatgtgaaggggtcttacgtgtcaattcactcaagcgggtttcgggactttctactgaaaccagagttactgcgtgccatcgtggactgcggtttcgaacatccttccgaggtgcaacacgagtgtatcccacaggcaattctagggatggatgttctctgtcaggccaagtctggaatggggaagactgccgttttcgtcctggccacccttcagcagctggaaccagtgaccgggcaggtgagcgttctggttatgtgtcatacgcgtgagctggcattccagattagtaaggaatatgaaaggttctccaaatacatgccgaatgtaaaggtggctgtgttttttggcggtttgtctattaagaaagatgaagaagttctcaagaagaattgcccccatatcgtggtcggaaccccaggacgtatcttggccctcgctagaaacaagtcactgaatcttaaacatataaaacattttatactcgatgagtgtgataaaatgttggagcagctggatatgcgccgagacgtgcaagaaatttttagaatgactccccatgagaagcaggtgatgatgttttctgctaccctgtccaaagagatccgctag

SEQ ID NO: 220178 - DNA, 564 bp, Artificial Sequence
  Description of Artificial Sequence: Synthetic coding sequence
taaagcgaagagcgcgatatagggaagcccatggagatttttgtcgatgatgagactaagctgacgctgcacggactccagcagtactatgttaaactgaaggacaacgagaaaaacaggaaactcttcgatttgctagatgtactggaatttaaccaagtcgtcattttcgtcaagtctgtgcagagatgcattgctctggctcagctcctcgtggagcagaactttcccgcaatcgctattcacagggggatgcctcaggaggagcggctgagccggtatcagcagtttaaagactttcagcgaagaatactggtggcaaccaacctcttcggcagaggcatggacattgaaagagtcaacattgcgttcaactacgacatgcctgaagattcagatacatatcttcacagggtggcccgagcaggcagattcggcacaaagggactcgcaattacttttgtgagcgacgagaatgatgccaagattctcaatgacgtgcaggataggtttgaagtgaacatatctgaactacctgatgagattgatatcagtagttactag

SEQ ID NO: 220179 - DNA, 378 bp, Artificial Sequence
  Description of Artificial Sequence: Synthetic coding sequence
atggccgagaacgatgtggataatgaactgctggactatgaagatgacgaggtggagactgcagcgggaggtgatggggctgaggctccagcaaagaaagacgttaaggggtcatacgtgtctatccattctagtggtttcagggattttctcctgaagcccgagctgctcagagccatcgtggactgcggctttgaacatccaagcgaggtgcaacatgagtgtataccacaggccattttggggatggatgtcttgtgtcaggcgaagagtggaatgggcaagactgccgtttttgtgcttgctacgttgcaacagttagaacctgtgactggacaggtatctgtgctcgtcatgtgccataccagagaactgtag

SEQ ID NO: 220180 - DNA, 291 bp, Artificial Sequence
  Description of Artificial Sequence: Synthetic coding sequence
atggccgagaatgacgtggacaatgagctcctggattatgaggatgacgaggtcgagaccgcagcaggtggagatggagccgaagccccagcaaaaaaagacgtgaagggctcgtacgtttcaatccattcttccggatttagagatttcctccttaagccagagctcttacgtgctatagttgattgcgggttcgaacacccatcagaggtgcagcatgagtgtatccctcaggccatattgggcatggacgtgctgtgtcaggctaaatctgggatggggaaaacatag

SEQ ID NO: 220181 - DNA, 378 bp, Artificial Sequence
  Description of Artificial Sequence: Synthetic coding sequence
atggcagaaaacgacgtcgataacgaactgcttgactatgaggatgacgaggtagaaacagcagctggtggcgatggcgcagaggccccagcaaagaaggatgtgaaaggcagctacgtctctatccattcctccggattccgggattttttgctgaaaccagaattgctccgggcaatagttgattgtggcttcgagcatccgagcgaggtgcagcatgagtgcattcctcaggccatcttagggatggacgttttatgccaggccaagagcgggatgggcaagactgcagtatttgtcctcgcaaccttacagcagctggagccagtgaccgggcaggtttcagtcctcgtaatgtgccatacacgagaactgtag

SEQ ID NO: 220182 - DNA, 987 bp, Artificial Sequence
  Description of Artificial Sequence: Synthetic coding sequence
tgagcaacactgcagcagctggaaccagtaacaggacaagtgtcagtgctagtgatgtgccacacgagggagctggcatttcagatttctaaggagtacgaacgcttctctaagtacatgcccaacgttaaagtggccgttttttttggaggtctctctattaaaaaggatgaagaagtgctcaagaaaaactgtccacacatagtcgtcggaaccccaggacgaatattggccctcgcgcgaaacaagagcctgaacctaaagcacatcaagcatttcatcctcgatgaatgcgacaagatgctagagcagctggatatgcgtcgggacgtccaggagatctttcggatgaccccacacgaaaagcaggtaatgatgttctccgccaccctgagcaaggaaattcgtcctgtatgtagaaagttcatgcaggatcctatggaaatcttcgtggatgacgagacaaagcttacactgcatgggctgcaacagtactacgtcaagctaaaagacaacgagaaaaacaggaaactctttgacctccttgatgttttagaatttaaccaagtggtcatattcgtgaaatcagtccagaggtgtatcgccctggctcagctgctggtcgaacagaattttcccgctatcgcaattcacagaggtatgcctcaggaggaaagactctcgagataccagcagttcaaagactttcagcgtcggatactggtagctacaaacctgtttgggagagggatggacatcgagcgggtgaatatagctttcaactatgatatgcccgaggacagcgatacttacctgcatagggtcgctcgggctggcagattcgggacaaaaggcttagctataacctttgtgtccgacgaaaatgacgccaagatcctgaatgacgtccaggacagatttgaggtcaatatctctgaactgccagatgaaatcgacatctctagctacatagaacagactagatag

SEQ ID NO: 220183 - DNA, 870 bp, Artificial Sequence
  Description of Artificial Sequence: Synthetic coding sequence
atggcagaaaacgacgttgataacgagctgctcgattatgaagatgacgaagtggagacggccgcaggcggtgacggggcagaagcacctgccaaaaaagatgtcaagggttcatacgtgagcatccatagtagtggattcagagatttcctgctcaaaccggaacttctcagggctatagtggactgcgggttcgaacatccgtccgaagtgcagcacgagtgcatccctcaggctattctggggatggacgttctctgtcaggcaaaatcaggaatgggtaaaacggcagttttcgtgctggctactctgcagcagttagagccggtgacaggacaggtctctgtcttggtaatgtgccacacacgggagttggcttttcagatttccaaagaatacgagcggttctctaagtacatgcctaatgtaaaagtggcagtcttctttgggggtttgtctattaaaaaagatgaggaagttctgaagaagaattgccctcacatagtcgtcggcacacctgggcgaattctcgccctcgcccgtaataagtcactcaacctcaagcacattaagcacttcattttggacgaatgtgacaagatgcttgagcaactagatatgagaagagacgtgcaggagatatttcgcatgaccccacacgagaaacaggtcatgatgttttctgccaccctgagcaaggagatccggcctgtgtgcaggaagtttatgcaagacccaatggagatatttgtggacgacgagacaaagctcacactgcacggcctgcaacaatattatgtcaagttgaaagataacgagaagaatcgtaaactgtttgacctgttagacgttctagagtttaatcagtag

SEQ ID NO: 220184 - DNA, 738 bp, Artificial Sequence
  Description of Artificial Sequence: Synthetic coding sequence
atgtggaccatgtccagttggacaatgaagatgatgagatggcgccagcagctgggggagatgggacttaggccacttcctaggaggatgtccagagcccctatgtccccgagtacagctcttgctttcgtgacgtcctgttcatctcaatcctgctcaggtccactctctacagtggcgctgagcatacggcagaaggtggcggtgttctttggtgggctctctattaagaaagacgaggaagtcctgaaaaagaactgcccacacatcgtggtcggcacgcccggacggattttggccctcgcgaggaacaagagcctgaatcttaagcacatcaagcattttatcttagatgagtgtgataaaatgctagaacagttggacatgcggagagacgtccaagagatctttagaatgaccccccatgaaaagcaggtgatgatgtttagtgctactctgtctaaagagatccgaccagtctgccgaaagtttatgcaggaccctatggagatttttgtggatgacgagactaagctgaccctgcatggtctgcagcaatactatgtcaaactcaaggataacgagaaaaataggaaattattcgacctgctggatgtgctcgagtttaaccaggtagttattttcgtcaaaagcgttcagcgctgtattgcccttgcccaattgctggtggagcagaacttccccgcaatcgcaatacataggggtatgcctcagtag

SEQ ID NO: 220185 - DNA, 738 bp, Artificial Sequence
  Description of Artificial Sequence: Synthetic coding sequence
atgtggactatgtctagctggacgatgaagatgatgaggtggaggcagcagctgggggaaatgggtcttcgcccattgccccgaaggatgtctcgcgctccaatgtctccctctaccgctctggcatttgttacatcttgtagctcccagtcttgttcaggaccgctctctactgtggctctgagtattagacagaaggtggccgtcttctttggcggtttgagcattaaaaaggatgaagaagtgctgaagaagaattgtcctcacattgtcgtgggaactcctggccgaatcctcgctctggcacgtaataaatccctgaatctcaaacacattaagcacttcatcctagatgagtgcgataagatgctggagcaattagacatgcgaagggacgtacaagagatctttaggatgacgccgcacgaaaaacaagtcatgatgttctcggccaccctgtcaaaggagattcggccagtgtgtcgcaagttcatgcaggaccccatggagatcttcgttgatgatgagactaaactgacactgcacgggttacagcaatactacgtgaagctgaaggataatgagaaaaacaggaaactttttgatctactagatgtactggagtttaaccaggttgtgatttttgtgaaaagcgtgcagcgatgtatcgctttggcccagctgcttgtcgagcagaacttccccgctattgccatacacagggggatgccccagtag

SEQ ID NO: 220186 - DNA, 396 bp, Artificial Sequence
  Description of Artificial Sequence: Synthetic coding sequence
taggctacactgcagcagcttgaacctgtgacaggacaagtctccgtcctggtgatgtgccatacccgggagctagcgttccaaatcagtaaagagtatgaacggttcagtaaatacatgcccaacgttaaagtggcagtgttcttcggtggcctatccatcaaaaaggatgaagaagtactgaaaaaaaattgcccacacatcgtcgtgggcaccccaggcagaattctcgcccttgctcgcaataaatccttgaacctgaaacacattaagcatttcatcctggacgagtgcgacaaaatgctggaacagctggacatgcggagggatgtgcaggagattttccgaatgacaccccatgaaaaacaggtaatgatgttttctgctacactctag

SEQ ID NO: 220187 - DNA, 411 bp, Artificial Sequence
  Description of Artificial Sequence: Synthetic coding sequence
tgagcaacacttcagcagctcgagcccgtaaccggacaggtatctgtgttggtgatgtgtcacacgcgggaactggctttccagatctcaaaagagtatgagcgcttcagcaagtacatgccaaatgtcaaagtggcagttttttttgggggactctctataaagaaagacgaggaggttctcaaaaagaactgcccacacatagtggtggggacaccaggccgtattcttgccctggcccgaaacaagtcactgaacctgaagcacatcaaacatttcattttggatgagtgtgataaaatgttggaacaactcgacatgcgtcgtgacgtgcaggaaattttcagaatgactccccacgagaagcaagtgatgatgttttctgcgaccttatctaaggaaattagatag

SEQ ID NO: 220188 - DNA, 717 bp, Artificial Sequence
  Description of Artificial Sequence: Synthetic coding sequence
atggcagagaatgacgtagacaatgaactgcttgattacgaggatgacgaggtggagaccgctgcaggtggcgatggtgccgaagccccagcaaaaaaagatgtgaaaggttcttacgtttcaatccactcctcgggatttcgagatttcctgttaaagcctgagttgctgagagcaatcgtagactgtgggtttgagcacccgtccgaagtccagcatgagtgcattcctcaggccatcttggggatggacgtgttatgtcaggccaaaagtggcatgggaaagactgctgtgtttgtgttagctaccctgcagcagctggaacctgtgacaggccaggtgtcggtgcttgtcatgtgccatacacgggaactggcttttcaaataagcaaggaatatgagcggttcagcaagtacatgcccaatgtcaaggtagctgtgttcttcggcggattaagcattaagaaagacgaggaggtgctcaaaaaaaactgccctcacatcgttgtgggtacccccggtagaatcttagcacttgccaggaacaaatctctaaatcttaagcatataaagcacttcatcctagacgaatgcgataagatgctggagcagctcgatatgcgtcgggacgtccaggaaatctttcggatgacgccccatgaaaagcaggtcatgatgttttcagctacgctttctaaggaaataaggcctgtgtag

SEQ ID NO: 220189 - DNA, 564 bp, Artificial Sequence
  Description of Artificial Sequence: Synthetic coding sequence
tgaagcgaggaaagggatattgggaaacctatggagatttttgttgacgacgagacgaagctaacactgcatggcttgcagcagtattacgtgaagctgaaagacaatgagaaaaacagaaaactgtttgacttgctggacgtgcttgagttcaaccaagttgtcatctttgtgaagagcgtgcagcgatgtatcgccctggctcaacttctggtcgaacagaatttccccgctatagccattcaccgcggaatgcctcaggaagagaggctctcgcggtaccaacagttcaaagactttcagaggcgtattctggtggcaacgaaccttttcgggagaggcatggatattgagagagttaacatcgctttcaactacgacatgccagaggattccgacacctacttgcaccgtgtggcccgagctggacggttcgggactaagggactcgctatcactttcgtgtctgacgaaaacgatgctaagatactgaacgacgtgcaggacaggttcgaggttaacatctcggagctgccagatgagattgacatctccagctactag

SEQ ID NO: 220190 - DNA, 594 bp, Artificial Sequence
  Description of Artificial Sequence: Synthetic coding sequence
atggccgaaaacgatgttgacaacgaattactggattatgaagacgacgaagtcgagactgccgctggaggcgacggggcagaggccccagcaaagaaagatgtgaaggggtcctatgtaagtatacatagctccggcttccgggactttctcctcaagccagagctgctccgggctattgttgactgcggcttcgaacacccctctgaagtacagcacgagtgtattccccaggcaatactgggaatggatgttctttgtcaagcgaaaagcggcatgggcaaaactgctgtcttcgtactcgccacccttcagcagcttgagcctgtgaccggtcaggtgtgcttttgtgactctcacttcccccgaggcgataatgaggaactccatctgccatatgtgtctgtgtacttcctgccaaaagtctctgtacttgtgatgtgtcacactcgggaattggcattccaaatttccaaggaatacgagcgcttttcaaaatatatgccaaacgtcaaagttgccgtgttttttggaggactcagcattaagaaagacgaggaagtgctgaagaagaactgcccccacatcgtctag

SEQ ID NO: 220191 - DNA, 594 bp, Artificial Sequence
  Description of Artificial Sequence: Synthetic coding sequence
atggccgagaacgacgtggataacgagctgctggactacgaagacgacgaggtggagaccgccgcaggcggtgacggcgcagaggctcccgctaagaaagacgtaaaggggtcttacgtttctattcatagttctggattcagggacttcctgctgaaaccagagttgctcagggccattgtagattgtgggtttgaacacccctcagaggtgcaacacgaatgcattcctcaggctatcctcgggatggatgtgctctgccaggctaaaagtggtatgggaaagacagcggtgttcgttctggcaacgctgcagcagctcgaaccagtaaccggccaagtgtgcttctgcgactcacatttcccaaggggcgataatgaggaattacacctgccttatgtttccgtgtatttccttccgaaggtaagtgtcctggtaatgtgccatactcgggagttagccttccagatatcaaaagaatacgagaggttctctaagtacatgcccaacgtaaaggttgctgtgttcttcgggggtctgagcattaaaaaggacgaggaagtgctcaaaaaaaactgtccacacattgtgtag

SEQ ID NO: 220192 - DNA, 411 bp, Artificial Sequence
  Description of Artificial Sequence: Synthetic coding sequence
atggggggaggcaggcgcccatatgatgtgttcttttccaaagtgatggccgagaatgatgtagacaacgagctgttggattacgaggacgacgaggtcgagacggcggctggtggcgatggcgctgaagcgccagccaagaaggatgtaaaggggagctacgtctcaattcatagtagtggattcagggacttccttctgaagcccgaattgttgcgggctatcgttgactgcggattcgagcatccctctgaagtccagcatgaatgtattccccaagccattctgggaatggacgttctgtgccaggcaaagagcgggatggggaagacggctgtgtttgttcttgcaaccctgcagcaactagaaccggtaaccggacaggtctctgtgctggtcatgtgccattag

SEQ ID NO: 220193 - DNA, 1278 bp, Artificial Sequence
  Description of Artificial Sequence: Synthetic coding sequence
atggctgaaaacgatgttgacaatgaactcctcgactacgaagacgatgaagtagagactgcagcagggggagacggagctgaagcccctgcgaagaaagacgttaaaggtagttacgtttcaatacactcctccggatttcgagactttctgttgaagccagaactcctacgagctattgtggactgcggtttcgagcacccatctgaagtccagcatgagtgcatcccccaggccattctgggtatggatgttctgtgtcaagccaaatctgggatgggaaagaccgctgtctttgtgcttgccacactgcagcagcttgagcccgtgactggtcaagtgtccgtcctggttatgtgccacacaagggagttggccttccagataagcaaagagtacgaacgattttccaaatacatgcccaacgtgaaggttgcagtattcttcggcggactttccattaaaaaagacgaagaagtgcttaagaaaaattgcccgcacatcgtggttgggactccagggcgtatcctcgccttagcccgaaataaatctttaaatttgaaacatatcaaacatttcatccttgatgaatgcgacaagatgctggaacagctcgacatgcgaagggacgtccaggaaatcttccgcatgacacctcacgaaaagcaagtgatgatgttttccgccacactatccaaggagatccggccagtctgcaggaagttcatgcaggaccctatggagatcttcgtagacgacgagaccaaactaaccctgcatggtctgcaacagtattatgtgaaactgaaggacaatgagaagaaccgtaaattgtttgacttactcgacgtgcttgaattcaaccaggttgtcatcttcgtcaagtccgtccagcgatgtatagcattagcgcaactccttgtggaacagaacttccccgcaatcgctatccaccggggtatgccgcaggaagagcggctctcgaggtaccagcaatttaaggacttccaacgccgtattctggtggccactaatctctttggtaggggcatggacattgaacgggtaaatattgcctttaattacgatatgcccgaagattccgatacatatctgcataggtgctatcctctgagccctagcagatggcctgagcaagccggactggctccgagggcatggctaagccatctgtgtcccatgaggatgatgccccgttccagcatgatgtgccgaattgctctgcggtcgattcttgtttcttgcttaatgagatag

SEQ ID NO: 220194 - DNA, 1287 bp, Artificial Sequence
  Description of Artificial Sequence: Synthetic coding sequence
atggcggagaacgatgtcgacaacgagcttctggattatgaggatgatgaagtggagacggctgctggcggagatggcgcagaagcacctgccaaaaaagatgtgaaaggttcttatgttagcattcacagctcgggttttcgggattttctgttaaagccggagctgcttcgtgcaattgtggattgcggttttgaacatccatcagaggtccagcacgagtgtatcccgcaggccatcttgggaatggacgtcttatgtcaagctaagagcgggatgggtaagaccgccgtcttcgtactggcgacactgcagcagcttgagccagtgacaggacaggtgagcgtcctagtcatgtgtcatacgcgggaattggctttccagatctcaaaagagtatgaaaggttttcaaagtatatgcccaacgtcaaagtggccgtgttctttggcggactttcaatcaagaaagatgaggaggtgctgaagaagaactgcccacatattgtggtgggaacccctgggagaatactcgcccttgcccgaaataagagtctgaatttgaaacacatcaaacactttatcctagacgaatgcgataagatgttggagcagctcgatatgcgcagggacgtccaagaaatctttcgtatgaccccccacgaaaagcaggttatgatgttctccgccactctgtccaaagagattcgaccagtgtgcagaaagttcatgcaggaccccatggagatattcgtggacgacgagacgaagctgaccttgcatggtttgcagcaatactatgttaagttgaaggacaatgagaaaaaccgcaaattattcgatctgctggatgtgcttgagtttaaccaggtggtcatcttcgtcaagtcagtccaacggtgcatcgcccttgcacaactgctcgtcgaacagaattttcccgctatcgcgatacaccgtgggatgccacaggaggaacgactgtcacgctatcagcagttcaaggactttcaacgcaggatcctggttgcaacgaacctatttggacgcggaatggacatcgagcgcgtcaacatcgccttcaactacgacatgcctgaagatagtgatacatatctgcatagggtggccagagcagggagattcgggactaagggcctcgcaataaccttcgtcagcgacgaaaacgacgccaagatactaaacgacgttcaggatcgttttgaggttaacatttcggagttaccagatgaaattgacatcagttcatatattgagcaaaccaggtag

SEQ ID NO: 220195 - DNA, 1287 bp, Artificial Sequence
  Description of Artificial Sequence: Synthetic coding sequence
atggctgagaacgacgtggataacgagctgctggactatgaggatgacgaggtggagactgccgctggcggtgacggtgccgaggctccagctaaaaaggacgtcaagggaagctacgtgtctatccactcatctggctttagagacttcttacttaagcccgagctgttgcgcgctatcgtggactgtggatttgaacaccccagtgaagtgcagcatgagtgtatcccccaggctatcctagggatggacgttttgtgccaagcgaaaagcgggatgggtaagactgctgtgtttgtactggccaccctccaacaactggagcccgtcaccggtcaggtgtctgtcctcgtgatgtgtcacactagggagctggcattccagatcagtaaggagtacgaaaggttctcaaaatacatgccaaatgtcaaggttgcagttttttttggaggcttgtccattaagaaagatgaggaggtcttgaagaaaaattgtccacacatcgtggtaggtaccccaggccgtatcctggcactggctcggaacaagagcctgaacttgaagcatattaagcattttatactggatgagtgcgacaagatgcttgagcagcttgatatgaggagagacgtacaggagatatttcggatgacacctcacgagaagcaggtgatgatgttcagcgctactctgagtaaggagattcggccagtttgtagaaaattcatgcaagaccctatggagatcttcgtagatgacgaaactaaactcactctccacgggcttcagcaatactatgtcaaactcaaggataatgagaagaaccgcaaactttttgatctactggatgtgctcgaatttaaccaggtggtcatcttcgtgaagagcgtgcagcgctgtattgccctggcacagctgctggtggagcagaacttcccggctatagccatccacaggggaatgccccaggaggaacgcctttcccggtatcaacaattcaaggactttcagagacggattttagtcgccactaatcttttcgggaggggcatggacattgagcgcgtgaatatcgcgtttaactatgacatgcctgaagactctgacacgtacttgcatagggtggcgcgtgccggtcggttcgggaccaaagggctggctattactttcgtgtccgatgaaaatgacgccaagattttaaacgacgtacaagataggttcgaggtgaatatctccgaattgcctgacgagattgacatttcctcctacatcgaacagactagatag

SEQ ID NO: 220196 - DNA, 738 bp, Artificial Sequence
  Description of Artificial Sequence: Synthetic coding sequence
atgtggacgatgtcttcatggacgatgaaaatgatgaggtggaggcagcaattgggtgagatgggcctgcgcccactgccacgccgtatgtcgcgcgctcctatgagtccctccaccgctctcgcctttgtgacatcctgtagttcgcagtcctgttccgggccactcagtacagtcgcactgtcaatccggcagaaggtcgctgtattctttggaggcctgagcattaagaaggacgaagaagtccttaaaaaaaactgtccacacatcgttgtggggactccaggcaggatcctggcactcgctcgcaacaaaagcctgaaccttaaacacattaaacatttcattctggacgagtgcgacaagatgctggaacaactggacatgcggagagacgtgcaggagatcttccgaatgacgccacacgagaaacaggtgatgatgttctctgcaactctttctaaggaaatcagacctgtgtgtcggaagtttatgcaggatccaatggaaatcttcgtggacgatgagaccaaacttacactgcacggactgcagcagtactacgttaagctgaaggataatgaaaagaaccgaaaattattcgatctgctggatgtcctcgaatttaaccaggtggtcatctttgtgaagagtgtgcaacggtgcattgcgttggcccagctgcttgtggaacagaatttcccagccatagccatccaccggggtatgccccagtag

SEQ ID NO: 220197 - DNA, 696 bp, Artificial Sequence
  Description of Artificial Sequence: Synthetic coding sequence
atggccgaaaatgatgtcgacaatgagctgctcgattatgaagacgacgaggtggagaccgctgccggaggcgacggtgcagaggcccctgccaagaaagatgtgaaaggctcgtatgtcagcatccactcttctggcttcagggacttcttgttaaagcctgagctgctgagggccattgtggactgtggcttcgaacacccttccgaggtccagcatgagtgcattccacaagcaatcctaggcatggacgtgttatgtcaagccaagtccggcatgggcaaaacagcagtttttgttctcgcaactctgcagcaacttgagccagtgacagggcaagtgagtgtgctcgttatgtgccatactagagaattggcttttcagatcagtaaggagtatgagagattttcaaagtacatgcctaacgtgaaagtggccgtgttttttggaggactgtcaatcaaaaaggacgaggaggtacttaaaaagaattgccctcacattgtggtgggaacgccaggcaggatccttgccttggccagaaacaagagccttaaccttaagcacattaagcattttatccttgacgagtgcgacaaaatgctggagcagctggacatgaggcgggatgtgcaggaaatcttcaggatgacaccccacgagaagcaggttatgatgttctctgcaacactctag

SEQ ID NO: 220198 - DNA, 594 bp, Artificial Sequence
  Description of Artificial Sequence: Synthetic coding sequence
atggcagagaatgacgttgataacgaactgctggattacgaggatgatgaggtggagactgccgcaggaggagatggagctgaggccccagctaaaaaggatgttaaagggtcatacgtgtcaatacatagcagtggcttccgtgactttctcctcaaacctgagctgctgcgcgcaatcgtggactgtggatttgagcacccctccgaagtgcagcatgaatgcattccgcaggctatccttggtatggacgttttgtgtcaggccaaatcaggaatgggcaagactgctgtgtttgtactagccaccctccagcagctggagcccgtaaccgggcaggtgtgtttctgtgactcccacttcccccgaggcgataacgaggagttgcatctgccctacgtgtccgtgtatttcctgcccaaggtctcggtcctagtgatgtgccacacccgtgaacttgcatttcagatttccaaagagtatgaacgattctctaaatacatgcccaatgttaaagtagcagtctttttcggaggcttgtcgattaaaaaagacgaggaagttctgaaaaaaaactgcccgcatattgtctag

SEQ ID NO: 220199 - DNA, 594 bp, Artificial Sequence
  Description of Artificial Sequence: Synthetic coding sequence
atggctgagaatgacgtagacaatgaactgctggattacgaagacgatgaagtagagactgcagcagggggtgatggcgcagaagcaccggctaaaaaagatgttaaagggagttatgtaagtatacactcctcggggtttcgggactttcttctgaagcctgaacttctgcgggcaatcgtggattgcggttttgagcacccgtccgaggtgcaacacgagtgtattccgcaggcgattttaggaatggatgttctgtgtcaggccaaatcagggatgggcaaaacggctgtatttgtcctcgccaccttgcagcagctggagcccgttaccggacaggtgtgtttctgcgattcccatttccccaggggcgataacgaggagctgcacctgccctatgtttcggtatatttcttacctaaggtttccgttctggtaatgtgtcatactcgggagctagcctttcagatctctaaggagtacgaaaggttctcaaaatatatgcccaacgtgaaagtcgcagttttcttcggtggtttgagcataaaaaaagacgaggaagtcctcaaaaagaattgcccccatattgtgtag

SEQ ID NO: 220200 - DNA, 540 bp, Artificial Sequence
  Description of Artificial Sequence: Synthetic coding sequence
gtggccgtctttttcggcggtctttccataaagaaggatgaggaggttcttaagaaaaactgcccacatatagttgtcgggacccctggtaggattctcgcattggctcgcaataaaagcctcaatctgaagcatattaaacactttatactagatgagtgtgataagatgctggagcagctcgacatgcggagggatgtccaagagatcttcagaatgacccctcacgaaaaacaggtgatgatgttttctgcaacactgtccaaggagatccgaccagtttgccgaaagtttatgcaggatcctatggaaatatttgtggacgatgagacaaaacttacgctgcacgggctacagcagtactatgtgaagcttaaagacaatgaaaagaatcggaagctgttcgacttgctagatgttttggagtttaatcaggttgtcatcttcgtgaagagcgtccaacgctgtattgccctggcacagttgctcgttgaacagaacttcccagccatcgccatccataggggaatgccccaatag

SEQ ID NO: 220201 - DNA, 594 bp, Artificial Sequence
  Description of Artificial Sequence: Synthetic coding sequence
atggctgaaaatgatgtggataatgagttgctcgactacgaggacgacgaagtcgagacggctgctggtggtgatggcgctgaggcaccagcaaagaaagatgtgaagggctcctatgtctcaatacacagttctgggttccgcgacttcctcttgaagccagaactgctgcgggctatagtggactgtggatttgaacatccctctgaggttcagcatgaatgcattccccaggcaatcttgggcatggacgtgctctgccaggctaagtccggcatgggaaaaaccgctgttttcgtgctggccactttacagcagctggagccagtgacaggccaggtgtgtttttgcgacagtcattttccacggggtgacaatgaagagctgcacttaccttacgtcagcgtttacttccttcctaaggtcagtgtgctggtcatgtgccacacacgtgaactcgcattccagatatccaaggagtacgaaagattttctaagtatatgccaaacgtgaaggttgctgtgttcttcggtggactgagtatcaagaaagatgaggaggtgctcaagaaaaattgcccgcacatcgtctag

SEQ ID NO: 220202 - DNA, 564 bp, Artificial Sequence
  Description of Artificial Sequence: Synthetic coding sequence
taaagcgaggaaagggacattggcaaaccgatggagatcttcgtggatgatgagacaaaattgaccctccacggtctccagcagtactatgttaaactgaaagataatgagaagaatcgaaagttgttcgatctcttggacgtcctcgagttcaatcaggtggtgatcttcgttaaaagtgtccagagatgtattgctctggcgcagctactcgtagagcagaactttcccgcaatcgccatccaccggggtatgcctcaggaggagcggctgagtcggtatcagcagttcaaggactttcagcgcagaattttggttgccacaaaccttttcgggaggggaatggacattgaacgggtgaatatagccttcaactacgatatgcccgaggactccgatacctatctgcatagagtggccagggcaggaaggttcgggacgaaaggcctagctattactttcgtttctgacgagaacgatgccaaaattcttaacgatgtgcaggaccggtttgaagtcaatatcagtgagcttcctgacgaaatcgacatcagttcgtactag

SEQ ID NO: 220203 - DNA, 195 bp, Artificial Sequence
  Description of Artificial Sequence: Synthetic coding sequence
tgagcaaccctgcagcagctggaacccgtcacgggtcaggtatccgttctggtgatgtgccatactcgagaactggcgttccagatctctaaggagtacgaacgatttagtaagtatatgccaaacgtcaaggtcgccgttttctttggtggattgtccatcaagaaggatgaagaagtcctgaagaaaaattag

SEQ ID NO: 220204 - DNA, 78 bp, Artificial Sequence
  Description of Artificial Sequence: Synthetic coding sequence
tgagcaaccctccagcaacttgaacccgtaaccgggcaagtctctgtgctggtcatgtgtcacactagggaactctag

SEQ ID NO: 220205 - DNA, 66 bp, Artificial Sequence
  Description of Artificial Sequence: Synthetic coding sequence
taagcgactctgcagcaacttgagccagtgactggacaggtgtcagttctagtcatgtgtcactag

SEQ ID NO: 220206 - DNA, 870 bp, Artificial Sequence
  Description of Artificial Sequence: Synthetic coding sequence
atggcagaaaatgacgtggacaacgaactgcttgattatgaggatgatgaggttgagactgctgccggtggagacggtgccgaagctcctgccaagaaagatgtcaaagggagctacgtgtcgattcattcgagcggattccgggatttcctccttaagccggaactgcttcgagccattgtggactgtgggttcgagcacccatctgaggttcagcatgaatgcattccacaagctattttaggtatggacgtgctgtgccaggctaagtcggggatgggaaagactgccgtgttcgttcttgccaccctacagcagttggaacccgtgacaggacaggtaagcgtgctggtgatgtgccatacccgggaattggcgtttcaaatctctaaagagtacgagcgcttctctaaatatatgcctaacgtgaaggtcgccgtgttctttggcggactctccattaaaaaggatgaagaagttctgaagaagaattgccctcatatagtcgtaggcactccgggaaggatcctggccctagcaagaaacaagagcctgaacttaaaacatattaaacatttcatcttagatgagtgtgataagatgctagagcagctcgatatgcgccgtgatgtgcaggaaatctttcgaatgaccccccacgagaaacaggttatgatgttctccgcaaccctcagtaaagaaatacgccctgtgtgcaggaagttcatgcaggaccctatggagatctttgtagacgatgagactaagctgactctccatggtctgcagcagtactacgtcaaactgaaggacaacgaaaagaatcgtaagctcttcgacctgttggacgtgctggaatttaatcaatag

SEQ ID NO: 220207 - DNA, 711 bp, Artificial Sequence
  Description of Artificial Sequence: Synthetic coding sequence
atggctgagaacgacgttgacaatgagctgttggactatgaggacgacgaggtggagactgccgctggtggcgatggggcagaagcacccgctaagaaagatgtgaagggttcatacgtcagcatacacagctcaggtttcagggacttcctccttaagccagagctccttcgtgccattgtggattgcggattcgagcacccatctgaagtgcagcacgaatgcatacctcaagctatcttaggaatggatgtgctatgccaagcaaaatccggaatggggaagactgccgtttttgtccttgccaccctccagcagcttgaacccgtcacaggccaagtgagcgtgctggtgatgtgccatacgcgcgaactggcattccagatctccaaagagtacgagaggtttagcaaatatatgcccaacgtgaaagttgccgttttcttcggcggactgtccattaagaaagacgaagaggtactgaaaaagaactgtcctcatattgtagtgggaaccccgggacgaattctcgccttagctcggaacaaaagcctgaatctgaaacacatcaaacactttatcttggatgagtgcgataaaatgctggagcagctcgatatgaggcgtgacgtgcaggagatatttaggatgacaccacatgagaagcaggtgatgatgttttcagcaacattgtccaaggaaatccgttag

SEQ ID NO: 220208 - DNA, 711 bp, Artificial Sequence
  Description of Artificial Sequence: Synthetic coding sequence
atggcagaaaatgacgtcgacaatgagttgctggactatgaggatgacgaggttgagacagctgccggaggtgatggagcagaggcacctgctaagaaagatgtaaagggcagttatgtgtcaattcactcgtctgggttccgggatttcctgctgaaaccagagctactcagagcaatcgtggattgtgggtttgagcatccgtccgaggtgcagcatgagtgcattccacaagcaatcctcggcatggatgtgctgtgccaggctaagtccgggatgggaaagacagctgttttcgtgctggccactttacagcagctagaacctgtgacaggacaggtttccgtccttgtaatgtgtcacacccgtgagctcgcattccaaatttcaaaagaatacgaacgtttttctaagtacatgcccaatgtgaaagtggctgtgttctttggagggttatctatcaaaaaagacgaggaggtgctgaagaagaattgtcctcatatcgttgtgggcacacccggtcggatcctggcactggcccgaaacaagtctctgaacctgaaacacatcaaacatttcatcctggatgaatgtgataaaatgctggaacagctggatatgcgaagagatgttcaagaaatctttaggatgacgccccacgagaaacaggtgatgatgttctctgccacactgagcaaagaaatcaggtag

SEQ ID NO: 220209 - DNA, 978 bp, Artificial Sequence
  Description of Artificial Sequence: Synthetic coding sequence
tgagccacactgcagcagctcgaaccggtgacaggccaggtgtctgtgctggtcatgtgccacactcgggagctggcttttcagattagtaaggaatatgagagatttagtaaatatatgcccaacgtgaaagtagccgtgtttttcggtggcctgagtattaaaaaggacgaggaagtgctcaagaaaaactgcccacacatcgtggtgggcacccccggacgaattctggccctagcacggaataagagtcttaatctgaaacacattaagcactttattctcgacgagtgcgataagatgctggagcaactggacatgcggagagacgttcaggagattttcagaatgaccccccatgaaaagcaagtgatgatgttctccgccaccctgtccaaggaaatcagacctgtgtgtaggaagtttatgcaggatccgatggagatcttcgttgatgatgaaaccaagttaactctgcacggcttgcagcagtactatgtcaaactgaaggacaacgaaaagaaccgaaaactcttcgatctactcgatgtgctagaattcaatcaggtcgttatttttgtcaagagcgtccagaggtgtatcgcactagcccaactgctggtcgaacagaatttccccgcaatagccatccaccggggaatgccacaggaggaacgcttgtctcgctaccagcaatttaaggactttcagcgacgcattctggtggccactaatctatttggacgtggtatggatattgagcgagttaacatcgctttcaattatgatatgccagaggactctgacacctaccttcatcgttgctacccactgagccctagtagatggccagaacaggccggactcgcccctagggcctggctgagccacctttgccctatgcgtatgatgcccaggtcaagtatgatgtgtcggatcgccctacggtccatccttgtctcttgtttgatgcgatag

SEQ ID NO: 220210 - DNA, 717 bp, Artificial Sequence
  Description of Artificial Sequence: Synthetic coding sequence
atggctgagaatgatgtagataacgagctgttggattatgaagatgacgaggtggaaacagccgctgggggtgacggagcagaagcccctgcaaaaaaagacgttaagggaagctacgtgagtatccattcgagcggctttagggattttctgctgaagcccgagttactgcgggctatcgtcgattgtggcttcgagcacccttcagaagtccaacacgagtgtatcccgcaggcaatcctcgggatggacgtattgtgtcaagccaagagtggtatgggaaagactgctgtcttcgttctggctactttgcagcagctggaacctgtgactggtcaagtgtccgtccttgtaatgtgtcacactcgggagctggcttttcaaatctcgaaagagtatgagaggttttccaagtatatgcctaacgtcaaggtcgctgtgttcttcggcggtcttagcatcaaaaaggacgaagaggtgctgaagaaaaattgtcctcatatagtcgtaggcactcctgggaggatactggccctggccaggaataagtctcttaatctcaaacatatcaaacactttatcctcgatgagtgcgacaagatgttagagcagttagacatgagacgtgatgtacaagaaatctttagaatgactccccatgagaagcaggtcatgatgttctcagccacgctatctaaggagatcagaccagtttag

SEQ ID NO: 220211 - DNA, 717 bp, Artificial Sequence
  Description of Artificial Sequence: Synthetic coding sequence
atggccgaaaacgatgttgacaatgagctgctcgattacgaggacgacgaagtggagaccgcagctggaggcgatggtgcagaggctcctgcgaaaaaggatgtgaaaggcagctacgtgagcattcatagcagcggttttagggatttcttgttgaaacctgaactgctccgggctatcgtcgattgcgggtttgaacacccctccgaagtacaacatgagtgtattccacaagccatcctgggaatggacgtactgtgccaggcaaagagcggtatggggaaaaccgccgtcttcgtactggctactctgcagcagttggagcctgtgaccggacaggtgagcgtgttggttatgtgccacacacgagaattggcgttccagatctcaaaggagtatgaacgcttttcaaagtacatgcccaatgttaaagtggcggtgttttttgggggtctatcgattaaaaaagacgaggaggtgctgaaaaagaactgcccacacattgtagttggtacacctgggcgtatactcgcactggcgaggaataagagcctgaatctgaaacacatcaagcattttatcctcgatgagtgcgataagatgttagagcaactcgacatgcgtagggacgtacaggaaatctttaggatgacccctcacgagaagcaggtgatgatgttttcagccaccctcagtaaggaaattaggcccgtctag

SEQ ID NO: 220212 - DNA, 870 bp, Artificial Sequence
  Description of Artificial Sequence: Synthetic coding sequence
atggccgagaacgatgttgataacgaactgctcgattatgaggacgatgaggtcgaaacagccgcaggaggcgacggggctgaagctccagccaaaaaagacgtaaaaggctcgtacgtgagcatccactcttcaggcttccgggactttctgcttaaacccgaactgcttcgcgcaatcgtcgactgcgggttcgaacacccatcggaggtacagcatgagtgtatccctcaggccatattgggaatggacgtgctatgtcaggctaaatcaggcatgggaaagacagctgtgttcgttctggcaactcttcagcagcttgaacccgtcaccggccaagtctctgtactggtgatgtgccacacccgcgaactagcatttcaaatttccaaagagtacgaacgctttagtaagtatatgcctaacgtaaaagttgccgtgttcttcgggggactgagcataaaaaaggacgaagaggtcttaaaaaagaactgcccccatatagtggttggaacccctggccgaatccttgcgctggccaggaataagtctctcaatctcaaacacattaagcactttatcctcgatgagtgtgataagatgttggaacagttagatatgcggagggacgtacaggaaattttcaggatgactccccacgaaaaacaggtaatgatgttttccgccaccctttcaaaggagattagacccgtctgtaggaagtttatgcaagaccctatggagattttcgtcgacgacgaaaccaagcttacactccacggtttgcagcagtattatgtcaagcttaaggacaacgagaaaaaccggaagctattcgacctgcttgacgttctggagtttaaccagtag

SEQ ID NO: 220213 - DNA, 1278 bp, Artificial Sequence
  Description of Artificial Sequence: Synthetic coding sequence
atggctgagaacgatgtcgacaacgagttactggactacgaagatgacgaggtggaaaccgctgctggtggggatggagcagaagctcctgccaagaaggatgtgaaggggtcatacgtttcaattcacagttctggattccgggacttcctgctgaagcccgagttacttcgggctattgtggactgcggcttcgaacatccttctgaggtgcagcacgaatgcatcccgcaggcaatcttgggtatggacgtgctctgccaagccaaatcgggaatgggcaaaacggctgtattcgttttggcaaccctgcaacagctcgagcctgttaccggacaggtttccgtactggttatgtgccatacaagagaattggcctttcaaatctcaaaggaatacgagcgcttcagcaaatacatgccaaacgttaaggtggctgtgtttttcggagggctgtctataaaaaaagacgaggaggtgctgaagaagaactgccctcacattgtagtgggaacccctgggagaatccttgccctagcgagaaataaatctctcaacctgaagcatatcaagcactttattctggatgaatgtgacaaaatgcttgagcagctggacatgaggcgggacgtccaggaaatcttccgaatgaccccccatgagaaacaggtgatgatgtttagcgccaccctttccaaagagatcaggccagtctgtcggaaattcatgcaggatcccatggagatctttgtagacgacgagaccaaactaaccctgcacggactccaacagtattacgtgaagctcaaggacaacgaaaagaatcggaagctgtttgacctactggacgtcctcgagttcaaccaggtggtcatcttcgtgaaatccgtccagcgctgtatcgccctggctcagctcctagtcgagcagaattttccggcaattgccatccatcgaggaatgccacaagaagaaaggctttcacggtatcagcagttcaaggacttccagcgcaggatattggtagccaccaacctctttggcaggggtatggacatcgagcgggtaaatattgcattcaattacgatatgcccgaagactccgacacatatctgcaccgttgctatccactctctcctagcaggtggccagagcaggctggcttggcccctcgcgcttggctaagccacctgtgtcccatgcgcatgatgccacggtcctctatgatgtgccgaatcgccttacgttccatactggtcagctgcctgatgcggtag

SEQ ID NO: 220214 - DNA, 411 bp, Artificial Sequence
  Description of Artificial Sequence: Synthetic coding sequence
atgggagggggtagaagaccctatgatgtcttcttttcaaaggtgatggccgaaaacgatgtggataacgagttgttagactacgaggacgacgaggtggagacagccgctggtggcgatggcgcagaggcaccagccaaaaaagacgtgaaaggctcatacgtctctattcactcatctggattccgggacttcctcctgaagcccgaattgttacgagcgatcgtagattgcgggtttgaacacccgtctgaagtgcagcacgagtgtatacctcaagcaattttagggatggatgtactttgccaagctaaaagtgggatgggcaagaccgccgtgttcgtacttgccaccctgcaacagctggagccagtgactggacaagtctctgtgctggtgatgtgtcactag

SEQ ID NO: 220215 - DNA, 564 bp, Artificial Sequence
  Description of Artificial Sequence: Synthetic coding sequence
atgggcagtagccacattggcggtctgtctattaacgagagaaggtgttctgcctcactaggactggtaatggcagagaacgacgtggataacgaactccttgattacgaggatgatgaggtggaaactgctgctggcggagatggagctgaggctcctgcaaagaaagacgtgaaaggaagttacgtgtccattcactcctctggtttcagagatttcctgctgaagccagaactgttgcgagcgatcgtagattgcggattcgagcatccctcggaagtgcagcatgaatgtatcccccaggccatcctgggcatggatgtcctgtgccaggccaaatcggggatgggcaagacggccgtgtttgtgctcgcaactttacagcagctggagcctgttactggtcaagtgtctgttctggtgatgtgtcatactcgggagttagcattccagatttccaaagagtacgaacggttctcaaaatatatgccgaacgttaaggtcgcagtgttttttggaggcttgtctatcaagaaggatgaggaggtcctgaagaagaattag

SEQ ID NO: 220216 - DNA, 399 bp, Artificial Sequence
  Description of Artificial Sequence: Synthetic coding sequence
atggctgaaaacgacgttgataacgagctgctggattacgaggatgacgaagtggaaactgcagccggaggggacggagcggaggcccctgcgaagaaggacgttaaggggagttatgtaagcattcactcatctggctttagagacttccttctgaaacccgagctgcttagggccatagtggactgtggtttcgaacacccatcagaagtgcaacacgagtgcatcccgcaggccattctcgggatggatgtcttgtgccaggctaagtcagggatgggtaaaaccgcagttttcgtcttggccacgctgcaacagcttgagcccgtgacgggacaggtgtgtttttgcgatagtcacttccctcgcggagacaatgaagaactgcatctcccctag

SEQ ID NO: 220217 - DNA, 870 bp, Artificial Sequence
  Description of Artificial Sequence: Synthetic coding sequence
atggctgaaaatgatgttgacaatgagttactcgactatgaggatgatgaggttgagacagctgccggaggcgacggagcagaagcgcctgcgaagaaagatgtgaaaggcagctatgtatccatacattcttcagggtttagggatttcttactgaaaccagaacttctcagagctatagtggattgcgggtttgagcatcctagtgaagtgcagcacgaatgcatcccccaggccattcttggcatggacgtgctgtgtcaggcaaaaagcggcatgggcaagactgccgtttttgtcctagctaccttgcagcaattggagccggtgaccggtcaggtttcagtgctcgttatgtgtcacacccgcgagctggctttccagatctctaaagaatatgagaggttttcgaaatatatgccaaatgtcaaggtggccgtgttttttggaggcctcagtatcaaaaaggacgaggaggtgctaaaaaaaaactgccctcatattgtggtgggaacacctggccgaattctggcactggccaggaataaatctctcaatcttaagcatattaaacattttatcctggatgagtgtgataagatgttggagcagcttgatatgagacgcgatgtacaagaaatcttccgtatgaccccgcatgagaaacaggtcatgatgtttagcgcaacgctgtcaaaggagatcaggcccgtctgtaggaaattcatgcaagatcctatggagatcttcgtcgacgacgagacaaaactgacactgcacggactgcaacagtattatgtgaaattgaaggataacgagaagaatcgcaaactttttgatctgcttgatgtattggagttcaatcagtag

SEQ ID NO: 220218 - DNA, 1287 bp, Artificial Sequence
  Description of Artificial Sequence: Synthetic coding sequence
atggctgaaaatgacgttgacaacgaactcctggactatgaggacgacgaagtggaaactgctgctgggggtgacggtgcagaagccccagccaagaaggacgttaaaggttcgtatgtcagtattcattcgagtggtttcagggactttctgctgaagccagagctgctgcgggcaatcgtggattgtggcttcgaacatcctagcgaggttcagcacgagtgtattcctcaagcaatcttaggcatggacgttctttgtcaggctaagtctggaatggggaagacagctgtgttcgtcctggccacattgcagcagctggagcctgtaacaggccaggtctccgtcctggtgatgtgtcacacaagggagctggcatttcaaatcagcaaggagtacgagcgatttagcaaatatatgcccaatgtgaaggtcgctgtttttttcggcggtctctccatcaagaaggatgaagaggtgctgaagaaaaactgtccccacattgtggttggcactcccggacggatactcgctctcgcgagaaacaaaagccttaacttgaagcacataaagcactttatcctagacgaatgtgataaaatgctagagcagctggatatgcgtcgggacgtgcaggagattttcagaatgactccccatgaaaagcaggtgatgatgttcagcgccaccctttctaaggagattcgacccgtatgtaggaaatttatgcaggaccccatggaaattttcgtggacgatgagaccaaactaacccttcatggcttacagcagtattatgtgaagctcaaggacaacgagaaaaacagaaagctgttcgacctcctcgatgtgctggaattcaatcaggttgttatctttgtaaaaagtgttcagcggtgcatcgcactggcccaactactggtcgaacagaacttcccagccatcgccatccatcgcggaatgccacaggaggagcgcttatctaggtatcagcagttcaaggatttccaacggaggattttggtggctactaatctttttgggaggggcatggatatcgagagagtgaatatcgcatttaattacgacatgcctgaggatagcgatacttacctccacagagtcgcaagagcgggacgatttggaactaagggcctggcaatcactttcgtgtccgatgagaacgatgccaaaatcctgaacgatgtgcaggatagattcgaagtcaacattagtgagctgcccgatgagatcgatatctcttcgtatattgagcaaaccagatag

SEQ ID NO: 220219 - DNA, 564 bp, Artificial Sequence
  Description of Artificial Sequence: Synthetic coding sequence
atgggctcatcgcacattggcggattgtccatcaatgagaggagatgtagcgcctcactgggactggtgatggcggaaaacgacgtcgataatgagctgctggactacgaggacgatgaggttgagacagctgccggtggcgatggggcagaagcacccgctaagaaagacgtgaaagggtcttacgtttctatccacagctccggctttagagattttctcctgaagcctgagctcttgagagccatcgtggattgtgggtttgagcaccccagtgaagtgcagcacgagtgcataccacaagctatcctgggtatggatgtgttgtgtcaggccaagtcaggaatgggcaagaccgccgtatttgtgctggccactttacaacagctggaaccagttaccgggcaggtttcagtactggtcatgtgtcacactcgagagttggcctttcagattagtaaagaatatgagaggttttcgaagtatatgccgaatgtgaaggtcgccgtgtttttcggaggtctatctatcaagaaagatgaagaggtcctgaaaaaaaactag

SEQ ID NO: 220220 - DNA, 291 bp, Artificial Sequence
  Description of Artificial Sequence: Synthetic coding sequence
atggccgaaaatgatgtggacaacgagctcttagactatgaggatgatgaagtggaaaccgccgcaggaggtgatggtgccgaggcacccgctaagaaagatgtgaaaggttcatatgttagcattcattcctcaggatttcgggattttctgctgaagccagagttactcagagccatcgtcgactgtggcttcgagcatcccagtgaagtgcagcatgaatgtattcctcaggccatcctaggcatggatgtgctgtgccaggctaagagtggcatgggaaaaacttag

SEQ ID NO: 220221 - DNA, 564 bp, Artificial Sequence
  Description of Artificial Sequence: Synthetic coding sequence
atgggctcctcacatatcggtggtctgtctataaacgagcgacgttgcagcgcatcccttggtttagtgatggccgagaatgacgtggataacgaactgctcgactatgaggatgacgaggtcgagacagccgctggtggagacggagctgaggcacctgccaagaaggatgtcaagggaagttacgtgtcaattcacagctctgggtttagggacttcctgctaaagccagaactgctcagagccatcgtggattgcgggtttgaacacccctctgaagtgcagcacgagtgtattcctcaagcaatcctgggcatggatgtcctttgccaggccaagtcaggcatgggcaagaccgcagtctttgtgctcgcaacgctgcagcagctggagccagtaacaggccaagtttccgtgttagtcatgtgccacacccgggagcttgctttccagatcagtaaagagtacgaacggttctcgaaatatatgcctaacgtgaaagtggctgtcttcttcggaggcctgagtataaagaaggacgaagaagttctgaaaaagaactag

SEQ ID NO: 220222 - DNA, 594 bp, Artificial Sequence
  Description of Artificial Sequence: Synthetic coding sequence
atggctgaaaatgacgtggacaatgaactgctggactacgaggacgacgaggtggaaaccgctgcaggaggagatggagccgaagcccctgctaaaaaggatgtcaaaggtagttatgtgtctatccactctagtggattcagagatttccttcttaagccagaactgctccgagccattgtcgactgcggattcgaacatccgtctgaggtacaacacgagtgtatccctcaggcaattctcggaatggacgtcctctgtcaggcaaaatccggaatgggtaagactgccgtgttcgtgcttgccacactacagcaactggagccagtaacaggtcaggtatgtttctgcgattcccactttcccagaggggataacgaagagttgcaccttccctacgtgagcgtttacttcctgcccaaggttagtgtgctcgttatgtgccataccagagagcttgcctttcaaatctccaaggaatatgagagattcagcaaatatatgccaaacgttaaggtcgctgtgttctttggaggcctgtcaatcaagaaggatgaagaggttctgaagaaaaattgtccccacattgtttag

SEQ ID NO: 220223 - DNA, 291 bp, Artificial Sequence
  Description of Artificial Sequence: Synthetic coding sequence
atggcagagaacgacgtagacaatgaacttctcgattatgaggacgatgaggtagagaccgccgcaggcggtgacggtgcagaagcccctgccaagaaagacgttaagggatcctatgtctccattcactccagcgggtttagggatttcctgcttaaacctgaactcttaagagccatagtggactgcggatttgagcacccaagtgaagtgcaacatgagtgcattcctcaggctattctcggaatggacgtactgtgccaggctaaaagcggcatgggtaaaacatag

SEQ ID NO: 220224 - DNA, 696 bp, Artificial Sequence
  Description of Artificial Sequence: Synthetic coding sequence
atggcagaaaacgacgtggataatgaattattggactacgaagatgacgaggtggaaaccgccgcagggggagatggggcagaagcgccagcgaagaaggacgttaaagggagctacgtgtcaatccattccagcggattcagagactttctcctaaaacctgaactcttgagggctatcgtggactgtggtttcgagcatccctccgaggttcagcatgaatgcattccacaggccatactggggatggatgtcctttgccaggccaagagtggcatggggaaaacggccgtgttcgtgttggctactctgcagcagttggagcccgtaaccgggcaagtcagcgttctcgtgatgtgccacactcgggaactggcctttcagatctccaaggaatatgaacggttttcaaaatacatgcctaacgttaaggtggcggtgtttttcggagggctgagcatcaagaaggatgaggaagttctaaagaagaactgccctcatattgtggttgggacgccagggaggatcctggctcttgcacgaaataagagcttaaacctgaaacacatcaaacactttatattggacgagtgtgacaagatgctagaacaactcgacatgcgtcgcgatgttcaggagatttttaggatgacacctcatgagaaacaggtcatgatgttctccgctaccttatag

SEQ ID NO: 220225 - DNA, 696 bp, Artificial Sequence
  Description of Artificial Sequence: Synthetic coding sequence
atggcagagaatgatgtcgataatgagctgctggattacgaagacgatgaggtcgaaacggccgcaggcggagatggggcagaagcaccagctaagaaggacgtgaaaggtagctacgtgagcattcacagcagcggcttcagagactttctgctgaaacccgagcttctaagagcaatcgttgattgcgggtttgaacacccttccgaggtccaacatgaatgtattccccaagccatcttgggcatggatgtgctgtgtcaagctaaatctgggatggggaaaacagctgttttcgttttggccacactacagcagctggagccagtcacaggccaggtcagcgtgcttgtgatgtgccatacccgggaactggcatttcagatctctaaggagtacgagcggttcagcaagtacatgccaaatgtaaaggtagctgttttcttcgggggactgagcattaagaaggatgaagaggtactcaagaaaaactgtcctcacatagtggttggcacgcccggtagaatcctcgccttagcaaggaacaaaagccttaacctgaaacacattaaacacttcattcttgacgaatgtgacaaaatgctggagcagctggacatgcgcagagatgtgcaggagatttttcggatgactcctcacgaaaagcaggtgatgatgtttagcgcaacgctctag

SEQ ID NO: 220226 - DNA, 717 bp, Artificial Sequence
  Description of Artificial Sequence: Synthetic coding sequence
atggctgagaatgacgtagataatgagctactcgactatgaggacgacgaggtagaaacggcggctgggggagatggagccgaggcaccagccaagaaggatgtgaaaggatcatacgtgtcaatccattcttcaggctttcgggattttctgttaaagccagagttgctcagagccatcgtggactgcggtttcgagcatccatccgaggtgcaacacgagtgtatcccccaggcaatcttaggcatggatgtactgtgtcaggccaagtcaggtatgggaaagacagccgtctttgtgctggcgactctacagcagctggagcccgtgacggggcaagtgtctgtgctagtaatgtgccacactcgggaactggcctttcagatctccaaggagtatgaaaggttctctaagtacatgcccaatgtgaaagtggccgtgttctttggcggtctcagtattaagaaagatgaggaggtgctgaagaagaattgcccgcacattgtggtcggcacaccaggcaggatattggctcttgcaagaaacaagagcctgaatctgaaacatataaaacatttcatcctggatgagtgcgacaagatgctggaacaactcgacatgagaagagacgtccaagagatctttcgcatgacaccacatgagaagcaagtgatgatgttctcggctactttgagcaaggagatacgcccagtgtag

SEQ ID NO: 220227 - DNA, 1287 bp, Artificial Sequence
  Description of Artificial Sequence: Synthetic coding sequence
atggccgaaaatgacgtagataacgaattgctggactacgaagacgacgaggtcgagacggccgctggcggtgacggggcagaggctcccgctaaaaaggacgtcaaggggtcttatgtatccatacacagctccggctttcgggactttctgttgaagcctgaattactgcgcgcaatagtggattgcgggttcgagcatccctccgaggtccagcatgagtgcatcccgcaggccatcctgggcatggatgtgctgtgtcaggcaaaaagcggaatgggaaaaacagccgtgtttgtccttgccacactgcagcaattggagcctgtgacaggccaggtgagtgtgcttgtcatgtgtcatactcgagagctggcctttcaaatcagcaaggaatatgagcggttcagcaaatatatgcctaacgtgaaggtggccgtgttttttggtgggctctcaattaaaaaagacgaggaggtcctgaaaaaaaattgtccacatattgtcgtgggcacaccagggcgaatcctggcactggccagaaataagtccttgaacttgaagcacataaaacacttcatcctggatgagtgcgataagatgctggaacagctggatatgcgaagagacgtgcaagagatctttcgaatgaccccccatgagaaacaagtgatgatgttctccgctacactgtccaaagagattaggcctgtctgtagaaagtttatgcaggatcctatggagattttcgtcgacgatgagaccaagctaaccctccacggcctacagcagtactatgtcaagctcaaggacaacgaaaagaaccgcaagttattcgatcttctggatgtactggagtttaaccaagtcgttattttcgtcaagtccgtgcaacgatgtattgctctggcccagctgctggtggagcaaaattttcccgcaatcgctatccacagaggcatgccacaggaggagagattaagccggtatcagcagttcaaagactttcaacgcagaatcctggttgccacaaatctgttcggccgtggcatggatatcgaacgggtaaatattgcctttaattatgatatgcccgaggatagtgatacctacttgcatcgagtggcccgagccggaaggttcggaacgaaaggcctggccattacattcgtgtccgacgagaacgacgccaaaatactgaatgatgtgcaagacagattcgaagttaacatatctgagctgcctgatgaaattgatatcagtagctacatcgagcagacgcgttag

SEQ ID NO: 220228 - DNA, 564 bp, Artificial Sequence
  Description of Artificial Sequence: Synthetic coding sequence
tagtcggaggaacgggacattgggaagcccatggagatatttgttgacgacgagacaaaactaactctacatggcctgcaacagtattatgtcaagttgaaagacaatgagaagaatcgtaaactgtttgatcttctggacgtcttagagtttaatcaggttgtcatttttgtaaagtccgtgcagcgatgcatcgcattggctcagctcctcgttgaacaaaactttccagctatagccattcatagagggatgccccaggaggagcgattgtccaggtatcaacagttcaaagactttcagagaaggatcctcgtggctactaacctgtttggacgcggaatggacatcgaacgagtaaatatcgcatttaattacgacatgcccgaggattcagacacatacttacaccgggttgcccgagcaggcaggtttggcacaaaggggctcgccatcacgttcgtatctgacgagaatgacgcaaaaattttgaatgacgtccaggatcgcttcgaggtgaacataagtgagctgccggacgaaattgacatttcctcttactag

SEQ ID NO: 220229 - DNA, 564 bp, Artificial Sequence
  Description of Artificial Sequence: Synthetic coding sequence
atgggcagttcacacattgggggattaagcatcaatgaacggcgttgttccgcatcactgggcctggtaatggcagagaatgacgtggacaatgaactgttggattatgaagacgatgaagtggaaactgctgccggtggggacggtgcagaggcccctgccaagaaggatgtcaaggggtcttacgtttctatacactcctccggctttcgggactttttgctgaagccggagctgctcagggccattgtagattgcggcttcgagcatccaagcgaagttcagcacgagtgtatacctcaggccatacttggaatggatgttctctgccaggccaagtcaggtatgggaaagaccgctgtttttgtgcttgccacacttcagcaactagagccagtgaccggtcaggtgagcgttctggtcatgtgtcatactcgggaactcgcctttcagatcagcaaggaatacgaaagattcagcaagtatatgcctaatgttaaggtggctgtgttcttcggagggctctcaatcaagaaggatgaggaagttctgaagaaaaattag

SEQ ID NO: 220230 - DNA, 717 bp, Artificial Sequence
  Description of Artificial Sequence: Synthetic coding sequence
atggcagagaacgatgtcgacaatgaactgctggattacgaggacgatgaagtggagacagccgctggaggagatggtgcagaggctcccgctaaaaaagatgtgaaaggcagctatgtcagcatacacagctctgggtttagagacttcctgttaaagcctgagctgcttcgcgcaatcgtggattgcgggtttgaacacccatccgaagttcagcatgagtgcatcccacaggccattctcggcatggacgtcctctgccaggccaaatcaggcatgggtaaaaccgctgtcttcgtgttagccacgttgcaacagctcgagcccgtcacaggccaggtaagcgtacttgtcatgtgtcacacacgagagctggcattccagattagtaaggagtacgagaggtttagcaagtacatgccgaatgtgaaggtagcagtgtttttcggcggtttgtccattaagaaagacgaagaggtgctgaagaaaaactgtccccatattgtagtgggcacacctggacgcattctcgcattagcacggaacaagagcctgaatcttaaacacattaaacactttatcctggacgagtgtgacaaaatgttggagcaattggatatgcggagggatgtacaggagatttttcgcatgacaccgcatgagaaacaagttatgatgttctccgcaactctttctaaggagatccgaccagtgtag

SEQ ID NO: 220231 - DNA, 738 bp, Artificial Sequence
  Description of Artificial Sequence: Synthetic coding sequence
atgtggacaatgagctcctggaccatgaagatgatgcgttggcgccaacaacttggcgaaatgggcctacgacctctgccgagacgaatgagtagggcccctatgtctccgtcaacggccctggctttcgtgactagctgcagttcccagtcttgctccggacctctgtcgacagtggccctgtccattcgccaaaaggtggccgttttttttggcggtttgtccattaagaaggacgaggaggttctcaaaaagaattgtccacatattgtcgtgggcaccccgggtaggatcctcgccctcgcacggaataagagcctgaacttgaaacacatcaagcacttcatcctggacgaatgcgacaaaatgttggaacagttggatatgcgaagagatgtacaggagatcttccggatgactccccatgaaaaacaggtgatgatgttttcagccaccctgtccaaggaaatacgccctgtctgcagaaaatttatgcaggatcccatggaaatctttgtcgatgatgagactaagctcacactccatggcctccagcagtactacgtgaaactaaaggacaatgagaaaaatcggaagctattcgatttgctcgacgtgcttgaatttaatcaggtggtaatctttgtgaagtctgtccaaagatgcattgcgctggcccagttgctggtggagcaaaatttccccgcaatcgccatccatcgaggaatgcctcaatag

SEQ ID NO: 220232 - DNA, 1278 bp, Artificial Sequence
  Description of Artificial Sequence: Synthetic coding sequence
atggcagagaacgacgttgacaatgaactgctggattatgaggacgatgaggtcgaaactgctgcagggggagacggagccgaagcacccgcaaagaaggatgtgaaggggtcttatgtaagtattcattcatcaggattccgtgatttcctactaaaacccgagctgctgagagctatcgttgactgtggcttcgaacatccctctgaagtgcagcatgaatgcatcccccaggctatcctgggcatggacgtgctctgccaagcaaagtctggaatgggaaagaccgccgtgtttgtcctcgccactctgcaacagctcgagcccgtgaccggccaagtgtccgtccttgtgatgtgtcacacgcgagaactcgcttttcagatttccaaagaatatgagagattcagcaaatatatgccaaatgtcaaagtggccgtgttcttcggcggtttgagcattaaaaaagatgaagaggtgcttaaaaagaattgtccccatatagtcgtgggcacccccggacgaattctcgccctggcacgcaataaatccctgaaccttaaacacataaagcactttattttggacgagtgcgacaagatgctcgagcaactcgacatgcgaagggatgttcaggagatcttcagaatgacaccccacgagaagcaggtcatgatgtttagcgcaacactgtccaaggagattcggcctgtctgccggaaattcatgcaggatccaatggagatcttcgtggatgacgagaccaaactgacacttcatggcctgcagcaatactatgtgaagctcaaggataacgaaaagaaccggaaacttttcgatctgctggatgttctggaattcaaccaggtggtaatattcgttaagagtgtacaaagatgcatcgcactcgctcaactcttagtggaacagaacttccctgcgatcgccatacatcgtggtatgccacaggaggaaaggctgagccggtaccagcagtttaaggatttccagagacgcattcttgtcgcaaccaacttgttcggcagggggatggacatcgaaagagtgaacatcgccttcaactatgacatgcctgaagattctgatacttacttacatcgctgctaccccctgtctccctcacgatggcctgaacaagcagggctggcccctcgtgcttggctctctcatctgtgtcccatgaggatgatgccacgttcctctatgatgtgtaggattgcactccggtccatcctggtcagctgcctcatgcgctag

SEQ ID NO: 220233 - DNA, 711 bp, Artificial Sequence
  Description of Artificial Sequence: Synthetic coding sequence
atggccgaaaatgacgtggataacgagctgctcgattatgaggacgacgaagttgaaacagctgccggtggagatggagccgaagctccggctaaaaaggatgtcaagggcagttatgtgtcgatacatagctcaggttttagggactttctgttgaaaccagagctgctgagggcaattgtcgactgcgggtttgagcatccctctgaggttcagcatgaatgtattccgcaggccatactgggcatggacgtgttatgccaggctaagtctggcatgggtaaaacagccgtatttgtgcttgcgaccctccagcaactggagcccgtgacaggccaagtgagcgtactggtgatgtgtcacactcgcgagttagcctttcaaattagcaaggagtatgagcgcttctcaaaatacatgcccaatgtgaaggtggccgttttctttggaggactctccatcaaaaaagatgaggaagtgcttaagaaaaattgtccacatattgtggtcggaactccagggaggatcctagctcttgcaaggaataaaagcttaaacctgaagcacattaagcactttattctcgatgagtgcgataagatgttggagcagttggacatgagaagagacgttcaagaaatctttagaatgaccccacacgagaagcaggtgatgatgttcagcgcgacgctcagcaaggaaataaggtag

SEQ ID NO: 220234 - DNA, 738 bp, Artificial Sequence
  Description of Artificial Sequence: Synthetic coding sequence
atgtggacgatgagtagctggacaatgaagatgatgcggtggagacagcaactgggggaaatgggcttacgaccgctcccgaggcgtatgtctcgtgctcccatgtcccctagtaccgccttggccttcgtcaccagttgtagtagtcagtcttgcagcggcccactttctaccgtagcactgtcaatccgccaaaaggttgccgttttctttggtgggctctcaatcaagaaagacgaggaggtgctgaagaagaactgcccacacattgtggtggggaccccaggcaggattctcgcactcgccaggaataaaagtctgaacctcaagcacattaaacacttcattctggatgagtgcgacaaaatgcttgagcagctggacatgcgcagagatgtgcaagagatatttaggatgacaccacatgagaaacaggtcatgatgttttcggcgaccttgtcaaaagaaattcgccctgtttgcaggaaattcatgcaggacccaatggagattttcgtcgacgatgaaacgaaacttacactccacggcttgcagcaatactacgtgaagctgaaggacaatgagaaaaatcgcaagctgtttgacctccttgatgtcctggagttcaatcaggttgtgatcttcgtgaagtcagtacagaggtgtatagctttagctcagcttttggtggagcagaattttcctgcaatcgcaattcacagaggaatgccacagtag

SEQ ID NO: 220235 - DNA, 1287 bp, Artificial Sequence
  Description of Artificial Sequence: Synthetic coding sequence
atggccgagaatgatgtcgataacgaactgctcgactatgaggatgatgaggtggaaaccgcggctggaggggatggcgctgaggccccagccaaaaaggacgtgaaggggtcttacgtgagtattcactccagcgggttccgggacttcctgctgaaacccgagctgctgcgtgctatcgtcgactgtggattcgagcatccgtccgaggtacagcacgagtgcatccctcaagctattctggggatggatgtgttatgtcaggcaaagagtgggatgggcaaaactgccgtcttcgtgctggccaccctccagcaactggaacctgtgacaggacaagtctccgtgttggtaatgtgtcacacacgagaactggcctttcagatctccaaggaatacgagagattttccaagtacatgcctaatgtcaaggtggcggtgttttttggcggtctctctataaagaaggacgaggaagtcttgaaaaaaaattgtccccatatcgtagttggcacccccggaaggattctggccctagccagaaataaaagtttgaacctgaaacacatcaagcattttatactggatgaatgcgataaaatgctagagcagctagatatgcggagagacgtacaggaaatcttcaggatgacacctcacgagaagcaagtcatgatgttctccgccacattatccaaagagattaggccagtctgccgtaaatttatgcaggatccaatggagatcttcgtcgatgatgaaaccaagctgactctccacggactgcagcaatactatgtgaagcttaaggacaacgagaaaaacaggaagctcttcgacctgctggatgtattggaatttaaccaggtggttatttttgtcaagtctgttcagcggtgcatagctctggcgcagctcctggtggagcagaattttcccgctatagcaattcatcggggaatgccccaggaagagagattgtcccggtatcagcagttcaaagacttccagcgacgtattctggtggctacgaatttgtttggacgtggcatggatattgagcgggtaaacattgccttcaactacgacatgccagaagactccgatacatacctgcaccgtgttgcacgcgctggtcgatttggtacaaaggggcttgctatcacattcgtaagcgatgaaaatgatgcaaagatcctcaacgacgtacaagaccgatttgaggtgaatattagcgagctcccagacgaaatcgacataagctcttatatcgagcagacccggtag

SEQ ID NO: 220236 - DNA, 411 bp, Artificial Sequence
  Description of Artificial Sequence: Synthetic coding sequence
atgggcggtggacgcaggccatacgacgtctttttcagtaaggttatggccgaaaacgacgtggacaacgaactcctcgattacgaggacgacgaggtcgaaaccgctgccggaggagacggtgcggaggcccctgctaagaaggatgtgaaggggagttacgtgtctatccacagctcaggcttccgggatttcctgctcaaaccagagctgctgcgcgcaatcgtggactgcggattcgagcaccctagcgaagtgcagcacgaatgtatcccacaggcaatcctgggcatggatgtgctgtgtcaggctaagtccgggatgggcaagacggcagttttcgtgctggcaacactgcaacaacttgaaccagttacaggacaggtttccgtcctggtgatgtgtcattag

SEQ ID NO: 220237 - DNA, 987 bp, Artificial Sequence
  Description of Artificial Sequence: Synthetic coding sequence
tgagcaaccctgcaacagttggaaccagtcaccggccaggtttctgtgttggtgatgtgccatacgagagagctcgcgtttcaaatttccaaagagtacgaacgcttctcgaaatatatgcctaacgtgaaggttgcggtcttttttggaggactcagcattaaaaaggatgaggaggtgctgaaaaaaaattgtcctcatattgtggtgggcacgcccggtcgcattcttgctctggcccgaaataagagcctgaatcttaaacatatcaaacactttattttggacgaatgcgacaaaatgttggaacaacttgacatgaggagagatgtgcaggagattttccgcatgactccacacgagaagcaagtgatgatgttcagcgctacactcagtaaagagatccgccctgtgtgtagaaagttcatgcaggatcccatggagatcttcgttgatgacgagacaaaactcaccctgcacgggctgcagcagtattacgtgaaactcaaagataatgaaaagaacagaaaactgttcgaccttctcgacgtcttggaatttaatcaggtggtgatcttcgtcaagtctgtgcagagatgtattgccttagcccagttgcttgtggaacagaactttcccgcaatcgccatacatcggggtatgccgcaggaagagcgcctctcaagataccagcagttcaaggactttcagcgtcggatcctggtcgcaaccaacttgttcggacgcggtatggatatagagagagtgaacatcgcttttaactatgacatgcccgaggactctgacacgtacttacatagagtggctcgggcagggagatttggaactaaaggcttagccatcacctttgttagcgacgagaatgacgctaagattttaaatgatgtgcaggacaggtttgaagttaacattagcgaactgcccgatgaaatcgacatctcgtcatacattgaacaaactcgttag

SEQ ID NO: 220238 - DNA, 399 bp, Artificial Sequence
  Description of Artificial Sequence: Synthetic coding sequence
atggctgagaacgacgtggacaacgaattgctcgactatgaagacgatgaggtggagactgccgctggcggtgacggagcagaggcacctgcaaaaaaagacgttaaggggtcttatgtctctatccactcctcaggtttcagggacttcctactaaagcccgagttactccgggctattgtcgactgcggctttgagcatccaagtgaggttcagcacgaatgtataccccaggccatactggggatggatgtgctgtgccaggccaagtccggaatgggcaagaccgcagtctttgtgctggccacccttcagcagctggagcccgtgacagggcaagtgtgtttttgtgactcacatttcccacggggagacaatgaggaactgcatctgccttag

SEQ ID NO: 220239 - DNA, 420 bp, Artificial Sequence
  Description of Artificial Sequence: Synthetic coding sequence
atggcggaaaatgacgtagataatgaattacttgattatgaggatgacgaggtggaaacagcggctgggggagatggtgctgaagcaccagcaaaaaaggacgttaagggtagttatgtttcaattcacagcagtggatttcgcgatttcttacttaagcctgaactgttaagagccatcgtggactgtggattcgaacacccgagtgaggtgcagcacgagtgcataccacaggcaatactcggaatggatgtgctctgtcaggccaaaagcggtatgggtaagaccgcggtgttcgtgttggctacgttgcagcaactggaaccggtgactgggcagtcgcacgagcacatgaccagcgtaaccttggataacctcaccgcggttggggatgtgctttcccaagcctgggggtcctag

SEQ ID NO: 220240 - DNA, 717 bp, Artificial Sequence
  Description of Artificial Sequence: Synthetic coding sequence
atggccgagaacgatgtggacaacgagcttctagattacgaggacgacgaagttgaaacagctgcaggaggggacggagcagaagctcctgcgaagaaggatgtgaagggctcctacgtatcaatccactcttcgggcttcagggatttcctcttgaagccggagctcttacgggcaatcgtggattgtggatttgagcaccccagtgaggtgcagcacgagtgcatcccacaggcaatccttgggatggacgtcctatgccaggccaaatcaggaatgggcaagacagctgttttcgtgctggctacactccagcaattggaacccgtgactggtcaggtgtctgtactggtgatgtgccacactcgcgagctggcctttcagatctctaaagagtatgaacgcttttcaaagtacatgccaaatgtaaaggtagccgtcttcttcgggggactttcaattaaaaaggatgaagaagtactgaaaaaaaattgtccgcatatagtggtggggactccaggacgcatactggcactggcaagaaataaatctttgaacttgaaacacatcaaacacttcattcttgacgaatgtgataaaatgctagagcagctagacatgcgcagggatgtacaggaaattttcagaatgactccccatgagaaacaggtgatgatgtttagcgccaccctctcaaaggagatccgtcctgtgtag

SEQ ID NO: 220241 - DNA, 564 bp, Artificial Sequence
  Description of Artificial Sequence: Synthetic coding sequence
atgggttcgtcccacataggaggcctgtctattaacgagcggcgtagaagcgccagcctcggcctggtgatggcagaaaatgatgtcgacaacgagctgcttgattatgaagacgacgaggtggaaaccgcggctgggggagatggtgctgaagctcccgctaagaaggatgtcaagggctcgtatgttagcatccatagttctggtttcagagactttttgctgaaacccgagttattgcgggcaattgttgattgcggcttcgaacatcccagtgaagttcagcacgagtgcatacctcaggccattctgggcatggacgtgctttgtcaggccaagtccggcatgggaaaaacagcagtgtttgtgttagctacactgcagcagctagaacccgtgaccggccaggtgagcgtactggtaatgtgtcacactcgtgaactggcgtttcagatctccaaggaatacgagcgattttctaaatacatgcccaacgttaaagtggccgtctttttcgggggactttcgatcaagaaagacgaagaggtcctcaagaagaattag

SEQ ID NO: 220242 - DNA, 711 bp, Artificial Sequence
  Description of Artificial Sequence: Synthetic coding sequence
atggccgagaatgacgtggataacgagcttctggattacgaggatgatgaagttgagaccgccgcaggtggggacggtgcagaagcacctgctaaaaaagatgtcaagggcagttatgtgagcatccattctagcggcttcagggacttcctgctcaagcccgagcttttgcgtgcaattgtggattgcgggtttgaacaccccagcgaggttcaacatgaatgtatccctcaggctatactggggatggatgtgctgtgtcaggccaagagcggcatgggcaagactgccgtcttcgtgcttgccactctgcagcaactggagccggtgactgggcaggtttccgtgttggtcatgtgccacacacgcgagttggcattccagatttccaaagagtatgagcggttttcgaaatacatgccaaacgtgaaggtggccgttttctttgggggattgtccataaaaaaggacgaggaagtcctgaaaaaaaattgtcctcacatcgtggtgggcactcccggacgcatcctggccctggcaagaaataagtcgttaaacctgaagcacatcaagcacttcatactggacgagtgtgataagatgttggagcagctggacatgcggcgagatgtgcaggaaatattccggatgaccccgcatgagaaacaggtgatgatgttttccgccaccctcagcaaggagataagatag

SEQ ID NO: 220243 - DNA, 1278 bp, Artificial Sequence
  Description of Artificial Sequence: Synthetic coding sequence
atggctgaaaatgacgtggacaacgaattgctggactacgaagacgatgaagtggaaaccgctgcaggtggcgatggagccgaggcccctgcgaaaaaagacgtgaaggggtcatatgtgagcatccattcttccggattcagggacttccttctcaaaccggagctcttgagagcgatcgtcgactgtgggtttgagcatcccagtgaagtgcagcatgagtgtataccccaagctatcttgggaatggatgtcctctgtcaggcaaaatcagggatgggaaaaacagcggtgtttgtacttgcgaccctccagcagctggagcccgtcactggacaggtttcagtactcgtcatgtgccacacaagagaacttgcctttcaaatcagcaaagagtacgaacgtttttctaaatatatgcctaatgtgaaggtcgcagtgttctttggaggcctgtctattaaaaaagatgaggaggtcctgaaaaaaaactgcccccatatcgtcgtgggtacaccgggacgaatcttagccctggcgaggaacaagtcccttaacctgaagcatatcaaacacttcatactggacgaatgcgataaaatgttggagcagctggacatgcggagggatgtgcaggagatcttccggatgacaccccatgagaaacaagtgatgatgttttccgcgactctctccaaggagattcgtcctgtgtgcaggaaatttatgcaagaccccatggaaatttttgtggatgacgaaacaaagctgaccctgcacgggctgcagcagtactatgtcaagctcaaagataatgagaaaaaccgtaaactatttgacctgcttgacgtcctggagttcaaccaggtggtgatatttgttaagagtgtacagagatgcatcgcccttgcccagctgctcgtagagcagaacttccccgctatagctatacaccgcggtatgccacaggaggagaggttgtcccgttatcagcagttcaaggacttccagcgcagaatcctggtagccaccaatctgttcggccgtggtatggatattgaacgggtgaacattgctttcaactatgatatgcctgaggactctgacacttacttgcacaggtgttaccccctgtctccctctcgatggccagaacaggctggcctggccccacgggcatggttgtctcatctgtgtcccatgaggatgatgcccagatcttccatgatgtgtagaatcgcgctgcgtagcatactcgtttcatgcttgatgaggtag

SEQ ID NO: 220244 - DNA, 696 bp, Artificial Sequence
  Description of Artificial Sequence: Synthetic coding sequence
atggctgagaacgatgtcgacaatgagcttctggactatgaagatgatgaagtggagaccgccgcaggcggagatggagcagaggccccagctaaaaaggacgtgaaaggcagctacgtcagcattcatagttcagggttccgcgatttccttctcaagcctgaactcctcagagctatcgttgactgtggctttgagcaccctagtgaggttcagcacgaatgtattccgcaagcgatcctgggaatggatgtgctgtgtcaggcgaaaagcggaatggggaagaccgctgtatttgtcctcgcaaccctccagcagctggagcctgtgacgggccaggtatccgtactcgttatgtgccacacccgggaactggccttccagattagtaaagaatatgaaagatttagcaagtacatgcctaatgtaaaagttgccgtgttcttcggagggctctctatcaaaaaagatgaagaagtattaaagaagaattgtccgcatattgtggtcgggactccagggagaattctggcactcgcacggaacaagtcactgaacctgaaacatatcaaacattttattctggacgaatgtgacaagatgttagagcagctcgacatgcgaagagacgtccaagaaatttttcgcatgacgcctcatgagaaacaggttatgatgttcagcgccacactgtag

SEQ ID NO: 220245 - DNA, 99 bp, Artificial Sequence
  Description of Artificial Sequence: Synthetic coding sequence
tgagctaccctgcaacagctcgaacccgtcactggtcaggtttgtttctgtgactctcatttccctaggggggacaacgaagagctacatttgccctag

SEQ ID NO: 220246 - DNA, 399 bp, Artificial Sequence
  Description of Artificial Sequence: Synthetic coding sequence
atggcagagaacgacgtagacaatgagttattggattacgaggacgatgaggtggaaacagccgcaggaggcgacggtgctgaggcccctgcaaagaaagatgttaagggctcatatgtgagcattcactcttctggattcagggatttcctgcttaagcctgagctattgcgtgccatcgtggactgtggctttgagcacccatcagaggtccaacacgagtgtatccctcaagcaatactcgggatggacgtcctgtgccaggcaaaaagcggcatgggtaagactgcggttttcgtcctcgccaccctgcagcagttagaacctgtgaccgggcaggtctgcttttgcgacagccatttccccagaggcgacaacgaggagctgcatctaccttag

SEQ ID NO: 220247 - DNA, 399 bp, Artificial Sequence
  Description of Artificial Sequence: Synthetic coding sequence
atggcagaaaacgacgtcgacaatgagctgctggactacgaggatgacgaggtcgagaccgccgctggcggagatggagccgaggctcctgcgaaaaaagacgtgaagggaagctacgtgtctatccactccagtgggtttcgcgatttccttttaaaacccgaactcctccgggctatcgtggactgcggtttcgaacatcctagcgaggtacagcatgaatgtataccccaagctattctggggatggacgtactttgccaagcgaaaagcggtatgggaaagaccgcggtgttcgtgctggctacactgcagcagcttgagcctgtgaccggacaggtgtgcttttgtgattcacatttcccccgaggtgacaacgaagagcttcacctcccatag

SEQ ID NO: 220248 - DNA, 738 bp, Artificial Sequence
  Description of Artificial Sequence: Synthetic coding sequence
atgtggacaatgagcagctggaccatgaagatgatgagatggcgccagcaacttggcgagatggggctccgtccgctgcctagacgcatgtcaagagcccctatgagtcccagcacagctctcgctttcgtgacctcctgctccagtcagtcctgcagtgggccactgtcaacagtggccttgagtattagacagaaggtagcagttttctttggcggactttccatcaagaaggacgaggaagtgctcaaaaaaaactgtccccatatcgtcgtcggtacgcccggacgcatcctggcgcttgcgagaaacaagtcattaaatctgaagcatataaaacatttcattctagacgagtgcgacaaaatgttggagcagctggacatgaggcgcgacgtgcaagagatctttcggatgacaccccacgaaaagcaggtgatgatgttcagcgccaccttatctaaagaaattaggcccgtttgcaggaaattcatgcaggatccaatggagatcttcgtggacgacgagactaaactcacacttcacggcctgcagcagtactatgtgaaactgaaggacaatgagaagaaccggaaactgttcgacctgttagacgtcctagaatttaatcaagttgttattttcgttaaatctgtgcagcgatgtattgctctggcccagctcctggttgaacagaatttccccgctatagcaattcaccgaggcatgccacaatag

SEQ ID NO: 220249 - DNA, 696 bp, Artificial Sequence
  Description of Artificial Sequence: Synthetic coding sequence
atggccgaaaacgatgtggataatgagctgctcgactatgaagatgacgaagtagaaaccgctgccggaggagacggagccgaagcacctgctaagaaggacgtaaaagggtcttatgtgtccatccatagctcggggttcagggacttcctgctcaagccggagttgctgcgtgcaattgttgactgcggctttgaacacccaagcgaagttcaacacgaatgcatccctcaagctattctcggaatggacgtattgtgtcaggctaagagcggtatgggcaagaccgctgtcttcgtccttgccacactgcagcagctggaaccagtcactggccaggtgtcagtgctggtgatgtgtcacacacgtgagctcgcatttcagatctccaaagagtatgagagattctctaaatatatgccaaacgttaaggtggcagttttcttcggagggctaagtatcaagaaagacgaggaagtcttaaaaaaaaattgccctcacattgtggtgggaactccgggacgtatactggccttggctcgaaacaagtctctgaacctgaaacatataaaacattttatcctggacgaatgcgataaaatgctggagcagcttgacatgagaagggacgtccaggagatctttcgaatgactccgcacgagaaacaggtaatgatgttctccgctaccctttag

SEQ ID NO: 220250 - DNA, 732 bp, Artificial Sequence
  Description of Artificial Sequence: Synthetic coding sequence
atgtggactatgagtagctggactatgaagatgatgaggtggaggcagcagcttggtgagatgggcctaaggcctctgcctagaaggatgtctcgcgcacccatgagcccctcaacagctctagcattcgtaacttcatgttcctcccaaagttgctcaggtcctttgagcacggttgctctgagtatccgccagaaagtgtcagtcctagtgatgtgccatactcgggagctcgcttttcagatatctaaggagtacgagagattctcgaaatacatgcccaatgttaaggtggctgtgttttttggaggcctgtctatcaaaaaggacgaggaagttctgaaaaaaaactgtccccacatagtggtgggtacccctggtcggatcctggcactcgcccgaaataagagtctcaatctcaaacacattaagcacttcattctagatgagtgtgacaagatgctcgaacaattggacatgcgacgggacgtgcaagaaatattccggatgactccgcacgagaagcaggtgatgatgttctcagcaaccctgtctaaggagatcaggccggtttgccggaagttcatgcaggacgtcaacacattgctccctagcctgcctcccctgcctgctcggtgtctgttacccttcttagcgttattcctacggctcccatgtcattccagtgccaagaaggctgcctgcgcccaactgggcgtgatgactccttag

SEQ ID NO: 220251 - DNA, 1287 bp, Artificial Sequence
  Description of Artificial Sequence: Synthetic coding sequence
atggccgagaacgatgtggacaatgaactgttagactacgaagatgacgaagtcgagactgctgctggcggagacggcgcagaggcccctgcgaagaaggacgtgaaaggcagctatgtgtcaatccactcgagtggtttccgcgacttcctcctgaagccagaactgctgcgggctatcgttgactgcgggttcgagcacccatctgaagttcagcacgagtgcatcccacaagcaatcctgggaatggatgtgctatgccaggcaaagtccggcatgggaaaaaccgccgtcttcgttctggcaacgctgcaacagctggagccagtcactggacaggttagcgttctcgtgatgtgccacacgcgagaactggcatttcagatctcgaaggagtacgagaggttttctaagtatatgccaaacgtcaaggtggctgtgtttttcgggggtttgtccattaaaaaagatgaagaagttcttaagaaaaattgtcctcacatcgtggtgggtacaccaggcagaattctggctctcgcacgcaacaagtccctgaatttgaagcatattaagcattttatcctcgacgagtgcgacaagatgctcgagcaactggacatgaggagagatgtccaagagatcttcaggatgacaccacacgagaaacaggtgatgatgttctctgcaactctctctaaagagattcgccctgtgtgcaggaagttcatgcaggatcccatggaaattttcgtcgacgacgaaacgaagttgaccttgcacggcctgcagcagtattatgtgaagctgaaagacaatgagaagaacaggaagctgtttgacttgctcgacgtactggagttcaaccaggtagtgatattcgtaaagtctgtccagcgctgcatcgcactcgcccagttgctcgttgagcagaattttcctgctatcgctattcatcgcggaatgccccaggaggagcggctttcaagataccagcagtttaaggacttccagcgtagaatcctggttgcaacaaacctctttggaagagggatggacatagagcgcgtgaatatagcatttaattatgatatgccagaggatagtgatacttatttgcacagagtggccagagccggacggtttgggacaaaagggttggccattacgtttgttagcgacgagaatgacgcaaagatactcaatgacgtccaagaccgcttcgaggtgaacatctctgagctgccagacgagatcgacatctcctcgtacattgagcagactaggtag

SEQ ID NO: 220252 - DNA, 1278 bp, Artificial Sequence
  Description of Artificial Sequence: Synthetic coding sequence
atggcggaaaacgatgtcgataacgagctgctggattacgaggacgatgaagtcgagaccgctgccggaggggatggagcagaggcaccggctaagaaggacgtgaagggaagttatgtatccatccattcctcagggtttagggatttcttactgaagcctgagctgcttcgcgcaattgtggactgcggcttcgagcatccctctgaggttcagcacgaatgtatccctcaggccatcctcggcatggacgtcttgtgccaggctaagtcagggatgggcaagaccgccgtgtttgtattagcaaccctgcagcaactggagcccgtgactggccaggtgagcgttctggtcatgtgtcataccagggaactggcttttcaaatctccaaggagtacgaacggttctctaaatacatgcccaacgtcaaggtcgctgtcttttttggtggactgtccatcaaaaaagacgaggaggtcctcaagaaaaattgcccacacatcgtcgtgggtacacctggtcgtatactggcattggcccgaaataagagtcttaatctgaagcacattaagcattttattctagacgaatgcgacaagatgcttgaacagcttgatatgaggcgcgacgttcaggagatcttccgaatgacacctcacgaaaagcaggtgatgatgtttagcgcaacactctccaaggagatccgaccggtgtgcaggaagttcatgcaggaccccatggaaatatttgttgatgacgagacaaagctgaccctgcatggcctgcaacagtactatgttaagttgaaggacaacgagaagaaccgcaagctgttcgacctactcgatgttttggagttcaatcaggtggtgatatttgtcaaatccgttcagaggtgcatcgcactggcccagttgctggtggaacagaatttcccagcaatcgccattcacagagggatgccccaggaggagcgtctttctcggtatcagcagttcaaagatttccaacgcaggattctggtggctacaaatctgttcggaaggggcatggatatcgaaagggtcaacatagcattcaactacgatatgccggaagactcagacacttatttgcataggtgttaccccctgtcaccctctagatggccagagcaggctgggctcgcacctcgagcgtggctcagccacttgtgtccgatgagaatgatgcccaggtcgagcatgatgtgccgaatcgccctacgttccatcctggtaagctgcctgatgcgctag

SEQ ID NO: 220253 - DNA, 291 bp, Artificial Sequence
  Description of Artificial Sequence: Synthetic coding sequence
atggctgaaaacgatgtagacaatgaattgttagattacgaagatgacgaagtggagactgcagccggaggagacggcgcagaagctccagccaagaaggacgtgaaaggatcctatgtatcaattcactcgagcggattcagagattttctgttaaaaccagagcttctgcgcgcaatcgtggattgcggctttgaacatccctcagaggttcagcacgagtgcattcctcaggctatcctcggtatggacgtcctctgccaggcaaagtctgggatgggcaagacctag

SEQ ID NO: 220254 - DNA, 411 bp, Artificial Sequence
  Description of Artificial Sequence: Synthetic coding sequence
atgggcggtggcagacgaccatatgacgtcttctttagtaaggtgatggccgagaacgatgtggacaatgagctcctggattatgaggatgatgaggtcgaaaccgctgcgggaggggacggggctgaggctcctgctaagaaagatgtaaagggatcttacgtgtctatccatagttctgggttccgcgatttcctgttaaaaccagagctgctgcgagcaatcgtggattgcggctttgaacacccgtcggaagtgcagcacgagtgcatcccacaggcaatcctgggaatggatgttctgtgtcaggctaagagcgggatgggtaagaccgccgtttttgtcttggccacactgcagcagcttgagcccgtgactggccaggtctcagtgcttgtgatgtgtcattag

SEQ ID NO: 220255 - DNA, 564 bp, Artificial Sequence
  Description of Artificial Sequence: Synthetic coding sequence
tagtctgaggaacgagacattggcaagccaatggaaatctttgtggacgacgaaaccaagcttaccttgcacggcctgcagcaatactacgttaaactcaaggacaacgaaaagaatcgcaagctctttgacctgcttgacgtgctggaattcaaccaggttgttatctttgttaagtcggttcagaggtgcatcgccttggcccagttgttagtcgagcagaacttccccgcaattgctatccacagaggcatgccccaggaagagaggttaagccgataccaacagtttaaagacttccagagacgaattcttgtcgcgacaaatctttttggcaggggcatggatatagagcgtgtgaacatcgcctttaattacgacatgcccgaggattccgatacttacctgcatagggtggctcgcgctgggaggttcggaacaaaaggattggccatcactttcgtcagtgatgaaaacgacgctaaaattctgaatgacgttcaggatcgtttcgaagtcaacatttcagaactgcccgacgagattgatatcagttcttactag

SEQ ID NO: 220256 - DNA, 717 bp, Artificial Sequence
  Description of Artificial Sequence: Synthetic coding sequence
atggctgaaaatgatgtcgacaacgaattactggattacgaagacgacgaggtggagactgcagcaggtggcgatggagccgaagcccctgctaaaaaagatgttaagggcagctatgtatcgatccattcaagtggattcagggactttttgctgaaaccagagctactgagagcaatcgtggactgtggctttgaacacccgagtgaagtgcagcacgaatgcatccctcaagccattctggggatggatgtgttgtgtcaggctaagtccggaatgggcaaaactgccgtgttcgtactggccacacttcaacagctggaacctgtcactggtcaggtcagcgtattagttatgtgtcacaccagagaacttgcgttccagatctcaaaagagtatgagcgcttctccaagtatatgcccaatgttaaggtagccgtgttcttcgggggtctgtcaattaagaaggatgaagaggtgctgaagaagaactgccctcacatcgttgtcgggactcctggcaggatccttgccctcgccagaaacaaatcactgaatctcaagcatatcaaacacttcattctggatgaatgcgacaaaatgttagaacagctggatatgcgaagagatgtacaggagatcttcagaatgactccacatgaaaaacaggtgatgatgttcagtgctaccttatccaaggagatacggcctgtttag

SEQ ID NO: 220257 - DNA, 417 bp, Artificial Sequence
  Description of Artificial Sequence: Synthetic coding sequence
tgagccaccctgcagcagctagagcccgtgaccgggcaggtttccgtacttgtcatgtgccatacacgggagctggcctttcaaatcagcaaagaatatgaacgctttagcaaatatatgccaaatgtcaaagtggcagtcttctttggcggtctgtccatcaagaaggatgaagaagtgctaaaaaagaattgccctcacattgtggtgggcaccccaggacggattcttgcgcttgccagaaacaaaagcctgaacctaaagcacatcaagcatttcatcttggatgaatgcgacaagatgttagagcaactggacatgcgacgggatgtacaggaaattttccgcatgacacctcatgagaaacaggtgatgatgttttcggcaaccttgagcaaagaaattaggcccgtctag

SEQ ID NO: 220258 - DNA, 870 bp, Artificial Sequence
  Description of Artificial Sequence: Synthetic coding sequence
atggctgagaacgacgtggacaatgagcttctagactacgaagacgacgaagtcgaaactgcggctggtggcgatggtgcagaggccccagccaagaaggatgtgaagggatcttatgtcagcattcactcgagtggcttcagagattttctcctgaagccagagctcctgagagctatagtggattgtggctttgaacacccctcggaggtgcagcatgaatgcatccctcaggctattctgggcatggatgtcctctgtcaagccaaatcagggatggggaaaacggctgtgttcgtcttggccacccttcagcaactggagccagtcactggacaggtgtccgtcctcgtcatgtgccatacaagagagctcgccttccagatctcaaaagagtatgagaggttcagcaagtacatgccaaacgtcaaggtggcggtcttttttggcggactgtcaatcaagaaagacgaagaagtcctcaagaaaaattgtcctcacatcgtagtaggaactcccggacgaatcctcgcgctggcccgaaacaagtctttgaacctcaaacatattaagcatttcattctggacgagtgcgacaagatgctggagcagctggatatgagacgggatgtgcaggaaatcttcaggatgactccccacgaaaagcaggtcatgatgttcagtgcaactctctcgaaagagatccgtcctgtttgcagaaaatttatgcaggacccaatggagatattcgtagatgatgaaacaaagctcaccctccatggcctccagcagtactatgtgaaactgaaagataatgagaagaatcgcaagctgtttgatctgctggacgtcttggagtttaaccaatag

SEQ ID NO: 220259 - DNA, 1287 bp, Artificial Sequence
  Description of Artificial Sequence: Synthetic coding sequence
atggcagaaaacgacgtggacaatgaattgcttgattatgaggacgatgaagtggaaactgccgctggcggtgatggagcagaagctcccgcaaaaaaagacgttaaggggagctatgtttcaattcacagttccggattccgggacttcctgctaaagcctgagctgctgcgggctatcgttgactgcgggtttgagcacccgtccgaagttcagcacgaatgcataccacaggccattctgggcatggatgtcttatgccaggccaaatccggaatgggtaagactgctgtgttcgtgctggccacactccagcagctcgagcccgttaccggacaagtgtccgtccttgttatgtgtcatactcgagagctagcatttcagatctctaaagaatatgaacgattcagcaagtacatgccaaatgtgaaggtggctgtgttcttcggagggctttcaataaagaaggacgaagaggttttaaagaaaaactgcccccatatagtggtcgggacaccgggtcgaattcttgcactggcccgtaacaaaagtctaaacctcaagcacataaagcattttatactggatgagtgtgataaaatgctggagcagttagatatgcgcagagacgttcaagagatattcagaatgactccacacgagaaacaggttatgatgtttagcgccacactgtctaaggagattaggccagtgtgcaggaagtttatgcaagacccgatggaaatttttgtagacgatgagacgaagctgacactacatggcctgcagcaatactacgttaaattgaaggacaacgagaaaaatagaaagttgttcgacctgcttgacgttctggagtttaatcaggtggtgatctttgtgaagagcgtgcagcgctgtatcgctttggcacaactcctggtcgagcaaaattttcccgctatcgctattcacagaggcatgccacaagaagagcggctgagccgatatcagcaatttaaagactttcagcgccgtatattggtggcaacgaacctgttcggaaggggaatggatattgaaagggtgaatattgcttttaattacgacatgccagaagacagtgacacctacctccaccgggtggcaagagcaggaagattcggcacgaagggattggccattaccttcgttagtgatgagaacgatgcgaaaatactcaatgatgtgcaggaccgattcgaagtgaatattagcgagctgcccgacgaaattgatatttcatcgtatattgaacagacacggtag

SEQ ID NO: 220260 - DNA, 696 bp, Artificial Sequence
  Description of Artificial Sequence: Synthetic coding sequence
atggccgagaacgacgtcgataacgagctgctagattatgaggacgacgaggtcgagactgcagcaggaggcgacggtgccgaagccccagccaagaaggacgtgaaggggtcctacgtttcaattcacagtagtggctttagagattttcttctaaagccagagcttctaagggccattgttgactgcggcttcgagcacccaagcgaagttcagcacgaatgcatcccccaggctattttaggcatggacgtgctctgccaagccaagagtggaatgggcaaaacggccgtgtttgtccttgccactctgcagcagctagagccagtcacgggacaagtttccgtgctggtgatgtgtcacacgcgcgaactcgccttccagatctctaaggagtacgagcgcttctcaaagtacatgcctaacgtgaaagtcgccgttttttttggcggactcagtataaagaaagatgaggaggtgctgaagaagaactgcccccacattgttgtgggcacgcctggtagaattctggcgctcgccaggaacaagagcctgaatctcaaacacattaagcattttatcttagacgagtgtgacaagatgcttgaacagttggacatgcggcgtgacgtccaagagatcttcagaatgacaccgcacgagaagcaggtgatgatgttcagcgcaacgctgtag

SEQ ID NO: 220261 - DNA, 1287 bp, Artificial Sequence
  Description of Artificial Sequence: Synthetic coding sequence
atggccgagaatgatgtcgataacgagctactggactatgaggacgacgaagtagagaccgctgctgggggtgacggcgctgaagcaccggcaaagaaggatgtcaagggaagctatgtttccatacatagcagtgggtttcgagatttcctcctgaaaccggagctgctccgggctatcgttgactgtggctttgagcatccttccgaagtccaacatgagtgcatccctcaggccatcctaggcatggatgtgctctgccaggccaagtctggtatggggaagacggcggtcttcgtactcgccacgcttcagcagctcgagcccgtgacaggacaggtgtccgtgctggttatgtgtcatacccgagagctagctttccagatctctaaggaatacgagcgcttctctaaatatatgcccaacgttaaggtggccgtcttcttcggaggtttatccattaagaaagacgaggaggtgttgaaaaaaaactgcccgcacatcgtggtaggtacacccggacgaatcctggccctcgccaggaataagtccctgaatctcaaacacatcaagcatttcatcctggatgaatgtgacaaaatgcttgagcagttagacatgcgccgagacgtccaagagatctttcgaatgacccctcatgaaaaacaggttatgatgttcagtgctacgttgtcgaaagagattagaccagtgtgccgtaaattcatgcaagacccgatggaaatttttgtggacgacgagaccaaactcaccttacatggcctccagcaatattatgtgaaactgaaagacaatgagaaaaaccgaaagctattcgatttactcgacgtattggagttcaaccaggtggtgatctttgtgaaaagcgtccaaagatgcattgctctggctcaactgctcgtggagcagaactttcctgctatcgccatccatcgaggcatgccccaagaagagcggctcagtagataccagcagttcaaagacttccaacgtcggattttggtagcaacaaatttgtttggccgtggcatggacatcgaaagggtgaatatcgcattcaattacgacatgcctgaggactctgatacctatctgcatagagtggccagggcagggaggttcggtactaagggactggccataacctttgtgagcgacgaaaatgacgcaaagattttgaatgatgttcaggataggtttgaggtgaacattagtgaactgccagatgaaattgacatctcctcatacatcgagcagacaaggtag

SEQ ID NO: 220262 - DNA, 378 bp, Artificial Sequence
  Description of Artificial Sequence: Synthetic coding sequence
atggcagagaacgacgtggataatgaactgctggattacgaagatgacgaagtcgaaactgccgctggtggggatggcgcagaggcccctgccaagaaggatgttaaaggcagttacgtatctatacactctagcggatttcgcgattttctactgaagcccgagctcctgcgcgctatcgtggactgtggttttgaacacccttcagaggtccagcacgaatgcatccctcaggctatcctgggcatggacgtcctctgccaggccaaatccggaatgggcaaaactgcagtcttcgtgctcgcaactctgcaacaacttgagcctgtgactgggcaggtctcggtgttagtcatgtgtcacactcgagaactctag

SEQ ID NO: 220263 - DNA, 294 bp, Artificial Sequence
  Description of Artificial Sequence: Synthetic coding sequence
taggccaccctccagcagttagaacccgtgacagggcaggtgtgtttctgcgattcccactttcccagaggtgacaacgaggagctccatctcccctacgtgtccgtgtattttctgcccaaggtaagcgtgttggtcatgtgccacacccgggaactcgcatttcagatcagcaaggagtatgaacggttcagcaagtatatgcccaacgtcaaggttgctgtctttttcggaggtttgtccatcaagaaggacgaggaggtcttgaagaagaattgcccacacatcgtgtag

SEQ ID NO: 220264 - DNA, 291 bp, Artificial Sequence
  Description of Artificial Sequence: Synthetic coding sequence
atggcagaaaatgatgtcgataatgagctcctggattatgaagatgatgaggtcgaaaccgccgctgggggagacggcgctgaggcacccgcaaagaaggacgtgaagggttcttatgtgtccatacatagttcaggcttccgtgacttccttctgaagcccgagttgcttagagccattgtggattgtggctttgaacatccttccgaggtgcagcacgaatgtatcccccaggctattctcggcatggatgttctctgtcaggccaagagtgggatgggcaagacctag

SEQ ID NO: 220265 - DNA, 291 bp, Artificial Sequence
  Description of Artificial Sequence: Synthetic coding sequence
atggcagaaaacgacgtggataatgagttactcgactatgaggatgatgaggtagaaacagcggcaggtggtgatggagccgaagccccagcaaaaaaggatgttaaaggcagctatgtgagtattcacagttctggattcagagatttcctgcttaaaccagaactcctgcgagctatagtagactgcggcttcgagcacccttccgaggtgcagcatgaatgcatcccacaggcaatcctgggaatggacgtcttatgccaagcaaagtcagggatgggaaagacctag

SEQ ID NO: 220266 - DNA, 1287 bp, Artificial Sequence
  Description of Artificial Sequence: Synthetic coding sequence
atggcagagaacgacgtcgataacgagctcctggattacgaagatgatgaggtggaaactgcagcgggtggagacggcgctgaggcacccgctaagaaggacgtcaagggttcctatgtctctatccattcttccggcttcagggatttcctcttgaaacccgagcttcttagagccatagtggactgtggcttcgaacacccaagcgaggttcaacacgagtgtatccctcaggctatactcggaatggacgtcctctgccaggccaaatccggaatgggcaagaccgcggtattcgtgctagccacactgcagcagctggagcctgtgacggggcaggtgagtgtgctggtgatgtgtcataccagggagctggcgtttcagatcagcaaagaatacgagcgtttcagtaagtatatgcctaatgtgaaagtggcggtctttttcggaggactgtcaataaaaaaagacgaagaagtcctcaagaaaaactgtcctcacatcgttgtgggtactccgggtaggatcctcgccctcgcgagaaataagtctttgaacctcaaacacataaaacacttcatcctggacgaatgcgataagatgctcgagcaattggacatgaggcgggatgtgcaggagatttttcggatgactcctcacgagaagcaagtgatgatgtttagtgctaccttatcaaaggagatccggcctgtctgccgtaaattcatgcaggaccctatggagatctttgtggatgatgaaacaaaattgaccctgcatgggttgcaacaatattatgtcaagctcaaagacaacgagaaaaaccggaagctgttcgacctgctcgacgtgctcgagttcaaccaggtggtgatattcgtaaagtctgtgcaaaggtgtattgccctggcccaactgctggtagagcaaaacttcccagccattgccatccaccgtggcatgccccaagaggaaaggctaagccgttaccagcagttcaaagacttccagaggcgaatcctggtggcaaccaatttattcggcagagggatggatatcgaacgcgtaaatatcgccttcaattacgatatgcccgaagactctgacacctacttgcaccgcgtagccagagcaggacgctttgggacaaagggacttgccatcacatttgtatccgacgaaaacgacgcaaagatcctgaatgatgttcaggaccgcttcgaggtcaacatctctgaactgccagatgaaatagacatctcttcctacattgagcagacgcgctag

SEQ ID NO: 220267 - DNA, 732 bp, Artificial Sequence
  Description of Artificial Sequence: Synthetic coding sequence
atgtggactatgagttcctggactatgaagatgatgcggtggcggcagcagctgggtgagatgggattgcgccctcttccaagacggatgagtagagccccaatgtccccaagtacggcattggccttcgtgacctcctgctccagtcagtcctgcagcggccctctctcgacagtggctctgtccataaggcagaaggtgtcagttctggtcatgtgccacactagggagctggccttccagatatccaaagaatacgaacgattctccaaatatatgccaaacgtgaaggtcgccgtgtttttcggtggactgtccataaagaaggatgaggaagttcttaagaagaactgccctcatattgtcgtcgggacacccggacgtattctggctctagcacgaaacaaaagcctgaatcttaagcatattaagcactttatcctagatgagtgtgataaaatgctggagcagttagatatgcgcagagatgtgcaggagatttttcggatgacaccacatgaaaagcaggtcatgatgttctcagccacactgagcaaggagattcggccagtgtgtaggaaattcatgcaggatgtgaatacactgctcccttctttaccccctctgcccgcaagatgtttgctaccttttcttgcgctattcctgcgcttgccttgccactccagcgccaaaaaagctgcctgtgcacagctgggtgttatgaccccatag

SEQ ID NO: 220268 - DNA, 972 bp, Artificial Sequence
  Description of Artificial Sequence: Synthetic coding sequence
atggcagagaatgacgttgacaacgagctcctggactatgaagatgatgaggtcgagacggcagcgggaggcgatggcgctgaagctcccgctaaaaaggatgtgaaaggatcctacgtgtccatacattcaagcggatttcgcgatttcctactaaaaccagagctgctgagggctattgttgactgtggtttcgagcatccatccgaggtccagcacgagtgcatccctcaggcgatcttggggatggacgtgctgtgtcaggccaagagcgggatgggtaaaaccgccgtttttgtgctagcgaccctacaacaacttgagccggttacaggacaggtgtcagtgctcgtcatgtgccacacccgcgagctggctttccaaattagcaaagaatacgaacgattctcaaagtacatgccaaacgtaaaagtagccgtctttttcgggggtctgtctattaaaaaggacgaagaggtgctgaagaagaactgtccacacattgtggtgggcacaccaggacgcatcctcgccctggccagaaacaagtcactgaacctgaaacatattaagcatttcatactagacgagtgcgacaaaatgcttgaacagctggatatgagacgtgacgtccaagaaatcttcaggatgacacctcacgagaagcaagtgatgatgttttcagcaaccttaagcaaggaaatcaggcccgtgtgccggaaattcatgcaggaccccatggaaatctttgtggatgatgagactaaactgacactacatggcctgcagcaatattacgttaaattaaaagacaatgagaaaaataggaaactatttgatctgctcgacgtgctcgagttcaatcaggagattacctgcaaatcagtccagcgtttcagcaccaccaattcttgtggctaccagccaatttggccacgacacggtcacagagcaggggaacactgcttctag

SEQ ID NO: 220269 - DNA, 972 bp, Artificial Sequence
  Description of Artificial Sequence: Synthetic coding sequence
atggccgagaatgatgttgacaacgagctgctggattacgaggacgatgaggttgagaccgcggctggcggagatggggctgaggccccagctaagaaggatgtgaagggcagttacgtttcaatccactctagtggattcagagattttctgctcaagcccgaactcctgcgcgctatcgtggattgtggcttcgagcacccatccgaggtccagcatgaatgcattcctcaggcgatcttagggatggacgtcctgtgtcaggctaaatcaggtatgggtaaaacagccgtatttgtactcgcaacattacagcagttggagcccgtgacaggccaagtttctgttctcgtaatgtgtcatacacgtgagctcgcctttcagatctctaaggagtacgagagatttagtaagtacatgcccaatgtcaaagtggcggtgttttttgggggtctcagcatcaagaaggatgaagaagtgttaaagaagaactgtccacatattgtcgttggcacaccaggcagaattctcgcgctcgccaggaataaatctctgaatctgaaacacatcaaacactttatcttagacgagtgtgacaagatgttggagcagctggatatgagaagagatgtgcaggagattttccggatgaccccccatgagaaacaggtcatgatgttctctgcaaccctttccaaggagattcgacccgtgtgcaggaaattcatgcaggaccccatggagatctttgtggacgatgagactaaactaacattacatggacttcaacagtattacgtgaagctaaaggacaacgagaaaaatcggaagctcttcgatctactggatgttctggagttcaaccaagagatcacctgcaaatctgtgcagcgcttctccacaacaaattcttgcggatatcagccgatttggccacgacatggacacagggctggagagcattgtttttag

SEQ ID NO: 220270 - DNA, 1332 bp, Artificial Sequence
  Description of Artificial Sequence: Synthetic coding sequence
atggccgaaaacgacgtagataacgaactcctggattacgaggacgacgaggtggagaccgcggctggtggcgatggggctgaagccccagctaaaaaggatgtcaaaggctcctatgtctcaatccacagctcagggtttcgggacttccttctgaaaccagaactgttgagagccatcgttgattgcgggtttgaacacccttcagaagtgcagcacgaatgcatccctcaggccatactaggaatggatgtgctgtgccaggccaagtcaggtatgggcaagacagcagtctttgtgctggcgaccttgcagcagttagagcctgtcacaggacaggtgtacctgggcagggtgttaggcagaggcttctggtgcgtattcgtgtcggtgctggtgatgtgtcacacccgcgagctggcgtttcagatttcgaaagagtatgaaagattcagtaagtatatgccaaatgtgaaggtggcagtcttcttcggtggtctgtctataaagaaggatgaagaagtgctgaagaagaactgccctcacatcgtggttggcacacccggaaggatcctggccctggcccgtaataaatccctcaacctgaagcacattaagcatttcatactcgatgagtgtgataaaatgctggagcagttggacatgcgcagggacgtccaggagatctttaggatgaccccgcatgagaaacaggtcatgatgtttagcgcaacgctgtccaaagaaattagacctgtctgccgaaagttcatgcaagatcccatggagatctttgttgatgacgaaaccaaactcactctgcacggtctgcaacagtactacgtcaagcttaaagacaatgaaaaaaacaggaagctgttcgatctcctggacgtgctggaattcaaccaagtcgtgatattcgtgaaaagcgtccagaggtgcattgcactggctcagctgttggtagaacagaacttccccgcaatcgctattcatcggggaatgcctcaggaggagaggctgtccaggtaccagcagtttaaagattttcaacgcagaatcctagtagccacgaacctgttcggcagagggatggacattgaaagggtcaacattgctttcaattacgatatgcccgaggattctgatacatacttgcatcgtgttgcgagagccggaaggtttggaactaaaggtttggcgataactttcgtgtccgacgagaacgacgccaagatcctgaatgacgtgcaagataggttcgaagttaatatatccgaactgcctgatgaaatcgacatcagctcttatatcgagcagacacgctag

SEQ ID NO: 220271 - DNA, 732 bp, Artificial Sequence
  Description of Artificial Sequence: Synthetic coding sequence
atgtggaccatgagtagctggacaatgaagatgatgcgttggagacagcaactgggagaaatgggacttaggcccctccccaggcggatgagcagggcacctatgtctccctcgacagcactggcctttgtgacaagctgtagctcccagtcttgctcagggccactgagcacagtggcattaagcattcggcaaaaagtaagcgtgctggtcatgtgtcacacacgcgagctggctttccagatctccaaggaatatgagcgatttagtaagtacatgcccaatgtgaaagtcgccgtattcttcgggggattatcaattaagaaagatgaagaagtactcaagaagaactgcccgcacattgtcgtcggaactcctggcagaattcttgctctcgctcggaacaagtcactgaacctaaagcatataaaacactttatactagacgaatgcgataagatgctcgaacagctggacatgagacgagatgtccaagagatttttcgcatgacacctcacgaaaaacaggtgatgatgtttagcgccactctctctaaggagatccgacccgtttgtcgcaaatttatgcaggacgttaacaccctgcttccgagcctgccaccacttcccgctagatgcctcctgccgtttctggccctctttttaagactgccctgccactcttctgccaaaaaagccgcatgtgcacagctgggagtcatgaccccatag

SEQ ID NO: 220272 - DNA, 1332 bp, Artificial Sequence
  Description of Artificial Sequence: Synthetic coding sequence
atggcggagaatgatgtagataatgagctgttggattacgaagatgacgaggttgagactgcggctgggggagatggggctgaggcgccagcaaagaaagacgtgaaaggctcctatgtttccatccatagcagcggcttccgcgattttctgctcaagcccgagctcctgcgagctatagtggactgtgggtttgagcacccctctgaggtccaacacgaatgcattcctcaagccattcttggcatggatgttttgtgccaggccaaatcgggaatgggcaaaacagcagtatttgtactggccactcttcagcagctggagccagtcaccggacaagtatatctcggaagggttctgggcaggggcttttggtgtgtgttcgtatccgtccttgttatgtgtcatacgagagaactcgccttccaaatctcaaaggagtatgagagatttagcaagtacatgcccaatgtcaaggtggcagtgtttttcggtgggctttctatcaagaaggacgaggaggtgttgaaaaagaattgtccgcatatcgtagtcggcactccaggtcgtatactagcactggctagaaataaaagcttaaacttaaaacacataaaacacttcattctggatgagtgcgacaaaatgttggagcaactggatatgcggagagacgtgcaggagatattccggatgacacctcatgaaaaacaggttatgatgttctccgccaccctgtcaaaagagatcagacccgtttgtagaaaattcatgcaggaccctatggagatattcgttgacgacgaaacgaaactcaccctgcacggtttacaacaatattatgtcaagctgaaagacaacgaaaagaacaggaaactgttcgatctgctggatgttctagagttcaaccaggtggtaatttttgttaaatccgtacagcgctgtattgctcttgcacagttgctggttgagcagaacttccccgctatcgcaatacaccgcggaatgcctcaagaagagcgattgagccgctaccagcaattcaaggacttccagagacgaatcttggtggccacgaacctcttcggcagaggcatggatatagagagggtcaatattgccttcaattatgacatgcccgaagatagcgatacctatctccacagagtggctcgtgctgggagattcggcacaaaggggctggcaataacattcgtatcagacgaaaacgacgcaaagatcctgaacgacgtccaagaccgcttcgaggtgaacatctcagagctgccggatgagatcgacatctcctcctacattgagcagacccgctag

SEQ ID NO: 220273 - DNA, 420 bp, Artificial Sequence
  Description of Artificial Sequence: Synthetic coding sequence
atggccgagaacgacgtggacaatgagctgctcgactacgaagatgatgaagtagagacagcagccggtggagacggcgcagaggctcctgcgaagaaagatgtcaagggcagctatgtgagcatccactcgtcaggctttagagacttcttgctaaaacccgagctgcttcgtgcaattgtggattgtggtttcgagcaccccagcgaggttcagcacgaatgcatcccacaagctattttggggatggacgtgctgtgtcaggccaagtccggcatgggcaagactgccgtgtttgtgcttgccaccctgcaacagctggagccagttacaggacagtctcacgagcatatgacatctgttacccttgataacttgactgccgtgggcgacgttttgtcacaggcctggggttcctag

SEQ ID NO: 220274 - DNA, 732 bp, Artificial Sequence
  Description of Artificial Sequence: Synthetic coding sequence
atgtggacaatgtcctcttggactatgaagatgatgaggtggcgtcagcagctcggagaaatggggctccgccctttgccacggcgaatgtcccgggcacccatgtccccctcaaccgctttggccttcgtcacgtcctgttcttcgcagagttgttctggcccacttagtactgttgccctgtccatccgtcagaaggtctcagtcttggtgatgtgccatacccgggagctcgctttccagatatctaaagagtacgagcggttctccaagtatatgccaaatgtaaaagtggcagttttcttcggcggtctaagcatcaagaaagatgaggaagtccttaaaaaaaactgcccacatattgtggtcggcacccccggtaggatcctcgccttagccagaaataaatctctcaaccttaaacatatcaagcatttcatccttgacgagtgcgataaaatgcttgaacagcttgatatgaggcgagacgtccaggagatattcagaatgacccctcatgagaagcaggtgatgatgttttctgccactctcagcaaagagattcgcccagtgtgcaggaagtttatgcaagatgtcaatactttacttcctagcctcccacctctgcccgctagatgcctgcttcccttcctggccctatttctaagactcccctgccattcatccgcaaagaaggccgcttgcgctcagttgggggtgatgaccccatag

SEQ ID NO: 220275 - DNA, 732 bp, Artificial Sequence
  Description of Artificial Sequence: Synthetic coding sequence
atgtggactatgtccagctggacaatgaaaatgatgaggtggaggcagcagctaggcgagatggggctgcggccactgccacgcagaatgtcgcgagcacccatgtctccatccaccgcccttgcttttgtgaccagctgtagttcacagagctgcagcggacctttaagcaccgtggcactttcaattaggcagaaggtttccgtcctggtgatgtgtcacacaagagaactggcctttcaaatcagcaaggaatacgagagatttagcaaatatatgcctaacgtgaaggtcgctgtgttcttcggtggcctgtccatcaagaaagatgaagaagtcctgaaaaagaactgtcctcacatcgtagtaggtaccccgggacgcatcctggctctggccaggaacaagagtctgaacctgaagcacatcaagcactttattctggacgaatgtgataagatgctcgaacagttggatatgcgccgtgatgttcaggagatctttcgtatgaccccccacgagaagcaggtgatgatgttttctgccacgttatcaaaggagattaggcctgtgtgtcgtaaatttatgcaggacgtaaacacactgctgccctccctgccccctctcccagcgagatgtctgttgcccttccttgccttatttctgagactcccatgccattccagcgccaagaaggccgcatgtgcccagcttggagtcatgacaccctag

SEQ ID NO: 220276 - DNA, 420 bp, Artificial Sequence
  Description of Artificial Sequence: Synthetic coding sequence
atggccgagaatgatgtggacaacgagcttctggactacgaagatgacgaggtggagacagctgcaggcggagacggcgcagaggcaccagccaaaaaggacgttaaaggtagctatgtttcgattcattcatctggctttcgggattttctgctgaagcctgagctccttcgtgctattgtggactgtgggttcgaacacccctcggaggtgcagcatgagtgtattcctcaggctattttggggatggacgtcctatgccaagctaagagcgggatgggcaaaaccgctgttttcgtgcttgctacacttcagcagttggagccagtgactggccagagtcacgagcatatgacctccgtgacactggataacctcaccgccgtgggggacgtgcttagtcaagcatgggggagctag

SEQ ID NO: 220277 - DNA, 972 bp, Artificial Sequence
  Description of Artificial Sequence: Synthetic coding sequence
atggccgaaaacgacgtagataacgagctactggactacgaggacgacgaagtcgaaacagctgccggaggagatggcgctgaagcaccggcaaaaaaggacgtgaagggatcctacgtttccatacattcttcaggattccgcgactttctacttaaacccgagctcctgcgggctatagttgactgtgggttcgagcatccctccgaggtgcagcacgaatgcataccacaggctatacttgggatggatgtcctgtgtcaggctaagagcggaatgggtaagactgctgtgttcgtgctcgctacgcttcaacaactggaacccgtgacaggccaggtaagcgttctggtgatgtgtcatacacgcgagttagcatttcagattagcaaggaatatgagcggtttagcaagtatatgcccaatgtgaaagtggcagtcttcttcggagggttgagtatcaagaaagacgaggaagtgctgaagaaaaattgtccccatattgttgttggtactcctgggaggatcctggcgctggcaaggaataagtcactgaacctgaaacacataaagcatttcatcctagacgaatgcgacaaaatgttagaacagttggacatgagacgggacgtgcaggaaatctttagaatgactccgcatgaaaagcaagtgatgatgttcagtgctaccctgtctaaggagatcagacccgtgtgcaggaagttcatgcaggacccgatggagatcttcgtggacgacgaaactaagttaacgcttcatggcctgcagcaatactacgttaaactgaaagacaacgaaaagaataggaagctatttgatttactcgatgtgcttgagttcaatcaggaaataacttgtaagagcgtgcaaaggttctcaacaacaaattcctgtgggtaccagccaatttggcccagacatggccaccgagcaggggagcactgcttctag

SEQ ID NO: 220278 - DNA, 1332 bp, Artificial Sequence
  Description of Artificial Sequence: Synthetic coding sequence
atggccgaaaatgatgtggacaatgagcttttggactatgaggatgacgaggtcgagacagctgctggcggagatggggctgaagctccagccaagaaagacgtgaagggctcctatgtgtccattcactcttctgggtttagggacttccttctgaaaccggaactcctccgtgctatcgtggactgtgggttcgagcacccttctgaggtccaacacgagtgcatcccccaggccatcttgggaatggacgttctgtgtcaggctaaatcaggcatgggcaaaacagccgtgttcgtgttagctaccctccagcagttggaacccgtcaccgggcaggtctacttgggtagagtccttggtcgcggattttggtgcgtattcgttagcgtgcttgtgatgtgtcacacaagggagctggcatttcagattagcaaagaatatgaacgcttctcaaagtatatgccaaatgtgaaagtggcggtgttttttggcggtcttagcataaaaaaagatgaagaagtgctgaagaaaaattgcccacacatcgtggtaggtaccccagggaggatccttgctctcgccaggaataaaagtctgaatttgaagcacatcaaacattttatcttagatgaatgtgataaaatgctagagcagttggacatgaggcgcgacgtacaggagatattcagaatgacaccacatgagaaacaagtgatgatgttctcagccactctgagtaaagagattcggcctgtgtgtcggaagtttatgcaagacccaatggagatttttgtggacgatgaaaccaagctgactctacatggacttcagcagtactatgtgaaacttaaggataatgaaaaaaacaggaagttgtttgatttgcttgatgtgcttgaatttaaccaggtcgtgatttttgttaagtcagtgcagaggtgtattgccctagctcaacttttggtggagcagaattttccagctatagccatccacaggggcatgcctcaggaggaaagactctcaaggtatcagcagtttaaagattttcagagacggattctcgtcgctaccaatctattcgggagaggcatggatatcgagagggttaacatcgcctttaactacgatatgcctgaggattctgatacatatctccacagggtcgcacgggctgggaggtttggtaccaaaggactagcgatcacgtttgtatctgacgagaacgacgctaagattctcaatgacgtgcaggatagattcgaagtgaacatctccgagttgccagacgaaatcgacatctcaagctacatagagcagacccggtag

SEQ ID NO: 220279 - DNA, 732 bp, Artificial Sequence
  Description of Artificial Sequence: Synthetic coding sequence
atgtggactatgtcttcttggaccatgaagatgatgcgatggcgacaacagctgggcgagatgggcctgaggccgctgcccagaagaatgtcacgggctcccatgtcgccctctactgctcttgccttcgttacatcctgcagttcacagagttgttccgggcctctatctaccgttgcattgtccatcagacaaaaggtaagtgttcttgtgatgtgtcacacgcgggagctggccttccaaatttcaaaagaatacgagaggttttcgaagtacatgccaaacgttaaggtggccgtgttctttggaggtttgtctatcaaaaaggatgaggaggtcctgaaaaagaactgcccccacatcgtggtcggaacacctgggaggatcctcgccctggctaggaataaatcattgaacctgaaacacataaaacacttcatattggatgagtgtgacaaaatgcttgaacaactggacatgcggcgtgatgtgcaagaaatattcaggatgacacctcacgagaagcaggtgatgatgtttagtgccactctcagcaaagaaataagaccagtctgccggaagtttatgcaggacgttaacaccttgttgccatccctcccaccgctccccgcacgttgcctcctcccattcctggccttgttcctgcggttaccttgccacagcagcgctaagaaagcagcatgcgcccagttaggagtgatgactccatag

SEQ ID NO: 220280 - DNA, 1053 bp, Artificial Sequence
  Description of Artificial Sequence: Synthetic coding sequence
atgtggactatgtcttcttggaccatgaaaatgatgagatggcgacaacagctgggagaaatgggcttgagaccactgcccagaagaatgtcaagagctcccatgtccccttcaacagctttggccttcgtgacttcttgctcttcacagtcatgttcagggcctctgtccactgttgccctttccatcagacagaaagtggctgtgttctttggcggtctgtcaataaaaaaagacgaagaggtcctgaaaaagaactgcccccatattgtggtcggaacgcccggtcgcattctggcactcgcacgcaacaagtcccttaatctgaagcatattaagcactttatcctggacgagtgcgataagatgctggaacagttggacatgcggagggatgttcaggagatcttcagaatgacacctcacgaaaagcaggttatgatgttttccgccacactcagtaaggagataaggccggtgtgcagaaaatttatgcaggatcctatggaaatcttcgttgacgacgaaactaaactcaccctgcatgggcttcagcaatattatgttaagctgaaggataatgaaaagaaccggaagctctttgatctgctcgatgtcttggaatttaatcaggttgtcatcttcgtgaagtcagtacaacggtgtattgcactggcacagctgttggttgagcagaattttccagccatagccatccatcgcggtatgccacaagaggaacgcttgagtcggtaccaacaattcaaggacttccagaggcgcattttggtcgcgactaacctcttcgggcgaggcatggatatcgagagggtgaatattgcttttaattacgatatgccggaggatagtgatacatacttgcatagagtggccagagccggacggttcggcaccaaaggtctggcaattacattcgtgtctgatgaaaacgatgccaaaatccttaatgacgtgcaggaccgttttgaagtgaatatctccgaattgcctgacgagatcgacatctcctcgtacatcgagcaaaccaggtag

SEQ ID NO: 220281 - DNA, 1332 bp, Artificial Sequence
  Description of Artificial Sequence: Synthetic coding sequence
atggccgaaaatgacgttgacaacgaacttcttgactatgaggacgatgaagtggagactgcagctgggggagatggagccgaggcgcctgctaagaaagacgtgaaagggagctacgtgagtatccattcatccggctttagggatttcttattaaagccggaacttctgagggcaatcgtggattgtggattcgaacatccgtctgaggtccagcacgagtgcatccctcaggccatactggggatggacgtgctctgtcaggccaaatcaggaatgggaaagaccgcagtatttgtgttggcaactctacagcagttggaacctgtcaccggccaagtgtaccttgggagggttctcggccgaggcttttggtgtgtgttcgtctccgtgcttgtcatgtgtcacaccagagagctcgcctttcagatcagtaaggaatacgaacggtttagcaagtatatgccgaatgtgaaagttgccgtctttttcggagggcttagtatcaaaaaagacgaggaagtcctcaagaaaaattgcccccacatagtagtgggcacacctgggcgtatcctcgcgcttgcaaggaataaaagcctgaacctcaagcacatcaaacacttcatcttagacgagtgcgacaaaatgctggagcagctggacatgaggagagatgtacaggagattttcagaatgactccccacgaaaagcaggtcatgatgttctccgccacactgagtaaggagattagacccgtttgtcgcaaatttatgcaggatcccatggaaatctttgttgatgacgagaccaagctcaccctccatggcctgcagcaatactacgtcaagctaaaggataacgaaaagaaccggaaactgttcgatctgctggacgtgctggaatttaatcaggtcgtgatattcgtgaagtctgttcaaaggtgcatcgcccttgctcagctgctcgttgaacaaaatttccctgccatagccattcaccgcggtatgccccaggaggaacggctgtcccgataccaacagtttaaggatttccagcgtcggatcctcgtggccacgaacctgttcgggaggggaatggacatcgagagagtgaatatcgcctttaattatgatatgcctgaggatagtgatacctatctgcatagggtcgcccgagccggaagattcggaaccaagggactggctattacttttgtctcagacgagaacgacgccaaaatcctaaacgacgtgcaggatcgatttgaggtaaatattagtgagctcccagacgagatcgacattagcagctacattgagcagaccaggtag

SEQ ID NO: 220282 - DNA, 1053 bp, Artificial Sequence
  Description of Artificial Sequence: Synthetic coding sequence
atgtggaccatgtcatcatggacgatgaagatgatgcgctggcgacaacagttgggtgaaatggggttgagacccctacctcggaggatgtcaagggccccaatgagtcctagtactgctctggcgtttgtcacgtcttgctccagccagagttgttctggtcccctatccactgttgcgttatccattcgtcagaaagtggcggtcttctttgggggtttatccattaagaaagatgaggaagtgcttaagaaaaattgcccccacatcgtggtgggcacaccaggccgtatactggccctagccagaaacaagtccctgaatcttaaacacattaaacattttattctggacgagtgcgacaagatgctggagcagctggatatgcggagagacgtgcaggagatttttcgcatgacgccacacgagaagcaggtgatgatgttctctgcaaccctgagcaaggaaattaggccggtgtgccgtaagtttatgcaggatcctatggaaatattcgtcgatgacgagaccaaactgacactgcacgggttgcagcagtattatgtgaaattgaaagataatgagaaaaatagaaaattgtttgacctactggatgttttggagttcaatcaggtggtgatttttgtcaagtctgtccaacggtgcatcgcactggcgcagctcctcgttgagcagaatttcccggctattgcaattcaccgaggcatgcctcaggaggagcgcctgtccaggtatcaacagttcaaggactttcagcggaggattttggtggccacaaatctgtttggcaggggcatggatattgagagggtgaacatagcttttaattacgacatgccagaggactctgacacttatcttcacagggtggctcgggcaggcagattcggaactaaggggctggccatcaccttcgtcagtgatgagaacgatgctaaaatcctgaatgatgtgcaggatcggtttgaggtcaacatctctgagttgcccgacgagattgacatcagctcctacatcgaacagaccagatag

SEQ ID NO: 220283 - DNA, 732 bp, Artificial Sequence
  Description of Artificial Sequence: Synthetic coding sequence
atgtggactatgagctcctggactatgaaaatgatgaggtggagacagcagttgggcgagatgggtctcagaccactcccgaggcgcatgtccagggcccctatgagtccttcaacagctctcgcgttcgtaacctcctgctcgtcccagagctgcagcggtcctctgagtactgtggctctgtctatccgtcaaaaagtgagcgtgttggtgatgtgtcacacccgggaacttgcctttcagatatctaaggaatatgaacgttttagtaagtatatgcctaacgtcaaagtggccgtctttttcgggggtctctctatcaagaaagacgaagaggtcctcaagaaaaactgcccacacatcgtcgtcggtacccccggtcgcatactggctcttgccaggaacaagagcctgaacttgaagcacatcaagcatttcattctcgacgagtgcgacaagatgttagagcagctggatatgaggcgtgatgtgcaagaaatcttccgcatgactcctcacgagaagcaagttatgatgttttcggcaacactcagtaaggagatcagacctgtttgccgcaagttcatgcaggatgtcaacaccttactgccctccctaccaccgttgcctgctagatgcctcctcccatttctagccctgttcctcagacttccctgtcattcttcagctaaaaaagctgcctgcgctcaactgggggtcatgacgccttag

SEQ ID NO: 220284 - DNA, 420 bp, Artificial Sequence
  Description of Artificial Sequence: Synthetic coding sequence
atggctgaaaatgatgttgataacgagctgctggactatgaggacgatgaagttgagactgccgctggcggagacggtgccgaagctccggcaaaaaaagatgtaaaaggcagttatgtctctatccacagttcaggcttcagagactttctgctcaaaccagaactccttagagcaatcgttgactgtggattcgaacatcctagcgaggtgcagcatgagtgtatccctcaggcaatcctgggcatggacgtgctgtgccaagccaagtccgggatgggtaaaaccgctgtgttcgttttggccacccttcaacagctggagccagtgaccggccagagccatgagcatatgacctctgtgacattagacaatctgaccgccgtgggcgacgtgctctcccaagcatggggatcctag

SEQ ID NO: 220285 - DNA, 1053 bp, Artificial Sequence
  Description of Artificial Sequence: Synthetic coding sequence
atgtggactatgagttcttggaccatgaagatgatgagatggagacagcagctcggcgaaatgggcttacgtccattgcctcggcgaatgtctcgcgcacccatgtcaccatcaacagccttagccttcgtgacaagctgtagtagccagtcatgttccgggccactctctacggtggcattatccatccggcagaaagttgccgtatttttcggcggactgagtattaagaaggacgaagaggtgcttaaaaagaattgcccccatatagtggtcggcacaccaggcagaattctggcactcgctcggaataaatccttaaatctcaaacatatcaagcactttatcctcgatgaatgtgacaagatgctcgagcaattggacatgcgacgtgatgtgcaggagatctttcggatgacaccgcatgagaaacaggtcatgatgttctctgcaactctctctaaggagatccggcctgtgtgtcgcaagttcatgcaggatcctatggagatttttgtggatgatgaaaccaagcttacattacacggcctgcaacaatattacgtgaagctcaaggacaacgaaaagaaccgaaaactattcgaccttctcgacgtactggaatttaatcaggtggtcatcttcgttaaatccgtccagcgctgtatcgctctcgcccagctgctggtcgagcagaatttcccagctattgctatccaccgcggaatgccccaggaggaacgcttgagccgctatcaacaatttaaggactttcagcggagaattctggttgcaacaaacctttttggacgtggcatggatatcgagcgggtgaacatagctttcaattacgacatgcccgaagacagtgatacctacctacatcgagtggcccgagcaggccgtttcggcacaaaaggcctggctataacatttgttagtgatgaaaacgatgccaaaatcctgaacgatgtgcaggacaggttcgaggtgaacatttccgagctcccagacgagattgacatatctagctatatcgaacagaccagatag

SEQ ID NO: 220286 - DNA, 972 bp, Artificial Sequence
  Description of Artificial Sequence: Synthetic coding sequence
atggccgagaacgatgtggacaacgaactactggactacgaggatgatgaggtggagacagccgcaggaggtgacggcgcagaggctcccgctaagaaggacgtgaagggctcttatgtgagcatccatagttccggctttagggactttcttcttaagcccgaactgttacgggctattgtcgattgtggatttgagcacccaagtgaggtccagcacgagtgtattccgcaggccattctaggtatggacgtgctgtgccaggcaaagtccggcatgggtaagactgcggtgttcgtgctggctactttgcagcagctcgaacctgttaccgggcaggtgtctgtgcttgtgatgtgccacactcgggagctggccttccagatatcgaaagagtacgagagatttagcaaatacatgccaaacgttaaagtggctgtctttttcgggggactttctattaaaaaggatgaggaagtgctgaaaaagaactgtccgcacatcgtggtgggcactccaggtcggatactcgccctcgcaaggaataaatccctgaacctcaaacacatcaagcacttcattcttgatgaatgtgacaagatgcttgaacaattagacatgcgcagggacgtgcaggagatttttagaatgaccccgcacgagaaacaagtaatgatgttctctgcgactttatctaaagaaatacgacctgtgtgcaggaaattcatgcaggatcccatggagatcttcgtggatgatgaaacaaagctgaccctgcacggactgcagcagtattacgtcaagcttaaagacaacgaaaagaatcggaaactgtttgacttgctggacgtgctggagttcaaccaggagatcacatgtaaatccgtgcagaggttcagcaccaccaattcctgtggctatcagcccatctggccaaggcacggacatagggcaggggagcactgtttctag

SEQ ID NO: 220287 - DNA, 1053 bp, Artificial Sequence
  Description of Artificial Sequence: Synthetic coding sequence
atgtggacaatgagttcgtggaccatgaagatgatgcggtggaggcaacagctcggcgaaatggggctccgcccattgccacggcgtatgtctcgggcaccaatgagcccttccacagctctagcattcgtgacaagctgtagctcccaatcctgctccggtccattaagtacagtggccctgtctattcggcagaaagtggccgtgttctttggcggactcagcataaaaaaagatgaagaagtgctgaaaaagaattgcccacacattgttgtgggcactccgggacgcatcctcgccctcgcacgcaataagagcctgaatttgaagcacattaaacattttattcttgacgaatgcgacaagatgctggagcagttggatatgcgcagagatgttcaggaaatcttccgcatgacgcctcacgagaagcaggtgatgatgttcagcgcgactctgagcaaagagatccgcccagtctgcagaaagtttatgcaagatccgatggagatttttgtggatgacgagactaagttgaccctccatgggctccagcagtattacgtgaaacttaaggacaacgagaagaaccgcaaactgttcgatctgctcgacgtcctggaatttaatcaggtggtgatcttcgtgaaaagcgtgcaacgctgtatcgctttagcccaactgctggtagaacaaaactttcctgccattgctatccacagggggatgcctcaggaggaacgcctatcaagatatcagcagttcaaagatttccagcgccgaatactggtggctactaatttgttcgggcgaggtatggatattgaacgggttaacattgcgttcaactacgacatgcccgaagacagtgacacatatctgcacagggtggcacgtgctgggagatttggaaccaaaggccttgccattacatttgtgagtgacgaaaacgatgccaagatcctgaacgacgtgcaagataggttcgaggtgaatatttcggagctgcccgacgagattgatatttcatcatacatagaacagacaaggtag

SEQ ID NO: 220288 - DNA, 420 bp, Artificial Sequence
  Description of Artificial Sequence: Synthetic coding sequence
atggcagaaaatgatgtggataacgagttattggactatgaagatgatgaggttgagactgctgccggaggtgacggggctgaggcccctgccaaaaaagacgtaaagggatcttatgtgtccattcacagcagcggctttagggactttctcttaaaacccgaactgctcagggcgatcgtggattgcggttttgagcacccctccgaggtccagcatgaatgcatccctcaggctattctggggatggatgttctctgccaagccaagagcggaatgggcaagaccgcggtgttcgtgcttgctacattgcaacaattagagccagtgaccggacaatcccatgaacatatgacatctgtgaccctagacaatctaacggctgtgggagacgtgctttcccaagcatggggatcttag

SEQ ID NO: 220289 - DNA, 1332 bp, Artificial Sequence
  Description of Artificial Sequence: Synthetic coding sequence
atggctgagaacgatgtagacaatgagttactggactacgaagacgacgaggtggaaacggccgcagggggagatggcgctgaagcgccagcaaagaaggacgtcaagggtagctacgtatccatccattctagcggtttcagggactttctgttgaagcctgagctgctgcgcgctatcgtggactgcggattcgaacatccttccgaggtacaacatgaatgtatacctcaggccatactggggatggacgtcctgtgccaggctaagagtggcatgggcaaaaccgccgtctttgtgttggccaccctacagcaactggagcctgtgacagggcaggtgtaccttgggagggtgctggggcgagggttttggtgtgttttcgtgagtgtgttagtgatgtgccatacccgagaactagcctttcagatatctaaggagtacgaaaggtttagcaagtatatgcctaatgtcaaagttgctgttttctttggaggactctctattaagaaagatgaggaagtgctcaaaaagaattgtccccacattgtggttggaacaccagggaggatactcgctttggcgaggaataaaagtctgaatctcaaacacatcaaacactttatcttagatgagtgtgacaaaatgttggagcagttagatatgcgcagggacgtgcaggaaatcttccggatgacgccccatgagaaacaggttatgatgttcagcgccaccctcagtaaggaaatacgtcccgtctgccggaagtttatgcaagaccccatggagattttcgtggacgatgaaaccaaacttactctgcatggactacagcaatattatgtgaagctgaaagataatgaaaagaatcgcaaactcttcgatcttctagacgtcctcgagtttaatcaggtggtgattttcgttaagagcgtgcaacgatgcattgccttggcccagctgcttgttgaacaaaatttcccagcaattgccatccacagaggcatgccgcaggaagagaggttgagtcggtaccagcagttcaaggattttcagcggaggatcctggtggcaacaaacctgttcggtcgtggcatggatatagagagagtgaacatcgccttcaattacgacatgccagaggacagcgacacgtacctgcaccgcgtcgcacgcgctgggaggttcggcactaagggcctggctatcacgttcgtatccgatgagaacgacgctaagatactgaatgatgtacaggatcgtttcgaggttaacatttccgagctacctgatgagatcgatattagtagctatattgagcagacacgatag

SEQ ID NO: 220290 - DNA, 972 bp, Artificial Sequence
  Description of Artificial Sequence: Synthetic coding sequence
atggccgagaacgatgtcgacaacgaattactcgactacgaagacgatgaagtggaaaccgctgctggcggagatggcgctgaagctcccgctaagaaagacgttaagggttcatatgtgtccatccacagctctggttttcgtgatttcttgctcaagcccgaactactgcgggctatcgtcgactgcgggtttgagcacccctcagaggtgcagcacgaatgcattccccaggcaatcttaggtatggatgtcctttgtcaggccaaatctggcatggggaagacagcagtgtttgtccttgctaccctgcagcagctggagccagtcaccggacaggtgtccgtgctggtgatgtgccacacaagagagttagcgtttcagatctcaaaggagtacgaaaggttcagcaagtacatgccaaatgtgaaagtggctgttttcttcgggggactttctataaagaaggatgaggaagtcctcaagaagaattgccctcacattgtggtcggaacgcccggtaggattctggccctggccagaaataagagtctcaacctgaaacacattaaacactttatcttagacgagtgcgataagatgctggagcaactggatatgcgcagggacgtgcaagagatcttccggatgactcctcacgaaaagcaggtaatgatgttctccgcaacactgagtaaagagatacggcctgtttgcagaaagtttatgcaggaccctatggagatctttgtggatgacgagactaagcttactctgcatggtctgcagcagtactacgttaaactgaaggataacgaaaaaaacagaaagctgtttgatttactggacgtgctggagtttaatcaggagatcacctgtaagtcggtgcagaggttctccaccacaaatagttgtggctaccaacctatttggcccagacacggacaccgagccggtgagcactgcttctag

SEQ ID NO: 220291 - DNA, 972 bp, Artificial Sequence
  Description of Artificial Sequence: Synthetic coding sequence
atggcagagaacgacgtcgacaatgaactgctcgattacgaggacgacgaggtcgaaacagcagccggtggagacggcgcagaggctcccgctaaaaaagatgttaagggttcttatgtatccatccacagcagcggcttcagagactttctccttaagccagagttactgcgagccattgtagactgtggattcgaacatccaagtgaagtacaacatgaatgcataccccaagcaatcctcggcatggacgtgctttgccaagccaagagcgggatgggtaagacagcagtgttcgttcttgccacgctgcagcagctggagcccgttactggtcaagtatccgtactggttatgtgtcatactcgggagctggcctttcagatctccaaagagtatgaaagattctccaagtacatgccaaatgttaaagtcgcagtctttttcggcggactatccataaagaaagatgaagaagtcctgaaaaagaactgtccccatatcgtggttggtactcctggccgaattcttgctctcgcccgtaataagtccctcaatctcaagcacattaagcacttcatcctggacgagtgcgataagatgttggagcagttggatatgcggcgtgacgtgcaggagatcttcaggatgaccccacacgaaaaacaggtgatgatgtttagcgccacccttagcaaggagatacgcccagtgtgcagaaagttcatgcaggatcccatggagatctttgtagatgatgagacaaaactaactttacacggtctccaacagtactatgtcaagctcaaggacaatgaaaaaaataggaagttgttcgacctgctggatgtactggagtttaaccaagagataacttgtaagtcagtccagaggttttctaccactaactcgtgcggataccaaccaatctggccaagacacggccaccgtgctggcgaacactgcttttag

SEQ ID NO: 220292 - DNA, 1053 bp, Artificial Sequence
  Description of Artificial Sequence: Synthetic coding sequence
atgtggacaatgagtagctggacaatgaagatgatgagatggaggcaacagctgggagagatgggtttacgtccactcccaaggcgcatgagcagagcgccaatgagcccctcaacagccctggcattcgtaacatcttgctcctcccagagctgcagcgggccactcagcaccgtagccctctccattcgacaaaaggttgctgtgttctttggagggctttctataaaaaaggacgaagaggtgctgaagaaaaattgtccacacatcgtggtgggtaccccaggaaggattctggcactggcaagaaataagtccctgaacctgaaacatatcaagcatttcatcttagacgaatgcgacaagatgctggagcaactcgacatgcgcagagatgtccaggagatcttcagaatgacgcctcatgaaaaacaggtcatgatgtttagtgccacactgtcaaaggagattcggcctgtgtgtcgcaagttcatgcaggaccccatggaaatcttcgtagacgatgagacgaaattaaccctgcacgggctccagcagtattacgtgaaactcaaagataatgagaagaacagaaagctgttcgaccttttggacgtcctcgaattcaaccaggtggttattttcgtgaagagtgtgcagcgttgtatcgccttggcccagctccttgtggaacaaaattttcctgctatcgccatccaccgcggaatgccacaggaggagcgattgtccaggtaccagcagttcaaggattttcagcgtcggatcctggtggccacaaatctctttgggagaggaatggatattgagcgtgtaaacattgccttcaactatgacatgccagaagattcagacacctatctgcatagggtggccagggccggacgctttgggaccaagggactggcaatcacattcgtatccgatgagaacgatgcgaagatcctgaatgatgtccaggacagatttgaggtcaacatttcagagttgccagacgagattgacatcagtagctacatcgagcagacacggtag

SEQ ID NO: 220293 - DNA, 420 bp, Artificial Sequence
  Description of Artificial Sequence: Synthetic coding sequence
atggcggagaatgacgtcgacaatgagctactggactatgaggatgacgaggtcgagaccgccgctggaggagacggagcagaagctcccgctaaaaaggatgtaaagggatcttatgtgtctatccatagctccggttttagggactttttactgaaacccgaattgctcagggcaatcgtggactgtggcttcgaacatcctagcgaagtccagcacgaatgtataccacaggcaatacttggaatggacgtgttgtgccaggccaaaagtggcatgggtaagactgcagtctttgttttagctacgctgcagcaactcgagcccgtcactgggcagtcacacgaacacatgactagtgtcacattagataacctgacggcagtcggggatgtcctgtcacaggcttggggcagttag

SEQ ID NO: 220294 - DNA, 1053 bp, Artificial Sequence
  Description of Artificial Sequence: Synthetic coding sequence
atgtggacaatgagcagctggactatgaagatgatgcgttggcgacagcagctgggtgagatgggcctgagacctctccctcgaagaatgtctagggctccaatgtcaccgagcaccgccctggcctttgtcacctcatgcagtagccagtcttgctcggggccactatccactgtggccctgagtatccgccagaaagtggctgtttttttcggagggctcagtattaaaaaagatgaagaagtgctgaaaaaaaactgcccccacattgtagtgggaaccccaggccgtatactggctttggccagaaataaatctctaaatctcaagcacattaagcacttcatcttggacgaatgtgataagatgcttgaacagttggatatgcggagagatgtgcaggagatttttcggatgacacctcatgaaaaacaggtgatgatgttctccgctaccctgagtaaagaaatccgccctgtctgccgcaagttcatgcaggacccaatggagattttcgtagatgacgagactaagctcacgctccacgggctgcagcagtattacgtgaagctgaaggataacgaaaaaaataggaagctctttgatctgcttgacgtgctggagttcaaccaggtggtgatttttgtgaaatcagtccagcgttgtatcgcactggcacagcttctggtggagcagaacttcccagctattgctatacatcggggtatgcctcaagaggaacggttgtcccgttaccaacaatttaaagacttccaaagacgtatcctcgttgctactaatctgtttggcagaggcatggacatcgaacgtgttaacattgcgttcaattatgacatgcctgaggactcagatacctacctccatagagtagccagggccggaagattcggcacaaaaggactggctattacgttcgtcagcgacgaaaatgacgctaagattctcaacgacgtgcaggacaggttcgaggttaatatttctgagttacccgatgagattgacatctcatcatatattgaacagacacggtag

SEQ ID NO: 220295 - DNA, 420 bp, Artificial Sequence
  Description of Artificial Sequence: Synthetic coding sequence
atggctgaaaatgacgtggataacgagcttctggattatgaggacgatgaggttgaaacagctgccggtggggacggtgcagaggcgccagctaaaaaggatgttaagggtagctatgtctcaattcactccagcggattccgggatttcctattgaaacctgagctgctgagagcaattgtggattgtggcttcgaacatccctccgaggtccagcacgaatgcattccccaagcaatacttggaatggacgttttatgtcaagctaagtccggtatgggcaagactgccgtattcgtcctggccaccctgcaacagctggaaccggtgaccggacagtcccacgaacacatgacgagcgttacactggacaatcttactgccgtgggggacgttctgtcgcaggcctggggcagttag

SEQ ID NO: 220296 - DNA, 1332 bp, Artificial Sequence
  Description of Artificial Sequence: Synthetic coding sequence
atggctgaaaatgatgtggacaacgaactgctggactacgaagacgatgaggtggaaaccgcagctggcggagacggcgctgaggcccctgccaaaaaagacgttaaggggtcttatgtctcaatccatagctctggatttagggatttcttattgaaacctgagttgctgcgcgcaatcgtggattgtgggtttgaacaccccagtgaggtccagcatgagtgtatcccgcaggctatcctgggaatggacgtgttgtgccaggctaaatctggtatgggtaagaccgccgttttcgtactagcgactcttcagcagctcgagccagtcaccggccaggtctacttaggtcgggtgctgggcaggggtttctggtgcgtgtttgtgagcgtgctcgtgatgtgccacacccgcgagcttgcctttcaaatctctaaagaatacgagcgattctctaagtacatgccaaacgtgaaagttgccgtatttttcggcggtctttccatcaagaaagatgaagaggttttaaagaaaaattgcccacacatcgttgtggggacaccagggaggattctagctctggccaggaataaatctcttaatcttaagcacataaaacattttatactcgacgaatgcgacaagatgctggagcagctggacatgagacgtgacgtccaggagatttttagaatgacgcctcatgagaagcaggtgatgatgttctctgctacattgagcaaagaaataaggcccgtctgtcgaaagtttatgcaggaccctatggaaatctttgtggacgacgaaaccaaattgacattgcatggtctgcagcagtattatgtgaaactgaaggataacgagaaaaatagaaagctgtttgatcttctggatgtgttggaattcaatcaagttgttatttttgttaagtcagtgcagcggtgtatagcactagctcaactgctggtggagcagaactttccagctatagccattcatagaggtatgccgcaggaggagcgcctgtcgcgctaccagcagtttaaagactttcagaggcgcatcctcgtggctactaacctgtttggcagagggatggacatagagagggtgaatattgcctttaactacgatatgcccgaagattctgacacttatctacaccgggttgcccgagccggaagatttggtaccaaagggctggccatcacatttgtgtcggacgaaaatgatgccaaaattctcaatgatgtacaggatcgattcgaggttaatattagtgagctgccggacgagatcgacatcagttcttacatcgagcagacaaggtag

SEQ ID NO: 220297 - DNA, 552 bp, Artificial Sequence
  Description of Artificial Sequence: Synthetic coding sequence
atggagatcttcgtcgacgatgaaaccaaactgacactacacggcctgcagcagtattatgtaaagcttaaagataacgagaaaaacagaaaactgttcgacctgttggacgtactagaattcaatcaggtggttatcttcgtcaagagcgtccaaaggtgcatcgcgctggctcagctgttagtagagcaaaattttccagctatcgcgatccatcgcggaatgccccaggaggaacggtggctttctcggtaccagcagtttaaagacttccaacggagaattcttgttgcgaccaatctttttggtcgtggcatggatatcgaacgggttaacatcgctttcaattatgacatgcctgaagactctgacacttatctccatcgggtggcgagagcagggagattcggcactaaggggttagccataacctttgtcagcgacgaaaacgatgcgaagatactaaacgatgtccaggacaggttcgaagtaaacatttctgagctacccgacgagattgatattagtagttacattgagcagaccaggtag

SEQ ID NO: 220298 - DNA, 2073 bp, Artificial Sequence
  Description of Artificial Sequence: Synthetic coding sequence
atgggagatgaagactgggaagcggagatcaaccctcacatgagctcatacgtgccgatcttcgagaaggatcgctatagcggcgagaatggggataacttcaatcggaccccggcatcctctagcgagatggatgatggcccatcccggagagaccatttcatgaaatctggctttgctagtggcaggaactttgggaaccgcgacgcgggtgagtgcaataagagagacaatacatccaccatgggcggtttcggagtggggaaaagcttcggtaatagaggtttctctaattctagatttgaagatggggacagctctgggttctggcgggaatcctcgaatgactgtgaagataatcccacccggaaccgaggcttctccaagaggggcgacaacgaccttgacccggatgagtgcatgcaaaggactgggggtctgttcggttcacgcagaccagtcctcagcgggactggaaatggtgacacctcccagagccgttccggatcaggctccgagaggggagggtataaaggacttaatgaagaggtaattacagggagcgggaaaaactcttggaaaagcgaagctgagggcggagagtccagcgatacccaaggtcccaaggttacctatatccccccacccccaccagaggacgaggactccatctttgcacattatcagaccggaatcaattttgataagtatgacacaatactggtggaagtttccggccatgatgcaccacccgcaatcctaaccttcgaagaggctaatctgtgccagaccctgaataacaatatcgcaaaggccggttacactaaacttacgcccgtgcaaaaatatagcataccaattattctggccggaagagatttgatggcctgcgcccagactggttctgggaagacagcggcattcctactacctatactggcacacatgatgcatgatggaatcacagcttcaagattcaaagagctgcaggagcctgagtgtatcatcgtcgcaccaacccgcgagctggtgaaccagatttacctggaggccagaaagttttcttttgggacctgcgtgagggccgtcgtgatctatggcggaacccaattgggccactctatacggcagattgttcagggctgtaatattttatgcgccaccccgggaaggttaatggacataatcggtaaggaaaagatcggcctgaagcaaattaagtacttagttctagacgaggcagaccgaatgttggatatgggctttgggcctgaaatgaagaaacttatcagctgccctggtatgccatctaaggaacagagacagactctcatgttttctgccacctttccggaggagattcaaaggctggcagcggaattccttaagagtaattatttgttcgtcgccgttgggcaagtggggggtgcttgtcgggacgtgcagcagaccgtgttacaggtcggacaatttagtaagcgggagaagctggtagagatactgcgaaatatcggcgatgaacggacgatggtctttgttgaaactaaaaaaaaagctgactttatagccacttttctgtgtcaggaaaagatcagcacaaccagtattcacggtgaccgggagcaacgcgagagagaacaggcacttggtgacttcagatttggcaaatgccccgtactcgtggctacctctgttgctgccagaggactcgacattgaaaatgtgcagcacgtgattaattttgacctgcccagcaccatcgacgaatacgtgcaccggattggtagaaccggacgttgtgggaatacggggagagccataagtttcttcgaccttgagtcggacaatcaccttgcccagcccctcgtgaaggtgctcactgatgctcagcaggatgtgcctgcttggcttgaagaaatcgccttttcgacatacattccgggttttagtggttcaaccaggggcaatgtgttcgcttccgttgacactaggaaaggaaagagcacactgaacaccgcagggttcagcagctctcaggctccaaatcccgtcgatgatgagagctgggactag

SEQ ID NO: 220299 - DNA, 2073 bp, Artificial Sequence
  Description of Artificial Sequence: Synthetic coding sequence
atgggagatgaagactgggaagctgagatcaatccccatatgagctcatatgtcccgattttcgaaaaagaccgatacagtggcgaaaatggcgataattttaatagaactcccgcttcctcttctgagatggatgatggtccatcaaggagggaccatttcatgaaatcgggcttcgctagtggacgcaacttcgggaaccgggatgctggagagtgtaataagcgggataatacgtccacgatggggggattcggggtaggaaagagctttggtaatcgaggtttttccaattccagatttgaggacggcgacagtagcggattttggcgggagtcctcgaatgactgtgaagacaaccccactcgtaataggggcttttccaagaggggtgacaacgatctggatcccgacgagtgcatgcagcggaccggtggcctttttgggagccgccgtccagtgctctccggaacaggcaatggagacacctcacaaagtcgaagtgggagcggatccgaaagaggtggatacaagggcttaaatgaggaggttataactggctctgggaagaacagctggaaatccgaggctgagggcggagagtcatcagacacacaggggccaaaggttacctatattccccctccaccccctgaagacgaggacagcatctttgcccattaccagacagggattaattttgataaatacgatacaatcctggtggaggttagcggacacgatgcacctccagccatcttaaccttcgaagaggcaaatctgtgtcagactcttaacaacaatatagctaaagcgggatacaccaaactcacccccgtgcagaagtactctataccaattattttggctgggagggacctgatggcatgtgcgcaaacgggaagcgggaagaccgccgctttcctcttgcctatcctggctcatatgatgcacgacggaattacggctagtcggttcaaagagttacaggagccagaatgcattatagtggccccaacccgggaattagtaaaccagatctatttggaggccaggaaattcagcttcggaacatgtgtgcgcgcagttgtgatctatggaggcacacagcttggacactccatcagacagattgtccaggggtgcaatatcctttgtgcaactcctgggagacttatggatataataggcaaagagaagattgggctcaaacagattaagtatttggtgttggacgaggctgaccgtatgttggatatgggtttcggacccgagatgaaaaaacttataagttgtcccggaatgccatcaaaagagcagcgtcagaccctcatgttctcagccacattccccgaggaaatccagcgcctggctgccgagtttctgaaatctaattatttgttcgtggccgttggacaagtggggggtgcttgtagagatgtgcagcagacagtgctccaggtgggacagttctctaaaagagagaaactggtggagatactgcgaaacataggagatgaaagaacaatggtcttcgtggagaccaagaagaaagccgatttcatcgcgactttcctctgtcaggagaagattagtacaacctctattcacggcgatagagagcagcgcgaacgagaacaagcccttggcgattttcgttttggtaagtgtccagtgcttgtggctacaagcgtggctgcccgaggactcgacatcgagaacgtgcagcacgtcatcaactttgatctcccatcgactattgacgaatatgttcatcggatcggcaggacaggaaggtgcggcaacacaggcagagccatatccttttttgatcttgaatccgacaaccacttggcccaacctctggtgaaggttttgacagacgctcagcaggacgtgcctgcttggctggaagaaatagcgttttccacgtacatccccggtttctctggatccacccgcggaaatgtctttgcctctgtcgacacacggaaaggaaaaagcactctgaacaccgcgggattctcctcaagccaggctccaaatccggtggatgatgagtcttgggactag

SEQ ID NO: 220300 - DNA, 2175 bp, Artificial Sequence
  Description of Artificial Sequence: Synthetic coding sequence
atgggggacgaggactgggaggcggagattaatccacatatgtccagctatgtgcctatcttcgaaaaagacaggtactccggcgagaacggggacaattttaataggacgcccgctagctctagcgaaatggacgacgggccatcgagacgggatcatttcatgaagtcagggtttgcctccggacgaaattttggaaacagggacgccggagagtgcaacaagcgagataatactagtacaatggggggattcggcgtgggcaagtcatttggtaaccgaggcttcagtaattcccggttcgaggatggtgattcctcaggcttttggcgtgagagctctaatgattgtgaggacaatccaacccgcaataggggtttcagcaaaagagggggataccgggatggcaataacagcgaagcctcgggcccttataggcgtggaggtcgtggcagttttaggggctgtcggggaggctttggtctgggctctcctaataacgacctagacccagacgagtgtatgcaaagaacagggggattgtttggctcacggcgtccggtcctcagtggcacggggaacggggacaccagtcagtcgcgtagtggctctggatctgaacggggtgggtataaaggactgaacgaggaagtgataacaggtagtggaaaaaacagctggaagtcagaagcagaaggcggagagagctcggacacccaggggccaaaggttacatacatccccccaccacccccagaagatgaagatagtattttcgcccattaccagaccgggattaacttcgataaatacgatactattttggtcgaggttagcggccacgatgcccctcctgccatcctgacatttgaggaggctaacctgtgccagacacttaataacaacatcgctaaggccggttatacaaagttgacccccgtgcaaaagtactctataccgatcatcctcgccggtagggacctcatggcatgcgcccagacgggctctggcaagacagcggctttcctgctgccaatactggcgcatatgatgcatgacggaataacggcaagcaggtttaaggaactgcaggaaccagagtgcatcatagtggctccaacgagggaactggttaatcagatataccttgaggctaggaagttttcctttggcacctgcgtgagagccgtagtgatctacgggggaactcaactgggccactcaatccgtcagattgtgcagggctgtaacatcctgtgtgcaactccaggtagactgatggatatcattgggaaagagaagataggtttgaagcagatcaagtacctggtgctcgacgaagccgataggatgctcgacatgggatttgggcctgagatgaagaagctgatcagctgccctggaatgcccagcaaggaacagcgccaaactctgatgtttagcgccacattccccgaagagatacagagattggcagcagagtttttaaaaagtaattatttgtttgtggccgtcggccaggtaggtggcgcttgtagagatgtgcaacagactgtgttacaggtcggccagttcagcaaaagggaaaagcttgtggagattctccgaaacatcggagatgagcggaccatggtgttcgtggaaaccaagaagaaggcggatttcatcgcaacattcttgtgccaggagaagatttcgacaaccagcatccacggcgaccgagaacagagggaacgggagcaggctttgggcgacttccgcttcggaaaatgccccgtgctggttgcgactagcgttgccgcacgtggattggacattgagaatgttcagcatgtgatcaatttcgatcttccctcgaccatagatgaatatgtacacaggattggaagaacgggcagatgtgggaatacaggccgagccataagcttctttgatctcgagtctgataatcacctggcccagccccttgtcaaagtcctgaccgatgcacagcaggatgttcccgcatggttggaggagatcgcattctcaacctatattcccggtttttccggctccacaagaggcaacgtgtttgcaagcgtggacaccagaaaaggcaagtcgaccctgaatacagctgggttttcatcttctcaggcccctaatcctgtagatgatgaaagctgggattag

SEQ ID NO: 220301 - DNA, 318 bp, Artificial Sequence
  Description of Artificial Sequence: Synthetic coding sequence
atgggggatgaagactgggaggccgagataaacccacatatgtcctcctacgtgcctattttcgagaaagatcgatactctggcgagaatggagataactttaataggacacccgcatctagttcggagatggatgacggcccaagcaggcgagatcatttcatgaagtcaggattcgcgtctggcagaaattttgggaacagggacgcaggagaatgtaacaagagggacaatactagcactatggggggttttggagtcgggaagagctttgggaatagaggtttctctaattctcgatttgaagatggtgattag

SEQ ID NO: 220302 - DNA, 2115 bp, Artificial Sequence
  Description of Artificial Sequence: Synthetic coding sequence
atgggggatgaggactgggaggcggagattaatccccacatgtcaagctatgtccctatcttcgaaaaggacagatacagtggcgaaaacggcgataatttcaacagaactccagcgagctcctcagaaatggacgacggaccctccagaagagaccacttcatgaaatcaggcttcgcctcagggcgaaatttcgggaacagagacgctggtgaatgcaataaacgggacaatacctcaacaatgggcggattcggagttggaaagtcttttgggaacaggggcttttccaacagcaggttcgaggatggggattcctcagggttctggcggggataccgtgatggtaataactctgaagcttctggaccttatagacgaggaggaagggggtcattccgaggctgtagagggggatttggcctgggttccccaaataacgacttggatccagatgagtgcatgcagaggaccggtggcctcttcggctccaggcgccctgtccttagcggcacgggcaatggggacacctcccagtctcgatcaggctccgggtctgaaaggggcggatacaaggggcttaacgaagaagtgataaccggaagtgggaagaacagctggaaatctgaggccgaaggcggagagtccagtgacacccagggacccaaagtcacgtatattcctcctcctccacctgaggacgaggattccattttcgcgcactaccagaccggcatcaacttcgataagtatgacaccatcttagtcgaagtaagcggccatgacgccccaccagcaatcctgacattcgaggaagcaaatctctgccagactcttaacaacaatatagccaaggcgggatacacaaagctgacgcctgtgcagaagtattccatacctattatcttggcgggtcgtgacctcatggcctgtgcccagactggtagcggcaaaactgccgcttttctcttgccaatcctagcccacatgatgcacgatgggatcacagcgtcaaggttcaaagaattgcaagagcccgagtgcatcatcgtcgctcctacccgggagctcgtgaaccaaatttatctggaggccaggaagttctcattcggaacctgtgtgagggctgtcgttatatacggaggcacacagctcggtcacagtatccgtcaaattgtccaaggctgtaacatcctgtgcgctaccccaggacgtctgatggatatcatcggtaaggaaaaaatcggtctgaagcagatcaaatacctcgtattggacgaagcggatagaatgctggacatggggttcggtccagagatgaaaaagctgatctcctgtcctggaatgccctctaaggagcagagacaaacactgatgttcagcgcaacctttcctgaagagattcagagattggccgcagagttcctgaagtctaactaccttttcgtggccgtcggacaggttggcggagcgtgccgggacgtacagcagaccgtattgcaggtcgggcagttctccaagagagaaaaactggtggaaatcctgcgcaacataggggacgaacgtacaatggtcttcgttgagacaaaaaagaaggctgactttatagccaccttcttatgtcaagagaaaatttcgacgacatccattcatggtgatagggagcagagagagcgcgaacaggccctaggagatttccgcttcgggaaatgcccagtgctcgtggccacctccgtggccgcaaggggactggatattgaaaatgtccagcacgttatcaattttgacctcccttctaccatcgatgagtatgtgcacagaatcgggcgtacagggagatgcgggaataccggcagggccatctctttctttgatttggaatcagacaaccacctagcacaaccgctggtaaaggttctaaccgatgcccaacaagacgttccggcatggctcgaggagatcgcttttagcacatatatcccgggtttttccgggtcgaccagagggaacgtctttgcctcagtcgacactcgcaaggggaagtctaccttaaacacagccggatttagttcgagtcaggctcctaaccctgtggacgatgagtcctgggactag

SEQ ID NO: 220303 - DNA, 480 bp, Artificial Sequence
  Description of Artificial Sequence: Synthetic coding sequence
atgggagatgaagattgggaggccgagatcaatccacacatgtcttcctacgtgcctatcttcgaaaaagatcgctactctggggagaatggcgataactttaatcggacccctgcatcttcatcagagatggatgacgggccttcaagacgagatcattttatgaagtcaggctttgcttctggacggaacttcggcaaccgcgacgcgggagaatgtaacaaacgagacaacacctccacaatggggggatttggtgtaggtaagtcctttgggaacagaggtttctcaaattccaggttcgaagacggcgattcatctggattttggagagagagttcaaacgactgcgaagacaatcctacccgtaatcggggattttccaagcggggtggctatcgagacgggaataactcagaagcttccggtccataccggagggggggaaggggaagctttcgaggctgcaggggcggatag

SEQ ID NO: 220304 - DNA, 1728 bp, Artificial Sequence
  Description of Artificial Sequence: Synthetic coding sequence
atggggtcaaggaatctgttcctcaccaactccccagagagttcaaatgactgtgaggataaccccaccagaaaccgcggattcagtaaacgtggagataacgacctggaccccgatgaatgcatgcagaggactgggggtctatttgggtcacgcaggcctgttctgagcggaacggggaacggagacaccagccagagtcgaagcggctccggttctgagagggatagttggaagtctgaagctgaaggaggcgagagtagcgacacccaggggcctaaagtgacctacattccaccccctcctcccgaagacgaggatagtatcttcgcacactaccaaactgggatcaactttgacaaatatgataccatattagtggaagtaagtggacatgacgccccacctgccattctgactttcgaagaagctaatctctgccaaaccctaaataataacatcgctaaggccggttataccaagctcacgccagtgcagaagtattccatccctattatattagccggtcgagatttgatggcctgtgcccagactgggagtggaaagacagcggcattcttattgcctatcctggcccatatgatgcatgatggcatcactgcaagccgattcaaagaactgcaggaacccgagtgtatcatagtagcccctacacgcgaactggttaaccagatctatctggaagccaggaagttttcctttggcacttgcgtgagggccgtggtgatatacggaggaacgcagctcggacacagcatccgacagatcgtgcaggggtgcaatatattatgcgctaccccgggacgactgatggacattattgggaaggagaaaattgggcttaagcagatcaagtaccttgtgctggacgaggctgaccgaatgctcgatatgggtttcggtcctgagatgaaaaagctgatctcctgccctggcatgcctagtaaggagcagcgacaaacactcatgtttagtgccacattcccagaagagattcaacggctggcggcagaatttctcaagtcgaattacctttttgttgccgtgggccaggttggaggcgcatgcagggacgtgcagcaaactgtactacaggtcggccagttctccaagagagagaagctcgtagagatactacgcaatattggagacgagaggacaatggtttttgtcgagacaaagaaaaaagcagactttattgccacattcctctgtcaggaaaagatctctactaccagtattcatggggacagagagcagagggaaagggaacaggccttgggcgattttcggttcggaaagtgtcccgtgcttgtagccacctcagtggcagccaggggcttagatattgaaaatgtccaacatgtgatcaacttcgacctaccatccaccattgacgagtatgtgcacaggattgggaggactggaaggtgcggaaatactgggcgtgccatctcgttcttcgacttggagagtgataatcacctggcgcaacctttggtgaaggtgctgacagatgcccagcaggatgtccccgcatggctcgaggaaatagctttttcaacatacataccagggttctcagggtcaaccaggggtaatgtgtttgcctctgttgatacacgtaaaggtaaaagcacccttaatactgctggatttagttcctcacaagcaccaaatccggtggatgatgaatcctgggattag

SEQ ID NO: 220305 - DNA, 1869 bp, Artificial Sequence
  Description of Artificial Sequence: Synthetic coding sequence
atggaggaaagcgagcctgaaaggaaacgtgctcgcaccgatgaagtgccggcaggtggctcaagatcagaagcagaagatgaggacgatgaggactatgtgccttatgtgcccttacggcagagacgccaactgctactccagaagctgctccagcgccgacgcaagggcgcagctgaagaggaacaacaggacagtgggtccgagcctaggggggacgaggacgacattcccctgggtcctcagtccaacgtttctctgcttgatcagcaccagcaccttaaagagaaggctgaggcccgtaaagaaagtgccaaagagaagcagctcaaggaggaagaaaagatactcgagagtgtggccgaaggacgcgctcttatgtctgtcaaggaaatggctaaggggatcacctatgacgatcccattaagacgtcatggacacccccaaggtacgttttgtctatgagcgaggagcgacatgaacgcgtcagaaagaagtaccatattcttgtagaaggcgatggcatcccaccacctatcaagtcatttaaggagatgaagtttccggcagctatcttgagaggcctgaaaaaaaaaggaatacatcaccctacccctattcagattcaagggatccccacaattcttagcggcagagatatgattggaattgcgttcaccgggagcggaaaaaccctggtattcacacttccagtaattatgttctgtctggagcaagaaaagcgactccctttcagcaaaagggaggggccatacggactgatcatctgcccgagcagggagcttgcaaggcagactcatggcatattagagtattactgccgtctcttgcaggaggactctagtccattgctaagatgtgcactctgtatcggaggtatgagcgtaaaagagcaaatggagaccattagacacggggttcacatgatggtcgccacacccggaagactcatggacctgctgcagaaaaagatggtgtcactggatatttgccgctatctggcattagacgaagcggacagaatgatcgatatgggattcgaaggggatataagaaccatttttagctactttaaaggacagcgccagaccctgcttttctccgcaaccatgcccaaaaagatccaaaacttcgcaaaaagcgcgctcgtcaaaccagtgacaataaatgtgggcagagcgggagccgcatccctggacgtgatccaggaggtagagtacgttaaagaggaggccaaaatggtttacctgctcgagtgtctccaaaagactcctccgccagtcttgatctttgcagaaaaaaaggccgacgttgacgctattcacgaatacttgctgcttaaaggcgtcgaggccgtggccatccatggtgggaaagatcaggaggagaggacaaaagcaattgaagcattccgtgagggcaagaaagatgtgttggtggccacagacgttgcttccaagggacttgacttcccagctatccagcatgtcattaactatgacatgcccgaagagatcgagaactatgtacatcgaatagggagaacaggtcggagcggcaacaccgggatcgcaacaacctttattaacaaggcctgtgatgagtctgtgttaatggatcttaaggcgcttttgctggaggctaagcagaaggtgcctccagtgttgcaggttctgcattgtggcgatgagtcaatgctggatataggaggggagcgcggttgcgccttctgcggcggactgggtcacaggattactgactgtcccaagcttgaggccatgcagacaaagcaagtatcaaatataggcaggaaagactacctcgcacatagctccatggatttttag

SEQ ID NO: 220306 - DNA, 1881 bp, Artificial Sequence
  Description of Artificial Sequence: Synthetic coding sequence
atgcaccagataaggaagagcgagtacacccaaccaactcccattcagtgtcagggggtccctgtggcccttagcggcagagacatgatcggcattgctaagactggaagcggaaagactgctgctttcatttggccaatgctaatccatattatggatcagaaggagttggaacctggcgatggcccaatagccgtgattgtttgtcctactagagagctgtgccagcagattcatgccgagtgtaaacgctttggtaaggcctacaacctcagaagtgtggcggtctacggcggaggctcaatgtgggagcaggccaaggccctgcaggagggcgcagaaattgtagtgtgtacccctggtagacttatcgatcacgtcaagaaaaaggccactaacctccagagggtgagttatctcgtcttcgacgaagctgatagaatgtttgacatgggcttcgagtaccaggtccgttcaatcgcctctcacgtgcgcccagaccgacagacacttctgttctcagccacgttccggaaaaagatcgagaagcttgcacgggatattctgattgaccctattcgtgttgttcagggcgatattggggaggctaatgaagacgtcacccagatcgtcgagatacttcactcggggccttcaaagtggaattggctcactagacggctcgttgagttcacttcctcgggcagcgtgttgctgttcgtgactaaaaaagctaatgccgaagaactagcaaacaatttgaagcaggagggtcacaaccttggtctgctacacggagatatggaccagagcgagcgaaataaggtgatctcagatttcaaaaaaaaagacatcccggttctggttgccaccgatgtcgcagcccgtggtctggacattccctctataaaaaccgtgatcaactacgacgtcgcccgtgatatcgatacactgctgacacctaaggactctaacttcgccggagaccttgtgaggaacctcgaaggagccaatcagcatgttagcaaggagctgctggatcttgccatgcagaatgcttggtttcgaaagagccggtttaaaggaggcaagggtaagaaactaaacataggcggtggcggactaggctaccgggagcgcccaggactcgggtctgaaaatatggaccggggaaacaacaacgttatgagcaactatgaagcctacaagcctagtaccggtgctatgggagatcggctcacagccatgaaagcagcgttccagagccaatataaatctcacttcgtagctgcctctctgagcaaccagaaggctgggagtagtgcggcaggcgcttctgggtggaccagcgccggatccctcaattctgttcctaccaacagcgctcagcagggtcacaacagtcctgactcccccgtaacatcagccgctaaggggatcccgggtttcggcaataccggcaatatttccggcgcacctgtgacgtatccgagcgctggcgctcagggcgtgaataacacagccagcgggaacaattcccgggaaggaaccggcggatccaacggtaagcgggagcggtacactgagaatagggggagctctcgccatagtcatggagagactgggaacaggcactcggactcaccccgacatggagatggaggtaggcacggtgatggttaccggcaccccgaatcgtcatctaggcacacagatggtcatagacatggggagaacaggcacgggggtagcgcagggaggcacggggagaacagaggcgctaacgatggcagaaacggcgaatcacgcaaggaggcattcaaccgcgagagcaaaatggaacctcctcccaagcgtaagaaaagcaggtgggactcctag

SEQ ID NO: 220307 - DNA, 2817 bp, Artificial Sequence
  Description of Artificial Sequence: Synthetic coding sequence
atgaattggaataagggaggtccaggcactaaacggggttttggattcggtggtttcgccatctctgctgggaagaaagaagaacctaaactgccacagcagagccacagtgccttcggcgcaacatcaagttcatccggctttggtaaatccgctccccctcagctgccctctttttataaaatcggatccaagcgagctaacttcgacgaggagaacgcctattttgaggacgaggaggaggactccagtaacgtggatctgccctatatccccgcagaaaactctccgacacgtcaacagttccacagcaagccggttgacagcgactccgacgatgaccccctcgaggcctttatggctgaagtggaggaccaggccgcaagagacatgaagcgtttggaggaaaaagataaggagagaaagaatgtgaagggcatcagggacgacattgaagaggaagatgaccaagaagcctattttcggtacatggcggagaaccccaccgctggcgtcgtgcaagaggaggaagaggacaacctggaatatgatagcgacgggaacccaatcgctcctacaaagaagattattgatcccctgcctcccatcgatcattcggagattgattacccaccattcgagaagaatttttataatgagcacgaggagattaccaaccttacaccacaacagctgatcgatctgcgacacaagctcaatctgcgggtgtcaggggctgcgcctcccaggccaggatccagctttgcgcattttggtttcgatgagcagctaatgcatcagatccggaaatctgagtatacgcagccaacccctatacaatgtcaaggtgtgcccgtggctttgtctggcagagatatgattgggatagccaagacaggctccgggaagacggctgccttcatttggccgatgctgattcacattatggatcaaaaagaacttgaaccaggtgacggccctattgctgtgatcgtatgtccaactcgcgaactgtgtcagcagattcacgccgagtgtaagcgtttcggaaaagcctacaacctgcgatccgtggcggtgtacggaggcggatcaatgtgggagcaggcgaaggccctccaggagggcgctgaaattgtggtatgcacacctggcagactaatcgatcatgttaagaaaaaggcaaccaatcttcaacgggtttcttatctggtgttcgacgaagcagaccgcatgtttgacatgggcttcgaataccaggtacggagcatcgcaagccacgtccgccctgacaggcagactttgttgttctcagctacatttcggaagaaaatcgagaagctggcgagagacattctcattgacccaatccgggtcgtacagggcgacataggggaggctaatgaggatgttactcagattgtcgagattctgcactcagggcctagcaagtggaattggctcacaagaagactcgtggaattcacctcatcaggttccgtgctgctgtttgtgaccaagaaagctaacgctgaagagctcgccaacaaccttaagcaggagggacataacctgggcttactgcatggggatatggaccagagcgagcgaaataaagttatctcggactttaagaagaaggacatacccgtcctggtcgccaccgacgttgctgctcggggactcgacattccttctattaagaccgtcatcaactacgatgtggcaagggatatcgacacccatacacacaggatcggacggacgggcagagctggcgaaaagggtgtggcttacaccctgcttacacctaaagacagtaatttcgccggtgatctggtgcgaaacctggagggagccaatcaacacgtttctaaggaactgttggaccttgccatgcagaatgcttggttccgtaagagcaggttcaagggcggtaaaggaaaaaaactgaacattggcggaggtggattgggttatcgagagaggccaggcctgggtagcgaaaacatggataggggcaacaataacgtaatgtcgaactacgaagcctataagcctagcacaggagcaatgggcgatagactgactgctatgaaggccgcttttcagagtcagtacaaatcccattttgtggccgcatctctgtccaatcaaaaagccggaagctccgctgccggtgcaagcggctggacttcggccggttcccttaatagcgtacctacgaacagtgcccaacagggtcataatagcccagactcgcctgtaacctccgccgctaagggaatccctggcttcgggaatacagggaacatctctggggcaccggtcacttacccctccgcaggggcacagggcgtcaataatacggctagcggcaacaactctagggagggtaccgggggttccaacggcaaacgcgagagatacactgagaaccgagggtcttcccgccacagtcacggagagactggcaaccgacatagtgacagtcctcgccatggtgatggtggcaggcacggcgacggatatagacacccagagagctcaagtaggcacacggatgggcatagacacggggagaataggcatgggggatcagccggaagacacggggagaatagaggagcgaacgatgggagaaatggtgagtcgagaaaagaggctttcaacagggagagcaaaatggagccaaagatggagcccaaagtggattcgagcaagatggataaggtcgacagtaagacggataagaccgcagatgggttcgcagtccctgagccgcctaaaaggaagaagtccagatgggactcttag

SEQ ID NO: 220308 - DNA, 2817 bp, Artificial Sequence
  Description of Artificial Sequence: Synthetic coding sequence
atgaactggaataagggaggacctggtaccaaacggggtttcggcttcggcggatttgcgatcagtgctggaaagaaagaagagccaaaactgcctcagcagtcacactccgcattcggagcaacctcctcgagttctggcttcgggaaatcagctcccccacagctgccgtcattctacaagatagggtccaagcgggcaaacttcgacgaagaaaatgcctatttcgaagatgaagaagaggactcttcaaatgttgatctgccatacatccctgctgaaaacagtcccactcgccaacagtttcactccaagcccgttgactccgatagcgacgacgaccccctggaagcgtttatggcagaggtggaggaccaggccgctcgggatatgaagaggttggaagagaaggataaggaacgcaaaaatgtaaagggtataagggacgatatcgaagaggaagatgaccaagaggcctatttccgatatatggctgaaaatccgacagccggagtagtgcaggaggaggaggaagataacttggagtatgactctgacggaaatccaatagcccctacgaagaagatcatcgatcctctcccccctattgatcactccgaaattgattaccccccatttgaaaaaaatttctacaacgagcacgaggagataacaaacctgacacctcagcaactcattgaccttagacacaagctgaatctgagggtcagcggcgctgcccctccccgaccaggatcctcattcgcacatttcggattcgatgaacaactaatgcatcaaattcgaaagtccgagtacacccaacctaccccaatccagtgtcagggcgtccccgtagctctgtcgggccgagacatgatcggcatcgccaagaccgggtccggcaagacagctgcattcatctggcccatgttaatacatatcatggatcagaaggagctggaacctggtgatggaccaatcgccgtgattgtctgtcctacacgggaactgtgccagcagattcatgctgaatgcaaaagattcgggaaggcctacaatctccgcagcgtagccgtctatggcggaggctccatgtgggagcaggcgaaggcacttcaggagggagctgaaatcgttgtatgcaccccaggaaggttaattgatcatgtcaagaaaaaagccacgaacctgcagcgggtgtcgtacctcgtgtttgatgaagctgacaggatgtttgacatggggtttgaataccaggtcaggtctattgcgtctcatgtccgtcctgaccgccagactctgttgttttcggctacatttcgcaaaaagattgagaaactggccagggacattttgatcgaccccatcagagtagtccagggcgacattggggaggccaacgaggatgtcacccagattgtcgaaattctacatagcggtccttccaagtggaactggctgacgagaaggctcgtggaattcactagcagcggctctgtgttgctttttgtgacaaagaaagcaaatgccgaggagctcgcaaataatctgaaacaagagggccacaatctcgggctgctacacggcgatatggatcaaagcgaaaggaacaaggtaatctctgatttcaaaaagaaggatatccccgtcctggtggccactgacgttgccgctcgcggtttggatatacccagtattaaaactgtgattaactatgacgttgcaagggacatcgacacgcacacgcaccgtatcggaagaacagggagggcaggagaaaagggagtggcatacaccctgttgaccccaaaggactctaacttcgcaggagatctagtacgcaatcttgaaggagccaatcaacatgtgtctaaagaacttttggacctagccatgcagaatgcttggtttcgcaagagcagattcaaaggagggaaggggaagaagctgaacatcggtggtggcggattgggataccgtgaaaggcccggattgggatccgaaaacatggacagagggaataacaacgtcatgagcaactacgaagcctacaagccctccaccggcgcaatgggagaccgacttaccgcaatgaaggccgcatttcaatcgcagtacaagtcacatttcgtggccgctagtcttagtaatcagaaagcaggctcttccgccgcaggcgcatccggctggacaagcgcgggatccttgaattccgttccgactaacagtgcacagcagggtcacaactcccctgattccccagtcacgagcgccgctaaaggaatccccggtttcgggaatacaggcaatatttccggtgccccagtgacatacccgtctgcaggcgcacagggggtgaacaataccgccagcgggaacaattctcgggagggaactgggggttccaatggtaaaagagagcgatacaccgaaaaccgaggcagcagcagacatagccatggggagaccggaaataggcattctgactcccctcggcacggcgatggcggtaggcatggtgatggctacaggcatccggaaagttctagtcgacacaccgatggacataggcatggcgagaatagacacgggggatccgctgggaggcacggagagaaccggggagcgaatgatggtcgcaacggcgaatcccgaaaggaagcgttcaaccgcgagtctaagatggagcctaagatggaacccaaggtcgattcgagcaagatggacaaagtggatagcaaaacagacaaaacagcggatggtttcgctgtgcctgagcctcctaaacgcaaaaagtcccgttgggactcttag

SEQ ID NO: 220309 - DNA, 2817 bp, Artificial Sequence
  Description of Artificial Sequence: Synthetic coding sequence
atgaattggaacaagggaggccctggaaccaagcgcggatttggctttggtgggtttgctatcagcgcaggaaaaaaggaagagccaaagttgcctcagcagagccatagtgccttcggagctacctcctcatccagcgggtttgggaaaagtgcgccaccccaactgcctagcttttacaagatcggtagtaaacgggctaatttcgacgaggagaatgcttactttgaggatgaagaagaagatagcagtaacgtggatctcccatacattcccgcagagaattcgcctacacggcagcaattccactccaagccagtcgattccgactccgatgacgacccattagaggccttcatggccgaagtagaagaccaggccgctagagatatgaagaggctggaggagaaagataaggagcgtaagaacgttaaaggcattcgggacgatatagaggaggaagacgatcaggaggcttactttcggtatatggctgaaaatcctacagctggagtagtgcaagaggaagaggaagataatctggaatatgacagcgatgggaaccccatcgccccaacgaaaaagataattgatccgctgcccccaatagaccactctgagatagattatcccccatttgagaaaaacttctacaacgaacacgaggaaataacaaacctaacacctcaacagctcattgacctgagacacaagctgaatctgcgagtgtcaggagccgctccgccacgccctggctctagcttcgcacactttggcttcgacgagcagcttatgcaccaaattcgtaagtctgaatatacacagccaacccctatccagtgtcaaggggttcctgtggctttgagtgggcgtgatatgataggcatcgcaaagactggctcagggaagaccgccgcattcatctggccaatgctcatccatataatggatcaaaaggagctcgagccaggggacggtccgatcgcggtcatagtgtgtcccactcgggagctatgccagcagatccacgcagaatgcaaaaggttcggcaaagcatataatctccgatctgtcgcagtctatggcggaggctctatgtgggaacaggccaaggcactccaggaaggcgctgagatcgttgtgtgcacaccaggacggctcattgaccacgttaagaaaaaagctactaatttacagcgcgtgtcttatttggtattcgatgaggctgacagaatgttcgatatgggattcgagtaccaagtgagatccatcgcctcccacgttagacccgaccggcagactctgcttttttctgccacattcagaaaaaagattgaaaaactcgctcgagacatactcatcgatcccatccgggtggtgcagggagacatcggggaagccaatgaggatgttacccagattgtggaaatcctgcactcaggccctagcaagtggaattggctgacacggcgtctggtagaattcactagttctggctctgtccttttgtttgtgactaaaaaagccaacgccgaggagctggccaacaacctgaaacaggagggccacaacctcgggctcctgcacggagacatggaccagagtgaacgaaataaagtgatttcggactttaaaaagaaggatattccagttctcgtcgcgaccgacgtggcggcaagaggcttagacatcccaagtataaagacagtgataaattatgatgtggctcgggacattgatacacacacacatcggataggtagaacagggagggccggagagaaaggtgtagcctacaccttgcttaccccgaaggattctaatttcgcaggcgatttggttcggaacctcgagggcgcaaaccagcatgtgagcaaggaactactggacctcgcaatgcagaatgcttggtttaggaagtcccgcttcaaaggagggaaagggaaaaagcttaatattggtgggggagggctaggatacagggagaggcccggtttgggaagcgagaatatggaccgtggtaataacaacgtaatgtcgaactacgaagcgtacaagccgtcgaccggagcaatgggtgatcgtctcaccgccatgaaagcggcatttcagagccagtacaagagccatttcgttgcggcatcactctcgaatcagaaagcaggctcatctgccgctggcgcttcaggatggacgagcgcaggatcattaaactccgttccaactaactctgcacaacagggccataactcacccgacagtcctgttacctcagccgctaaggggatacccggattcggcaataccggcaatatttcaggcgcacctgtgacatacccctcagctggggctcagggtgtgaacaacaccgcatcagggaacaattcccgtgaaggcacaggtggctccaacggtaagcgggaacgctacaccgaaaatcgcggtagctccaggcactcccacggcgagactggaaacaggcattccgactcgccccgtcacggggacgggggtcggcacggagacggataccgccatcccgagtcttcaagtaggcatacagacggccatcgccacggcgaaaatagacatggtggatctgctggcaggcatggagaaaaccggggagccaacgacggcagaaatggtgagagccggaaagaggcattcaatagagaaagcaaaatggagccgaagatggagcccaaggtggacagctcaaagatggacaaagtggactcaaaaacggacaagactgcagacggctttgctgtgcccgagccaccaaagcggaaaaagtcccgatgggacagttag

SEQ ID NO: 220310 - DNA, 2817 bp, Artificial Sequence
  Description of Artificial Sequence: Synthetic coding sequence
atgaactggaacaaagggggacccggtacaaaacgtggtttcggcttcgggggattcgcaatttccgccggaaaaaaggaggagccgaagctgccacagcagtcccacagcgccttcggcgctaccagcagttcttctggctttggaaaaagtgccccaccccagcttcctagcttctacaagatcggtagcaagagggctaatttcgatgaagaaaatgcctatttcgaggatgaagaagaggatagctcaaacgttgaccttccctacatcccagcggagaactcacccaccaggcaacagttccattctaaaccggtcgactctgatagtgatgacgacccactagaggcattcatggcagaggttgaggaccaagccgcaagagacatgaaaagactcgaagagaaagataaggaaagaaagaatgtgaaaggcataagggacgacatagaggaagaagacgaccaagaggcttactttcgatatatggccgaaaaccctacagccggagtggtacaagaagaggaagaggacaatctggagtatgactcggacgggaaccccattgcccctacaaaaaagatcatagacccattgccacctatcgaccactccgagatcgactatccgccatttgagaaaaatttctataacgaacatgaggagattaccaacctgacaccccaacagttaattgacctgagacacaagcttaaccttagggtttccggcgctgcccctcctagacctggaagttcttttgcccactttggcttcgacgaacaattgatgcaccagatacgcaagagtgaatatacccaacctactcctatacaatgtcagggcgttccggtagccctttctgggagggacatgatcgggatcgccaaaaccggctctggcaagactgcagccttcatctggcccatgctgatccatatcatggaccagaaggaactggaacctggtgacggacccatcgctgtgatcgtctgtcctacgcgggaactgtgccaacaaattcacgcggaatgcaagaggttcggaaaagcctacaacctccgatccgtcgctgtgtacggaggaggttccatgtgggagcaggccaaagcacttcaggaaggagccgagattgtagtgtgtacaccgggaagactgattgatcacgtgaagaaaaaagccacaaatctccagcgtgtctcttacctggtgtttgatgaggctgatagaatgttcgacatggggtttgagtaccaggttcgctctattgctagccacgtccggccagatcggcagacactgctattctccgctacatttagaaagaagattgaaaagctcgccagggatattttaattgatcccatccgggtggttcaaggggatattggagaggctaatgaagatgttacccagattgtagagatcttgcacagcggacccagcaagtggaactggctgacgcggagattagtcgagtttacctcaagcggtagcgtcttgttgttcgtgactaaaaaagctaacgcggaagagttggctaacaatctcaagcaggagggccacaacttggggctgttgcatggggacatggaccagtccgagaggaataaggtgatctctgacttcaagaaaaaggatatcccagtactggtagcgactgatgtcgcagctcgcggtctcgatatcccaagcataaagaccgtgataaactacgatgtggctagggatatcgatactcatacgcatcgaattggccgtaccggtcgtgccggtgagaaaggggtagcatatactttattgactcccaaggattcaaattttgcaggtgacctggtcaggaacctcgaaggtgcaaatcagcacgtatcaaaggagctgctggatctcgcgatgcagaacgcttggttccgcaaatcccgatttaagggaggcaaaggaaagaagctcaacattggaggaggtgggctgggctaccgtgaacggccaggactcggcagtgagaatatggacagaggtaacaataacgtcatgagcaattatgaagcctacaagccgagtaccggggctatgggagacaggctgacagctatgaaggcagctttccagtcccagtataaatctcactttgttgcagcgagtctgtctaaccagaaggcgggatcctcggccgcaggagcaagtggatggacttctgccggtagtttgaattccgtgcccaccaattccgcccagcagggccacaatagccccgactcccctgttacatcagccgctaagggcatccccggattcggcaatactgggaacatcagtggagctcctgtgacatacccaagtgcaggcgcacagggagtcaacaacaccgcaagtggcaataattcccgggagggaaccggaggttccaacggcaaacgcgaacgttacacagagaatcggggttcatctcggcattcccacggcgaaacaggaaaccgccactccgactcgcccaggcacggtgacgggggtcggcacggggacgggtataggcacccagaaagctcttcccgccacactgatggccatcgccacggcgagaataggcatggcggaagcgccggacggcacggcgagaatcggggagcgaatgacggacggaatggagaatctcgaaaggaagcattcaatcgggagtctaaaatggaacctaagatggagccaaaagtggactcatccaagatggacaaggtcgacagcaaaactgacaagacagccgatggatttgccgtgccagaaccacccaagagaaagaagtcccgatgggattcttag

SEQ ID NO: 220311 - DNA, 1947 bp, Artificial Sequence
  Description of Artificial Sequence: Synthetic coding sequence
atgtctcatcatgggggtgccccaaaagcatcaacatgggtcgtagcatccagaaggagttccacagtgtctcgcgcaccggaacgcagaccagccgaggagctgaaccggacgggccctgagggatactctgtcgggaggggcggacgatggcggggaaccagccgtcctccagaggctgtcgctgcgggtcacgaggagctccccctgtgtttcgctttgaagagtcactttgttggcgcagttatcggccgaggaggctcgaaaatcaagaacatccagagcactacgaatactaccatacagattatccaggagcagcccgagagcctcgtgaaaatatttgggtctaaagccatgcagaccaaggcaaaagccgtgatcgacaatttcgtgaagaagctcgaggaaaattacaattccgaatgtggcattgataccgcttttcagccttcagtcggcaaggacgggagtactgataacaatgtagttgctggtgatcggccactgatcgattgggatcagattagggaggaaggactcaaatggcagaagacgaaatgggccgatcttccacctataaaaaaaaatttctacaaggagagcacagccaccagcgccatgtcaaaggtagaggctgatagttggagaaaggaaaattttaatataacttgggatgacctgaaagatggagaaaaacgcccaattccgaaccccacctgcacgttcgatgacgcatttcagtgttacccagaggttatggaaaacattaagaaggctgggttccaaaaaccgacccctatccagtcccaggcatggcctatcgtgcttcagggcatcgacctgatcggcgtagcccaaacaggaacaggcaagacactttgttacctcatgcccggttttattcatctggttctgcagccctcgctgaaaggtcagaggaacaggcctggtatgctcgtgctgacgcctactcgcgaactagctctacaggtggaaggagaatgctgcaagtactcctacaagggacttagaagcgtttgtgtttatgggggaggtaatcgggacgaacagatcgaggaactaaaaaagggcgttgatataataatcgcaaccccaggacgtctcaatgacctgcagatgtccaactttgttaatctcaaaaatattacctatcttgtcctggatgaggctgacaaaatgctggacatggggttcgagccacagataatgaaaatcctcctggatgtccggcctgacagacaaacagttatgacctcagcgacatggcctcattctgtgcaccgtttggcacagtcttaccttaaagagccaatgattgtctatgtgggcacgcttgacctcgtggccgtgtccagcgtcaaacagaacatcatcgtgacgactgaggaagagaagtggtcacacatgcaaacctttctgcaatctatgtcaagtactgacaaggtcatcgtctttgtgtcccgcaaggcagtcgctgatcacctcagctcagatctcattctcgggaatataagtgtggagtccctacatggagaccgagagcaaagggaccgtgaaaaggcactggaaaactttaagacaggcaaggttagaattttgattgccacagatttggctagccgaggactagatgtacacgacgtgactcatgtatataattttgatttcccacgaaatattgaagaatatgtgcatagaatcggtagaactggacgggcaggccgtactggcgtgtctatcactaccttaaccaggaatgattggagggttgcgtccgaacttattaacattctggaaagagccaatcaatcgatacctgaagagttggtttcaatggcggaaagattcaaagcccaccagcagaagcgggagatggaacgcaagatggagaggccccaaggacgaccgaagaaattccattag

SEQ ID NO: 220312 - DNA, 588 bp, Artificial Sequence
  Description of Artificial Sequence: Synthetic coding sequence
atgagtcatcatgggggtgccccaaaagcctctacatgggtggtggcgtcccggagatcttcaaccgtgtctagggcaccggagcgcagacctgcggaagaactcaacaggactggccctgagggctactccgtcgggaggggaggcagatggaggggcacctcccggcctcctgaggcagtggcagcaggtcacgaggagttgccgttgtgttttgccctgaagtcccacttcgtgggggctgtgatcggtaggggtgggtcgaagataaaaaacattcaatctacaaccaatacaaccatccagattatacaggaacagcccgaaagccttgtgaaaattttcggttcaaaggctatgcaaactaaggcgaaggcagtcatagacaattttgtaaagaaactggaggagaactacaattccgagtgcgggattgacaccgcattccaaccatctgtgggtaaagacggatcaaccgacaataatgtggtggccggtgaccgccctttaattgactgggaccagatccgcgaagaaggcttgaagtggcagaagacaaaatgggcaggcaagaaaatattgatctag

SEQ ID NO: 220313 - DNA, 675 bp, Artificial Sequence
  Description of Artificial Sequence: Synthetic coding sequence
atggaaagtggagcttatggtgctgctaaggcaggaggtagcttcgacctccgccgttttctgacccagccccaggtggtggctagagcggtgtgccttgtctttgcactgattgttttttcttgcatatatggggagggatatagtaacgctcatgaatcgaaacaaatgtattgcgtcttcaaccgaaacgaggatgcctgtagatacggcagcgcaattggggtgttggcctttctggcctccgccttctttttggtggtggacgcctactttcctcagatcagcaatgcaacggaccggaaatatctggtgatcggcgaccttctgttcagtgccctttggacattcctctggttcgttggtttctgctttcttaccaaccagtgggcggtgacaaatcccaaggacgtgctcgttggagcggacagcgtccgcgcagctatcacattctcattcttttcgatcttctcctggggagtgctggcatccctcgcatatcagcgctataaggctggcgtcgatgactttatccaaaactatgttgaccccacaccagaccctaacacagcatatgcatcttacccaggcgctagcgtcgacaactatcagcagccaccctttacccagaacgccgaaacgactgaaggctatcagccgccacctgtgtattag

SEQ ID NO: 220314 - DNA, 1635 bp, Artificial Sequence
  Description of Artificial Sequence: Synthetic coding sequence
atgtctgggtactcctccgaccgcgaccggggaagggaccgtggctttggtgcaccaagatttggtggatctagagctggtcccctgtcaggcaagaaattcggcaaccccggagaaaagcttgtgaaaaagaagtggaatcttgatgaattgcccaaatttgaaaagaatttttaccaagaacaccctgacctggctaggcgtacagcccaggaggtagaaacataccggtacctgctgcccgcaatcgtgcacatcaaccaccagccatttctggagcgaggagatggtccaatatgtttggttctcgcccctaccagagagctcgcacaacaagtgcagcaagtcgccgcagagtattgcagggcatgccggctgaaaagcacgtgtatctacggaggagctccaaaaggtcctcagatcagagatctagagcgtggagtggaaatttgcatcgcaacacctggtcggctgattgatttcttagaatgcggcaagactaacttgaggaggactacatacctggtgctagatgaagccgaccggatgctcgatatgggattcgaaccgcaaatccgtaagatcgttgaccagattcggccagatcggcaaacgttgatgtggtctgccacttggccaaaagaagtccgccagttggccgaggacttcctaaaggactacatccacatcaacataggggctctggagcttagcgcaaatcacaatattctccaaatagtcgatgtctgtcatgatgtcgagaaagacgagaaattaatccgcctgatggaagagattatgagcgaaaaggagaataagactatcgtctttgtggaaacgaagaggcgctgtgatgaactgacgcgcaagatgagacgtgatggttggcccgcaatggggattcacggggacaagtcgcaacaagagagagattgggtcctgaatgagtttaagcacggaaaggcgcctattctcatcgcaaccgatgtcgccagccggggattggacgtggaagatgtgaaatttgtcatcaattacgattatcctaacagcagcgaggactatatccaccggatcgggagaactgcacggtccaccaagaccggcacagcctacactttctttactccaaacaatatcaagcaggtcagtgatctcatctcagtcctgcgcgaggccaaccaggcgattaacccaaaactcttgcagttggtcgaggaccgcggatccggtcggagtcgcggacgcggagggatgaaagatgacagacgtgatagatacagtgctggaaagcgtggaggctttaatacctttcgtgacagggagaactatgatcgcggttacagcagcttactgaagagagacttcggagcgaaaactcagaacggcgtctacagtgccgcaaattacacaaatgggtccttcggaagtaacttcgtgtccgccggaatccagacttcgttccgcacaggaaacccgactggcacataccagaacggctatgacagcacccagcagtacgggtcgaacgtgcctaacatgcataatggaatgaaccagcaggcatacgcgtacccggcaactgctgcagcacctatgattggatatccaatgcccactggttacagccagtag

SEQ ID NO: 220315 - DNA, 1845 bp, Artificial Sequence
  Description of Artificial Sequence: Synthetic coding sequence
atgtccggctactccagtgatagagaccgaggaagggaccggggattcggggcacctagatttggaggatctcgggcaggaccgctgagcgggaagaaatttgggaacccgggtgaaaagctggtcaaaaagaagtggaatctggatgaacttcctaagttcgaaaagaacttctatcaagagcaccctgacctggctcggcgaacagcacaggaagtagagacttaccgacgtagcaaagagattacagttcgaggtcacaattgccctaaacctgtcctgaatttctatgaggctaattttcctgctaacgttatggatgtgatagcaagacaaaactttaccgagcccacggcaattcaggcacaaggatggcctgtggccctctctggccttgatatggtcggggttgcgcagactggatcgggcaagaccttgagttaccttctgcccgcaatcgtccatataaatcaccagcctttcctcgagcgaggagatggtcctatctgtctggtcctggcgccaactcgggaactggcccaacaagtgcagcaagtcgccgctgaatactgtcgcgcatgtagattaaagtccacatgcatctatgggggagcccctaagggtcctcagattagggacctggagaggggcgtagagatctgtattgctacgcccggaaggctgatcgatttcctcgagtgcggcaaaactaaccttagaaggacaacatatctcgtgctggatgaggcagataggatgctggacatgggatttgagccgcagattcgcaaaattgtggaccagatcaggcccgataggcagacactcatgtggagtgccacttggcctaaagaggttcggcaactcgccgaggacttccttaaagactacatccacattaatattggagctctggagctgagcgcgaatcataacatcctgcagattgtggacgtgtgccacgacgttgaaaaagatgaaaagttgatccggctgatggaggagatcatgagcgagaaggagaataagaccatcgtttttgtggagacaaaaagacgctgcgacgaactaaccagaaaaatgaggcgggacgggtggcccgctatgggtatacacggggataaaagtcagcaggaacgggactgggtgctaaatgagttcaagcacggtaaggcccctatcctaatagcgacagatgtggcttcccgcggactcgacgtcgaggatgtgaaattcgtcattaactacgactatcccaatagcagcgaagattacattcacagaattgggcgtactgcgaggtccaccaagaccgggactgcgtatactttttttaccccgaacaatatcaaacaagtgtctgaccttatcagcgttctcagagaagcaaatcaggccattaatccaaagctactgcagcttgttgaagataggggctcaggacgcagccggggacgcggtggtatgaaagacgaccggagagacagatattctgctggtaagcggggaggttttaacaccttccgggaccgggagaattacgatcgcggatactcttctctattgaaacgcgacttcggcgctaaaacacagaacggcgtgtattctgccgcaaattataccaacgggtcatttggctcgaattttgtttccgccggtattcagacttcattccgaacaggcaaccctacaggtacctaccagaacggctacgacagcacacaacagtacgggtccaacgtgcctaatatgcataacgggatgaaccagcaagcgtacgcttatccagctaccgccgctgcacccatgatcggttatccaatgcccacggggtatagtcagtag

SEQ ID NO: 220316 - DNA, 1800 bp, Artificial Sequence
  Description of Artificial Sequence: Synthetic coding sequence
atggacgtccatgatctctttcggaggctgggagccggtgccaagtttgacacccgccgattttccgctgatgctgcacggttccagattggcaagcggaagtatgacttcgactcatcagaggtgctgcaggggttggatttctttggaaataaaaagagcgtgcctggggtctgcggtgcttctcagacacaccagaaaccgcaaaatggcgagaagaaggaggaatccctgactgagcggaaaagagaacaaagcaagaagaaaagaaagacgatgactagcgagatcgctagtcaggaggagggcgcaaccattcaatggatgagcagcgtcgaagcaaagattgaagacaaaaaggtgcagcgggagtccaaactgacgagcggtaagcttgagaatctgagaaaggaaaagattaattttctgcgcaacaaacataagattcatgtgcagggtactgatctgccggatcctatcgctacctttcagcagctggaccaggagtacaagattaatagccgacttctgcagaacatcctggatgctggtttccagatgcccacccctattcaaatgcaggccatacccgtcatgctccacgggagagaactgcttgcctccgctccaacaggcagcggcaaaactctggctttttctatccctattctaatgcagctaaaacagccagccaacaagggttttcgcgctctaattatttcgcctacccgagagctggcttcgcagattcaccgggaactgatcaagatctcagagggaacgggttttagaattcacatgatccataaagcagccgtggccgctaagaagttcgggcctaagtctagtaaaaaattcgatatcctcgttacaacacctaatcggctaatctatctgttgaagcaggatccacctgggatcgacttagctagtgttgaatggctggtcgtcgacgaatcggacaagttgttcgaggacggaaagaccggattcagagatcagctggccagtatcttcctagcgtgtaccagccataaggtcagacgtgctatgttttcagccaccttcgcgtatgacgtggaacagtggtgcaagctgaacctagataatgtaatttcagtttcaattggtgctcgaaatagcgccgtggagaccgtagaacaagaactgttgtttgtgggctctgagacgggaaagctgttggcaatgagggaactggtgaaaaaaggatttaatccaccggtgctcgtctttgttcaaagcatagagagggccaaagaactgtttcatgagctgatttacgagggtattaacgttgacgtgatccatgcagaacgtactcagcagcagcgcgacaacacagtccactcctttcgggcaggcaagatctgggttctgatctgcaccgcactactggccagaggcatagatttcaaaggagtcaaccttgtcatcaattacgattttcccacatcgtccgtcgagtatatccaccggatcggcaggacaggaagagctgggaataagggaaaggcaattaccttttttactgaagatgacaagccactgctgagatccgtcgccaatgtcattcagcaagccggttgcccggtacccgagtacataaaaggtttccagaagctgctgtccaagcagaaaaagaaaatgatcaaaaagcccttagagagagagagtatttctacaacccccaaatgttttctcgaaaaggcaaaagacaaacagaaaaaggtgacaggtcagaacagcaagaagaaagtggccctggaagataagtcctag

SEQ ID NO: 220317 - DNA, 1476 bp, Artificial Sequence
  Description of Artificial Sequence: Synthetic coding sequence
atgtcatcagtggaggccaaaattgaggacaaaaaggtccagagagaaagtaagctgacatcgggaaagctggagaatttacgaaaggaaaaaataaatttcttaagaaataagcataagatacacgtacagggaactgatctgcccgatccgatagccacattccagcagctggatcaagaatacaagatcaattctcgactgctacagaacattttggacgctggtttccagatgcccacccctatccagatgcaagcgatcccagttatgcttcatggtagggaactcctggcctctgcgccaacaggatctgggaagacgctcgcgttttcaattcccatcctaatgcagcttaaacagccggcaaacaagggatttagggcgctgattatctcgcctacacgtgagctggcgagccagatacatagggaactaatcaagattagcgagggaaccgggttcagaattcacatgatccataaggctgccgtggccgctaaaaaattcgggccaaagtcaagcaaaaaattcgacattctagtgaccacaccgaaccggctaatctatctgctgaagcaggatcccccagggattgatcttgccagcgtggaatggttagtcgtggacgagtccgataagctctttgaggacgggaagacagggttccgtgatcagctggcgtcaatcttcctagcctgcacatcacacaaagtgaggcgcgctatgttttctgccacgttcgcttacgatgtcgagcagtggtgtaagctgaatttggacaacgtgatttccgttagcataggagcccgtaatagcgcagtggagacggtggaacaggaactgctgttcgtcggctctgaaactgggaaattgctggctatgcgcgaattagtcaagaagggctttaaccccccagtgctggtgtttgttcaatccatcgagagggctaaggagctttttcacgaactgatatatgaaggcattaacgttgacgtaattcacgccgaaaggacgcagcagcagagggacaacacggttcactctttccgagccggtaagatttgggtgctcatctgtactgctctactagcaagaggcatcgattttaaaggggtcaacctcgtgattaactacgattttcccaccagcagtgtcgagtatattcacaggattggtaggaccggtagggcaggcaacaagggaaaagcaatcaccttcttcaccgaggacgataaaccacttctgcgcagcgtcgctaatgtcatccagcaagcagggtgtcctgtaccagagtacatcaagggcttccagaagctcctatctaagcagaaaaaaaagatgattaaaaaaccgctggagcgagagtcaatttcaacgactcccaagtgcttcctggagaaagccaaggataagcagaagaaagtgacaggtcagaactctaagaaaaaagtggccctggaagataaaagctag

SEQ ID NO: 220318 - DNA, 2646 bp, Artificial Sequence
  Description of Artificial Sequence: Synthetic coding sequence
atggcggctgataagggcccagctgccggtccacgttcccgagcggcaatggcccagtggaggaagaagaaaggccttaggaagcggcgtggcgctgcttcccaggcgcgaggctccgattccgaggacggcgaatttgaaatccaggctgaagatgatgctagggccagaaagctggggccagggagacctttacccaccttccctactagtgagtgcacttctgacgtcgaaccggatacgcgggagatggttcgagcccagaataagaagaagaaaaaaagcggcggtttccagtccatggggttgtcttaccctgtgttcaagggcatcatgaagaaggggtataaggtgcccacgcctatccagagaaaaactattcccgtaatcctggacggaaaagacgtagtggccatggcccgaaccggatcaggaaagaccgcctgcttcttattaccaatgttcgagcggctgaagacccactcggcacaaacaggcgcacgcgctctgatcttatctcccactcgggaactcgccctccaaaccttaaagttcaccaaagagctcggcaaatttactggactcaagactgcactaattcttggaggtgatcgaatggaagaccagtttgccgctctgcatgagaaccccgatatcataatcgcgactcccggtcgccttgtgcacgttgcggtagagatgtctttaaagctgcaaagtgttgaatacgtcgtgtttgacgaagcggatcggctcttcgagatggggttcgctgagcagctccaagagatcatcgcgagacttccagggggacaccagaccgtgttattttctgccaccctgcccaagctgctggtggagtttgctcgggcaggcctaactgagcctgtcttgattcgcttagatgtcgatactaagttaaacgagcagcttaagacttcttttttcctggtgagagaagataccaaggctgctgtcttgctgcatcttttgcacaacgtggtcaggccccaagaccaaaccgtcgttttcgtggcgacgaaacatcacgctgaatacctcaccgaactattgacaacccagcgcgtgagctgcgcccatatttattctgccttagaccctaccgctcgtaagatcaacctcgctaaatttactttagggaagtgctcgacacttatagtgaccgatctcgccgcaagagggttagacattccgttactcgataacgtgataaattattcgtttccggcaaaaggcaagctgtttttgcatcgagtgggtagggtggcacgcgctggcagatccggtactgcttattcccttgtggctcccgacgagattccttatctgctggatctgcaccttttcttgggacgtagtctcacccttgcccgacctttaaaagaaccttctggcgtggcaggcgtggatggaatgctgggacgcgtcccccagtccgtggtcgacgaggaggactcaggattacagtccacattggaagccagccttgaactgcgaggactggcgagagtggctgacaatgcccagcagcagtacgtgaggtcccgcccagctcccagtcctgagtcaatcaaaagggctaaggagatggatctggtgggcttaggactccaccccctgttctcatccagattcgaggaggaggagctgcagaggctgcgcctcgtagactcaatcaagaattatagaagccgagctacaatatttgagattaatgcctcgtccagggacttgtgcagccaagtgatgcgcgcaaaacggcagaaggatcggaaagccatcgcaaggttccagcagggacaacagggccgacaggaacagcaggagggcccagttggaccagccccatcaagaccagctttgcaagagaagcaacctgagaaggaagaggaggaagaagccggtgagtcagtagaagatattttcagtgaagtcgtcgggaggaaaagacagagaagtggacccaataggggagccaagagacgtagggaggaggccaggcagagggatcaggagttctacataccataccgaccgaaagactttgattctgagcggggtttatccattagcggagaaggtggggctttcgaacagcaggcagccggtgctgtcctggacctgatgggagacgaagcccagaatttaactcggggaagacaacaacttaaatgggacagaaagaagaagaggtttgtcggccagagcgggcaggaggacaaaaagaagataaagactgagagtggcaggtacattagcagttcttacaagagggacctctaccaaaaatggaagcaaaagcagaaaattgatgatcgagactctgacgaggaaggagcctcagacagacgcggacctgagagaaggggcggtaaaagagacagagggcagggagcaagccgaccacatgcgccaggtactccggcagggagagttcgaccagagctgaaaactaaacagcaaatcttaaagcagaggcgacgggcacagaagctgcattttttgcagcggggaggactgaagcagctgtccgcacgaaaccggcgtagagtccaagaacttcaacagggagcttttggcagaggagctaggtctaaaaaaggtaaaatgcgaaagagaatgtag

SEQ ID NO: 220319 - DNA, 2649 bp, Artificial Sequence
  Description of Artificial Sequence: Synthetic coding sequence
atggccgctgacaagggtcccgctgcaggcccaaggagtcgagcagctatggcccagtggcggaagaagaaggggctgagaaagcgcagaggcgctgcttcccaagcgaggggatcggattcagaggacggcgaatttgagatccaggctgaggacgacgcgcgtgctcgaaaacttggacctggtcgccctctcccaactttccctacttctgagtgcacatcagatgtggagcctgacacacgagagatggtacgcgcacagaacaagaaaaagaaaaaatccggaggcttccagagcatgggtttgtcctatccagtgttcaaaggcattatgaaaaaaggatacaaggtccctactccaatacagaggaagacaattcccgtgattctggacggcaaggacgtcgtggcaatggctcggactgggtcagggaagaccgcctgcttcctgctccctatgtttgagagattaaagacacattcagcccagacaggcgcacgcgcacttattttgtccccaacacgcgaactagctctgcagactctaaaattcacaaaggaactgggaaaatttaccggcttaaaaaccgccttaatccttggtggagacaggatggaggatcagttcgcagctctgcacgagaatccagacatcattatcgccactcccggaaggctggtccatgtagctgtggagatgtcccttaagctgcagagcgtcgagtatgtggtttttgatgaagcagacaggttgtttgagatggggtttgccgaacagctgcaggagattattgcacgcctgccgggagggcatcagaccgtgttattctcagccacactacctaagctgctggttgagtttgcacgagcaggccttaccgagccagtgctgatccgactcgatgtggacacaaagcttaacgaacaattaaagacgtctttctttttggtgcgggaggacaccaaggccgcagtcttgttgcatttactgcataatgtggtgcggcctcaagatcagactgtggtttttgtggccacaaaacaccacgcggagtacctcactgagctgctgacaacacagcgtgtgagttgcgcgcacatctattctgcgcttgacccaactgccaggaaaattaacctggccaagttcacactgggcaaatgcagcaccctgatcgtgaccgatctggccgctcggggactggacatacctctgcttgacaacgtgatcaattacagttttccagctaaaggcaagctgttcttgcatcgggtaggcagagttgctcgggcaggccgttccggaacagcttacagtctggtggcacctgatgagataccttatctgctggacctgcacttatttctggggcgttccctcacgctcgcaaggcctctcaaagagccctccggagttgctggggttgatggaatgctcggtcgggtgccacagtcggtcgtcgacgaagaggattcaggactgcaaagcaccctggaagcctccttggagctccggggactggctagagtggcggacaacgcacagcaacagtatgtgagaagcaggccagctccttcacctgaaagcattaaaagggcaaaagaaatggacctcgtggggcttggcctccaccccctgtttagcagtaggtttgaagaagaggagctacaacgattgcgacttgtggacagtatcaaaaactaccgctcccgagctacaatcttcgaaatcaatgcttcatcaagagacttgtgttcccaggtgatgcgtgctaaaaggcagaaggatcgtaaggcgatcgcaaggtttcagcagggacaacagggtcggcaggagcaacaggagggcccagtcggaccggctccctctagacctgctctccaggagaaacaaccagagaaggaggaagaagaagaagctggagagtcagtcgaagacatcttcagcgaagtcgtgggcagaaaaagacagagatccggacctaatcgtggtgccaagagacgtagggaagaagcacggcagagagaccaggaattctacattccatatagacccaaagactttgattctgagcggggactgagtatcagtggagagggcggagcctttgagcagcaagctgcaggtgctgtgctggacctgatgggggatgaggcgcaaaatctgaccaggggtcgtcagcagctgaagtgggatcgcaagaaaaaacgcttcgtgggccaatcaggacaggaggacaaaaaaaaaatcaagaccgagagcggcagatacattagcagtagctataaaagggacttgtaccagaaatggaagcagaagcagaaaatagacgaccgtgactccgacgaggagggggctagcgatcgacgtggcccagagagaaggggaggcaaacgagatcgtgggcaagctggagcctcccgcccacacgcacctggcactccagcaggccgagttcggccagaactgaagactaaacaacaaattctaaaacaacggagaagagctcagaaactccacttcctgcagcggggtggactgaagcagctgagcgctcgcaacaggaggagagtgcaggaactgcagcagggggcttttggaaggggagccagatctaagaaaggaaagatgcgcaagcgtatgtag

SEQ ID NO: 220320 - DNA, 1452 bp, Artificial Sequence
  Description of Artificial Sequence: Synthetic coding sequence
atgagcacggcacgcaccgagaacccagtcatcatgggactgtcatcccagaacggccaactgagaggacctgtgaagccaaccggcggtcctggcggtggcggtactcaaacccaacaacagatgaatcagcttaagaacacaaataccatcaacaacggcacccaacagcaggcccagtctatgacgaccactattaaacctggcgatgattggaaaaaaactttaaagcttcctccgaaggacctgagaataaagacgtcagatgtgacctcaaccaaggggaacgagttcgaggactattgcctgaaaagagagctcctgatgggcatctttgagatgggctgggagaaaccaagccccatccaagaggagagcatccccattgctctgtcaggacgggacattctggccagagccaagaacggaacggggaaaagtggcgcatacttgatcccattgctggagcggttagacctgaagaaagataacatccaagccatggtgattgtgccaaccagggaactggcactgcaagtctcccagatctgtatccaggtgtcgaagcatatgggcggagcgaaggtcatggccaccactggcggaactaacttgcgtgatgacatcatgaggctcgacgacaccgttcacgtggtgattgccactcccggaagaatcctggacttgattaagaagggagtggctaaagttgatcatgtgcaaatgatcgtgctcgatgaagccgataaactcctttcgcaagatttcgtgcagattatggaggatattatcctgactctgccaaaaaaccggcagatcttgttgtatagcgccacttttcctctgtcagttcaaaaattcatgaacagccatctacagaaaccatacgagatcaatctgatggaagagctgacgctcaaaggggtgactcagtactacgcgtacgtgacagagaggcagaaggtgcactgtctcaatacgctattttctagactgcagatcaatcagagcatcatattctgcaactcctctcagagagtggagctcctcgcgaaaaaaatttctcaactgggctacagttgcttctacatccatgctaagatgagacaggagcaccgcaaccgagtttttcatgacttccgcaacggcctttgcagaaacctggtgtgtactgatttatttacccgaggaatcgatatccaagcggtcaacgttgtcattaacttcgatttccctaaactggcggagacctatctgcaccgaataggcagaagtgggagatttggacatctaggactggctatcaatctaataacatacgatgaccgattcaatttaaagtcgatcgaggagcaactgggcacagagattaagcccattccctccaacatagataaatctctgtacgtcgctgagtatcactccgagcctgttgaagacgagaagccgtag

SEQ ID NO: 220321 - DNA, 1452 bp, Artificial Sequence
  Description of Artificial Sequence: Synthetic coding sequence
atgtctaccgcccgaacggaaaaccctgttattatggggctgtcatctcagaacggccaactgaggggacctgtgaaaccaactggaggtccaggaggcggtggaacccagacacagcagcagatgaaccagctaaagaacaccaacaccattaacaacgggactcagcaacaggctcaatctatgaccaccacgattaaacctggggatgactggaaaaaaaccctgaaactgccgccaaaagatcttagaatcaagacatccgacgtaacctcgacaaagggaaatgaattcgaagactactgcctcaaaagagagttactcatgggaatttttgaaatggggtgggaaaagccttcaccaatccaggaagagagcatcccaatcgccttgagcggaagagacatcctggctagagccaaaaacggcactggaaaatccggcgcatatctgattccgctattagagaggctagatctgaagaaggacaatatccaggccatggtcatagttcctacccgggaattggcgctgcaggtatctcaaatatgtatccaggttagtaaacacatgggtggagcgaaggtgatggccacaactggtggtactaatctgagagacgacatcatgagactggacgacacagtgcatgtggtgatcgccaccccaggacgtattctagatttgatcaaaaagggagtggcaaaggtggatcacgtgcagatgatcgttctggacgaggcggacaagctgctctcacaggactttgttcagattatggaagatattattttaaccctcccaaagaatcggcagattctcttgtactctgctacgttcccccttagcgttcagaagttcatgaactctcacctccagaagccttacgagataaacctgatggaggagctgactttgaagggagttacccagtattatgcgtatgttactgaacggcagaaggtgcattgcctgaacaccctgttttcacggttgcagattaaccagtcgataatcttttgtaattcttctcaaagagtggagctcctcgccaagaaaatctcccagctcgggtactcctgtttctacatccacgcgaagatgaggcaggagcaccgcaaccgcgtcttccatgacttcagaaatgggttatgcagaaacttagtctgcactgacctgttcacaaggggcatagatatacaggccgtcaacgtcgtcatcaacttcgattttcctaaattagctgagacctacctccaccgaatcggcaggagcggacgcttcggtcacctggggctggcaataaacctgatcacctacgatgatcgcttcaatctgaagagtattgaagagcaactaggcaccgaaatcaagccaatcccatcaaatattgataaaagtctgtacgttgccgagtatcacagcgaaccagtggaagatgagaaaccatag

SEQ ID NO: 220322 - DNA, 1452 bp, Artificial Sequence
  Description of Artificial Sequence: Synthetic coding sequence
atgtctacagcacggactgagaatccagtgataatgggcctatccagccagaacggccagctccggggacccgttaaaccaaccggtggcccaggcggaggagggacacagactcaacagcaaatgaatcagttaaagaataccaacaccattaataatgggacccagcagcaagcgcagtcaatgaccactacaattaagcctggtgacgattggaaaaagacgctgaaactcccgccaaaagatcttaggataaagactagtgacgtgaccagcaccaagggcaatgaattcgaggactattgcctgaagagagagctactaatgggcatatttgagatgggatgggagaagccctccccaattcaggaggaatctatccccatagccctctcaggtcgagacatcttagccagagccaagaatggtactggtaagagtggtgcctatctgattcccctactggagaggctggacctcaaaaaggacaatatccaggcgatggtcattgtccctacccgcgaactggctctccaggtctctcagatctgtatccaggtcagcaagcacatgggaggcgctaaggtgatggccacaaccggcggtaccaacttgcgcgacgatatcatgcgcctcgacgatacggttcacgtggttattgcaacccctgggaggattctggacttaattaagaagggggttgccaaggtggaccatgtccaaatgattgtgctggatgaagcggataagcttctgagtcaggatttcgtgcaaatcatggaggacatcatcttaactttgccaaagaacagacagattttgctatattccgccacattcccgctgtctgtccaaaaattcatgaatagccatttgcagaagccctacgaaataaatctgatggaagaattgaccttgaagggggtgacgcaatactatgcgtacgtgactgaacggcagaaagtgcattgcctgaataccctattttctcggctgcagataaaccaatctatcattttctgcaatagttcccagcgcgttgagctccttgcaaaaaagatctcacagctaggatacagttgtttctatatccacgcaaagatgcgccaagaacacagaaaccgagtgtttcatgactttcggaatggactgtgcaggaacttggtttgcaccgatctcttcacccgtggcattgacatccaggcagttaatgtcgttataaactttgacttccctaagctggcagagacctacctgcacagaatcggtagatccggacggttcgggcaccttggcttagccattaatctcataacatatgatgataggttcaatctgaagagcatcgaggagcagctagggacagagattaaaccgatcccgagcaacatcgataaatccctctatgttgctgagtaccatagtgagccagtggaggacgaaaaaccttag

SEQ ID NO: 220323 - DNA, 564 bp, Artificial Sequence
  Description of Artificial Sequence: Synthetic coding sequence
atgtctaccgccaggacggaaaaccccgtgattatggggctctcctcccagaatggtcaacttcgcggacctgttaagccgaccggagggccaggcggtggtggaacccaaacacagcagcagatgaatcagcttaagaacaccaatacgattaataatgggacccaacagcaggcacagagcatgacaaccacaattaaaccaggcgacgactggaagaaaactctgaagctcccacccaaagacctgcgaatcaagacatcggatgtcacgtccacaaaaggaaatgagtttgaggactactgcctgaaacgggagctgctcatgggaattttcgagatgggctgggaaaagccttcccctatccaggaggagtcaatacctatcgctctatccggacgcgatatcttggcgagagccaaaaatggcaccggtaaaagtggcgcttacctcattcctctccttgaacgcctagacctgaaaaaggacaacattcaggccatggttatcgtgcccactcgtgaactggccctccaagtgtcccagatttgtaccgtctgttag

SEQ ID NO: 220324 - DNA, 5138 bp, Artificial Sequence
  Description of Artificial Sequence: Synthetic coding sequence
atggaaagaaatgttctcacgactttttcgcaggaaatgtctcagcttatcctgaacgaaatgcccaaggctgaatatagctcactgttcaatgattttgtcgagagtgaattcttcctgatcgatggagattctcttctcatcacctgcatctgcgagatttcgttcaagccaggccagaatttgcatttcttttatcttgtggaaagatatctggttgacctgataagtaaaggagggcagtttaccattgtgttctttaaagatgctgagtatgcctactttaacttcccagagctgctctccctgcgaacagccctcatcctacatctacaaaagaacacaactatagacgtgcgaacaacctttagcagatgtctgtcaaaggaatggggtagttttttggaggagagctatccttattttcttatcgttgccgatgaaggtctcaacgacttacagacgcagcttttcaattttctgatcatccacagctgggccagaaaagttaatgtggtcttaagctccgggcaggaatccgatgttctgtgcctctacgcttacttacttccctctatgtatcgacaccagatcttctcgtggaagaataaacagaatatcaaagacgcctacacaactctcctcaatcagctagaacgctttaagttgtccgccttggccccactcttcgggtctttgaagtggaacaacattaccgaagaggctcataagacagtaagcctgctcacccaagtctggccggaaggcagtgatattagaagggtattttgtgtgacctcatgctcactgagcctaaggatgtaccaccggtttctggggaatagagagccatcaagcggacaggagaccgagattcaacaagtcaatagcaactgtctcacccttcaggagatggaggatctttgcaagctgcattgcctgacggtggtgttcctactgcatctgcctttaagtcagcgtgcttgcgcgagagtgattaccagtcattgggccgaggacatgaagccattgctgcagatgaagaagtggtgtgaatattttatcctgagaaatattcataccttcgaattctggaacctgaacctgatacatctgtccgacctgaacgatgagctcctgctcaagaatatcgctttttactatgagaacgaaaatgtcaaggggctgcacctcaacctgggcgacaccattatgaaggattacgaatacctgtggaacactgtttcaaaactggtgcgggacttcgaagtgggtcagccgtttcctctccgcaccacaaaagtatgctttctggaaaagaaaccgagtcctattaaagactctagtaacgagatggtcccgaatcttggctttatcccaaccagttctttcgtggtagacaagtttgctggggatatccttaaggacttgccttttctgaagagcgatgacccaatcgtgaccagtctggtgaaacaaaaggagttcgacgaactggttcattggcattcccacaagcctctttccgatgattacgatcgaagccgctgtcaattcgacgaaaaatcaagagatcccagggtcttgcgtagcgttcaaaaataccacgtctttcaaagattttatgggaattccttggaaacagtcagcagcaaaattatcgtgactcagactattaagagtaaaaaggacttctccgggcctaaatccaagaaagcacacgaaacaaaggccgagattattgctagggagaataagaagcggctcttcgctcgagaagagcagaaggaagagcagaaatggaacgcattgagtttcagtatcgaagaacagctcaaagagaatctgcatagtgggatcaaaagcctagaagatttcctgaagagttgcaaatcaagctgcgtcaaattgcaggtggagatggtgggcctgactgcatgcctcaaagcatggaaagagcactgccgaagtgaggaaggtaagactacaaaggatctctccattgcagtgcaggtcatgaaacgaatccattctctgatggagaagtattccgagctcctccaggaagatgatcgccagttaatcgcaagatgcttaaaatacttaggattcgacgagttggctagttccctgcatccggctcaggatgccgagaacgacgtcaaggtgaagaagagaaacaagtacagtgttggaatcggccctgctagatttcaactgcagtacatgggtcattatttaatacgcgatgagcgcaaggaccccgaccccagagtccaggatttcattcccgacacatggcagagagagttgttagatgtcgtcgacaaaaacgagagcgccgtgatcgtagcaccaacatccagcggaaagacttacgctagctattattgtatggagaaagtcttgaaggagtccgacgacggagtggtcgtatatgtggccccaacgaaagcgcttgtgaaccaagtggccgctacggtgcaaaacagatttaccaaaaatctgccaagcggagaggttctgtgtggagtttttacccgggagtaccggcatgatgctctaaattgccaagtgctcattaccgtgcctgcctgttttgaaattctcttgctcgctcctcatcgtcagaattgggtgaagaagattagatacgtgatattcgatgaagtacactgtctcggcggtgaaatcggcgctgaaatctgggagcatcttcttgtcatgattaggtgcccattcctcgccctgtcagccaccattagtaatcccgaacacctcacggagtggctccaaagcgtaaaatggtattggaagcaggaagacaaaattatcgaaaataacacagcatccaagagacatgtgggtaggcaagctggattccctaaggattacctacaggtgaagcagtcttacaaggtgcggttggtcctgtacggtgaaaggtacaatgatctggagaagcatgtgtgctctattaagcacggtgatattcactttgatcactttcacccttgtgcagctcttactacagaccacatcgaacgctacggattcccaccggatctgacgctgtcccctagagaaagcatccaactctacgacgccatgtttcaaatttggaaaagctggccacgagctcaggaactctgtcccgagaattttatccactttaataataaattggtgataaaaaagatggacgccaggaaatacgaggaaagcctgaaagcagagctcacctcctggattaagaatggcaacgttgaacaagcacggatggtgcttcaaaacttaagccccgaagcagatctgagtcccgagaacatgatcaccatgtttccgctccttgtcgaaaagctgcgaaaaatggagaagcttcccgcacttttttttctgtttaaactgggcgctgtggagaacgctgccgagtcggtgagtacttttttaaaaaagaagcaagagacaaagcgtcctccaaaggctgataaggaagcccacgtgatggccaataaattgcggaaggtgaagaaatctatcgaaaagcaaaagattatcgacgaaaagagccagaaaaaaacccggaacgtcgaccagagtctgatccacgaagcagagcacgataatctagtgaagtgcttggagaagaatctggaaatcccccaggactgtacctacgcagatcagaaggccgtcgataccgaaacactgcagaaagtattcggtcgtgttaagttcgagaggaagggagaagagctgaaagcccttgccgaacggggaatcggctatcaccatagcgccatgtctttcaaagagaagcagttagttgagatcctcttccgcaaggggtacctgcgcgtcgtaaccgctacggggactttggcactcggggttaatatgccatgtaagtctgtggtgttcgctcagaattccgtttatctggatgcactgaattatagacagatgagcggccgagcgggtagaaggggccaggacctgatgggtgacgtttatttttttgatattccattcccgaagatcggcaagctcattaagtcaaatgtacctgagctccgtgggcatttcccattgtccatcacactggtcctgcgtctgatgctcttggcttctaaaggcgatgacccggaagacgccaaagccaaagtgctgagtgtgctgaagcactcactgttgagtttcaaacagccgagagtcatggatatgttaaaactctacttcctttttagcttacagttcctggtgaaggaaggctacctggatcaagaaggtaaccctatgggattcgcagggctggtatcccaccttcactatcacgagccctccaatctggtgttcgtatcctttttggtgaacggcctgtttcatgatttgtgccagccaaccaggaagggttccaagcatttctcccaggacgtgatggagaagttggtgcttgttctcgctcatctgttcggcagaagatacttcccgcctaaattccaagatgcgcattttgagttttatcagagcaaggtgtttctggatgatctgcccgaggacttcagcgacgctctcgatgagtataacatgaaaataatggaggactttacgacattccttcgcatagtgtccaagttagctgatatgaaccaggaataccaattgccgctgagcaaaatcaagtttacagggaaggaatgtgaggacagccagctcgtgtcccatcttatgtcttgcaaggagggccgtgtagccattagccccttcgtgtgtctttcagggaactttgacgacgacttgctgagattagagacccccaatcacgtgactctcggaaccatcggtgtgaacagatcccaggctccggtgctgctgtcacagaaattcgacaaccggggtcgcaagatgtcccttaatgcatacgcattggatttctacaaacatgggtctctgattggactggtgcaggataaccgcatgaatgagggagacgcgtattacttgctaaaagatttcgccttgacaatcaaaagtattagcgtgtcactcagagaattgtgcgagaatgaggatgataatgttgtcctcgctttcgagcagctctccaccactttctgggagaaactcaataaggtgta

SEQ ID NO: 220325 - DNA, 363 bp, Artificial Sequence
  Description of Artificial Sequence: Synthetic coding sequence
atggaacgcaatgtgctgactacattcagccaggaaatgagccagctgattctcaacgaaatgcctaaagcggagtacagtagcttgtttaacgacttcgtggaaagcgaattcttcctcattgacggtgactccctgttgatcacttgcatctgtgagataagttttaagcccggacagaatctccactttttttacctggtggaaaggtacttggtcgatctgatctccaaggggggacagttcaccatcgtgtttttcaaagatgccgaatacgcttatttcaactttcccgaactgctttcgctgcgtaccgcactgatcctgcatttacaaaagaacacgaccatcgacgtgagatag

SEQ ID NO: 220326 - DNA, 885 bp, Artificial Sequence
  Description of Artificial Sequence: Synthetic coding sequence
atgattcggtgcccatttcttgctttgtcagctactatctctaatcccgagcatcttacagaatggttgcaaagcgttaaatggtactggaaacaggaggataagatcatcgaaaacaacactgcgtctaaaagacatgtgggtagacaggctggatttccgaaagattatctacaagtcaaacaatcatacaaggttcggctcgtgctttatggagaacgctataacgacctcgagaaacacgtatgtagtattaagcacggcgacattcacttcgatcacttccacccatgcgctgccctcaccacggaccacattgaacgttacggattccctccggacttaacactgtctcctagagaatcaatacaattgtatgatgctatgtttcagatttggaaaagctggcctcgcgctcaagaattgtgccccgagaattttattcatttcaataataagctggtgataaagaagatggatgctcgaaaatatgaggagtccctcaaggccgaactgactagctggattaagaatggtaacgtcgagcaggcaagaatggtgctgcagaacctttctcccgaggctgacctcagcccagaaaatatgatcacaatgtttcccttgctggtagagaagctgcgaaagatggaaaaactgcctgctctatttttcttattcaaactcggggctgttgaaaatgcagcggagtctgttagcacctttttgaagaaaaagcaggaaaccaagagaccacctaaggccgacaaggaggcacacgtcatggccaacaagttaagaaaagtgaagaagtccattgagaagcagaaaatcatcgatgagaagtcccagaaaaaccagaaatgtggaagcaagcccaacacctag

SEQ ID NO: 220327 - DNA, 1062 bp, Artificial Sequence
  Description of Artificial Sequence: Synthetic coding sequence
atgcaatcaaagcgtgactgtgaattgtggtgcgagcgcgtgaatcctgagaataaggccgctctggaagcttgggttagagagaccgggataaggctggttcaggtgaatggtcagagaaagtatggagggccaccgccagggtgggtgggaagtcctcctcctgccggaagtgaggtgtttattggcaggctcccccaagatgtctacgagcaccagcttattcccctgtttcagcgagtgggccgactctatgagtttcgtctgatgatgaccttttccggcctcaaccgcggatttgcctacgctcgctacagctccaggcggggtgcccaggctgcaattgcaacactgcacaaccacccgctgcgccctagttgtccactgctggtttgccgctcaaccgaaaagtgtgagttatccgtggacggcttaccaccaaacctgacacgctcagcgttgcttctcgccctccaacccctcggacccggactccaggaagcaagactactcccgtctccaggtcctgcacctgggcagatcgctttgctcaaatttagctcccaccgtgctgctgccatggctaagaaggcactggtggagggtcagagtcacttgtgtggcgaacaggtggccgttgaatggcttaagcctgacttgaaacagcggctgcggcagcagctggtaggacccttccttcggagcccccagcctgaggggtcccagctggccctggcaagggataagttggggttccagggagccagggccaccctccaacttttgtgccagcgcatgaagctaggttcacccgtgtttctgacaaaatgcctgggcattggtccagctgggtggcatcgcttttggtaccaggtggtcattcctgggcatcccgtgcctttctctgggttgatatgggtggtgctaaccctcgatggcagggatggacatgaggtcgccaaggatgctgtgagcgtgagattactccaggcattatccgagtccggcgctaacctcctctggtctgccggtgccgaagctggcacaatggtgaagcaatag

SEQ ID NO: 220328 - DNA, 1491 bp, Artificial Sequence
  Description of Artificial Sequence: Synthetic coding sequence
atgtttgcaaaagctacaaggaactttctacgagaagtggacgccgatggagacctgatcgctgtctctaacttaaacgactccgacaagctccagttactatctctcgtgaccaaaaaaaaacggttctggtgctggcagcggcctaagtaccagttcctgagcctgacattgggagacgtgttaatcgaagaccagttcccctctcctgtggtcgtggagtccgattttgtaaagtacgaagggaagttcgctaatcacgtgagcggcacgcttgagactgcacttggcaaagtcaagttgaatctaggaggctctagcagagttgagtcccaatcatctttcggcaccctcaggaaacaggaggtcgacttgcagcaactgatcagggattctgccgagcgaaccattaaccttaggaaccctgtcctgcaacaggtgctagaaggtagaaatgaggtgctgtgtgttctgacacagaagatcactactatgcagaagtgcgtaatttcagagcatatgcaagtcgaagagaagtgtggcggaattgtcgggatccagactaagacggtgcaggttagcgctaccgaagacggtaacgtgactaaggatagcaacgtagtgcttgaaatccccgcagcaaccacgatagcttatggcgttattgaactgtacgtcaagctcgacggccagttcgagttctgcctgctccgcggaaagcaaggcggattcgaaaacaagaagaggattgattcggtgtatctggacccactcgtgttcagagagtttgcttttatcgatatgcccgatgctgcgcatgggatcagtagtcaagatgggcctctgtcagtcctgaaacaggcaacactccttctagaacgcaatttccacccgttcgctgaattaccagagccgcagcaaaccgcgttgtctgacattttccaggccgtgctgtttgacgacgagctcctgatggtgttagaacccgtgtgcgatgacctggtgtcaggcctctctccgaccgtggccgttctcggcgagctgaagcctagacaacaacaagaccttgtcgccttccttcaacttgtcgggtgcagcttgcagggagggtgtcccggacctgaggatgctggatccaagcaactgttcatgacggcctactttttggtgagcgccctggcagaaatgcctgattcagctgccgctctgctcggcacctgctgtaaactgcaaatcataccaacactatgccacctgcttagagccttgtccgacgacggggtttccgacttggaggatccaacgctgactccgcttaaggacacagagagattcggcattgtccagaggctgtttgccagtgccgacatcagtctagaacgcctcaaatcgtcagtgaaggctgtgatactgaaagattccaaggtctttcctttactgctttgtatcaccctcaatggactctgcgccctaggaagagaacattcctag

SEQ ID NO: 220329 - DNA, 1491 bp, Artificial Sequence
  Description of Artificial Sequence: Synthetic coding sequence
atgttcgccaaggccacccgcaacttccttcgtgaggtagatgctgacggcgatctgattgccgtcagtaacctcaacgacagcgacaaacttcagctgctgtctcttgtgaccaagaagaagaggttctggtgctggcaacgtccgaagtaccaatttctgagtctgaccctgggggatgtcctcattgaggaccagttccccagcccggtggtggtggaaagcgatttcgtcaagtacgaaggcaaattcgcgaaccacgtctctggcacgctggagactgcattgggcaaggtcaagcttaacctaggaggtagttcgcgcgttgaaagccagtcatcctttggcactctgcgtaagcaagaagttgaccttcagcagcttatcagagactcagctgagcggactataaatcttagaaatccggtgctgcagcaggtcctggaagggcgtaatgaagtcctgtgcgtactgacccagaagatcactacgatgcagaagtgcgtgatttccgagcacatgcaggtagaagaaaagtgtggaggcattgtgggaatccagaccaagaccgtccaggttagcgctacagaagacgggaacgttacgaaggacagcaatgtagtgttggagatccccgctgcgactaccatcgcttacggcgtaatcgagctctatgttaaactcgatgggcaatttgaattttgtctgctcagaggcaaacagggtggcttcgaaaataagaagagaattgacagtgtctacctcgatcccctcgtgttcagggagttcgcttttattgatatgcccgatgccgctcacggcatctcgagccaggacggtcctctaagcgtgctaaagcaagcaactctgctgctcgaacgtaacttccacccatttgccgagctgcctgagccccaacagacagcactaagcgatatttttcaagctgtgctgtttgacgatgagctgctcatggtcttggaaccagtttgcgatgacctcgtctcaggattgtcccccacggtagccgtactgggagagctcaaaccgcgacagcagcaggatctggtcgctttcctgcagctcgtaggatgttccctccagggtgggtgccccggacccgaagatgcgggatcaaagcaattatttatgactgcttattttctggtgtccgccctcgctgagatgcctgactctgcagctgcacttctgggtacatgttgcaagctgcaaataattcctaccctgtgtcatcttctccgtgccctgagcgacgacggggtctccgatctggaagaccccaccctgacccccctcaaagacacagagaggttcgggatagtgcagagactgtttgccagcgcagacatcagcttggagagactcaaatcctctgtgaaagcagtcatactaaaggacagcaaggtgtttcctcttctactgtgcattactctcaatgggctatgcgctttgggcagggagcactcttag

SEQ ID NO: 220330 - DNA, 999 bp, Artificial Sequence
  Description of Artificial Sequence: Synthetic coding sequence
atgcagaagtgtgttatctccgaacatatgcaggtggaggaaaaatgcggtggaatagtgggaatccagacaaagactgtccaggttagtgctactgaagatggtaatgtcacaaaagacagtaacgtggtgctggagatccccgctgccaccacgatcgcgtacggggtgattgagctgtacgtgaaactggatggacaatttgaattctgcctgttgaggggcaagcagggaggcttcgagaacaagaaacggatagattctgtctacctggaccccctagtgtttcgcgagtttgccttcatagacatgccagacgcagcacacggaattagctcacaggatggacctctctctgtactcaagcaggcaaccttgttgttagagagaaattttcatccattcgcagagttaccggagccccagcagacagctttatctgatatctttcaggcggtgttgtttgacgacgagcttcttatggtgcttgagcctgtgtgcgacgatcttgtctccgggctgagccctacagtggccgtcctcggggaactgaagccaaggcagcaacaggatcttgtggcattcctgcaacttgtggggtgttcgctccagggcggatgcccagggccagaagacgcaggctctaagcagctcttcatgactgcatactttttggtttcagcattggcggagatgcccgattctgccgctgcacttttgggtacgtgttgtaagcttcaaattatccctactttgtgtcacctgctgcgagcgttatctgatgacggagtgtctgacttggaggacccgactttgactcctctaaaagataccgaaaggtttggcatcgtacagcggctgtttgctagtgctgatatatccctggagcgcttaaagagcagcgtcaaggccgtgatattgaaggactctaaggtattcccgttgctgctgtgcattactctgaacggtctgtgcgcactcgggagggaacatagttag

SEQ ID NO: 220331 - DNA, 999 bp, Artificial Sequence
  Description of Artificial Sequence: Synthetic coding sequence
atgcagaaatgcgttatttcagaacatatgcaggtggaagaaaagtgcggcggaattgtgggaatccaaacgaagacagtccaggttagcgctacagaggatggtaatgtcaccaaggacagtaacgtggtactggagatcccagcagcaaccactatagcatacggtgtgatagaactgtatgtaaagctagacggtcagtttgaattctgcctcctgcgcggtaagcaggggggatttgaaaataagaagagaatcgattctgtgtatcttgacccgttagtgtttagggagtttgcattcatcgacatgcctgatgcagcccacggtatttcttctcaggatggaccattgagcgttctgaaacaagccacacttttgttggaacggaactttcacccgtttgcagagctccctgagccacagcaaaccgcgctgtccgacattttccaggccgtcctcttcgacgacgagctgctgatggtgctggaacccgtgtgtgatgatctcgtgagcggattgagccctactgtggctgtgctgggggaacttaaacctaggcagcaacaggacttggtcgccttccttcagctggtgggatgcagcctgcaaggtggatgccctggccctgaggatgcagggagtaaacagctctttatgacagcctacttcctcgtgagcgctctagctgaaatgcctgacagcgctgctgccctactcgggacttgctgcaagctgcagataatcccaaccctctgccacctgttaagagcactttccgatgacggggtttccgatctcgaagacccaactctgacaccacttaaggatacggagagattcgggattgtacaacgtcttttcgcatccgccgatataagcctggagagactcaaaagcagtgttaaagccgtcatccttaaagatagcaaagtgtttccgctgctgttatgtattaccctgaatggactgtgcgccctgggacgggagcacagctag

SEQ ID NO: 220332 - DNA, 1575 bp, Artificial Sequence
  Description of Artificial Sequence: Synthetic coding sequence
atggcaaattcagctggatttctgggcgatttgactaccgaggggattaataaacctggcttttacaagggaccggctggatcacaggtcacccttagctcacttggcaaccagacaagggtgctgctggaagagcaggcacggcatcttcttaatgagcaagagcacgcaactatggcatactatctggatgaatataggggcggatccgtctcagtggaggcgctggtcatggctcttttcaaacttctgaatacccatgcaaaattctctctcctctcggaggtgagaggaaccatctcacctcaggatctagagaggtttgatcacctggtcctgcgacgggaaattgagtctatgaaagccaggcaaccccctggtcctggagcaggagatacatattcaatggttagctacagtgatacaggctctagcacaggttcccatgggacgtcaaccacagtctcctcggcgagaaacacactcgatctggaggagactggggaagctgtccagggaaacataaatgcacttcccgatgtctctgttgacgacgtgaggagcaccagccagggactgagttccttcaaaccactccctcggccacctcctctcgcccagggaaatgaccttccattagggcaacccagaaagctgggtcgcgaagatcttcagcctcccagtagcatgccgtcctgttcaggaacggtcttctccgcaccccagaaccggtccccgcctgctgggactgcaccaacccccggaacgtcctccgcccaggacctcccttcttcccccatatacgcatctgtttcaccggctaatccatctagcaagcgcccactcgacgcccacctggcgcttgtaaaccaacaccctattgggcctttcccgagagttcagtctccaccgcatctaaagtcaccttcagcagaggcaacagtggccggtgggtgtctgctgcctcctagtcccagcggccatccagaccagactggaacgaatcaacacttcgtcatggtagaggtgcaccggccagatagcgaaccggacgttaatgaggttcgggctcttcctcagactcgtacagccagtacattatcacacctgtccgactctggccaaactctatcggaggacagcggagtcgatgccggagaagcggaagcttcggctcccggaagagggaggcagtccgtctctactaaaagtcggagtagtaaggagctgcctcgcaatgaaaggccaacagatggagctaataagcctcccggactgctggaaccaacgagtacgctggtacgcgttaagaagtccgcagccaccctcggaattgccattgaaggcggtgctaatactcgtcaaccgctgccgagaatcgtaactattcaaaggggcggatcagcccacaactgcggccaactaaaggtcgggcatgttatcttggaggtgaacgggcttactctgcggggaaaagagcatcgggaagcagccagaatcattgctgaggcctttaagactaaggacagagactacattgattttcttgtgacagagtttaatgttatgctctag

SEQ ID NO: 220333 - DNA, 2724 bp, Artificial Sequence
  Description of Artificial Sequence: Synthetic coding sequence
atgaatgcccctctggacggattgagtgtgagcagttccagtacaggaagtctgggttccgctgcaggggcaggtgggggtggaggagccggactgcgcttactgtccgcgaacgttcgacagctccatcaggctctcaccgctctcctgtcagaagctgagcgcgagcagtttacccactgcctcaacgcctaccatgcaagaaggaatgtgttcgatctggttaggaccctccgtgtactgttagatagccccgtgaaacgtcggttactccccatgctgagactggttatccctagaagtgatcaactgctgtttgatcaatacacggccgaaggcctgtacctgcctgctactacaccttatagacagcccgcttggggtggccctgattcggctgggccaggcgaggtcaggctcgtgtcccttcgaagagcgaaagctcatgaaggactaggcttttctattcgcggtggttccgagcatggggtcggtatctatgttagtcttgtggagcctggatctctggcagaaaaggaggggctgcgagttggcgatcagatactccgcgtcaacgataagtccttagcgcgtgtcacccatgccgaggccgttaaggctttaaaaggtagtaaaaaactagtgctaagtgtgtacagcgccggacgcatcccaggaggttacgtaacgaaccacatatacacctgggtcgatccacaggggagaagtatcagcccaccatcgggcctgccgcagccacacggcggagccctgcgccagcaggagggcgatcgccgttcaacattgcacctgttacaggggggagacgagaagaaggtcaatctggtgctaggtgacgggaggtctctcggcctgaccatccgcggtggagccgaatacggtcttggtatttacatcaccggcgtggacccaggcagtgaagctgagggctcgggcctcaaagtcggcgatcaaattctggaggtgaatggtaggagtttcctaaatatcctgcatgacgaagctgtgagactgctcaagagctcacgacatcttatactcaccgtgaaggatgtgggcaggctacccagggcgaggaccacagtggatgagaccaagtggatcgcaagctccaggatccgggaaacgatggcaaacagcgctggatttctgggcgatctgacaacagagggaatcaataaaccgggtttttataaaggaccagcgggaagccaggtgactctgtcaagcctgggcaatcaaacgagggtactgcttgaagaacaggcacgtcacctgctgaacgagcaagagcacgccactatggcctactaccttgacgaatacaggggaggcagtgtctctgtagaagctctggtcatggctttgttcaagcttctcaacacacatgctaaattctccttgttatcagaggtccggggaacaatatctccgcaggatctcgagaggttcgatcacctggtcctcagacgagagatagagagcatgaaggccaggcagcctcccggaccaggtgctggcgatacctatagcatggtgtcctacagcgataccggttcttcaactggatcgcatgggacttcaacgacggtttcaagtgcaagaaacaccctcgacctggaggagactggggaggccgtgcagggtaatattaacgcacttcccgatgtctctgtggacgatgtccggagtacaagccaggggctgtcttctttcaagcccttgcctaggcctccacccttggcccagggcaacgatttgcctctgggccagcccagaaagctgggacgtgaggatttacagcctccctcaagcatgccttcttgtagcgggaccgtcttctccgcaccacagaatcgctcaccaccagctggcacagcccctacccccggtaccagctccgctcaagatctcccttcctcaccgatttacgcctccgtgtccccagccaacccaagcagtaagcgcccactggacgcacaccttgcgctcgtgaatcaacatcctatcgggccattcccacgtgtgcagtcgcctccacacctcaaatcaccttccgcggaggctacggttgctgggggatgcttgctccccccaagcccctccggccatccagaccagactggcaccaaccagcactttgtaatggtcgaagttcatcgccctgacagtgagcccgatgtcaatgaggttcgcgctctgccacagactaggacagcatccacactgtcgcacctttctgacagcggccagactctcagtgaggatagtggtgtagacgctggtgaggccgaagcttcagccccaggtcgcggtagacagtcagtgagtaccaaatcacggtcctccaaagagctgccacggaatgagaggcccaccgacggcgctaacaaaccgcctggacttctggagccaaccagcactttggttcgagtaaagaaatctgccgctaccctgggaatcgctatcgagggtggtgccaatacccggcagcccctgcccaggatcgtcaccattcaaagggggggatccgcccataattgtggacaattgaaggtggggcatgtgatcttggaggtcaatggactgacacttcggggaaaagaacatcgcgaagctgccagaataattgctgaggcatttaagaccaaggatagagactacatagactttcttgtgacagaatttaatgtaatgctctag

SEQ ID NO: 220334 - DNA, 1038 bp, Artificial Sequence
  Description of Artificial Sequence: Synthetic coding sequence
atgaatgctcccttagacggtcttagcgtttctagtagttccaccggctccctgggatcagctgccggtgctgggggtgggggtggcgctggcctgaggctcctgtcagcaaatgtccgacaactacatcaagccctgactgctctgctgagcgaagccgaacgggagcagtttactcattgcttgaacgcctaccatgcgaggcgcaacgtctttgacctggtgcgaacactcagggtgctgctggacagcccagtgaaaaggcggctactgcccatgctgcggcttgtgatcccacggagtgatcagttgctttttgaccagtatacagccgagggattatatttaccagctaccaccccctacaggcagcccgcatggggtggaccggacagtgctggacccggagaagtcaggctggtgagtttgcggagagctaaggcccatgagggcctgggatttagtattcgcggaggttccgagcacggcgtggggatctacgtgagcctggtggaacccggttctctggcagagaaagagggcctgcgggtgggagaccagatacttcgtgtaaatgataaatctctcgctagagttactcacgccgaggctgtaaaggccttaaaggggtcaaaaaaacttgtcctgagcgtttatagcgcaggacgcataccaggcggatacgtaaccaatcacatctatacctgggtggatccccagggaaggagcatttcaccaccctcaggcttgccacagccccacggaggcgcactgagacagcaggagggcgatagacgctctaccctgcacctactgcaggggggtgacgaaaagaaggtatccggggtgggcaaggggggacagccattgaggcacagaatcctgccccctaaccccgaacagcaatcttgcctcgaggctgccagacggggatggttctgtcccggatccgttttcccacaggtttgcacggagggctggtgcttcttcttcgccttcctctttgacctttgttccgtatgctataacacaggctag

SEQ ID NO: 220335 - DNA, 1671 bp, Artificial Sequence
  Description of Artificial Sequence: Synthetic coding sequence
atgcacggctcgctggaagctctgctctttctgccgcaggtaaccctcagcctggcccatgcacatctgatctgttccaatgcgcaactggagatgtgcgtcttcccgcataggtttctcggcgacctcaccactgaggggatcaacaaacctgggttctacaagggccctgccggatctcaagtgaccctttcttctctgggcaatcagacaagggtgcttctagaggaacaggcccgacacttgctgaatgaacaggagcacgccaccatggcctactatctggacgagtatagaggcggatcagtcagcgtggaagcgttggtcatggccttgtttaaactgctgaacacacatgccaaattctccctactgtctgaagtgaggggaacgatctccccccaggatctggaacgtttcgatcatttggtgctgagaagagagatcgaaagtatgaaagctcgacagcctcccggaccgggagccggagacacgtacagcatggtgagttacagcgacacagggagcagcaccggttcccacggaaccagcacgaccgtttctagtgcccgaaacactctagacttagaagaaaccggagaggctgtgcagggcaatataaatgccttacccgatgtcagcgttgatgacgtcaggagcacctcacagggattgtcctccttcaagcctctgccgaggccaccccctctagcacagggcaacgatctgccccttggacaacccagaaaactcggtcgggaggatcttcagcccccaagtagcatgccgtcatgtagtggaactgttttttcagctccacagaatcgcagtcccccagccggaaccgcccctacaccgggaacttcctccgcccaagacttaccatcgagtcccatttatgcatctgtcagccctgctaatccttctagcaagaggccactggacgcacatctggcgctcgttaatcagcatcccatcgggccttttcccagagtgcagtctccaccgcacttgaagtcaccctccgccgaggccacagtggctggcggttgcctgttgcctcctagtccttccggccatcctgaccagactggtaccaaccagcacttcgttatggtggaagtgcatcgtccggactctgagcccgatgtgaacgaagtcagagctcttccgcagacccgtacagcaagtacattaagccacttaagcgacagtggccagaccttgtcggaagacagtggtgtcgatgctggcgaagcggaggcttctgctcccggacgcggacgccagtcagtttctacaaaaagccgttccagcaaggaattgcccagaaatgaaaggcctaccgatggagcgaataaacctcctggactgttagaacctacatccaccctggttcgcgtaaagaagagtgcagcaactctcggcatcgccatcgagggcggagccaacacccgacagcctctccccaggatcgtgaccatccagagaggaggttctgcccataattgcggacagctgaaagtgggacacgtgatcctcgaggttaacgggctaaccctacggggaaaggagcaccgagaggcagccaggatcattgcagaagcattcaaaaccaaggacagggattatatcgacttcctagtgacggaattcaacgtgatgctctag

SEQ ID NO: 220336 - DNA, 1059 bp, Artificial Sequence
  Description of Artificial Sequence: Synthetic coding sequence
atgttcgccgctgctacaaaatcttttgtaaagcaagtaggggatggaggcaggttagtgcctgttccctcattgagcgaagcggataaatatcaacctctgtcactggtagtgaaaaaaaagcgttgcttcctgttcccgaggtataaattcacgtccacaccgtttactttaaaggatattctcttgggcgaccgggaaatatcggcaggaataagctcataccaactgctcaactacgaagacgagtcggacgtcagtctgtatggccgaaggggaaaccatatagttaatgatgttggaatcaacgtggcgggatcagacagcatagccgtgaaggcctccttcggcatcgtgacaaaacacgaagtggaagtctcaacactgctcaaagaaatcaccacccgcaaaattaattttgatcacagcctaatacgacagtcccgttcctctagaaaggctgtgctctgtgttgttatggaaagtatcaggaccacacggcagtgctcgctctctgtgcacgccggaatcagaggggaggccatgcggtttcacttcatggacgagcaaaaccccaaaggcagagacaaagccatcgtgttccctgcccatacaacaattgcattctcagtgtttgagctcttcatctatttagatggtgccttcgatctttgtgtgactagtgtgtctaagggtgggtttgaacgcgaggagacagcaacattcgcgctgctttatcgattgagaaacatcttgttcgagaggaaccgacgggtaatggacgtaatctccaggagtcaattgtatctggacgacctgttctcggactactacgataaacctctgtccatgacagacatttctttaaaagaaggcacacacattcgggtgaatctcctcaaccacaatatccctaaggggccatgcatcctgtgtggcatgggtaattttaagcgcgagactgtgtatggctgcttccaatgctctgtggacggtcagaaatatgtacggctccacgctgtaccctgtttcgatatctggcacaagaggatgaagtag

SEQ ID NO: 220337 - DNA, 1059 bp, Artificial Sequence
  Description of Artificial Sequence: Synthetic coding sequence
atgtttgctgctgctaccaagtcctttgtcaagcaagtgggcgacggcggacggctcgtgcccgtcccatccctgtctgaggctgacaagtaccagcccctgtctctggttgtcaaaaaaaaacggtgtttccttttccctagatacaagtttacttccactcccttcactcttaaggacatcctccttggcgaccgggagatttccgcaggtatctcatcctaccagctcttgaattatgaggacgaaagcgatgtctcactgtacggcaggaggggtaatcacattgtgaatgatgtcggaatcaatgttgctggtagcgattcgatcgcagtcaaggcatcatttgggattgtgacaaagcacgaggtagaggtgtcaaccctacttaaggaaattaccacccgaaaaatcaactttgatcattctctgattagacagtcccggtctagcaggaaggccgtactgtgtgtcgtgatggagtctatcaggaccacacggcagtgctccctgtctgttcacgcaggaatccgcggtgaagcaatgcggttccacttcatggatgaacagaatccaaaggggagggataaagccattgtattcccagctcacaccactattgcgttctctgtttttgagctcttcatctatctcgacggagcattcgacttgtgcgtcaccagcgtctctaagggtggctttgagcgggaggagactgcgacctttgcgttgttgtaccgactgcgtaacatattatttgagcgaaacaggcgagtcatggacgtaatcagcagaagccagctttacctggatgacttatttagtgattactacgataagcctctgagtatgacagacatctctctcaaggagggaacccatattagggtgaaccttttgaaccacaacatcccaaaaggaccatgcatcctctgtgggatgggtaacttcaaaagagaaactgtctatggttgctttcagtgttccgtcgatggacagaagtatgtcaggttgcacgctgtcccctgctttgatatttggcataagaggatgaaatag

SEQ ID NO: 220338 - DNA, 2388 bp, Artificial Sequence
  Description of Artificial Sequence: Synthetic coding sequence
atgtccaaaagacatcgactggatctgggggaggactatcctagtgggaaaaaacgagccggtactgatggtaaggaccgcgaccgcgaccgggaccgcgaggaccgttccaaggacagggatagggagcgcgatcggggagacagagaacgcgaaagagaaaaggaaaaggaaaaggagcttagggccagcaccaatgctatgctgatctctgcagggctgcctccacttaaggccagccactctgctcattctacccactcggctcacagtacccattcaacacattctgctcacagcacccacgccggtcacgctggccacacttccttgccacaatgcatcaatccttttacaaacttgccgcacacccctaggtactacgacatcctgaagaagcggctgcagctgccagtgtgggagtataaggacaggttcacagacatcctcgttcggcaccagtcattcgtgctggtgggggagactgggagcggaaaaaccacacagattcctcaatggtgtgttgagtacatgaggagcctgccagggccaaagaggggggtggcctgcacccaacctagacgcgtggcggctatgtcagtggctcagcgggtcgctgacgaaatggatgtcatgctgggacaggaagtgggctatagtatcaggttcgaggattgctccagcgccaaaaccatcctcaaatacatgacagacggtatgctactccgcgaggcaatgaacgatccccttctggagcggtacggagtaattatcctcgacgaagcacacgagaggactctggctactgatatcctcatgggcgtacttaaggaggtagtccggcagagatcagacttgaaagtaattgtgatgagcgccacgcttgatgccggaaagtttcaaatctacttcgacaactgcccactcctgactataccagggaggacccatcccgttgagattttctatacacctgagcctgagcgggattacttggaggctgctatcagaaccgtcatccagattcatatgtgcgaggaggaggagggcgaccttctcctcttcctgactggacaagaagaaatcgacgaggcctgcaagcgaatcaaaagagaggtcgacgacctcgggcctgaggttggcgacatcaagattatccctttatactctactctgccaccccagcaacaacagcggatctttgaaccccctccacctaaaaagcagaacggagcaattggtagaaaagtggttgtaagtactaacattgccgaaacaagcctcacaattgacggcgttgtgttcgtaatcgaccccggtttcgcaaaacagaaggtgtacaatcctcgcattcgagtcgagagtctcctcgttacagctatctcaaaagcatccgctcagcaacgcgctgggcgagcaggccgaaccagaccaggaaaatgcttccgcctatacactgagaaagcctacaagactgagatgcaggataatacttatccagagattctcaggtccaaccttggcagcgtcgttctgcagctcaaaaagctgggcatcgatgacctggttcattttgactttatggatcctccggctccagagacactgatgcgggcactcgaactcctgaattacctggccgctctgaacgacgatggagacctgacagaactgggcagtatgatggcagagttccctctcgacccccagcttgccaagatggttatcgcaagctgcgactacaactgttctaacgaggtcctgtcaatcaccgctatgttatctgtaccccaatgctttgtgagacccacagaggctaaaaaggccgcagacgaagccaagatgcgtttcgcccacatagatggtgaccacctgacgcttttgaacgtgtaccatgctttcaagcagaaccacgagtcggtgcagtggtgctacgacaattttataaattacaggtcgttaatgtcagccgataatgtacgtcagcagttgtcacggatcatggaccgatttaacctgccacggagaagcacagatttcaccagtcgggattactacataaacattcgcaaggcccttgtgacaggatatttcatgcaggttgcacaccttgaacggacaggacactatctgacggtgaaagacaatcaggttgtgcagctccatcccagcaccgtactagaccataagccagaatgggtgctttataatgaattcgtgttgacaactaaaaattatattcgtacctgtaccgacatcaaacccgaatggttggtgaagattgctccacagtattacgacatgtccaacttcccacagtgcgaggccaaacgtcagctagacaggataatagcaaaacttcaatctaaggagtattcacagtattag

SEQ ID NO: 220339 - DNA, 2355 bp, Artificial Sequence
  Description of Artificial Sequence: Synthetic coding sequence
atgagtaaacgacatagactagatctgggcgaggactaccccagcggcaagaaacgggctggaaccgacgggaaggatcgggacagggacagagagcgcgaccggggtgacagggaaagagagagagagaaggagaaggagaaggaactccgcgcttctacgaatgctatgctaatttctgccggtctaccacccctaaaagcatcccactccgcacacagcacccattcagctcactctacccactcaacacatagcgcccactctactcatgccggacatgcaggtcacacaagcttgccgcaatgtattaatccattcacaaacctcccccacacacccagatactatgacattctcaagaaaaggctgcagctccctgtttgggaatataaagaccgatttactgacattctggtccgccatcaatcatttgtgctggtcggtgagacaggaagcggaaagactactcagatccctcaatggtgtgtggaatacatgcgctcgctccctggcccaaaacgtggcgtcgcttgcacacagcccaggagggtggccgcaatgtccgttgcacaaagggtggccgatgaaatggacgtaatgttaggccaggaagtaggttattcaatcagattcgaagattgcagtagtgcgaagaccattctgaaatatatgactgatgggatgctgcttcgcgaggccatgaatgatcccctcttggagcgctatggagtaatcatcctcgatgaggcccatgaaagaactctcgccactgacattctgatgggggtgctgaaagaagtggtcagacagcgtagcgacctgaaggtgatagtcatgagtgcaaccctcgacgccggaaagtttcagatttatttcgataactgcccgctgcttaccatcccaggtcgcacccacccagtagagattttctacacacccgaaccagaaagagactacctggaagccgcaattcggacggtgatccagatacacatgtgcgaggaagaagagggggacttgctcctctttcttaccgggcaggaggaaatcgacgaagcttgcaagagaattaagcgcgaagtggacgacctcggccctgaagtgggcgacatcaagatcatcccgctttatagcacactccctcctcaacaacagcaaaggatttttgaaccccctccgccaaagaaacagaatggagcaattggcagaaaggtggtcgtcagcactaacatagcagagacatccctgacgatcgatggcgtggtatttgtcatcgaccctgggtttgcaaaacagaaagtgtataaccccaggatccgagtcgagagtctgctggtaaccgctataagcaaggctagtgcccagcagcgcgctggtagagcaggcaggactaggccgggtaagtgctttagactatataccgagaaggcttacaaaacagagatgcaagacaacacatatccagagattctcagatccaacctgggtagcgtcgttctgcaattgaaaaaactcggaatcgatgatctcgtccacttcgatttcatggatccaccagcccctgagactctgatgcgggctttagaactacttaactatctagccgctctcaacgatgacggcgatttaacagagctgggatcaatgatggccgagttccctctggacccacaactggccaagatggtgattgcaagttgcgattacaactgttccaacgaggtattatccatcacagccatgctctccgtccctcagtgctttgtaaggcctactgaggccaaaaaggccgctgatgaagcaaagatgcgcttcgctcatatcgacggtgaccatctgaccctgctgaacgtgtatcacgcttttaagcagaaccacgagagcgtacaatggtgctacgataatttcataaactacaggtcactaatgtctgcagacaacgtgaggcaacagctgtcaaggatcatggaccggttcaacctgccaagacggtctactgacttcacatcaagggattattatataaacattcggaaggctctcgtgacaggctacttcatgcaggtggcccacctggaacgaaccggacactacctaacagttaaagacaatcaggtggtccagctacatccatctaccgtgctggaccacaaacctgagtgggtgttgtataatgagtttgtgcttactaccaaaaattatataagaacctgcacggatatcaaacccgaatggttggtgaaaattgcaccacagtattacgacatgtcaaattttccccagtgtgaggctaagcgacagttggaccgaataatcgcaaagctgcagtcgaaggaatactctcaatactag

SEQ ID NO: 220340 - DNA, 1683 bp, Artificial Sequence
  Description of Artificial Sequence: Synthetic coding sequence
atggagtctcagccggctcaggaatgcctaatgcagatgttcttgcctatcgagcctgcctgctttgtagaatggttgggcacaagccctagccagttgggggtcgtgatggtggacgaagctcacgagagaacgcttcacaccgacatactgtttggactgataaaagacgtcgccagatttcgtcccgaattaaaagtcctagtggccagcgcaacaatggatacggccagattcagcacattcttcgacgatgcgcctgtatttcgcatccctggtcgtcgattcccagttgacattttctacaccaaggcccctgaagctgattacttagaggcttgcgtggtgtccgtgctccagattcacgtgacacagccacctggtgatatcttagtttttttgacaggacaggaggagatagaggcggcatgcgagatgctgcaggataggtgtcggagattgggttctaaaatacgagagctcctcgtactccccatctatgcaaatctgccttccgacatgcaggctaggatcttccaacccactcctccaggggcacggaaagtagttgtcgccacaaatatcgctgagacctccctcaccattgagggaattatttatgttcttgacccaggcttctgcaagcaaaaatcgtacaatcctcgtaccggaatggaatccctcacagtgacaccgtgtagcaaggcaagtgccaaccagcgcgctggtcgagctgggagggtggcagctggaaaatgtttccgcctgtatacagcctgggcctaccaacacgaactggaagaaaccacggtgcccgaaatacaacgcacgtccctggggaatgtggtgcttctgctgaaatcccttgggatacatgatttgatgcattttgacttcctggacccccctccttatgagactctgctgttagctctggagcagttatacgcactgggcgctcttaatcatttgggggagctgaccacctcaggcagaaagatggcagaactgcccgttgatccgatgttgagtaaaatgatcctcgcttctgagaaatactcgtgctccgaggagatcctaacagtggcagcaatgttgtccgttaataactctattttttataggcctaaggacaaggtcgttcatgccgacaatgcaagagtgaacttctttttaccaggaggagatcacttggtactgcttaatgtctatacgcagtgggcagaaagcggatattcttcacagtggtgctacgagaatttcgtgcagttcaggtctatgagaagagcccgagatgtacgggagcaattggagggcctgttggaaagggtcgaggttggcctttcgtcatgccagggcgattatatccgcgtccgcaaggccatcacggccggttacttttaccacaccgcacggctgaccaggagtggataccgaaccgtcaagcagcagcagacagtcttcatacatcctaatagcagcctctttgaacagcaacctcggtggttattgtatcatgagctggtgcttacaacaaaagagtttatgcggcaggtgcttgagatcgagtccagctggcttttggaagttgcccctcactactacaaggcgaaggaactcgaggacccgcatgccaagaagatgcccaaaaagatcggcaaaacccgcgaggaactaggatag

SEQ ID NO: 220341 - DNA, 3126 bp, Artificial Sequence
  Description of Artificial Sequence: Synthetic coding sequence
atggcgacccctgcgggtctggaacgttgggtccaagacgaactccattctgtcctcggattgagtgagcgacacgttgcacagtttctcattgggacagcacagaggtgcacaagtgccgaggaatttgtccagaggctcagagatactgacaccttggatctctcagggcctgcccgtgacttcgcattgagactgtggaataaagtgcctcggaaggcagttgtagaaaagccggctcgagctgctgaacgggaggccagggcattactcgaaaaaaaccggagctataggcttctggaagatagcgaggagagcagtgaggaaacagtcagccgggcaggtagctctcttcaaaaaaaaaggaagaaaagaaagcacttaaggaaaaagcgagaggaagaagaagaagaggaagccagcgagaaagggaagaaaaagacaggtggcagtaaacagcagaccgaaaaaccggaaagtgaggatgagtgggaacggactgagcgcgagagactgcaggacctcgaggagcgcgacgcctttgcggaacgggtgcgccagagagataaggaccgcaccaggaacgtcctggagagatcagacaagaaagcatacgaggaagcacagaagcgactcaagatggctgaggaagacaggaaagctatggttccggagctgagaaaaaaaagtcgcagggagtacctcgcaaaaagggagcgcgagaagttagaggacctggaggctgagctggccgatgaggagttcctctttggagacgtcgaattgagtcggcatgaacgacaagaactgaaatataaaaggcgagtgcgtgatcttgccagggaatatcgcgcagcaggcgagcaggaaaaactagaggccaccaatcgataccacatgcccaaggagacacgcggtcagcctgcgcgtgctgttgatctggtggaggaagaatcaggggctcctggcgaggagcagcggaggtgggaagaggccagactcggcgcagcctcgctgaaattcggagcgagggacgccgcaagccaggagccgaaatatcagttggtattggaggaagaagaaaccatagagtttgtccgggcaacgcagcttcagggtgacgaggagccgtcggccccacctacgtcaacccaggcgcaacaaaaggaaagcatacaggccgttcggagaagtctgccagtttttccttttagggaagagctactggctgcgatcgctaaccaccaggtgctgattattgagggggaaaccggtagcggaaaaacgacccagatcccccagtacctattcgaggaaggatacacgaacaagggtatgaagatcgcctgcacgcagcctagacgggtggcggcaatgagtgttgccgctcgggtcgcccgagagatgggtgtgaagctgggcaacgaggtcgggtatagcatacgattcgaagattgcacatcagagagaacagttctgagatatatgaccgacgggatgctactccgggaattcctatcagaacccgacctggctagctacagtgtggtgatggtggacgaagcccatgagagaacccttcatactgacatcttgtttggtctgattaaagatgtggccaggttccgccctgagttgaaggtgctggtggcctctgccaccatggacaccgccagattttcaacctttttcgatgatgcccctgtctttcggataccgggacgcagatttccagtagatatcttttacactaaggcccctgaggccgactacctagaggcctgtgtcgtatccgtgctccagattcatgtgactcagcctcctggagatatactcgtgtttctcaccggacaagaggaaattgaggccgcttgtgagatgctacaggatagatgccggaggctcggctctaagatccgagagctgctagtcctgcctatttacgctaaccttccaagtgatatgcaggcgaggattttccaaccgaccccacccggagcccgaaaggtcgtggtcgccaccaacatcgccgagacttccctgacaatcgaaggaattatctatgtgctcgaccctgggttttgcaagcaaaagtcttataacccccgtaccggcatggagtctctgactgtcacaccatgttccaaagcttccgcgaaccagcgagctggcagagccggacgcgtggcagccggaaaatgtttccggttgtacactgcctgggcctatcaacacgaacttgaagaaaccactgtgcccgaaatccaaaggacctctctcggcaatgttgtcctgctgcttaaatcactggggatccacgacctcatgcactttgactttctagaccctcctccctacgagacgttactgttggccctcgaacagctatacgccttgggtgcactcaaccacctcggggaattaactactagcggcaggaagatggccgagctgccggttgaccccatgttatccaagatgattcttgcttcagagaagtactcatgttccgaagagatcctgacggttgccgcaatgctgtcagtaaataactcgattttttacaggcctaaggacaaagtggttcatgccgataacgcaagggttaattttttcttaccaggcggtgatcatcttgtgttactgaatgtctacacacagtgggccgaaagtggatatagctctcaatggtgctacgaaaacttcgtgcagtttagatccatgcgcagagcccgtgacgtgcgggaacaactggaaggactgctcgaacgcgtggaagtgggcctaagctcttgtcagggtgattatatcagagtgagaaaggctattaccgcaggctatttttaccacaccgctcgcctgaccagatctggttacaggacggttaagcaacagcagacagtgttcattcaccccaatagttcgctttttgaacagcaacccagatggctgctttaccacgagttagttttgacaacaaaggagttcatgaggcaggtcctagagattgagagcagttggctgttagaagtggctccacactattacaaagccaaggagctggaggatccgcatgccaagaagatgcctaaaaaaattggcaaaacaagagaagagctgggctag

SEQ ID NO: 220342 - DNA, 1683 bp, Artificial Sequence
  Description of Artificial Sequence: Synthetic coding sequence
atggagtcacagccggcacaagaatgtctgatgcagatgtttctacccattgagcctgcttgctttgtggagtggttaggtaccagtccgagtcagttgggtgtagtcatggttgacgaagcccatgagaggacccttcataccgacattctctttggacttatcaaagatgtggcgaggtttaggcccgagcttaaagtgctggttgcctcagctactatggacacagctagattcagtactttctttgatggagccccagtgttccgcatccccggtcggaggttccctgtcgatatcttttacaccaaggcccctgaggcagactatctcgaggcctgtgtagtctctgttctccagattcacgtaactcagcctcccggagacattttggtattcttgacaggccaggaagagatagaagctgcctgtgagatgctgcaggatcgttgccgcaggcttggttctaaaatcagggagctgctggtgcttcctatctacgccaacctgccttccgacatgcaggctaggatctttcaacctaccccccctggtgctaggaaggtcgtggtcgctacgaatatcgctgaaacaagtctgacaatcgagggaattatctatgtccttgatccgggtttctgtaaacagaaaagttacaaccctcggactgggatggagagcctcacagtcaccccatgctccaaggcttctgcaaaccagagggcgggtagagccggacgagtcgctgctgggaagtgttttaggctctatacagcatgggcttaccagcatgagcttgaagagacgactgtacccgaaattcagagaaccagtttagggaatgtggtgctgttacttaagtcgctgggcattcacgatctgatgcactttgattttctggatcctccgccttacgagacccttttactcgcgctagagcagttatatgcgcttggagccttgaatcacctcggggagctcaccacttcgggacgcaaaatggccgaacttcccgtcgatccgatgttgtctaagatgattctggcctctgagaagtattcctgttccgaagagattctcactgtggctgctatgttgagcgtgaataatagcatcttttaccgacccaaagataaggtggtgcatgcagacaatgcacgcgtgaacttttttttgccaggcggagatcatctggtactgctcaacgtctacacacagtgggctgagtccggctacagctcacagtggtgttacgaaaattttgtgcagtttcgatcaatgcgcagagcaagggatgtgagggaacagctcgaggggttgcttgagcgggtggaggtgggactgtccagctgccagggtgactacatacgggtgaggaaggccatcacagcaggctacttctaccacaccgcaagattaactcgaagtggctatcggactgtaaaacaacagcagacggtgtttattcaccctaattcctctttgtttgaacagcagcccaggtggcttctctatcacgaactagtcctgactactaaggaatttatgaggcaggtcctggagattgagagctcttggctcttggaagtggctccccactattataaggcgaaggagttggaagatccacacgcgaaaaagatgccaaagaaaataggcaaaacacgggaggagctgggatag

SEQ ID NO: 220343 - DNA, 3126 bp, Artificial Sequence
  Description of Artificial Sequence: Synthetic coding sequence
atggcaacccccgctggcttggagcgatgggtccaggatgagcttcacagcgtcctgggattatccgagcggcacgtcgcccagtttcttatcggtacagcccagcgctgtacatctgctgaggaattcgttcaacgccttcgcgacaccgacacactggatctcagcgggccagcacgggattttgcacttcgcctctggaataaggtccccagaaaagcagtggtggaaaaacctgctagagccgcagaacgggaggccagagcactactggagaaaaataggagctacagactcctcgaggatagtgaggaatcctcggaggaaactgtgtcccgggctgggtccagtttgcagaagaagcgaaagaagcggaagcacctgcggaagaaaagggaggaggaggaagaggaggaggcctccgagaagggtaaaaagaaaactggtgggtctaagcagcagaccgaaaagccagagtctgaggacgagtgggagagaaccgagcgggaaaggctccaagacctcgaggagagagacgcctttgcagaacgcgtgcgacagcgcgacaaagaccggacacgaaatgtcctcgagcgttctgacaaaaaagcatacgaggaagctcagaagaggcttaagatggcagaagaggacagaaaggccatggttcctgaactacgcaagaagtctagacgagagtacctggctaagagagagcgagaaaagcttgaggacctggaagcagagcttgctgatgaggagttcctttttggggatgtggagctgagcaggcatgaaagacaagagctgaaatataagaggagagtgagggatctggcccgagagtacagagccgctggggaacaagaaaaactggaagccacaaatcgatatcatatgcctaaggagacaagaggacaacccgctagggccgtagacctcgtggaggaagaatcaggggctcccggagaggagcagcggaggtgggaggaggccaggctcggcgcagcttccctgaagttcggcgctcgggacgctgccagtcaggagccaaagtaccagctggtgctcgaggaggaagagacaattgaattcgttcgagccacccagctccagggagacgaagaacctagcgctccaccgacaagtacacaggcccagcaaaaggaatctatacaggccgtcaggcgttctctgcccgtcttccctttccgggaggagctactggcagccattgcaaaccatcaggtattaatcatcgagggcgaaacaggaagcggtaaaaccacacaaattcctcaatatctctttgaggagggctacactaataaaggcatgaagatcgcctgtactcagccacggagggtcgcggctatgagcgtcgcagccagagtggcacgcgagatgggcgtgaaactaggaaacgaggtgggctactctattagatttgaggactgtactagtgagcgcaccgttctgcggtatatgacggatgggatgttgttaagagagtttttgagcgaaccagacctggctagctattcagtggtaatggttgatgaggcccatgagcggaccctgcacaccgatatcctgtttggtcttatcaaagatgtggccaggttccgccctgagctaaaggtgcttgtggccagcgctaccatggatacagctcgtttttcaaccttctttgacggcgcacctgtgttccggatacccggaagacggtttccagtggatattttctacacaaaggcgccagaagctgactacctcgaggcatgcgtcgtgtcagtcctgcagattcacgtcacccagccccctggagatatactggtattcttaacgggccaggaggagatcgaggcagcctgcgagatgctacaggacagatgcaggagactgggatctaagattagggagttactagtgctgcccatctacgctaatttgcctagtgatatgcaggctcggatttttcagcccacccctccaggagcccgaaaggttgtggtggctaccaacatcgctgagacctcactgacgatcgaggggatcatctacgtgttggatccgggattctgtaagcagaagtcatacaacccgaggaccgggatggagtcattgactgttacaccctgttccaaagcatccgcgaaccagcgagccggacgggctggtcgggtcgctgctggaaagtgttttcggctttatactgcatgggcgtaccaacatgagttggaagagaccaccgtgcctgagatccagaggaccagtctgggcaacgtcgtgctgctcctgaagagtctgggcattcatgacctcatgcacttcgactttctggacccacccccatacgagacactgctgctggcgttagagcagctgtatgccctcggggctctgaaccaccttggggaactcactacgagcggcagaaaaatggccgagctgcctgttgaccctatgcttagtaaaatgatcctggcaagtgagaagtactcgtgtagcgaagagattttgactgtcgcagcaatgctcagcgtaaataactccatcttttaccggccaaaggacaaggttgtccacgccgacaatgcgagagtgaatttctttcttcctggcggagaccacctggtcttgcttaacgtttacacccagtgggccgaaagcggctattcgtcgcagtggtgttatgaaaacttcgttcagttccggagcatgagacgagctcgggatgtacgtgaacaactagagggcctcctggagcgggtggaagtcgggctatcgagctgccagggggattatatccgggtgcggaaggctatcactgcaggttacttctatcataccgcgaggctgacacggagcggataccgcacggtgaagcagcagcaaaccgtgtttatccaccccaatagttctctcttcgagcagcagccgagatggctactgtatcatgagctcgtgctgacaaccaaagagttcatgaggcaagtcttagaaattgaaagttcctggctcctcgaggtggctcctcattattacaaagctaaagaactcgaagatcctcacgctaagaaaatgcccaagaaaattggcaaaacccgtgaagagctcggctag

SEQ ID NO: 220344 - DNA, 1683 bp, Artificial Sequence
  Description of Artificial Sequence: Synthetic coding sequence
atggagtcgcaaccggctcaggagtgcctgatgcagatgtttctacctatagagcctgcttgctttgtcgaatggctcgggacttcgccctctcagctcggagtcgtgatggtagacgaagctcacgagcgcaccttgcatactgacatcctgttcggcctgatcaaagatgtagcccgattccgaccagagctcaaggttctagtggcctcagccaccatggataccgctagattttcgacattctttgatgacgcccctgtatttcgtattccagggcgacggttccccgttgacatcttctacacgaaggcccctgaggctgactaccttgaggcttgtgttgtgtccgttttgcagatccatgtaacccagcccccaggtgacatcttagtattcctgacagggcaagaagagattgaggctgcttgtgaaatgctccaggaccgctgtagaaggctgggcagtaagatcagggagttgctagtgctcccgatctatgccaatctacctagtgatatgcaagcacggatctttcagcccaccccccctggcgctagaaaggtggtagtggcaacgaacatcgcggaaacatcacttaccatcgagggaatcatttatgtgttggatccagggttttgcaaacagaagtcctacaaccccagaaccgggatggaatccctcacagtgactccttgttctaaggcctccgctaaccagcgggctgggcgagctggacgagtagctgctgggaagtgctttcgtctctataccgcatgggcctaccaacatgagctcgaggagacgactgttcccgaaattcagaggacttccttggggaacgtcgtgctgctgctgaagtccttgggcattcacgatttgatgcatttcgacttcctggatccgccaccctatgaaactcttcttttggcgctcgagcaactttatgccctcggggcactgaaccacctgggcgagctgaccacgtcagggagaaaaatggctgagttgcccgtggaccccatgctgtctaagatgatcctcgcatccgaaaagtatagttgcagcgaggagatcttgacagtggccgctatgctatcggtgaataacagcatattttaccgacctaaagacaaggtggtgcacgcagataatgctcgggtgaattttttcctgccaggaggcgatcatcttgtgctgctcaatgtgtatacgcagtgggccgagagcggatactcaagtcagtggtgttatgaaaacttcgtccaatttcgctctatgcgcagagcacgcgatgtgagagaacagctggagggcttgctcgagcgggtggaagtggggctgtcctcctgccagggtgactatatcagagtaagaaaagctataacggccggttatttctaccataccgcccgactcactcgcagcggctatcggaccgtaaaacagcagcagactgtgttcatccaccccaacagttctctgttcgaacaacaaccgcgatggttattataccatgagctcgtgttaacaacaaaggaatttatgcggcaggtgctcgagattgaaagtagttggctgctggaagtggcccctcattattacaaagctaaagagttggaagacccccatgccaagaaaatgccaaaaaagatagggaagacccgggaagaactagggtag

SEQ ID NO: 220345 - DNA, 888 bp, Artificial Sequence
  Description of Artificial Sequence: Synthetic coding sequence
atgtctgaagatccgaggggccctaaagtgccgagaaaagcggtggtggagaaaccagcaagggccgcagaacgggaagcaagggcacttttagaaaaaaaccgttcgtacagactccttgaggacagtgaggagtcctccgaagaaacggtgtcaagggccggatcctctctgcagaaaaagaggaagaaaaggaagcatctgcggaagaagcgggaagaagaggaagaggaggaggcatctgagaaaggaaaaaaaaagacgggcggtagcaagcaacaaaccgagaaacctgaatccgaagacgaatgggagcgcactgaacgcgagcgcctgcaggacctcgaggagcgcgatgcctttgccgaacgagtgaggcagcgggacaaggacagaaccaggaatgtgctcgaaagatctgacaagaaggcgtatgaggaggcccagaagaggctgaagatggcagaggaggacaggaaagctatggttcccgagctgagaaaaaagtcgaggcgcgagtatttggccaaacgtgaacgggaaaagctggaagacctggaagcggaactcgcggacgaggagttcttgtttggcgatgtggagctctcaagacatgagagacaggagctgaagtataaacgtagggtgagggacttagcacgcgagtatagagccgcaggcgagcaggagaaattggaagctactaacagatatcacatgcctaaggagacacgaggtcagcccgctagggctgtggacctagtggaggaggaaagtggtgccccaggcgaagaacaacgcaggtgggaggaggccaggttaggtgccgctagcctgaaattcggcgctcgggacgccgcatcacaagagcctaagtatcagctgtag

SEQ ID NO: 220346 - DNA, 3126 bp, Artificial Sequence
  Description of Artificial Sequence: Synthetic coding sequence
atggcaacacctgcaggcttagagcgttgggtccaggatgagttacattccgtcctgggcctctctgagcgccacgtggctcagttcctgataggtacggcccagaggtgcactagcgctgaggaattcgtccaacggctccgggacactgatactcttgacctgtctggccctgcaagggatttcgctcttagactctggaataaggttccaagaaaagcagtggttgaaaagcccgctagagccgctgaaagagaggcccgagccctcttagaaaagaatagatcatatcgcctgctcgaggattctgaagaatccagcgaagagacagtctcgagggccggttccagcctccagaagaagagaaaaaagcgcaagcacctgcgaaaaaaaagagaggaggaggaggaagaggaggcgtcagagaagggcaaaaaaaaaacagggggatctaagcagcagacagagaagcccgagagtgaggacgaatgggagcggactgagcgagagaggctccaggatctagaagaaagagatgcattcgctgaacgagtaagacagagggacaaggatcgaacacggaatgtgctagaacggtctgacaagaaggcttatgaggaggcccaaaaaagattaaaaatggccgaagaggatcgtaaggccatggtgcccgagcttcgtaaaaaatcacggcgagagtacctcgccaagcgagaacgggaaaagcttgaagacctcgaggcagaactcgccgatgaggaattcctgttcggtgatgtggaactgagcaggcacgagaggcaggaactgaagtataagaggagagtgagggacctggcacgggaatacagggccgctggcgaacaggagaagctggaggctacaaatagataccacatgccgaaggagactcgcggacagcctgcgcgtgcagtggacctggtcgaggaggaatccggggcacccggtgaggagcagcgaaggtgggaggaggctcggctgggggcagccagtctcaaatttggcgcacgggacgccgctagccaggagcccaaataccaactcgtgctggaagaggaagaaaccatcgagttcgtaagagccacccagttgcaaggcgacgaagaaccatccgcccctccaacaagcactcaggctcaacagaaggagtctattcaagccgtgaggcggagcctgcccgtgttcccttttcgagaagagctcctggcagccattgcaaaccaccaggtccttataattgaaggagaaactggatctggcaagaccactcagatcccgcagtacctgttcgaagaggggtacactaacaagggtatgaagatcgcctgtactcaaccccgtagggtcgccgctatgtccgtagccgctagagttgccagggaaatgggagtaaagctcggcaacgaggtagggtactctattagattcgaggattgtacaagtgaaaggacggtccttaggtacatgaccgatggcatgttgcttagggaattcctatccgaacccgacctcgcctcttactctgtcgtcatggtcgacgaggcgcacgagcggaccctgcacacggacatcttgttcggcctgatcaaagatgtggcaaggttccggccagaacttaaggttttagtggctagcgctaccatggataccgcaagatttagcaccttcttcgatgacgctcctgtatttagaattcccggacgacgtttcccggtggatatattctataccaaggctcctgaggccgattatctggaagcctgcgtggtgtctgtactacagattcatgtcacccaaccccctggagatattcttgtgtttctgaccggccaggaggagatcgaagccgcttgtgagatgttgcaggatcggtgccgcaggcttgggtccaaaatccgtgaacttctcgtgttgcccatctacgcaaaccttccatcagatatgcaagcaaggatctttcagcccactccacctggtgcccgaaaggtagtagtggctactaatatcgccgagacctccctgaccatagagggtatcatctacgttctggacccgggattttgtaaacaaaaatcgtataaccctcggaccgggatggaatcactgactgttactccctgcagcaaagcttctgcgaaccaacgcgctggcagagccggtcgcgttgccgctggaaagtgctttcgactttatacagcatgggcatatcagcacgagctggaggagacgactgtcccagaaattcagcgtacatctcttggtaatgtagttcttctgcttaaaagtttgggcatccacgacttgatgcatttcgattttctggacccccctccgtatgaaacactcttactcgccttagagcaactgtatgcgttaggggctctcaaccatctaggcgagctcaccactagtggacggaaaatggctgaactccccgtcgaccccatgcttagtaagatgattcttgcatccgaaaaatatagttgcagcgaggaaattcttacggtggctgcgatgctcagcgtgaataatagcattttttatcggcctaaggacaaagttgtgcacgccgataatgccagagtgaattttttccttcctggaggtgatcatcttgtgctgctgaatgtttatacccagtgggccgaaagtgggtactcatcacagtggtgttacgagaactttgtgcagtttcgctccatgagaagagcccgtgacgtgcgggagcagctcgaggggctccttgaacgcgtcgaagtggggctgtcatcttgccaaggcgattatattcgtgtccgcaaagcaatcactgccggatacttttaccacactgcacgactaaccaggtctgggtaccgcaccgtgaaacagcaacaaacagtctttatacatcctaatagctcactttttgagcagcagccccgttggctgttgtaccacgagttggtcctgacaacgaaggagttcatgcggcaggtgcttgagattgagtcgagttggctcttggaagtggctccacattattacaaggccaaggagctggaggaccctcacgccaaaaagatgcctaaaaaaatcggcaaaactcgggaagaactcggctag

SEQ ID NO: 220347 - DNA, 3126 bp, Artificial Sequence
  Description of Artificial Sequence: Synthetic coding sequence
atggccactcctgccggattagagcgctgggtccaggacgaactgcacagcgtcctgggtctgagcgagcggcatgtcgcacagtttctgatcggaacagcccaacggtgcactagcgcggaggaattcgtgcagaggttgcgcgacacagatacactcgatctgtcaggaccagcaagggattttgcccttcggctgtggaacaaggtgccaagaaaagcggtggtagaaaagcccgctcgcgctgcggagcgagaggctcgagctttgctggagaagaacaggtcatatagactgctggaggactccgaggaatcttccgaagaaactgtgtcgcgagcaggctcctctctgcagaagaaacggaagaagcgcaaacatctgagaaagaagagggaggaagaggaagaggaggaagcctctgagaaagggaaaaagaaaacagggggatcaaaacagcagactgagaaacccgagtcagaggatgagtgggagagaacagagagggaacggttacaggaccttgaagagagagatgccttcgcagagagggtgcgtcagcgggataaagaccggactcggaatgtcttggaaaggtccgataagaaagcctacgaggaggctcaaaagagactaaagatggcggaggaggacagaaaagcaatggtgccagagctgcggaaaaagtctagacgagaatatttagcaaagagagaaagagagaagctggaggacctggaagcggagctcgccgacgaagagttcctgtttggagacgtggagctatctcgtcatgaacgccaagagctgaagtacaagagacgggtgcgggacctagcaagggaataccgcgctgcaggtgaacaggagaaattggaggccaccaacagatatcatatgcctaaagagaccagaggccaaccagccagggccgtcgatcttgtggaggaggagtctggcgcaccgggtgaggagcagaggagatgggaggaggctagattaggagcggctagtctcaagtttggggcaagagacgccgcttcacaggaacctaaataccagcttgtgctggaggaggaagagaccatcgagtttgtcagagccacccagctccagggggacgaggaaccttctgcacccccaacctccactcaagcccagcagaaggagtccatacaggccgttaggcggagtcttcctgttttcccctttcgcgaagagctactggcggctatcgcaaaccatcaagtgcttatcatcgagggcgagactggcagtggtaaaacaacccaaatcccacagtacctgttcgaagaaggctacacaaataaaggtatgaaaatcgcttgcactcagccaagacgagtggccgctatgtcagtagccgcacgggtcgccagggaaatgggggtcaagctggggaatgaggtgggttacagtattcgattcgaagattgcacaagtgagcggactgtgttacgatacatgacagacggaatgctgctgcgggagttcctgtctgagcccgatcttgcatcctactccgtggtcatggttgacgaggcacatgagcgaaccctgcatacagatattttatttggcctgatcaaggacgtggcgaggttcaggcctgaactgaaggtgttggtcgccagtgcaaccatggatactgcgcgattcagtacatttttcgacgacgcgcctgtgtttagaatacctggcaggagatttccagtggatatcttttacacaaaggcaccggaagctgactatctggaagcatgcgtggtttcagttctgcaaattcatgtcacacagccacccggtgacatacttgtgtttttgactggacaggaagagatagaagccgcatgtgagatgctgcaagatcggtgccggcgactaggaagcaagattcgggagttactagttctgcccatttatgccaatctgcctagcgatatgcaggcaagaatctttcagccgacgcctccaggtgcccgaaaagtggtggtggctaccaacattgcagagacctcgctcaccatcgaggggatcatctacgttttagaccccggtttttgcaagcaaaagagctataatcctcgcaccggaatggagtcattgaccgtgaccccctgtagcaaagccagcgcaaaccagagggcagggagggctggacgcgttgccgctggcaagtgttttcgtctgtacacggcttgggcatatcagcacgagctggaggagacaactgtgccagaaatccagcgcacgtcactgggcaacgtcgtgcttttactcaagagcctgggtattcatgatttgatgcactttgatttcctagatccccctccttacgagacgctgctgctggctttggagcaactgtacgccctgggcgctttaaatcacttgggcgaactcaccacctccggtagaaagatggcagaactcccagttgaccctatgttgtccaagatgatcttagcatccgaaaaatactcttgtagcgaggagattctgacagtggccgctatgctaagcgtgaacaactcaattttttaccgacccaaggacaaagtcgtgcacgcggacaatgctcgggtgaactttttcctccccggaggcgatcacctcgtcctcctaaacgtatacactcagtgggccgaaagcggctacagcagccagtggtgttatgaaaactttgtgcagttccggtcgatgcggagagcaagagatgttagagaacagctcgaaggcctgcttgagcgtgtcgaggttgggttaagtagttgccaaggagattacatcagggtgcgcaaggcgatcacagccggttatttctatcatacggcgaggctgacgcggagcgggtaccgcacggtcaagcagcagcagactgtctttattcaccctaattcttcactctttgagcagcagcctagatggctcctctatcacgaattggttctgacgactaaagaattcatgagacaggtgctggagatagagtcatcatggctcctggaggtggctccacactattataaggccaaagagctcgaggacccacacgcgaaaaagatgcccaaaaaaattggcaagacacgtgaggaattgggctag

SEQ ID NO: 220348 - DNA, 3126 bp, Artificial Sequence
  Description of Artificial Sequence: Synthetic coding sequence
atggccacccccgctggtctcgaacgctgggtgcaggacgagctccattccgtgctgggccttagtgagagacatgtggcccaattccttattggcactgcgcaaagatgcacttcagcagaggaatttgtgcaaaggctgagggataccgacaccctggatctcagcggaccagcgagggatttcgcactacggctgtggaataaagtcccacgcaaggcggtggtggagaagcccgcacgcgcagccgagcgcgaagcacgggctctgttagagaaaaacagatcgtaccggctccttgaagattccgaggagtcatctgaggaaacagttagtcgcgcaggctcatctttgcaaaagaaacgaaaaaagagaaaacacctgcgcaaaaagcgcgaagaggaggaagaagaggaggcctccgaaaagggcaaaaagaagacgggcggatccaagcagcagacagaaaagccagagtccgaagatgagtgggagcggaccgaacgcgagaggttacaggatctggaggaacgtgatgcttttgccgagagagtgaggcagcgggataaggatagaactcgcaacgtcttagaaagatcagacaagaaggcctatgaagaggcccagaaaagactgaagatggcggaggaggatagaaaagctatggtgccagagcttcggaaaaaaagcagacgggaatacctagccaagagagagcgggaaaagttagaggatctcgaggcagagctggccgatgaagagttcttattcggtgatgtcgagttgtcgcgccatgagaggcaggagttaaagtacaaaagaagagtgagggatctggcacgcgagtacagggctgctggggaacaggagaaacttgaggccactaacagataccatatgcccaaggaaacacggggacaacctgctcgggctgttgacttggtggaggaagagtctggcgcaccaggcgaagaacaacgtcggtgggaagaggccaggctgggtgccgcaagcttaaagtttggagctagagacgcagccagccaggaaccaaaatatcagctggtattggaggaagaggaaactatcgagtttgtgagggccacacagcttcagggggatgaggagcccagtgcaccacccacatcaacccaggctcagcagaaagagagcatacaagctgtcaggaggtcactgcctgtattccccttcagggaagagctcttagctgcaatcgcgaaccatcaggtgctgataatcgagggagagactgggagtgggaagaccacccagatcccacaatacctgtttgaagaaggatacacgaacaaaggcatgaagatcgcatgcactcagccgcgacgtgtcgcggctatgtctgtggccgctagagtagccagagagatgggggttaagctcggaaatgaagtaggctactcaatcaggtttgaggattgtacctctgagcgcactgtcctgcggtacatgaccgacggcatgctgctgcgtgaattcctttctgaacccgacctcgccagctattcagtcgtgatggtggacgaggctcatgagaggacgttgcatacagacatcctgttcggattaatcaaggacgtggctcggttcagacccgagctcaaggtgcttgtggcaagcgccaccatggacactgctaggttttccactttttttgatgacgccccagtcttccgcattcctggcaggcggttcccagtggatatcttttacactaaagccccagaggctgactaccttgaagcgtgtgtggtatcggtcctgcagattcatgtgacccagcctcccggagatatcctggtctttctgacaggccaagaggaaatcgaggccgcttgtgaaatgctgcaggatcggtgccgccgattaggttctaagattcgcgagctcctggtgctgcctatttacgctaaccttcccagcgatatgcaggccaggatcttccagccaacacctccaggcgctagaaaggtggtagtggccaccaacatcgctgagacaagcctgacaattgaaggtatcatttacgtgctagatccaggcttttgcaaacagaaatcctacaacccccgtactgggatggagtccttgactgtgactccatgctcaaaggcctcagccaatcagcgggctgggagggctggaagagttgcagctggcaaatgcttcaggctgtatacagcgtgggcgtaccagcacgagctggaagagaccacagtgcccgaaatccagcgcaccagcctgggaaatgtggtcctgttgttgaagtccttgggcatccatgatcttatgcatttcgactttctggatccaccaccttatgaaactcttttactggccttggagcaattgtacgccctcggcgcactgaaccaccttggggagcttacgacctcgggccgaaagatggccgaactgcccgtggaccctatgctgtcaaagatgatcctggccagcgagaagtactcttgctccgaggaaatactcaccgtagctgccatgttaagcgttaataacagtatcttctacaggccaaaagacaaggtcgtgcacgccgataatgctcgcgttaattttttcctgcccggaggtgaccatctcgtgctgctgaacgtgtacactcagtgggccgaatcgggctattccagtcagtggtgctatgaaaattttgtccagtttcgatcaatgaggcgggcacgcgacgttagggagcagctagaaggcctcctggaaagggtggaggtgggcttaagttcctgtcaaggagattatatccgtgtgcgaaaggccattacagccggatatttctaccacactgccagattaacacggtcaggatatcggaccgtaaaacagcagcagaccgtgtttatacacccaaacagctctctctttgagcagcagcctcgatggttattgtatcacgaactggtcctgacaaccaaagaattcatgagacaggtgctggagattgaatcaagctggctccttgaggtggcccctcattattacaaagcaaaggagctcgaggatccccacgcgaagaagatgccaaaaaaaattggtaaaactagggaagaattggggtag

SEQ ID NO: 220349 - DNA, 888 bp, Artificial Sequence
  Description of Artificial Sequence: Synthetic coding sequence
atgagtgaagaccctcgcggtccaaaggtgcctaggaaggctgtggtggagaagcctgcccgagccgctgaaagagaagccagggcacttctggaaaagaacagatcctaccgcctcctagaggacagtgaagagagttcagaggaaacagtcagccgggcagggtcatctctgcaaaagaagcggaagaagcgaaagcatctgaggaagaagcgcgaggaagaagaggaagaggaggccagcgaaaaagggaagaaaaagaccggcggatccaagcagcagaccgagaagcccgaatccgaggacgaatgggaacggaccgaacgtgaaaggctacaggacctagaggagcgagatgcttttgcagagcgcgtgcgccagcgggataaagatcgaacaaggaatgttctggagcgctctgacaaaaaggcgtacgaggaggcccaaaagagactgaagatggcggaagaagataggaaagctatggtacctgagcttcgcaagaaaagccgccgagagtacttagctaaacgagagcgcgagaagctcgaagacctggaggcagaactggcagatgaggaatttttgttcggggacgtagagcttagcaggcatgaacgtcaggagcttaagtataaacgccgagtgagggatctcgctcgcgagtatagggccgcaggagaacaggagaagctggaggccaccaatcgatatcacatgcctaaggagacgcgtggccaacccgctagggctgtcgacctagtcgaagaagagtccggagctcccggtgaagaacagaggaggtgggaagaagcccgtctgggagcagcctccctaaagtttggcgctagggatgctgccagtcaggaacctaaatatcagctgtag

SEQ ID NO: 220350 - DNA, 888 bp, Artificial Sequence
  Description of Artificial Sequence: Synthetic coding sequence
atgagcgaggacccacgaggaccaaaggttcccagaaaggcagtagtcgagaagcctgcgcgagctgccgaacgggaggccagagcactgctggaaaagaaccgatcctatagactgctggaggactctgaagagtcaagcgaggaaactgttagccgcgctggcagttccttgcagaagaagcgcaaaaagcgaaaacacttacggaaaaagcgggaggaggaagaagaggaagaagcgagcgagaaagggaagaagaaaactggcggttccaaacagcaaacagagaaacctgagtcagaagatgagtgggagcgtacggagcgagagaggctgcaggatcttgaagaacgggacgcttttgccgagcgggtaagacagcgagataaagaccggacgagaaatgtcttagaaagaagcgataaaaaggcttacgaggaggctcagaagagattgaaaatggctgaggaggacagaaaggcgatggtgccggagctccggaagaaaagccgccgagagtacctggccaagcgtgagcgggagaagcttgaggacctcgaggccgagctggccgacgaggaattcctctttggcgatgtggaattgtccagacacgaacgtcaggaactgaagtataaaagaagggtgcgggaccttgccagggagtacagggccgcaggagaacaagagaagctggaggccacaaatagatatcacatgcccaaggaaacaagaggacagccggcacgggcagtggatctcgttgaggaggaatcgggcgctccaggggaagagcaacgtcggtgggaagaggcacggctgggagcagcgagcctaaagttcggcgcacgggatgccgctagccaggaacctaagtatcagctgtag

SEQ ID NO: 220351 - DNA, 1683 bp, Artificial Sequence
  Description of Artificial Sequence: Synthetic coding sequence
atggaatcccagcccgctcaggaatgccttatgcagatgtttctgcccatcgagcctgcttgttttgtagagtggctgggcacaagcccctcgcagctgggcgttgttatggtcgacgaagctcacgaaagaacactgcacacagatatcttgtttggattgatcaaggacgtggccaggttccgcccagagctcaaggtattggtggcatctgctactatggacacagccaggttcagcacttttttcgacgacgcacctgtcttcagaatccccggacgcaggttcccagttgacattttttacacaaaagcacctgaggccgattatcttgaggcctgtgttgtgtccgtactgcagatccacgttactcagccacccggagacatcctagtttttctgactggccaagaggaaattgaggccgcttgtgagatgctgcaagataggtgtaggcggcttggttctaaaatccgcgaacttcttgttctacctatctacgcaaacctacccagcgatatgcaagcaaggatcttccagcctacccctccaggtgcccgaaaagttgtcgtggccacaaatattgctgaaacttccctgaccattgaaggtataatatatgtgttggatccgggtttttgcaagcagaaatcttacaaccctagaaccgggatggagtcacttaccgttactccctgctctaaagccagtgccaaccagcgagctggacgggcaggcagagtggcagccggaaagtgtttccggctgtatactgcatgggcctaccagcacgagctagaggaaactactgtacccgagatccagcggacttccctagggaacgtggtactgctgctgaagtccctaggaatacatgacctgatgcacttcgactttctggacccacctccctatgagacattactgctagcactagaacagctatacgctctcggtgccctgaaccatctgggcgagctgacaaccagcgggcgaaagatggccgagctgccagtcgaccctatgctgagtaagatgattttggccagtgagaagtactcttgttcagaagaaattcttaccgtggcagccatgttaagtgttaacaactcgatcttttacagaccgaaagacaaagtggtacacgccgataacgcaagggtgaacttttttctccccggaggagatcatctcgtgctgctgaacgtctatacacaatgggcagagtctggatactcctcacaatggtgctatgagaacttcgtgcagtttcgcagcatgagacgggcacgcgatgtccgggaacagttggagggactcctagagcgtgttgaggtgggtttgtcctcatgtcagggtgattacatccgtgtcagaaaagccatcactgctggttacttttatcacacagcccgacttacacggtcgggctaccgaaccgtcaaacagcaacagaccgttttcatccaccccaactcctccctgttcgaacagcagccccgttggctgctctaccacgagcttgttctaacaactaaggaattcatgcggcaggttcttgagatagaatcttcatggctgctggaggtcgctccccactactacaaggcgaaagagctggaggacccgcacgccaagaagatgcctaaaaagatcggtaaaactagagaggagctgggttag

SEQ ID NO: 220352 - DNA, 888 bp, Artificial Sequence
  Description of Artificial Sequence: Synthetic coding sequence
atgtctgaggatcccaggggaccgaaagtacccagaaaagcagtagttgaaaaacctgcccgtgctgccgaacgagaggcccgtgccctgctggagaaaaatcgctcataccgcctccttgaagattcagaggaaagttccgaggagacagtgtccagagccggtagcagtctgcaaaaaaaacgaaaaaaaagaaaacacctccgaaaaaaacgggaggaagaggaggaagaggaagcctcagaaaagggcaaaaagaaaaccggcggttccaaacagcaaactgaaaagcccgagtctgaagacgagtgggagcggacggaacgggagcgactgcaggaccttgaagagagagatgcctttgcggaacgggtgcggcagagggacaaagatcggacgcgaaacgtactggagcgctctgacaagaaggcttacgaagaagcccaaaagcgcctgaaaatggccgaggaggatcggaaggctatggtgcccgaactgcgaaagaagagtcgaagggagtacctcgcaaaacgcgagcgcgagaagctcgaagacctggaagccgaactggcggacgaggagtttctatttggagacgtggaactgagtcggcacgagcggcaagagttaaagtataaaaggcgagtgagagacttggctcgcgaatacagagccgcaggagagcaagaaaagttggaggccaccaacagataccacatgcctaaagaaacacggggtcaaccagcaagagcagtggatttagtggaagaagagagtggtgccccaggcgaggagcagcgaaggtgggaagaagccaggttgggggctgcttcattgaagttcggagcacgcgacgccgcttcccaggagccaaaataccagctatag

SEQ ID NO: 220353 - DNA, 888 bp, Artificial Sequence
  Description of Artificial Sequence: Synthetic coding sequence
atgtcagaggatcccagaggacctaaggtccctcggaaagccgtggtggaaaagccggcaagggccgctgagagagaagccagggctcttctggaaaaaaaccggagctaccgtcttcttgaagattccgaggaatccagcgaggaaactgtgtcccgagctggaagttccttgcagaaaaaacggaagaaacgaaaacaccttcgtaagaagcgagaagaggaagaggaagaggaggcatccgaaaaaggcaaaaagaaaacaggtggctcaaagcagcaaaccgagaagcctgagtctgaagatgagtgggagcggaccgagagagagagactacaggatttggaggaaagagacgccttcgccgaacgggtccgccaacgggacaaggaccgcacacggaatgttctcgaacggtccgacaaaaaagcctacgaggaagcccagaagaggctgaagatggccgaggaggataggaaggcgatggtgcctgagctgaggaagaaatcaaggcgagaatacctagctaaaagggaacgcgagaaactggaagacttggaggccgagctcgccgacgaggaattcctctttggtgacgtcgaactgagccgccacgaacgacaggaactgaagtacaagcgccgtgtacgggatttagcaagagaatacagagctgccggtgaacaggaaaaattggaagcaactaaccgatatcatatgccgaaggaaacaaggggacagcccgctagagccgtggatctggtcgaggaagagtccggcgcacctggtgaggaacagcgtcgctgggaagaggccagacttggggctgctagcctaaagtttggtgcccgagacgctgcatcacaggaacctaagtaccagctgtag

SEQ ID NO: 220354 - DNA, 888 bp, Artificial Sequence
  Description of Artificial Sequence: Synthetic coding sequence
atgagcgaagaccccagaggtcctaaagttcctaggaaagctgtcgtggaaaagccggctagagcagctgaaagggaggctcgtgctctgctcgaaaagaaccgatcgtatagactgctggaggactctgaggaatcttccgaggaaacggtgagtcgcgcagggtctagcctgcagaagaagaggaaaaagagaaagcatttacgaaagaagagagaggaagaagaggaagaggaagccagtgagaaggggaagaaaaaaaccggaggctctaaacaacagaccgagaagcctgagtctgaggatgagtgggagcgaacagagagagagagactccaagatctcgaggagcgggacgctttcgccgaacgcgtcaggcagcgagataaagatcgaacacgtaacgtcctggagcggagcgacaaaaaggcctacgaggaagcacagaagagacttaaaatggcagaggaggaccgcaaggccatggtccccgagctgcgcaaaaaatcacgcagggagtatctcgcaaaaagagagcgggaaaaactggaagatcttgaagccgaactagccgacgaggaatttcttttcggcgacgtggaattaagccgacatgagagacaggagctgaaatataaacgtagagtgcgcgatctagctcgggagtatagagctgctggcgaacaagagaagttagaagcgaccaatcgatatcacatgccaaaagaaaccagaggacagccggcaagggccgtggatctggtggaggaagaaagtggggcacccggagaggaacagcggagatgggaagaagctcgactaggggcagccagccttaaattcggggctcgggacgctgcttcccaggagccaaaatatcagctgtag

SEQ ID NO: 220355 - DNA, 888 bp, Artificial Sequence
  Description of Artificial Sequence: Synthetic coding sequence
atgtccgaagatcctcgcggacccaaagtgcctcgaaaagcagtcgtcgagaaacctgccagggcagcggagagagaggccagggctctcctggagaaaaaccgctcttataggttactggaggatagcgaggaaagcagcgaggagaccgtgtcccgagcgggatcttcactccagaagaaacgtaaaaagagaaagcatctgcggaagaagcgagaggaggaggaagaagaggaggcaagtgaaaaggggaagaagaaaaccggcggatctaaacaacagactgagaaaccagagagcgaggatgagtgggagagaacagagcgagaaaggttgcaggacctcgaagaacgagatgcctttgcagagagggtgaggcagagggacaaagatcggacgaggaatgtgctcgaacggtctgacaagaaggcttatgaagaagctcaaaagcggctcaagatggctgaggaggaccgcaaagctatggttccagagctccgcaagaagtctagacgtgaatacctggcaaaaagggagcgggagaaactggaggatctagaggccgaactggctgacgaggagtttctgttcggagatgtggaactcagtcggcatgaacgtcaagagttaaagtacaagaggagagttcgggatctggcacgtgagtaccgggctgctggagagcaagagaaactggaagcaaccaatcggtaccacatgccgaaggagacccgcggacagccggcaagagctgtggacctggtggaggaagaatcaggagcccctggagaggagcagcgcaggtgggaggaggccaggctcggtgctgccagtctgaaatttggcgcaagagatgcagcatctcaggagccaaagtaccagctttag

SEQ ID NO: 220356 - DNA, 1683 bp, Artificial Sequence
  Description of Artificial Sequence: Synthetic coding sequence
atggaaagccaacctgcccaagaatgcttgatgcagatgttcctgcctatcgaacccgcatgcttcgtagagtggctgggcacttccccctcacaactgggagtggttatggtagacgaggcacatgagcgcaccctgcatacagacatactgttcggactaataaaggatgtggccaggtttcgacctgaactgaaggtgcttgtggccagcgcaacgatggacaccgcccgtttctctacttttttcgatgacgctccagtcttccggattccgggacgcaggtttcctgtggatattttttataccaaggcacccgaagccgattatctcgaagcttgcgtggtcagcgtactgcagatccacgtcactcagcctccaggggatattctggtcttccttaccggacaggaagaaatagaggcagcctgtgaaatgctgcaagataggtgccgcaggttgggttcaaagatccgggagttgctagttcttcccatttacgctaatttgccgtcagatatgcaagcccgtatttttcaacccaccccaccaggggcacgaaaagttgtcgtggctaccaacatcgccgagacttcacttacgattgaagggattatttatgtcctggatcctggcttctgcaagcaaaagtcttataatccgagaaccgggatggaatcactgacagttactccatgttccaaggcctctgctaaccagagagctggaagagccggtcgggtggctgctgggaagtgctttcggctctatacggcctgggcatatcagcatgaacttgaagaaacgaccgtgcccgaaatccagcgaacatcgctcggcaatgtcgtgctgctgctgaaatcactggggattcacgacctcatgcacttcgatttcctggacccccctccatatgaaacactactgctggctttggaacagttgtatgctctgggcgctctcaatcatctgggggagctcacaaccagcggccgtaaaatggcagagctccccgtggatcccatgctctccaaaatgattctcgcttcagaaaagtatagttgttctgaagaaatcctgaccgtggccgcaatgctgagtgttaacaactccatattttacagacctaaggacaaggtggtgcacgctgataatgccagagtaaacttctttttacctggcggagaccatttggtgctactgaacgtatacacccagtgggcagagagtgggtactcctcacagtggtgttacgaaaatttcgtgcagttcaggagcatgcggagagccagggatgtaagggagcagcttgaaggattgctcgagcgtgtggaggttggtctatctagttgccagggagattatattagagtgcgcaaggccatcacagcaggatatttctatcacaccgccagactgacgagaagtggctatcgtacggtgaagcagcagcaaaccgtcttcatacacccaaactctagcctgttcgagcagcagccccgatggctgctgtaccacgaactagtgctgaccacgaaggagtttatgcgccaggtgctggaaattgagtccagctggctgctcgaagtggcccctcattattacaaggccaaagaattggaagatccccacgccaagaaaatgcctaagaagattggtaagacgcgcgaggaactaggatag

SEQ ID NO: 220357 - DNA, 888 bp, Artificial Sequence
  Description of Artificial Sequence: Synthetic coding sequence
atgtccgaggaccctcgagggccaaaagtgccaagaaaagcagtcgtagaaaagcccgctagagcggctgaaagggaagctagggccttattggagaagaatcgttcctaccgtcttctcgaagatagcgaagaatcttccgaggagaccgtgagtcgggctggctctagtctccaaaagaagcgtaagaagaggaagcacctgaggaaaaaacgagaagaggaagaagaagaggaggccagcgaaaaagggaaaaagaagacggggggatctaaacagcagactgagaagcctgaaagcgaggacgagtgggagaggacagagagagagcgcctgcaggacctggaagagagggacgcattcgcagagagggtcaggcaaagagataaagaccgaacgcgaaacgttctggagaggagtgacaagaaggcctacgaggaggcacagaagagactgaagatggcagaggaggaccgaaaagcgatggtcccagaacttcggaaaaagtcacggcgtgagtatttagcgaaacgggagcgggaaaaactcgaggaccttgaagccgagctggccgatgaagagttcctgtttggggacgtcgaactctccagacacgaacggcaggaactcaaatacaagaggcgcgtgagagaccttgctagagaataccgagccgcaggggaacaagagaaactcgaagctacgaatcggtaccatatgccgaaagagacccggggacagcccgctcgcgcagttgacctggttgaagaggagagtggagcgccaggtgaggaacagaggcgctgggaggaagctcgactgggtgcagctagtctcaagtttggcgctcgcgacgccgcatctcaagagcccaaataccagctctag

SEQ ID NO: 220358 - DNA, 2010 bp, Artificial Sequence
  Description of Artificial Sequence: Synthetic coding sequence
atggccactcctgccggtcttgaacgatgggtccaggacgaacttcatagcgtgctgggcttgtctgaaagacatgtggcccagtttctgattgggaccgcgcaacggtgtactagcgccgaggagttcgtgcagcgtctccgggataccgacaccctggacctcagcggacccgcacgagattttgcgctgcggctctggaacaaagtgcctcgcaaggccgtggttgaaaagcccgctcgcgcagctgagcgggaggccagggcccttctggaaaaaaatagatcttatcgtctcctggaggacagcgaggaatccagtgaagagaccgtgagtcgagccggatcctctctgcagaaaaagcgcaaaaaaagaaaacatctgaggaagaagagagaggaagaagaggaagaggaagcgagtgagaagggaaagaaaaagactggcggatcgaaacagcagacagaaaagcctgaatctgaagacgagtgggaacgcaccgaacgcgagaggctgcaggatctggaagaaagagacgcattcgctgagagagttcgccagagggacaaagatagaacccggaacgtcctggaacgtagtgataagaaggcatacgaagaagcccagaagcgactgaaaatggcagaggaggatcgtaaagctatggtacctgagctgaggaagaaaagtcggagggagtaccttgccaaacgcgaaagagaaaaactagaagatttggaggctgagctggccgacgaggagtttttgttcggagacgttgagcttagtcggcatgagcgtcaggaattgaagtataaacgcagggttagggacctcgccagagagtaccgggcagccggagagcaggagaagctagaggcaacaaataggtaccatatgccgaaggagaccaggggtcagccagccagggccgtcgatttagtcgaggaagagagcggagccccaggagaagagcagaggcgctgggaagaggctagattaggcgctgcctccctcaaatttggcgctcgagacgcggcttctcaagaacccaagtatcagctagtgctcgaggaggaagaaaccattgagtttgtcagggctacacagttgcagggcgatgaggagcccagcgcaccgcctacatccacccaagcccagcagaaggaatccattcaggcagtcagacgcagtctccctgtgttcccatttagagaagagctactcgcagccatcgctaatcaccaggttctgataattgaaggggaaaccgggtctggcaaaaccacacagatcccccagtacctgttcgaagagggatataccaacaagggtatgaaaattgcctgtactcagcctagaagagttgcagcaatgagtgttgccgcacgggtcgctcgtgagatgggagtgaagctgggaaacgaggtcggatactctatccgctttgaggactgtacatctgaacggactgtgttgaggtatatgacggatggcatgctgcttcgcgagtttctgtcagaaccggatctcgcctcctacagcgtggtgatggtggacgaagcccacgagaggactctgcacacagatatcctctttggactgatcaaagacgtcgcgcgatttaggcccgagctcaaagtgttggtcgcttcggcgaccatggacactgcaagattttccacttttttcgatgacgcccctgtttttcgcatacccggtcgcaggtttcctgtggatattttttacactaaagcccctgaagcagattatctagaagcttgcgtggtcagtgtgttgcagatccacgtgacacaaccaccaggggatattctggtgtttctcaccggacaggaggagatagaggccgcttgcgagatgttacaggataggtgccgtcgtctgggctccaagattagggaacttttagtgctgcccatctacgctaacctacccagcgacatgcaggctcgcatatttcagcctactcctcctggtgcacgaaagtag

SEQ ID NO: 220359 - DNA, 3126 bp, Artificial Sequence
  Description of Artificial Sequence: Synthetic coding sequence
atggctacccccgcaggattagagcgctgggtgcaggatgagcttcacagcgttctgggactgtcagagcgccacgtggcgcaattcctcataggcacggcgcagcggtgcaccagcgctgaggagtttgtgcaaaggttacgcgataccgatacccttgatttgagcggccctgccagggattttgctttgaggctgtggaacaaagtcccccgaaaagccgtcgtggaaaaaccagcacgcgcagctgagcgcgaggccagagctctgctggaaaaaaaccgctcttaccgcctgctggaggattcagaggagagctccgaggaaacagtgagcagggctggcagtagcctacaaaaaaagcgcaagaaacgaaaacacctcaggaagaaacgcgaggaggaggaggaggaggaggcctccgagaagggaaagaagaagaccggcggttccaagcaacagactgagaagccggaatccgaggatgaatgggagcgcaccgaacgggagcgccttcaggatctggaagaacgcgacgcctttgcagagagagtgcgccagcgggacaaggacaggacaaggaacgtgcttgaaagatctgataagaaggcatacgaggaggcacagaagcggctgaaaatggccgaggaggaccgtaaagctatggtaccagagttaagaaagaaatctcgcagggagtatctagcaaaacgcgagcgcgagaaactggaagacttggaagctgaactggctgacgaggaattcttgtttggagacgtcgagctaagtcgccatgaacggcaggaactgaagtacaaaagaagggtaagagacctggccagggagtacagagcagccggtgaacaggagaagctggaggccaccaacaggtatcatatgccgaaagagacacggggacaacccgcaagagcagtggatctggtggaggaggagtcaggggctcccggagaagaacagcgcaggtgggaggaggctcgcctgggggctgccagcttgaagttcggcgctagagacgctgctagccaagaaccaaaataccagctcgtcctggaagaagaggagaccatcgagttcgtcagggcaacccagcttcagggcgatgaggaaccttcagctcctcccacatccactcaggctcagcagaaggagtctattcaggccgtgcgtcggtccctgcccgtattcccctttagagaagagctgctcgccgctattgccaatcaccaagttttaattatcgagggagagactggctcgggtaagacgacacaaatccctcaatacctgttcgaagaaggatacaccaacaagggtatgaaaatagcttgtacccaaccgaggcgtgttgcagccatgagtgttgctgctagagttgccagagagatgggcgtgaagctggggaacgaagtgggttattctatacgttttgaggattgtacctccgagcggactgtgctcagatatatgacagatggcatgctgttgcgcgaattcttgtccgagcccgacctggcctcatacagcgttgtcatggtagatgaggcccacgagcggaccctgcacaccgacattttgtttgggctgatcaaagacgtggctagattccggcctgaactgaaagtgctggtagcaagcgccactatggataccgcaaggttctccaccttcttcgacgacgccccagtgtttaggatccccggacgcagatttccagtggacattttctacaccaaggctcccgaggcagactatcttgaggcctgcgtggtgtccgttctacagatccatgtgacacaaccaccaggggatattctggtcttcctgacagggcaggaagagatcgaggccgcatgtgagatgctccaagacaggtgcaggaggctggggtctaagattagagagctgctcgttctaccgatttacgccaaccttccttcagatatgcaggctaggatcttccagccaacacctcccggagcccgtaaggtggtcgttgccaccaatatcgccgagacttccctgaccatagaagggattatctacgtcctcgatccgggtttttgtaagcagaagagctataatccccgtactggcatggaatccctaacagttaccccctgttccaaagcttctgccaaccaacgcgctggacgcgctggtagggtagcagccggtaagtgcttccgcctctacacagcctgggcttaccagcatgaacttgaagagaccactgtccccgagattcagcgcaccagcctggggaacgttgtcctgctgctaaagtctctggggatccacgatttgatgcacttcgattttcttgacccaccaccctatgaaacccttcttcttgctctcgagcagctatatgccttgggtgcactaaaccacctcggagaactgacaaccagcggtagaaagatggccgagctgcccgtcgatcccatgctctctaagatgatcctcgcttctgagaagtactcctgttcagaggaaattctgacagtcgctgctatgctgtcagtgaataatagcattttctaccgcccaaaggacaaagtggtgcacgccgataatgcgagagttaacttctttctccccggaggggaccacctggtgctgctgaacgtctatacccaatgggcagaatcggggtattcttcccagtggtgctacgaaaatttcgtgcagtttcggtccatgagaagagctcgtgacgtaagagaacagctcgagggattgctggaacgggtggaagtcgggttgtcctcgtgtcagggcgactacatacgggtccgcaaggcaataactgccggatacttctaccatacagcacggttgacacgttcgggctacaggaccgtcaaacagcaacaaacagtgttcatacacccaaactcttccctcttcgaacagcagcccaggtggctcctgtaccacgaactggtgctgaccacaaaggaattcatgcggcaggttctcgagatagaaagctcgtggctgcttgaggtcgccccacactattacaaggccaaagagctggaagatcctcacgctaaaaaaatgccgaaaaagattggtaaaacacgtgaagagctaggctag

SEQ ID NO: 220360 - DNA, 1683 bp, Artificial Sequence
  Description of Artificial Sequence: Synthetic coding sequence
atggagtctcagccagcgcaggagtgtctgatgcagatgtttcttccaatcgagcccgcatgcttcgtagagtggctaggtacctccccttcccaactaggggtggtgatggttgacgaggcccatgagcgaaccctccacactgatatcctgttcggtctgatcaaggacgtagcgagattcagacctgagctcaaagtactagtagcctcagctactatggataccgctagattttcgactttctttgacgatgcacctgtcttcaggatcccgggtcgtcgctttcccgtggacattttttatactaaagctcctgaagccgattatttggaggcgtgtgtagtgtcggtactccaaattcacgtgacacagcccccaggagatatcctggtgtttttgactggccaagaggagatcgaagcagcatgtgaaatgctgcaggacagatgtaggagactcgggtctaagataagagagcttctggtgctgccaatctatgccaacctgccatcggacatgcaagcaaggatttttcagcccaccccccctggcgcaaggaaggtggtagtcgcgactaatatagccgagacctcactgacaatagaaggaatcatatacgtccttgatccagggttttgtaagcagaaatcttacaatcctcggactggaatggaaagcctcacagtcaccccatgctctaaggcctccgccaaccagagagccggacgggctggccgagtggccgctggcaagtgttttcgactgtatactgcttgggcttatcaacatgagctggaggaaaccacagttccagagattcagcgaacttccctgggcaatgtggtattgctgctgaaaagcctcggcatccacgatctgatgcacttcgacttcctcgatcctcccccatacgaaacactgttactcgcactggaacagttatacgctctgggtgctttgaatcatctgggcgagctgaccacctccggtcgaaagatggccgagctgcctgtggaccctatgctatccaaaatgatcctggcatcggagaagtattcctgctctgaggagatcctgacagttgccgcaatgttaagcgtcaataatagcattttttaccgcccaaaggacaaagtcgtgcacgcagacaacgctagagtaaacttcttcctaccaggaggcgatcatcttgtgctcctgaacgtgtacacgcaatgggcagagtcaggctactcgtcacagtggtgttatgagaattttgtgcagttccggtcaatgagaagagccagggacgtgagagagcagcttgagggcctccttgagagggtcgaggttggactctctagttgccagggcgactatattcgggttcgcaaggctatcaccgccggatacttctaccacactgccagactgactagatctggctatcgcactgtgaagcaacagcaaactgttttcatccaccccaattcatcactgttcgagcagcagccaaggtggttgctataccacgaactggtgcttaccacaaaggaatttatgcggcaggttcttgagatagagtcgtcatggctcctggaagtcgcgccacactactataaggccaaagagcttgaagatccccacgccaagaaaatgcctaagaagataggcaagactcgggaggagttgggttag

SEQ ID NO: 220361 - DNA, 1683 bp, Artificial Sequence
  Description of Artificial Sequence: Synthetic coding sequence
atggaatcacagcccgcacaagaatgtcttatgcagatgttcctacctattgagccggcatgtttcgttgagtggctgggcaccagtccttctcagcttggtgtcgtgatggtagacgaggctcacgaaaggacactccataccgacattctctttggactgatcaaggacgtggctagatttcgacctgagctgaaggtgttggtggcatccgccactatggatactgctagattttccacgtttttcgacgacgcacccgtctttcgaatccccggacgtcgctttcctgtggatatcttttacaccaaagcccctgaggccgattatctggaggcatgcgtcgtctctgttctgcagatccacgtcactcagccccctggcgacatcctcgtttttcttactggacaggaagaaattgaagccgcttgcgagatgctgcaggacaggtgccgcaggctagggagtaagattcgagaattgctggtcctgcccatctatgctaacctgcctagtgatatgcaggcgcgaattttccaacccacgcccccaggagctaggaaggtggtagtcgccacaaatatcgctgagactagcctgacaatcgagggaatcatttacgtgcttgacccagggttctgcaagcagaaatcctacaacccacggactgggatggaatcgcttacagtcacaccttgctctaaagcctccgccaatcaaagagctggacgagctggtcgagtggctgcagggaaatgcttccggttgtacactgcgtgggcctatcagcacgaactcgaggaaaccaccgtgccagagatccagcgaacttcattgggaaatgttgtgttgctgctgaagtccctcggcatccacgacttgatgcacttcgactttctggatccgcctccttatgagacactgctcctggctctcgagcaactctatgccctgggagccctgaaccatctaggggagctgacaacatctggccgtaaaatggctgaacttccagtcgacccgatgttatcaaaaatgatcttggcctccgagaagtattcctgctcagaggagatccttaccgtggccgctatgctgtccgtgaacaattctatcttttatcggcctaaggacaaagtcgttcacgcagataatgcaagggttaacttcttccttccagggggtgatcatctggtcctgctcaacgtgtatacccagtgggctgaaagtggttattcctcccagtggtgttacgaaaatttcgtacagtttaggagtatgaggcgagcacgcgatgtgcgggagcagctcgagggactgctcgagcgggttgaggtgggcctgagcagctgccagggggattacatacgggtgcgtaaagccataactgctgggtacttctatcacactgcacgattaaccagatcgggatacaggacagttaagcagcagcaaacggtctttatccacccaaattctagcctgttcgagcagcagccacggtggttactgtaccatgaactggtgctcaccaccaaagagttcatgcgccaggttctggagatcgagagctcttggctgttggaagtagctcctcactattataaagctaaggagctggaagacccccatgctaagaaaatgccaaaaaagatcggcaaaacccgagaagagcttggctag

SEQ ID NO: 220362 - DNA, 567 bp, Artificial Sequence
  Description of Artificial Sequence: Synthetic coding sequence
atggagagtcagcctgcccaggaatgtcttatgcagatgttccttcctatcgagcctgcgtgcttcgtggagtggctagggactagccccagccaactgggggtggtgatggtagacgaagcgcacgagcgcacactgcatactgacattctgtttggtctgattaaagatgttgcgcgattccgaccggagctgaaggttctggtggcctcagcaacaatggacactgccaggttctctaccttctttgacgacgcacctgtctttaggatcccgggtcggcgatttcctgtggacatattttacactaaggcccctgaagcagactatctcgaggcatgtgtcgtgagcgtgctgcagattcacgtgacacaaccgccaggcgacatcttggtattcctgaccggacaagaagaaatcgaggccgcttgcgaaatgctgcaggacaggtgccggagattaggatctaagattcgcgagctccttgtactcccaatctacgcgaatcttccctccgatatgcaagccagaatctttcagccaacaccacccggagccagaaagtag

SEQ ID NO: 220363 - DNA, 3126 bp, Artificial Sequence
  Description of Artificial Sequence: Synthetic coding sequence
atggcaacaccggctgggctcgagagatgggtgcaggatgaactccacagtgtcctaggactgagcgagcgtcatgttgcccagttcttgatcggtacagctcagaggtgtacaagcgccgaggaatttgtgcagcggctgagagatacagacacactggatctgtccggccctgccagggatttcgccttgaggctatggaataaagtgcctcgtaaggcagtcgtcgagaaacctgctcgagcggctgagcgcgaggccagagccctcctcgagaagaacaggagctaccgcctactggaggatagcgaagagagctccgaggagactgtcagccgcgcagggtcgagcctgcaaaagaaaagaaagaagcggaagcacctgcgcaagaagcgcgaagaagaagaagaagaggaagcctctgaaaagggcaaaaagaaaactgggggatcgaagcagcagacggaaaaacctgaaagcgaagatgaatgggaacggactgaaagggaaagactccaagatttggaggaacgtgacgccttcgccgaaagggtacgacaacgagataaggatagaacgaggaacgtgttagagaggagtgacaagaaggcctacgaggaggcgcaaaaaaggctgaaaatggctgaggaagatcgcaaggccatggtccccgagttaaggaagaaaagcaggagggaatacctggctaagagagaacgagagaaactggaggatctggaggccgagcttgccgacgaagaatttctgttcggcgacgttgaactgtcccggcacgagaggcaggagctcaagtacaaacgacgggtgcgagatctagcgcgagagtaccgagccgctggcgaacaagagaaactagaggcaacaaaccgctatcatatgcctaaggaaacacgcggacagccagccagagcggtagacctggtcgaagaagaaagcggagcaccaggcgaggaacaaagaaggtgggaggaggctcgactcggtgctgcttccctcaaattcggcgcacgcgatgcagccagtcaggaacccaagtaccagcttgtgctcgaggaggaggagacaattgaatttgtgcgcgctacacagctacaaggtgacgaggagccaagtgcacccccaacaagtacccaggcccagcagaaggagtccatccaagccgtacgcagatccctcccggtgttcccctttcgtgaggaactgctcgctgccattgccaatcatcaagttctcatcatagaaggagagactgggagtgggaagaccacccagattccccagtacttgtttgaggagggctacaccaacaagggtatgaaaattgcctgtactcagccaagaagggtcgcagccatgtccgtagctgcaagagtggccagggagatgggggtgaaattgggcaacgaagtcggttattccattcggttcgaagactgtaccagtgagcggactgtccttcggtatatgacggatgggatgcttctcagggaattcctctcagagcccgacttagccagttatagcgtggttatggtggacgaggctcacgaacgaacactccataccgatattcttttcggactgatcaaggacgttgcccgattcaggccagagctgaaggtgttggtcgcctccgcaactatggatacagccaggtttagcacgttcttcgatgacgcacctgtatttcggatccctggcagacgattccccgtggacatcttttacaccaaagctcccgaggccgattatctcgaagcttgtgtggtgtcagtgctccagattcacgtgacccagcctcctggagatatcctagtctttctaaccgggcaagaagaaatcgaggctgcttgcgaaatgctccaggatcgctgccgaagactcggtagcaaaattcgggagctcttggtactaccgatttatgctaacttgccctccgacatgcaagcaaggatcttccagcccacacctcctggtgctcgcaaggtggtagtggctacaaatatcgcagagacttcgctgactatcgagggaattatctacgtcctggaccccggattttgcaaacagaagtcctataaccctagaaccggcatggaatccctcaccgtgaccccttgtagtaaagcctccgccaaccaacgggcaggtagagctggccgagtggcagccggaaaatgctttcgcctgtataccgcctgggcgtaccaacacgaactcgaggagacgactgtccccgaaatccagcggacaagtctcggcaatgtggtgctgcttctgaaaagcctgggaattcacgatttaatgcatttcgactttctggatcctcctccctacgaaacactactgctggcactagagcagctttacgcgctcggggctctgaaccatctgggagaactgacgacaagcggacggaaaatggccgagttgcccgtagaccccatgctgtcaaaaatgattctggcaagtgaaaaatactcttgctccgaagaaattctgacggtcgccgctatgttgtccgtgaacaattctatcttttataggcccaaggacaaggtcgtccacgctgataatgctagagtgaatttctttctccctggaggcgaccacctggtgctcctcaacgtgtacacccaatgggcggaatccggctactcgtctcagtggtgctacgaaaattttgttcagttccgcagtatgcgcagagcacgcgacgtccgtgagcagctcgaggggctgctggagagggtggaggtgggcttgagctcttgccagggggattacatccgcgtgcggaaggccatcacggccggatacttttatcataccgctcgtttaacccggtccgggtacagaacggttaagcagcagcagaccgtgtttattcacccaaactctagcctgttcgaacagcaacccagatggctgctttatcacgagttagttctgaccaccaaggagtttatgcgccaggtgcttgaaatcgaatcttcatggctcctggaggtggctccccactactataaggccaaggagttggaagacccacacgccaaaaagatgccgaagaaaattggcaagacacgggaggagctcggctag

SEQ ID NO: 220364 - DNA, 444 bp, Artificial Sequence
  Description of Artificial Sequence: Synthetic coding sequence
atggcgactcctgcgggtctcgagcgttgggttcaagacgaactccacagtgtcctggggctgagcgaaaggcacgttgcacaatttttgattgggactgcccaaagatgtacatccgctgaggaattcgttcaacgtctgagggacaccgacacgctggacctgtcaggcccagcccgagattttgccctgagactttggaataaagtgccccgaaaagcagtcgtggaaaagcccgctcgcgcagccgagcgggaagcccgagcactcttggaaaaaaatcggtcgtacaggttactcgaagacagtgaggagtcatctgaagagactgtgagccgggctgggagtagccttcagaaaaagagaaaaaaacgaaagcacctacgaaaaaagcgtgaggaggaggaagaggaggaggcttcagaaaaggggaagaagaagtag

SEQ ID NO: 220365 - DNA, 4110 bp, Artificial Sequence
  Description of Artificial Sequence: Synthetic coding sequence
atgggagggaaaaataagaaacacaaggccccagctgcagccgtggtcagggctgcggtctcagcgagtcgcgctaaatctgcggaggccggtatcgctggcgaggcccagtccaaaaagccagtgtcccgaccagccacggcggcagcagcagcagctggctcacgcgaacctagggtgaaacaggggccaaagatttacagctttaactctaccaatgatagctcaggcccagccaatctcgataagtctattttgaaagtggtcataaacaataaactggaacagcggatcatcggagtgattaacgagcacaagaagcagaacaatgataagggtatgatctccgggcgactgacagctaaaaaactccaggacctatacatggccctgcaggcattctctttcaagaccaaggacatcgaggatgcaatgactaacaccttattatacggtggagacttgcactcagcgctggattggctgtgcctgaacttgtccgatgacgccctcccagaagggtttagtcaggaatttgaggaacaacaacccaagtcccgcccaaaattccagagcccacagatacaagccactattagtccccctcttcagcccaagacaaaaacctacgaggaagacccaaaatctaagcccaagaaggaagaaaaaaatatggaggtaaacatgaaggaatggatcctgcgctacgcagaacagcagaacgaggaggagaaaaacgagaactctaagtccttagaggaggaggagaagttcgacccaaacgagaggtatttgcacctggcagctaagctgctggacgccaaagagcaggctgccaccttcaagcttgaaaaaaacaagcaaggtcaaaaggaggctcaggaaaaaattcggaagttccagagggagatggagacactggaggaccaccctgtgttcaatcccgcaatgaagatcagccatcagcaaaatgaaaggaagaagccccctgtggcaactgaaggcgaatctgctttgaatttcaatctgttcgagaagtccgctgcagccacagaggaagagaaggacaaaaagaaagagccccacgatgtgcgaaactttgactataccgcccgaagctggaccgggaagagtcccaagcagtttctgatcgattgggtgaggaaaaacctgccaaaatccccaaacccgtctttcgaaaaggtgccggtggggaggtactggaagtgcagggtgagggttataaaaagcgaggacgacgtgcttgtggtgtgtcccaccattttaactgaggatggtatgcaggcccagcatttgggagctacattggcactatatagacttgtgaaaggtcagtcagttcatcagctgttaccgccaacctacagggatgtgtggctggagtggagtgatgccgaaaaaaagcgcgaggagctaaataaaatggagaccaataagcccagagatttattcatagccaaactgctgaacaaactgaagcagcagcagcagcaacagcagcagcattctgagaacaagcgcgagaacagtgaggatccagaggaatcttgggaaaacctcgtcagcgacgaagatttctccgccttgagcctcgaatccgctaacgtcgaggatctggagcctgttcggaacctttttcggaagctgcagagtacgccgaagtaccaaaagcttctgaaagagaggcagcagctacccgttttcaagcatcgagactctattgtagagaccctcaagcggcatcgcgtcgtggtcgtggccggagagacaggcagtggcaaatcaacccaagtgcctcactttctgctcgaggacttacttttgaacgagtgggaggcttcgaagtgtaatatcgtgtgtacacagcccaggcggatctctgctgtgagtctcgccaatcgcgtttgcgatgagctagggtgcgagaacgggcctggcggaaggaatagcctatgcggctaccagatcaggatggagtctagggcgtgtgagagcactcggctgttgtattgcaccacaggcgtgttgttacgcaagcttcaggaggacggactgctgtctaatgtgagtcacgtgattgtggacgaagttcacgagcgctctgtacagtctgactttctattaattatcctcaaagaaattctgcagaaacgctcagatttgcacctgattctgatgtcagcaaccgtggattcagagaagttctctacctacttcactcactgccctatcctgagaatctctggtcgctcataccctgtcgaggtgtttcacctagaggatatcatcgaagaaacaggattcgtgctggaaaaggactcagagtattgtcagaagttcctggaggaggaggaagaagttaccatcaatgttacatcaaaagctggcggtataaagaagtaccaggaatacattcctgtgcaaaccggtgctcacgctgatctgaaccccttttaccagaaatattcttctcggacccaacacgccatcctctacatgaatccacacaaaataaatctggatctgatcttagaattactggcttatttagacaaatccccccaatttcggaatatcgaaggagccgtgttaatcttcctccctggactagcacatatccagcaattgtacgatttgctgtctaacgaccggagattttattcggaacggtataaagtgatcgctctgcactctatcctttcgacgcaggatcaggccgctgcattcacactcccacccccaggagtcaggaaaattgtgctcgccacaaacatcgctgagacaggtataacaatccccgatgtggtgttcgtaatagatactggcaggacgaaagagaacaaatatcacgaaagtagccagatgtcatccctggtggaaacctttgtgtcaaaagcgtcagcgctgcagaggcagggccgtgccggtcgggtgagagatggcttttgcttccgcatgtataccagagagagattcgagggattcatggactactcagtgcctgaaatccttcgcgttccacttgaggagctgtgtctgcacattatgaaatgcaatctgggaagccccgaagatttcttgtcaaaagctctcgatccacctcagctccaagtcatctcaaacgccatgaatcttctgcgcaaaatcggcgcttgtgaattgaacgagccgaaactgacgcccctgggtcagcacctcgccgctctcccagtcaatgtgaagatcgggaaaatgctaatcttcggagccatttttggttgtctggatcctgtggctactctggctgccgtgatgacagaaaagagcccgttcaccacccctattggacggaaggacgaagctgatctcgcgaagagcgccctcgcaatggccgatagcgatcacctgaccatttataacgcctacttgggttggaagaaagcccgtcaagaggggggttaccgatctgagatcacgtactgccggagaaatttcctgaatagaacatccctgctgaccctcgaggacgtcaagcaagagttgatcaaattagtgaaggctgcaggcttttcttccagtacaacctcaacaagttgggaaggaaatagagcgagccagactttatcgtttcaagagatcgccctcttgaaagctgtgttagttgccggactatacgacaacgtcgggaagataatttataccaaatccgtcgatgtgaccgaaaagcttgcatgcatcgtagagaccgcccagggaaaggcccaggttcatccttcctccgtgaacagagatttgcagacacacggatggctgctttaccaggagaagatccgctacgccagggtatacctgcgcgagacgactttgatcacacctttccctgtattactgttcggaggcgatattgaagtgcaacaccgagagaggctgttaagcatcgacgggtggatctattttcaggcccctgtgaaaatcgcggtcattttcaagcagctgcgcgttctcatcgattccgtcctccggaagaagttggaaaaccctaagatgagcttggaaaatgataagatcctgcaaattatcacagagctcatcaagaccgagaataactag

SEQ ID NO: 220366 - DNA, 1989 bp, Artificial Sequence
  Description of Artificial Sequence: Synthetic coding sequence
atggaagaggaggggctagaatgccccaattcctcgagcgagaagcgttactttccagaatcactggacagctctgacggtgacgaggaagaagtactggcctgcgaagacctggaactcaatccttttgacgggctcccatatagcagcagatactacaagctactgaaagagagggaagaccttcctatatggaaggagaagtactctttcatggagaatcttttacagaatcagattgtgattgtgagtggcgatgcaaagtgcggcaaatccgcccaggtgccccaatggtgtgcagagtactgtctctcaatccactaccagcacggcggtgtcatctgcactcaggtgcacaagcagaccgtggttcaattagcactcagggtcgccgatgaaatggatgtcaacattgggcacgaggtggggtatgttatcccttttgagaactgctgtaccaatgagacaattctcaggtattgcacagacgatatgctgcagcgcgaaatgatgtccaatcccttcctgggatcgtacggcgttatcattctggacgacatccacgagaggtctatcgcgactgatgtgctcctgggactgttaaaggacgttctacttgcccgtcccgagcttaagctgattattaattcatctccccatctaataagtaagttgaatagttactacggcaatgttccagtgatcgaggttaagaacaaacatcctgtggaagtagtgtacctgagtgaagctcagaaggactcctttgagtcgatccttcggctgatttttgagatccaccactcaggagagaaaggcgatatcgtggtgttccttgcctgtgagcaggtttacaatcccaggatcagagctaactcattggtcatgcagcctatttcgcagagtcaggccgaaatcagaaaacagattctaggatctagctcatcaggtaagtttttttgtctgtacaccgaagagtttgcaagcaaggatatgacaccgctgaagcccgcagaaatgcaggaggcgaacctgacctcaatggtcctgttcatgaaacggatcgacatcgcaggcctgggccattgtgacttcatgaatcggcctgccccagaatcgctgatgcaggcactggaagacctggattatctagccgcactggataacgacggcaacctgagcgagttcggcatcattatgtccgaatttcctctggatccccagctttccaaaagcattctagcaagctgcgaattcgattgcgtggacgaggtgcttactattgccgcaatggtgactgccccaaactgctttagccatgtgccccacggcgctgaagaagcagccctgacatgttggaagactttcctgcacccagaaggcgatcatttcactttgattagtatatacaaagcctatcaggacaccactctgaactcctcttccgagtattgtgtggagaagtggtgtagagactattttctgaactgctccgcactccgtatggccgacgtgatacgggcagaacttctggaaatcataaagaggatcgaattaccttatgccgaacccgcattcggttccaaggaaaataccttgaacatcaagaaggcactcctctctggctatttcatgcaaatagcccgtgacgtggacggctccggaaattacttgatgctcacccacaagcaagtggcccagctccacccactctctggatactccataaccaaaaaaatgcctgaatgggtgctcttccacaagttctctattagcgaaaataactacatcaggatcacatccgagatctcacccgagttatttatgcagctagtgccacaatactatttctcaaatctccccccaagcgagtccaaagatattctccagcaggtagtcgatcacttgtccccggtcagtactatgaacaaggagcagcagatgtgcgaaacttgcccagagacagagcaacgatgcacgcttcaatag

SEQ ID NO: 220367 - DNA, 2232 bp, Artificial Sequence
  Description of Artificial Sequence: Synthetic coding sequence
atggaggaagaaggtttggagtgccctaatagcagcagtgagaagcggtacttcccagagtccttggattcttcggatggcgacgaagaagaggtgctggcttgcgaggatctcgaactcaacccttttgacggcttaccttacagcagccggtactataagctgctgaaagaaagagaggacctgcctatttggaaggaaaagtactcgtttatggagaacctgctgcagaaccagattgtgatagtgtccggagatgcaaaatgtggcaagtccgcccaagtgccccagtggtgtgctgagtactgcctcagtatccattaccaacacggaggggtaatctgtacacaggtgcacaaacagacagtggtgcagctggcactgagagtggccgacgagatggatgttaatatcggccatgaggttggatacgtcatcccattcgaaaactgctgcacaaacgagacaatcctcagatattgcacagacgatatgctacagcgagagatgatgtctaatccctttttgggaagttatggagtcataatcctggatgacatccacgagcggagcatcgccaccgacgtccttttgggtctgctcaaagatgtactattagctcgcccagaattgaaactgatcatcaattccagtcctcatttaatcagcaaactcaactcatactacgggaatgttccagtgatcgaggtcaaaaataagcaccccgtcgaagtcgtctatctttctgaggctcagaaggattcatttgagtctatcctccgcttgatcttcgagatccatcatagtggagaaaaaggtgatattgtggtctttctcgcttgtgagcaagacatcgagaaggtgtgtgagactgtgtaccaaggctcaaacctcaaccccgatttaggagagttggtcgttgtgccactgtatccaaaggagaaatgtagtctcttcaagcctctagacgaaacggaaaaaagatgccaagtataccagcggagggtggtgcttacaacgtcatctggagagttcctgatctggtcaaattccgtgcggttcgtgatcgacgtgggtgtggaaagacggaaggtctacaatcctcgtatccgtgcgaactctttagtgatgcaaccaatttctcaatcccaggcagagatccgcaaacagatcctgggcagcagtagctctggcaagttcttttgcctgtataccgaagagtttgccagtaaagacatgacccccctgaagccagccgaaatgcaggaagccaatttgacctcaatggtgcttttcatgaagagaattgacatcgcaggactgggccattgcgatttcatgaataggcctgcccctgagtccctgatgcaggcactagaagaccttgactatttagccgctctggacaatgatggaaacctttccgagtttggcattataatgtctgagtttcccctggatcctcaattaagcaagtcaatattagccagctgtgaattcgattgtgtggacgaagttctcaccatcgccgctatggtgaccgcgccaaattgtttctcccacgttccacatggcgcagaagaggccgctcttacgtgctggaagaccttcctccatccagagggggaccactttactctgatctccatctataaagcgtaccaggacaccaccctgaattcttcctcggaatactgtgttgagaaatggtgtcgcgactacttcttaaactgcagcgccttacgtatggctgacgtcattcgtgcggaactgttggagatcattaaacggatcgagctaccctatgctgagcccgctttcggatctaaagagaacactctgaatataaaaaaagctctcctgtccggttacttcatgcagatcgcgcgtgacgtcgacggcagcgggaattatctgatgttaacgcataaacaagtagctcaattacatccgctctctgggtattcgatcactaagaagatgccagaatgggtgctcttccacaaatttagtatcagcgaaaataattacatcagaattacctcagagatatctccggaattgttcatgcaactagtgccacagtactatttctctaatctgccaccttccgaaagcaaggatattctgcaacaagtggtcgaccacctctccccagtctccactatgaataaggagcaacagatgtgcgagacgtgccccgaaaccgagcaacgatgcactctccaatag

SEQ ID NO: 220368 - DNA, 1104 bp, Artificial Sequence
  Description of Artificial Sequence: Synthetic coding sequence
atgcagcccatatctcagagccaagccgagatcagaaagcagatcctcggctctagttcctccggaaaatttttctgcttatatacagaagagttcgcatcgaaggatatgactcctctgaaaccagccgaaatgcaggaggcgaacctgactagtatggtgctcttcatgaagcgcattgatattgctgggttgggccactgcgattttatgaaccgcccagccccagagtcactgatgcaggcacttgaagaccttgactacctggcggctctggacaacgatggtaacctgagcgagtttggaattataatgagcgaattcccgcttgacccccagctaagtaaatctattctggccagttgtgaatttgactgtgtcgacgaagttttgaccatagctgccatggtaactgctcctaactgcttttcgcacgtgccgcatggggctgaggaagccgcactcacctgctggaagactttcctgcaccctgagggtgatcactttaccctaatctcaatttacaaggcttaccaggacacaactcttaactcttcatccgaatattgcgtggaaaaatggtgccgcgactactttctgaactgttcagccttaagaatggctgatgtgattcgcgcagagctccttgaaatcatcaagagaatcgagttaccctacgccgagccagctttcggcagtaaggaaaacactttgaatatcaagaaggctttactcagtggctatttcatgcagattgccagggatgtggatgggtctgggaactacctgatgctcactcataaacaagttgctcagctacaccccctgtccggctactccattactaagaaaatgcctgaatgggtgttatttcacaagttttctatctctgagaacaattacattcgaatcacctcggagatttctccggagctttttatgcagctggttcctcagtactacttcagtaatcttcctccatctgaatccaaggacattcttcaacaagtcgtggaccacttaagtccggtcagtaccatgaacaaagaacagcaaatgtgtgagacttgcccagaaacagagcagcggtgtacacttcaatag

SEQ ID NO: 220369 - DNA, 339 bp, Artificial Sequence
  Description of Artificial Sequence: Synthetic coding sequence
atggaggaagaaggccttgaatgtcccaatagctcctctgaaaagcgttattttcccgagagcctggactcttccgatggggacgaggaggaggtcctagcgtgtgaggacttggaactgaaccccttcgatggcttaccctattccagccggtattacaagcttcttaaggagcgcgaggacctcccgatttggaaagagaaatacagctttatggagaatctgctccagaaccagatcgtcatcgtttcaggggacgcaaaatgcggcaagtccgcacaagttccccagtggtgtgctgagtattgcctctctatccattaccaacatggtgggtag

SEQ ID NO: 220370 - DNA, 1935 bp, Artificial Sequence
  Description of Artificial Sequence: Synthetic coding sequence
atgaccatagagatagatttcttgcaaaaaaaatcaattgatagtaacccctacgacacagataagatggctgctgagttcattcagcaattcaacaatcaggcctttagtgtcggccagcagctggtcttttcttttaacgagaaattgttcggactgttggtcaaggatatcgaggccatggatccctctatcctgaagggcgaaccggctactgggaaaaggcagaaaatcgaggtggggctcgttgtcggtaactcccaggtggcattcgagaaggctgaaaattctagtctgaatctgatcggtaaagccaaaacgaaggagaacagacagagtatcatcaaccccgattggaactttgagaagatgggaattggagggctcgacaaggagttctctgatatcttccggcgagcatttgcctcgcgggtctttcctcccgaaatagtggagcaaatgggttgtaaacacgtgaagggaatactgctttatggcccacctggatgtgggaagacacttcttgctaggcagattggcaaaatgctgaacgcccgtgagcctaaagtggtgaatgggcctgaaatacttaataagtacgtgggcgagtcggaggccaatatccgcaagttattcgcagatgctgaggaggagcagcgtcggttgggcgctaattcgggattacatattattattttcgacgagatagacgccatctgcaaacagagaggatctatggccggatctacaggagttcacgatacagtggtgaaccagctcctttcaaaaatcgacggcgtggagcaattgaacaacatccttgtcattgggatgacaaataggccggacctgattgatgaggccctgttgcgccctggccgattggaggtgaagatggagattgggttaccagacgaaaaaggtcggctgcagatcctgcatatacatacggcacggatgcgcggacatcagctcctgagcgccgacgtggatataaaggagctggcagtggaaactaaaaatttcagcggggctgagcttgagggcctggtccgggctgctcaaagcacggctatgaatagacacattaaagcttccaccaaagtcgaggttgacatggagaaagccgagtcactgcaggtcacaagaggagactttttagccagtctcgagaatgacattaaaccggcatttggcacaaatcaggaggattatgccagctacattatgaatggaatcataaagtggggagatcctgtcaccagagttctcgatgacggcgaactgctagtccaacagaccaaaaatagtgaccggacccctctcgtgagcgttctgttggaaggcccaccgcacagcggcaaaacagctcttgccgctaaaatcgccgaagaatctaattttccatttatcaagatctgttctccagataaaatgatcggattttctgagaccgcaaaatgtcaggcgatgaaaaagatttttgacgacgcctataaatcccagctgtcctgtgtggtcgtagatgatatcgaacgcctcctcgattacgtgcctattggacccagattttccaatctcgtattacaggcactgctggtgctcttgaaaaaggctcccccacagggacggaagcttttgattattggaaccacctcccggaaagacgtgctgcaagagatggagatgcttaatgctttctcaacaaccatccacgtgccgaatatcgctacaggggaacaattacttgaggctctggagttgctgggcaacttcaaggacaaggagcgcacaactatcgcgcagcaggtgaaaggcaaaaaggtttggatcggaatcaagaagctgctcatgctgatcgagatgtccttacagatggatccagagtacagagtgaggaagtttctcgctctgctccgggaggaaggagcctag

SEQ ID NO: 220371 - DNA, 1452 bp, Artificial Sequence
  Description of Artificial Sequence: Synthetic coding sequence
atgcctgaggaagccggtttccccccagccaagaggtttagacccggatctgggccaccttctcgtgctgggagctttcccccaggacggcaagtggtcatgttactgacagctgggtccggcggacgcggtggtggcggtgggagaagacagcagccgccactggctcagccaagtgcctcgccctaccccgaagcagtggaactgcagaggagatctctccccatctttcaggcacggggacagctgctggcccagcttcgtaatctggacaatgcagtgctcatcggtagcccattttttaccggacaccccggtgtgccgcattgggccggaggggatagatctcacgagcaggacgtgccccgacactgcaaagcccctcccagacgactcccctgcgacgcgggtccatcttcagtaaggctcccagccctgtgtaccgccgctccatccctccccagaggacccaaggactctggcctggaggttctagccgtacagcgggtgtccaaaacccaggcttggcagcgaaccggaagagctgggagggaagatagcggaatttgctatcggctttacacagaggacgaattcgagaagtttgataagatgaccgtgcctgagattcaacgatgcaatctggcaagcgtcatgctgcagcttcttgccatgaaagtgcccaacgtgcttacctttgactttatgtctaagcccagtccagaccatatccaggccgctattgctcagctggatctgctgggggctctggaacataaggatgatcagctgaccctgaccccaatgggtcggaagatggcggcattcccccttgaaccaaagttcgcaaagacaatccttatgtcaccaaagttccactgtacagaggagattctcacgattgtatctttactgtctgtggacagtgtgttacataatcctcctagccgcagggaagaagtccaaggcgtgaggaagaagtttattagcagcgagggagatcacatgacccttctgaacatttatcgcacattcaaaaatctcggtggaaacaaggactggtgtaaggagaactttgtgaacagtaagaatatgaccctggtggctgaggtccgtgcgcagctgagagatatttgtctgaagatgagtatgccgatcgctagtagcaggggcgacgtggaatcagtgagaagatgcttggctcattctttgttcatgtctaccgctgagctgcagcctgatggaacttatgccaccaccgacacgcaccagcccgtagccatacacccctcgtctgtgctcttccactgcaagcccgcatgcgtagtatacactgagctgttgtataccaataaatgttatatgcgagatctgtgtgtaattgacgcacaatggctttatgaggctgctccagaatatttcaggcgcaagcttagaactgcccgtaactag

SEQ ID NO: 220372 - DNA, 2940 bp, Artificial Sequence
  Description of Artificial Sequence: Synthetic coding sequence
atgtcctatgactatcaccagaattggggacgggacggtgggcctcggtcttcaggtgggggatacggtgggggtccagccggaggtcacggcggtaatcgtggatcaggaggaggaggtggaggcggtgggggaggcagagggggacgtggaaggcacccgggacatctcaagggcagagagattggcatgtggtatgccaaaaagcagggtcagaagaacaaagaagctgagcgccaggagcgggctgtggtgcacatggacgaacgaagggaggagcagatagtgcaactgctgaattcggtgcaggccaagaatgacaaggagtccgaagcacaaatcagctggttcgcccctgaggatcacggttacggaacagaggtctctacgaaaaacaccccatgtagtgagaataagctagatatccaggaaaagaaactcattaatcaggagaaaaagatgtttaggatccggaacaggtcttatattgatcgcgattccgagtatttactgcaagagaacgaaccagatggaactctggatcaaaaacttctggaagacctgcagaaaaaaaagaacgacctacggtacatcgaaatgcagcattttcgagagaagttgccttcatacggaatgcaaaaagagctagtgaacctcatcgataaccatcaagtgacagttattagcggcgaaaccgggtgcggaaaaaccactcaggtaacccagtttatcttagataactatatcgaacgcggaaagggctccgcttgcaggatcgtctgcacacaaccacgacggatttcagctatctctgtggccgagcgagtggccgctgagcgcgctgagtcttgtggatctggaaactccactggttaccagatcagactgcagagccggctgcctcgcaagcaaggaagcattctctactgcaccaccgggattatcctccaatggctgcagtcggacccgtatttgtcgtcggtgtcacacatagtcttagatgagatccacgagcggaacctgcagagtgatgtcttgatgaccgttgtgaaagatctcctgaactttcggtcagacttgaaggtgatacttatgtcagctaccttgaatgctgaaaaattctcagaatatttcggaaactgtcccatgatccatatccctggttttacttttcccgtggtagaatacctgctggaggacgtaatcgaaaaaatcaggtacgtgcctgaacagaaggaacaccgcagccagtttaaacgcggattcatgcaagggcacgtgaacagacaggagaaagaggagaaggaggctatttacaaggaaaggtggccagactacgtacgagagttacggaggcgctacagcgccagcaccgttgatgtgatcgagatgatggaagacgacaaagtggatctaaacctgatcgtggcgctgataagatatatcgttctagaggaggaagacggggctatactagtgttcctaccaggttgggataatatttcaaccttgcacgacctactgatgagccaggtcatgtttaagagcgataaattcctgatcatcccactacacagtctgatgcccaccgtgaaccagacacaggttttcaaacggaccccccctggtgtgcgaaaaatcgtcatcgccacaaacattgctgagacttccatcaccatcgatgatgtagtatacgttattgatgggggtaaaatcaaggagactcactttgatacccagaataacattagtacgatgagtgccgagtgggtgtctaaagccaacgctaagcaaagaaagggacgcgctggacgagttcaaccaggccactgttaccatctctacaacgggctcagagcttcgctactagacgattatcagctaccagagattctcagaactcccttggaagaactgtgcctgcagatcaaaattctcaggctggggggtatagcttacttcctatcccggttaatggatccgcctagcaacgaggccgtgcttctgtccattcggcatttgatggagctgaacgctttggataagcaagaagagctgactcctctgggtgtgcacctcgctcgtcttccagtggaaccccacattggaaaaatgattctctttggggcactcttttgctgcttggaccccgtgctgactattgccgcaagcctctcgttcaaggacccgtttgttattccactggggtgggaagaggctcggagaaggggattccggtacgagaaagattactgctgggaatacttcctcagcagtaacaccctgcagatgttacataatatgaaggggcaattcgctgagcacttgctaggggcaggatttgtgagcagcaggaatcctaaggatcctgagtccaacattaacagcgataatgagaaaatcattaaagctgtgatctgcgcgggactgtaccccaaggttgccaagattcggttgaatttgggcaaaaagagaaagatggtgaaagtatataccaagacagacggacttgtcgcagtccacccgaagtccgtgaacgtcgagcagaccgactttcactacaattggctgatttaccatcttaaaatgcgcaccagctcaatctatctgtatgactgcactgaggtctccccatactgcctcctatttttcggaggagacattagtattcaaaaggacaacgatcaggagaccatagcagtcgatgaatggatcgtgttccagtccccagcacggattgcccatttggtcaaggagctgcgcaaggaactcgacatacttctccaagaaaagatagaatcgccacatcctgtggattggaacgacactaagagtcgggactgcgccgtgctgtcagcaattatagacttaataaaaacccaggaaaaagccacgccaagaaattttccacccagatttcaagatggttactactcttag

SEQ ID NO: 220373 - DNA, 2985 bp, Artificial Sequence
  Description of Artificial Sequence: Synthetic coding sequence
atgtcttatgactatcatcagaattggggtcgtgatggcggaccaagatcaagcggcggagggtatggaggaggcccagccggtggtcacgggggaaaccgcggaagcgggggtgggggaggcggtggtggtggaggtagaggcggaagggggagacaccctgggcacctgaagggacgggaaatcgggatgtggtatgccaagaaacagggccagaagaacaaggaagctgagcggcaggaacgggcagtagtccatatggatgaacgcagagaggaacagattgtgcagctgctgaatagtgtgcaagccaagaacgacaaagagagcgaggcccagatttcatggtttgcgcctgaagatcacggatatggtacagaagtatcaactaagaacactccgtgctccgagaataaactggatatccaggaaaaaaagctcattaaccaggagaagaaaatgtttcgaatcagaaatagaagctacatcgatcgcgatagtgagtacctacttcaagaaaacgaacccgacggaacactcgaccagaagctcctcgaggacctgcagaagaagaagaatgacttgcgatacatcgagatgcagcactttcgcgagaaactgcctagttacggcatgcaaaaggaactcgttaacctcattgacaaccaccaggtcaccgtgatttctggggaaactgggtgtggcaaaaccacacaggtcacgcagttcatcctcgataattacattgaaagggggaaaggatcagcctgccggatcgtttgcacccagccacggaggatttcagccataagtgtcgcagaacgtgtcgctgccgaaagagcagagagctgcggaagtggcaactctacgggttatcagattcgtctgcagtcccgactcccacgcaaacaagggtccattctgtactgcaccacgggtatcatcctgcagtggctgcaaagtgacccctacctgagttctgtgagccacatcgtactagatgaaatccacgaaaggaatctccagtctgatgtcctgatgactgtcgtaaaggatcttcttaacttccggtcagacctaaaggtgatcctgatgtctgcaaccttgaacgccgaaaagttctctgagtatttcggtaattgtccaatgatccacatcccaggcttcaccttcccagttgtggaatatctgcttgaagacgtcattgagaagattcgttacgtacccgagcaaaaagagcataggagccagtttaagcgagggtttatgcagggccacgtaaaccgccaggagaaagaagagaaagaggccatttacaaggaaagatggccagactacgtgagggagctgagacgccgatacagcgcatcgaccgtcgacgttattgaaatgatggaggacgataaggtagaccttaacctaatcgtcgcacttattcggtacattgtgttggaggaagaggacggcgcaatcctggtgtttctccctggctgggacaacatatcaacattgcacgacctgctgatgagccaagtgatgtttaagagcgttaaccagacacaggtcttcaaacgaactcccccaggcgtgcggaagatagtaattgcaacaaacattgctgaaaccagcataactatcgatgatgtggtctacgttatagacgggggaaaaatcaaggagactcactttgacacacagaataatatcagcaccatgtctgccgagtgggtatcaaaagctaacgccaagcagaggaaaggtcgggctggtcgcgtacagcctggccactgttaccacctgtacaacggtcttcgagccagcctgctcgacgattatcagctgccagagattcttaggaccccccttgaggagttgtgcttgcagattaaaatcctccgcttaggcggaattgcgtattttctgtcccggcttatggatcctcccagcaacgaagccgtgttgctgagtattcgtcatctgatggagcttaatgccctcgacaaacaggaggagctcaccccactgggagtgcatctcgctcggctgccagttgaaccacatatcggaaagatgatattgttcggcgcactgttttgctgtctggacccagtcctgactatcgctgcaagtctgagcttcaaagatccctttgtgatccctctgggaaaggaaaagatagccgatgcccgaagaaaagaattggccaaagatactagaagcgatcatctgaccgtcgtcaatgcgttcgaaggatgggaagaagccagacgaagggggttcagatacgaaaaggactactgttgggagtactttctgagttccaatacactccagatgctgcacaacatgaaaggacaattcgccgagcacctgcttggcgctggcttcgtctcttcgaggaacccaaaagatcctgaaagcaacataaatagtgataacgagaaaattataaaggccgtcatctgcgctggtttgtatcctaaggtcgctaagatccgactgaacttaggcaaaaaacgcaagatggtgaaagtgtacaccaagacggatggcctggtagctgttcatccaaaatcggtaaacgtggagcaaacagacttccactacaattggctcatttatcacctaaagatgagaaccagctctatttatctgtatgattgcaccgaggtgagtccttactgcctcctcttcttcgggggagatatatcgatccaaaaagacaatgaccaggagacaattgccgtggatgaatggatagttttccagtcccccgcacgaattgcccacttggtgaaagagcttcggaaggagttggacatcctcctacaggagaaaatcgagtcaccccaccccgttgactggaatgatacaaaatcgcgggactgtgctgtgctatccgccatcatcgacctcattaaaacccaggagaaggccacccctcgaaattttccccctcggttccaggacggatattatagttag

SEQ ID NO: 220374 - DNA, 3027 bp, Artificial Sequence
  Description of Artificial Sequence: Synthetic coding sequence
atgagctatgattatcaccagaactgggggagggatggaggtccaaggtcatccgggggtggatacggagggggtccggcaggcggtcacggcggtaaccgtgggtccggcggaggaggaggcggaggagggggaggccgaggagggaggggcagacatccagggcatttaaagggtagagaaatcgggatgtggtacgccaagaaacaggggcagaaaaataaagaggcagaaaggcaggaacgagccgttgtgcatatggacgaaaggagggaggagcaaattgtacaactccttaattcagtgcaggccaaaaacgataaggagtccgaggcgcaaatttcctggtttgcaccagaagaccacggatacggaactgaagtgagcacaaagaacacaccctgttccgagaacaaactggatattcaggaaaaaaagctcattaaccaagagaagaaaatgttcagaattagaaacagaagctacatcgatcgcgattccgagtacctgctacaagagaacgaaccagatggcacactggaccagaaactgctggaggacctccagaagaaaaagaatgacctgcgctatatcgagatgcagcactttagggagaagctcccctcctacggaatgcagaaagaacttgtcaatcttatcgataaccaccaggtcacagtcatttcgggggagaccggctgcggcaaaactacacaggtaactcaattcatcctggataactacattgagagaggtaaaggcagcgcatgcaggatagtgtgtacccagcccagacgcatttctgctataagcgtggccgagcgagtggccgcagagagagctgagagctgtggatcaggcaattctaccggttaccagattaggcttcagtcaaggctccctcgaaaacagggctctatactgtactgcacaaccggcatcatcctgcagtggctgcagtctgatccatacctgtcctcagtgagccacatcgtcctggatgagatccacgagcggaacttgcaatccgacgtcctgatgaccgtggttaaagaccttcttaatttccggtctgatctgaaggtgatactgatgtcagcaacgctcaatgcagagaagttttcagagtacttcggcaattgcccaatgattcacattccgggattcacctttcccgtcgtggagtacctattggaggatgtcatcgagaaaattaggtacgttccagagcagaaggagcatagaagccaattcaagcggggatttatgcagggtcacgtaaatcgacaggagaaagaggaaaaggaagctatttataaagaaagatggcccgattacgtgcgggaactccggagaaggtattccgcaagcacggtggacgtcattgaaatgatggaagacgataaggtggatttaaacctaatcgtcgctctgattcggtacatagtgctggaggaagaagacggagcgatccttgtgtttctccccggatgggacaatatcagtacactgcatgacctgctgatgagccaagttatgtttaagtcggataagttccttattatcccattgcactctctcatgccgacagtcaaccagactcaagttttcaagcgtacccccccaggggttagaaagattgtaatcgctactaacattgcagaaacctctatcaccattgatgatgtagtctatgtgatcgacggaggcaagatcaaggaaactcattttgatacccagaataacatctcaactatgtccgcggaatgggtttccaaagctaacgctaagcagcgtaagggtcgcgctggcagagtgcagccaggtcattgttatcacctctataacggcttaagggcctccctgctggacgactaccagctccctgaaattttgcgaacacccctagaggaattgtgtcttcagatcaagatccttcgcctcgggggaatcgcttactttctgagccgccttatggaccctccctccaacgaagctgtgctgctgtcgattcggcacctgatggagctgaacgcattggataaacaggaagaattgaccccactcggcgtgcacctggcccgtctcccagtcgaacctcacattggcaagatgatactgtttggggcacttttctgctgcctagaccctgttttaacaattgctgcctcactttcgtttaaggacccatttgttattccacttgggaaagagaaaattgccgacgctaggagaaaggagctggctaaagacaccagaagtgaccatttgacagtggtgaatgccttcgaaggctgggaggaggccagacggagagggttcaggtatgaaaaggactattgttgggagtacttcctgagttcaaacaccctgcaaatgctgcacaatatgaaggggcagttcgccgaacacttgttgggagcgggtttcgtatctagccgtaatcccaaagacccggaaagcaacatcaattctgacaatgaaaaaatcattaaagctgtcatttgcgcaggcctttaccccaaagtggctaagatcagacttaatttgggcaaaaaacgtaagatggtgaaagtgtatacaaaaacggacggtcttgtcgccgttcaccccaaaagcgtcaatgtggagcagacagatttccattataactggctgatatatcatttgaagatgcggacatcctccatctatctgtacgactgcaccgaggtgagtccatactgtctgcttttttttggcggtgatatttccattcagaaggataatgatcaggagacaatagctgtggacgaatggatcgtgtttcaaagtccagccaggattgcccaccttgtgaaggagctcaggaaggagttggacattctacttcaggaaaagatcgagtctccacatcctgtagactggaatgatacaaaatccagggattgcgccgttctgagtgctataatagacctcattaagacgcaggaaaaagccactcctcggaactttccccctagattccaagatgggtactatagttag

SEQ ID NO: 220375 - DNA, 2985 bp, Artificial Sequence
  Description of Artificial Sequence: Synthetic coding sequence
atgagttatgactaccaccaaaattggggacgggacggcggtccaaggtcaagtgggggtgggtacgggggtggtccagccggaggtcacggagggaatcgtggatccggaggcggtgggggaggcggtggtggcggaagaggtgggagaggcaggcatccagggcatctcaagggcagggagatcggaatgtggtatgccaaaaagcagggccagaaaaacaaggaggctgaaagacaggagagagccgttgtgcacatggatgaacggagggaggaacaaatcgtgcagctgcttaactctgtccaggccaagaatgacaaggagtcggaggctcaaatttcatggtttgcacccgaagaccatggctacggcactgaggtttccactaagaacacaccatgtagcgagaataagctggacattcaagagaagaagctcatcaaccaagagaaaaagatgttccgaatacggaatagatcctacattgatcgggacagtgagtacctccttcaggagaacgaacccgacgggactctcgaccaaaaactgttggaagaccttcagaaaaagaaaaacgacctgagatacatcgaaatgcagcattttcgagagaagctcccctcctatgggatgcaaaaggaactggtcaatctcatcgacaatcatcaagttactgtcatcagcggcgaaaccgggtgcgggaaaactactcaggtgacccagtttattctcgacaattacatagagcgcggtaaaggctccgcctgccgcattgtgtgtacacagccgagacgaatcagcgccatttctgtcgcggaacgggtggctgctgaaagggctgagagttgtggatccggaaactccactggctatcagatccgcctgcaaagcaggctgccacgcaaacagggttccatactgtactgcactactggtattattctgcagtggctgcagagtgatccatatctatcatcagtgagccatattgtgctggatgagatccacgagagaaatcttcagtctgatgtgcttatgacagtggtgaaggacctcttgaacttcagaagcgatttgaaggtaatccttatgagcgcaactctcaacgccgaaaagttttctgagtatttcggcaactgtcccatgatacatatcccagggtttacctttcctgttgtcgaatacttgctcgaggacgtcatcgagaagatcagatatgtgccagagcaaaaggagcacaggtctcagttcaagagagggtttatgcaaggacatgtcaacagacaggaaaaggaagaaaaggaggccatctacaaagagagatggccagattatgtgcgcgagcttcgcaggcggtactccgcaagtacagtggatgttattgagatgatggaggacgacaaagtggatctcaacctgattgtggctcttatcagatacatcgtgctggaggaggaggatggggctattttagttttcctcccaggctgggacaacatatcgacactccacgacctcttaatgtcccaggtcatgtttaagagcggaaccatgagtcaggtgttcaaaagaactccgcctggcgtgaggaagatcgtgattgcgacaaacattgccgaaacgtccatcacaatcgacgacgtagtttatgtaatcgatggcggaaaaattaaggagactcatttcgacacacagaataatatctccactatgtccgcggaatgggtgagtaaagcaaatgctaagcagagaaaaggtagggcagggagggtgcagccagggcactgctatcacctctacaatggactgcgcgcttcactgcttgatgactatcagcttcctgaaatccttaggacccccttggaagagctctgcctgcagatcaaaatcctacggttggggggaatcgcttacttcctctcccgtctcatggatccgccttcgaatgaggccgttctcctctcaattcgacacctcatggagctgaacgccctggacaaacaagaagaactcactcctctgggcgttcatctggccaggctgccagtggagccccacataggcaagatgattcttttcggtgccctgttttgttgcttggatcccgtgttgacaatcgccgctagtctcagcttcaaggaccccttcgtgattccacttgggaaggaaaagatcgccgacgccaggagaaaggaactggccaaagatactagatctgaccacctcactgttgtgaacgcctttgagggctgggaggaagccaggagacggggttttaggtacgaaaaagattactgctgggagtactttctgtccagtaacacactgcagatgctgcataacatgaagggtcagtttgctgagcacctgctcggagcgggatttgtgagctctcgcaatcccaaggatccagagtcgaacattaacagtgacaacgaaaagatcatcaaagccgttatatgtgccggactctatcctaaggtcgctaaaatcaggctgaacttagggaagaaacgaaagatggtgaaagtgtataccaaaacagacggcctggtggccgtccaccccaagtccgtcaatgttgagcagaccgatttccattacaactggctgatctatcaccttaaaatgagaacttcaagcatttatctttacgattgcactgaggtctccccatactgcttgcttttctttgggggagacatctccatacaaaaagataacgaccaagagacaatagcagttgatgaatggatcgtcttccaatcacctgcaaggattgcccaccttgtgaaggagctcaggaaagagttagacattctgttacaggaaaaaatagaatctcctcatccagtcgactggaatgacaccaagagcagggactgcgctgttctgtctgcaatcattgatctgatcaaaactcaggagaaagccacaccacgaaacttcccaccgcgattccaggacgggtattacagctag

SEQ ID NO: 220376 - DNA, 3684 bp, Artificial Sequence
  Description of Artificial Sequence: Synthetic coding sequence
atgggggataccagtgaagacgcctcgattcaccgcctggaagggacagacctcgactgccaggtcggtggactaatctgtaagagtaagtcggcagcatcagagcaacacgtgttcaaggcacccgcacctcgcccatccctgctcggccttgacctgctggcctctcttaagagacgtgagagggaggaaaaggacgatggagaagataagaagaagtctaaggtctccagctacaaagattgggaggagagcaaggacgatcagaaggacgctgaggaagagggcggagaccaggccggacagaatataaggaaagatcgtcactatcgctctgcacgggtcgagacgccctctcaccctggcggagtttcagaggaattctgggagaggtcccggcagagggagagagaacggagggagcacggtgtgtacgcaagctccaaggaggaaaaagactggaagaaggagaagtctagagatcgcgattatgatagaaagcgtgacagggacgagcgtgatcggagtagacattcgagcaggagcgaacgcgacggcggaagcgagcgctcatcccgaagaaacgaacctgagtctccacgacataggcccaaagatgctgctaccccgagcagatcaacttgggaggaagaggattcgggttatggtagtagccggagatctcagtgggaaagcccgagtccaaccccaagttatagggattcagagagaagtcatagattgagcacacgcgatcgagatagatcggtaagggggaagtatagcgatgacaccccgctacccaccccatcttataagtacaacgaatgggcggacgaccggcgacatttgggctcaacgcctcgcctctcgcgaggacggggtcggagggaagagggggaggaaggcatctcgtttgacaccgaagaagaacgacagcagtgggaagatgaccagaggcaggccgaccgcgactggtatatgatggatgaggggtatgacgagtttcacaacccattggcgtattcgtcggaggattacgtccggaggcgggaacagcacctgcacaagcagaagcagaaaagaatctctgcacagaggcggcaaattaacgaggataatgagaggtgggaaaccaatagaatgctcaccagtggtgtggttcatcgtcttgaggtcgacgaggattttgaggaagataacgcagccaaagtgcacctcatggtgcacaacctggtgcctccattccttgatggccgtatcgttttcaccaagcaaccagagcccgtcattcccgtgaaggatgccaccagcgatttggccatcatagcccgtaagggcagtcagaccgtaagaaagcacagagagcagaaagagcgcaagaaagcccagcataagcattgggagctggctggcaccaagctgggtgatatcatgggagtgaaaaaagaggaagaaccggataaagccgtcaccgaggatggaaaggtcgactatcgaactgaacaaaaatttgccgaccacatgaagaggaagagcgaagccagctctgagtttgccaaaaagaaaagcatactggagcagaggcaatatctcccaatctttgctgtgcagcaggaattgctgactatcatccgcgacaactccatcgtgatcgtcgtaggagaaacaggttccggcaaaactacccagctgacccagtatttacatgaagacggatacaccgattacgggatgattgggtgtactcagccacgtagagttgcagccatgtcagtggccaagcgcgtgtccgaagagatgggcggaaacctgggggaagaagtgggctatgcaattcggtttgaagattgtacctccgagaataccctgatcaaatacatgactgatggcattctgctccgtgaatcgctccgggaggcggacctggaccattattcagcaattattatggatgaggcacatgagaggagcctgaacaccgacgtcctgttcggactgctaagggaagttgtggctagaaggagcgacctgaaactaatcgtaacaagcgctactatggacgctgagaagtttgccgctttctttggaaacgtgccgattttccacatccccggtaggacattccccgtggacattctgttctccaagacgccacaggaagattatgtggaggccgcagttaagcaaagtcttcaggttcacctctctggcgctcccggagacatcttaatttttatgccaggacaagaggatatcgaggttactagcgatcaaatcgtggagcacttggaggaactggaaaatgcccctgcactggctgttttgccaatctatagtcaactgcccagtgacctgcaagccaagattttccaaaaagctcctgacggggtcaggaagtgcatcgtcgcaacgaatattgccgagacaagcctgactgtggacggcattatgtttgtcatcgactcaggttactgtaaactcaaagtttttaaccctaggatcgggatggatgcactgcagatttatcctattagtcaggcaaacgccaaccagcgcagcggacgagctggcagaacgggccctggccaatgtttccggctgtatacccagagcgcctacaagaacgaattactgacaaccacagtccctgaaatccagcgtaccaacttagctaatgtggtgctcctgttgaagtctcttggtgtgcaggatcttctgcagttccactttatggatccccctccagaagacaacatgcttaattccatgtaccagctctggatactcggggcactggacaataccggtggactcacctccacgggtaggctcatggttgaattccctctcgaccctgctttgtccaaaatgctgattgtcagttgcgatatgggatgtagtagcgaaattctcctgattgtgtccatgctctctgtgccggcaattttctacaggcccaagggtcgcgaggaggagtctgaccaaattagagaaaaattcgccgtgccggagtccgaccacctgacttacctcaatgtgtacctgcaatggaaaaacaacaattactccacaatttggtgcaatgaccattttatccatgctaaagccatgagaaaggtgagggaggtgcgagcacagttgaaggacattatggtccagcagaggatgtcattagcaagctgcggcacagattgggacatcgtccgcaaatgtatttgcgcagcctatttccaccaggctgcaaaacttaagggcataggggaatatgtgaacattaggaccggcatgccctgccatctccatcctacaagctccttatttggcatgggatatactccagattatatcgtttatcatgaactggtgatgacgaccaaagaatacatgcagtgtgtgaccgccgttgatggggaatggctcgcagaactcgggcctatgttctatagtgtcaaacaagcagggaagtcccgccaggagaacagacggagagcaaaggaggaggcaagcgccatggaagaagaaatggcccttgccgaggagcagctccgggcacgccgacaggagcaggagaaacgatccccattaggcagcgtgcggtccactaagatctataccccaggccgtaaggaacagggcgaaccgatgacccccaggcgcacgcctgctagattcggcctctag

SEQ ID NO: 220377 - DNA, 1620 bp, Artificial Sequence
  Description of Artificial Sequence: Synthetic coding sequence
atgggcgacaccagcgaagacgccagtattcaccgactagagggtaccgacctcgattgccaagtcgggggtctgatctgcaagtctaaaagcgcagccagtgaacaacacgtcttcaaagctccggctcccaggccatccctgttgggactcgacctgttagcctcccttaaacggagggaacgagaagagaaggatgatggcgaggacaaaaagaagagtaaggtatcatcttataaggactgggaagagagcaaggacgaccagaaggacgccgaggaggaggggggtgaccaagccaagatctttcagaaggctcctgacggggtgcgaaaatgcattgtggcaacgaacattgctgaaacgtctttaacagtggacggaatcatgttcgtgatagactcagggtactgcaagctgaaagttttcaatcctagaattggaatggacgctctgcagatctaccctatatcacaggcaaacgctaaccagagatcaggacgggcaggtagaacaggcccaggccaatgcttccgactttacacacagagcgcctacaaaaacgaactgctcaccactacagttcccgagatccagcggaccaacttggctaacgttgtgctccttcttaaaagtttaggagttcaggatcttttacaattccatttcatggacccaccccctgaagataatatgctaaactctatgtaccagctatggatcctgggcgctcttgacaacacgggcggactgaccagcactggtcgtttgatggtggagttccccctggatccggcactttcaaaaatgctgatcgtgtcttgtgacatgggctgctcgtcggagatcctcctgatcgtttctatgctcagcgtgccagccattttttaccgcccaaaaggacgcgaggaagaaagcgaccagattagagagaagttcgcggtaccagagagcgaccacctgacctatctgaatgtgtatcttcagtggaagaacaataattactctacaatctggtgcaatgaccattttatccatgccaaggctatgcggaaagttagggaagtccgtgcccagctcaaggacatcatggtgcaacaacggatgagcctagcctcatgcggcacagactgggacattgttcgaaagtgcatatgtgcggcttatttccatcaggccgcaaaactgaagggaattggggagtatgttaatatcagaacaggcatgccttgtcacctgcaccccaccagttcgttgtttggcatgggctacacacccgactatattgtgtaccacgagctcgtcatgacgactaaagagtacatgcagtgcgtgacggccgttgatggggaatggctcgccgagcttggcccaatgttctattccgtaaagcaggccggaaaatccagacaggaaaaccggaggcgggcaaaggaggaggcaagcgccatggaggaggaaatggccctggcagaggagcagctgcgtgccaggaggcaggagcaagagaaaaggtcaccactgggatctgttcgctccacaaagatctatactccaggacgcaaagaacagggagaaccaatgaccccacggaggacccccgctagattcggcttatag

SEQ ID NO: 220378 - DNA, 2340 bp, Artificial Sequence
  Description of Artificial Sequence: Synthetic coding sequence
atgagcagattccctgctgtcgctgggcgtgccccacgcaggcaagaagaaggcgaaagaagcagagacctgcaggaggaaagattgtcggccgtctgcatcgcggatcgggaggaaaaggggtgcacctcacaagaagggggtactaccccgactttccctatccagaagcaaaggaagaagatcatacaggccgtgagggacaattcttttctgattgttacagggaacactggatccggtaaaaccacccagctgcccaaatacctgtatgaggctggattttcccagcatggaatgattggcgtcactcagcctagaaaggttgcagcaattagcgtcgcccagagggttgcagaggaaatgaagtgcacactgggttccaaggtggggtatcaagtcagatttgatgattgttctagtaaagaaaccgcgattaaatacatgacggatggatgcctgctgaagcatatcctgggcgatccaaacctgaccaagtttagcgtgatcatactagatgaggcacacgagaggaccctcaccacagatattttattcgggctgttaaagaaattgtttcaagagaaatcacctaacagaaaagagcacctgaaggtcgtcgttatgagcgctaccatggagctcgccaagctctccgcgttctttggcaactgtccaatcttcgatattccgggtcggttatatcccgtgagagaaaaattctgcaacctgatcgggccaagggatagggagaataccgcgtacatccaggcaatagtaaaagtaactatggacattcatctgaacgaaatggccggtgatattcttgtgttcctgaccggtcaatttgaaattgagaagagttgtgagctcctattccagatggccgaaagtgtggactacgactacgacgtgcaggacacaaccctcgacggcctgctaatcttaccctgctatggcagcatgaccactgatcagcaaagacgcatctttctgccacctcccccaggtattcgcaagtgtgtcatttccactaatatcagcgctacgtccctgactatcgatgggattaggtatgtggtcgacggaggatttgtcaagcagctgaatcataatccgaggctgggactagacattcttgaagtcgtgcccatcagtaaatcagaagccctgcagcgatctggtcgcgcaggcagaacttcatcaggcaagtgctttcgcatttatagtaaagatttctggaatcaatgtatgccagaccatgttattcccgagatcaagcgaacctctttgacaagcgtcgtgctgacattaaagtgccttgcaatacacgatgtgatccgctttccgtacctcgacccccctaacgaacggctgattctcgaggctttgaaacagctgtatcagtgcgatgccattgaccggagtgggcacgtgactcgcttagggttgtcaatggtcgagttccctctcccccctcaccttacatgcgctgttataaaggccgcatcccttgactgcgaggacctccttctgcctattgctgccatgcttagcgtcgaaaatgtgtttattcggcctgtggacccagagtaccagaaagaggcagagcaacggcaccgggaactcgccgcaaaggccggtggtttcaacgactttgccacgctcgctgtgattttcgagcagtgtaagtcttccggggctccagcctcttggtgccaaaagcattggatccactggagatgcctcttctcggccttccgcgtcgaagcccagctgagggaattgatcagaaagctgaagcagcagtcggatttcccaaaggaaacctttgaaggcccaaaacacgaggtgctaaggaggtgtctatgcgccggatacttcaagaatgtggcacggagatcagtgggaaggacattctgcaccatggatggccgtggttcccccgtgcatatacatccctcatccgccctccatgaacaggagactaagctcgagtggattatttttcatgaggttctcgtgacaacgaaggtgtatgccaggatcgtttgtcctattcggtacgagtgggtgcgggatcttcttcccaaactgcatgaattcaacgctcatgacctgtcttcagtggcacggagggaagttagagaagacgcgcgacgccgttggaccaacaaagaaaacgttaagcaattgaaagacggcatctccaaagacgtgctgaagaaaatgcagagaagaaacgatgacaagtcaatcagtgacgcgagggcgcgttttcttgagcgtaaacagcagcgaactcaggatcatagtgacaccagaaaagaaaccggatag

SEQ ID NO: 220379 - DNA, 2169 bp, Artificial Sequence
  Description of Artificial Sequence: Synthetic coding sequence
atgtccagatttccagcagttgcaggcagggccccacgccgtcaggaagaaggggaaaggtcacgtgacctccaggaagagaggctgtccgcagtctgcatcgccgatcgagaagaaaagggatgcacctcccaggagggaggcacaacccccactttcccaatccagaagcagcgaaaaaagattatacaggccgtacgggataactcttttctgattgtcaccggcaataccggttccggaaaaaccacgcaactgcctaaatatttgtacgaggctggattttcacaacacgggatgatcggcgtcactcaaccaaggaaggtcgctgcaatctcagtagcccagagggttgccgaggagatgaagtgcaccctcggatctaaagtaggctatcaggtgcgctttgatgactgctcttcgaaggaaaccgcaatcaaatatatgacagacgggtgtctgctcaagcatatcctgggcgatcctaaccttacaaagttcagtgtgatcatcctggacgaggcccatgaaaggacactgacaacagacatcctatttggcttgcttaagaaattgttccaggaaaaatcaccaaatcggaaagagcacctgaaagtggtggtaatgagcgcaacgatggaacttgccaagctgtcggctttcttcggcaattgtcccattttcgatattcccggacgcctttacccagtgcgggagaagttttgcaatctgatcggtccccgagatagagaaaatacagcgtacatccaggccatcgtgaaagtcacaatggacattcacctgaatgagatggcaggcgacatcctggtgttcctcactggccagttcgaaatcgagaaatcatgtgaactgcttttccagatggccgagtccgtcgattacgattatgacgtccaggatactacgctcgacgggctccttattctgccgtgttacggatccatgactacagatcagcagcgtaggatctttctgccgccaccaccgggtattagaaaatgtgtaataagtaccaacatctcggccaccagcctgacgatagatggaattcgatacgtggtcgatggagggtttgttaaacagcttaaccacaaccctcgattagggctggacatccttgaggtggtaccaatatcaaaaagtgaagccctccagcgttcaggtagagctggtaggacatccagcggaaaatgtttccgaatatattctaaggacttctggaaccagtgcatgcccgaccatgtgatccccgagatcaagagaacctcgctcacatcagtggttctgaccctgaaatgcctggccattcatgacgtgatacggtttccctatctggatccccctaatgagaggcttattcttgaagcgctgaagcaactctatcaatgcgacgctatcgatcggtccggccacgtgaccaggctgggcctgagcatggtagagttccctctgcctccccacttaacatgtgcggtgatcaaggctgcctcccttgattgtgaggatctgttgctcccgatagcagccatgctaagcgttgagaatgtgttcattcgacccgtcgacccggaataccagaaggaggctgagcagcggcaccgcgagttggccgctaaagcgggaggctttaatgattttgcgacactcgcggtgatcttcgaacaatgcaagagtagcggcgcacccgcttcctggtgtcagaaacactggatacattggagatgcctgttttcagcgttccgcgtggaggctcagctgagagagttgattagaaaacttaaacaacagtccgatttccccaaagaaaccttcgagggacccaagcacgaagtccttaggcgctgtctgtgcgctggatacttcaagaatgtggccagacggtctgtggggagaactttttgtacaatggacggcagaggatcccctgtgcatatccatccaagctcggccctccacgaacaggaaaccaaactcgagtggatcatatttcatgaggtcctggttaccaccaaagtctatgccagaatagtttgcccaatcaggtacgaatgggttcgcgacctgctccccaagttacatgagtttaatgcccatgatctatcttccgttgcacggagggaggtgagcaagataaagctcttccagtag

SEQ ID NO: 220380 - DNA, 2196 bp, Artificial Sequence
  Description of Artificial Sequence: Synthetic coding sequence
atgatcggagtgacccagcctcgaaaggttgcagccatcagtgttgctcagcgtgttgcggaagaaatgaagtgcacactgggttccaaggtgggctaccaggtgcgcttcgacgattgtagcagcaaagagacggccatcaagtacatgactgacggatgtctgctgaagcacatcctgggggatccaaacctgactaagttctccgtgattatcctcgacgaggctcacgagagaactttaacaactgacatcctctttggactcctgaaaaagctgttccaggaaaaatcacctaatagaaaggaacatctgaaagtggtcgtcatgtccgcaactatggaactggccaagctttctgcttttttcgggaactgtcccatattcgacatccccggacggctttacccagttagagaaaagttctgcaatcttattgggcctagagatagagagaatactgcttacatacaggccatcgtgaaggtgactatggatatccacctgaacgagatggctggcgacatcttagtatttcttaccggccaattcgagatcgagaaatcttgcgagttgctgtttcaaatggccgagtcagtggattatgattacgacgtgcaggacacaaccctggacggtttactgatactgccatgttacgggtctatgactacagtgtcccagacctctctgacttttgtgacgcatatccagatcatgaagcagatttcggagaaccagcactcactgaccggcctcactatagcaggaatcaccggggtgagtcaccacgccagacccagaaacatgacttgcaatgaaaagctaaaccagcagcgcaggattttccttcctccccctccaggaatacgcaagtgtgtaatctccactaacatctccgccacatccttgaccattgatggcataagatatgtggtggacgggggattcgtaaagcagttaaatcataatcctcggctggggctggacatcctggaggtcgtccccatttccaagtcagaagccctgcaacgctctggtagagccggtcggacttcaagtggaaaatgttttagaatctactcaaaggatttctggaatcaatgcatgcctgaccacgtcatccccgagattaagcgcacttcactcacttcagtggtgttgaccctgaaatgcctagctattcatgacgtaattcgcttcccctatctggacccaccaaacgagcgcctcattctggaagccttgaagcagctgtaccagtgcgacgcaattgaccgcagcggccatgttacacgcctcggactatccatggtggagtttcctctgcctccacatctcacttgcgccgtcatcaaagctgcctccttagattgcgaagatctgttgttgccaattgccgctatgctgagtgtggagaacgtgttcataaggcccgtcgaccctgaataccaaaaagaagcagaacagaggcatagggagcttgcagctaaggctggcggtttcaacgacttcgccactcttgctgtgatttttgagcaatgcaaaagctccggtgcccctgcctcttggtgtcaaaaacactggattcactggcgttgtctgttttctgcttttagggtggaagctcaattgagggagctcataaggaagttgaagcagcagtcagatttccctaaggagacctttgagggacctaagcacgaggtgctgcgcagatgcttatgtgctggttattttaagaacgttgctcggagatccgtgggcaggaccttttgcactatggacggtcgaggttcacccgtgcacatccacccatcatccgcattacacgaacaggaaaccaaattggagtggattatcttccatgaagtactggttaccacaaaagtatatgcacggattgtatgccccattagatatgagtgggtgcgcgacctgctacccaaattacacgagtttaatgctcatgacttgagttcagtggcacgccgtgaggttagagaggatgctaggagacgttggactaataaagaaaacgtcaaacaactgaaagatgggattagcaaagatgtgttgaagaagatgcagcggagaaacgacgataaatccatcagcgatgcacgtgcaaggtttctggagcgcaagcagcagcgcacacaggatcattccgatacgaggaaagagacgggatag

SEQ ID NO: 220381 - DNA, 2109 bp, Artificial Sequence
  Description of Artificial Sequence: Synthetic coding sequence
atgtctagatttccggctgtggcaggccgagcccctcgtcgacaggaagagggtgaaagatccagagatctgcaagaggagagactgagtgccgtgtgcatcgcagacagggaggagaaaggttgcacctcccaggaaggtggcactaccccaacattccccatccagaaacaacggaagaagattattcaggccgagactgctatcaagtacatgaccgatggctgcttactaaagcatatcctaggggatccgaacctgacaaaattcagcgtgatcattttggacgaagctcatgagaggactcttactactgacattttgttcgggctgctgaaaaagctctttcaagagaagtcaccgaatcgtaaggaacacttaaaggttgtggtgatgtccgcaactatggaactcgccaagctctccgctttctttggcaactgtcctatttttgacatccccggaaggctgtaccccgtgcgtgaaaagttctgcaaccttattgggcctcgggatagggaaaataccgcctacatccaggccatcgttaaagtcacaatggatatccacctaaacgagatggcaggggatatcctcgtcttccttacaggacagttcgagatcgagaaaagctgtgagttactatttcagatggccgaatctgtagactatgattatgacgtgcaggacaccacgctggatggactcttaattcttccctgctatggcagtatgacaaccgaccagcagcggagaattttcctgcccccacctccgggtatccggaagtgcgttatcagcaccaatatctccgctacaagcttgactatcgatggaattcgttacgtcgtggacggcggttttgtcaagcagctgaaccataacccacgcctaggtctggacatcctggaagtcgtgcctatttccaagagcgaagccctgcagcgatctggaagggcaggcagaacttcaagcgggaagtgcttccgaatctactccaaggacttttggaaccaatgcatgcccgatcacgttatcccagagattaagcgcacttccttgacttccgtggtgctaacgttgaaatgtctcgccatccacgacgtgatccgctttccataccttgaccccccaaatgagaggttaattctggaggctctgaagcagctgtatcagtgtgacgctattgatcgtagtggtcacgtcactcggctgggcctgtccatggtagagttcccattgccaccgcacctcacctgtgcagttattaaagccgcatcacttgactgcgaagacctgctgctgcctatagcggctatgctcagcgtcgagaatgtttttattcggccagtagacccggaataccaaaaggaggccgagcagcggcaccgagaactagccgcaaaggccggaggattcaatgatttcgcgaccctggcggtaattttcgaacaatgtaagtcttctggggcaccagcatcatggtgtcagaaacattggatccattggcgctgcctcttctcagcgtttagggtggaagctcagctccgcgagctcatcagaaaactcaagcaacagagcgacttccccaaagaaacttttgaggggcctaagcacgaggtactgcgccgatgcttatgcgcaggatacttcaaaaacgtggccagacggtcagtgggcagaacattttgcaccatggatggtaggggcagtcccgtccacattcacccctcatcagccctgcatgaacaggaaacgaagttggaatggatcatcttccatgaggtcctcgtcactaccaaggtgtatgctcgcattgtttgccccattagatatgaatgggtgagagatctcctgcctaaactgcatgagtttaacgcccacgacttgtcttctgtggcacgcagggaagtgcgagaagatgccaggaggcgatggacaaataaagaaaacgttaaacagttgaaagatggtatttcaaaagatgtacttaaaaagatgcagaggagaaacgatgataagtcaatttcagacgccagagcgaggttcctggagcggaaacagcagcggactcaggaccacagtgataccaggaaagaaaccggatag

SEQ ID NO: 220382 - DNA, 3663 bp, Artificial Sequence
  Description of Artificial Sequence: Synthetic coding sequence
atggccgtggctgtcgcaatggccggtgccctgattggctctgagcccggacctgcagaggagctcgccaagctcgagtatctctcactggtgtccaaggtttgtactgagctggacaaccacctaggaatcaacgataaggatctcgctgaatttgtgatttctctcgctgagaagaacacgaccttcgacaccttcaaggcttccctggtgaagaacggagcagagtttaccgattcccttattagtaacctccttcgtcttatccagacaatgcggccaccggcaaaacctagtaccagcaaggaccctgtggtgaaacctaagactgaaaaagagaagttgaaagagctgttcccagtgctctgtcaacctgacaaccctagcgttcgcaccatgcttgatgaggacgacgtcaaagtcgctgtcgacgtgttgaaagaactggaggccttgatgccctcagcagctggccaggaaaaacagagggacgctgagcatcgcgatagaacaaaaaagaagaaacgatcccgttctagggaccggaaccgtgatcgggatcgcgatcgcgaaagaaacagagaccgcgatcacaaacggagacatcgatcaagaagtaggtctcgctcgagaactagggagcggaacaaggtaaagagtcgctaccgttcgcgaagccgcagccagagccccccaaaagaccgtaaggacagggataaatacggagaaagaaatctggataggtggagagataagcacgtagatcgaccacctcctgaagaacctacaattggggatatctacaacggcaaggtgacatccattatgcagtttgggtgttttgtgcaattggaagggctacggaagcgatgggaaggactggtgcatatttccgagctccgcagagaagggcgagtggctaatgtggctgatgtggttagtaagggccagcgggtaaaggttaaagtgctatcctttaccggtacgaagacatccttgagcatgaaagacgtggatcaagagacaggcgaggacctcaatcccaaccggagacggaatctggtaggcgagacaaacgaagagacaagcatgcggaatccagataggccgacccacttgagcctcgtctcagcacccgaagtagaggacgattccttagagcgaaaacggttgactcggattagcgatccggaaaagtgggagatcaagcagatgattgctgccaatgtcctttctaaagaagaatttccagacttcgatgaggaaacaggaattctccctaaagttgacgatgaagaggacgaggatctggaaatcgagctggtggaagaggagccacccttcttgcggggacatacaaagcaatccatggacatgtccccgatcaaaatagtcaaaaacccagatggaagtctgtcacaggccgctatgatgcagtccgctcttgcaaaggagaggagagagctgaaacaggcacaacgggaggctgagatggactccattccaatgggcctgaataagcactgggtggatcccctgccagacgcagagggacgtcagatcgccgcaaatatgcgcggaattggcatgatgcctaatgatatcccagaatggaaaaagcacgcctttggaggcaacaaagcctcctatggcaagaagacacaaatgagcatccttgagcagagagaatctttacctatttataaactgaaggaacagttggtccaggctgtgcacgacaaccagattctcatcgtcatcggcgaaacaggatccgggaagacgacccagatcactcaatatctcgcagaggctgggtacacttccagagggaagatcgggtgtactcagcccagaagagtggcagctatgtcggttgctaagcgggtgagcgaggaatttggttgctgcctgggccaggaagtagggtataccattagatttgaagattgcacaagcccagagaccgtgatcaaatatatgaccgatggaatgctactgagggagtgtctgatagatcccgatctgacacagtacgcgatcatcatgctcgacgaggctcatgagagaacaattcacacagacgtcctatttggtctcttaaagaaaacagtgcagaaacgccaggatatgaaacttattgtgacatctgctacattggacgccgttaagtttagtcagtatttttatgaggcgcctatttttacaataccaggaaggacgtacccggttgagatattgtataccaaagaacctgagaccgactatctggacgcatctctcatcacagtgatgcagatccacctcaccgagcctcctggcgacatattagtgttcttgacggggcaagaggagatagacactgcatgtgaaatcctatacgagaggatgaaatccctgggaccagatgtgccggagctcatcatcctgcccgtctacagtgccctgccatccgagatgcagacgaggatcttcgatccagccccaccaggcagtaggaaggtggtaatcgcaacgaacattgctgagacttccctcacaatcgacggaatctactatgtggtggatccaggttttgtaaaacagaaagtatataactcaaagaccgggatcgatcagctggttgtgacaccaatttcacaggcgcaggcaaagcagcgtgccggaagagccggaaggaccggcccaggaaaatgttatcgcctttacactgaaagagcttacagagacgaaatgcttacaacaaacgtaccggaaatacagaggaccaacctggcatctactgtgctcagcctaaaggccatgggaatcaatgacttgctttcttttgattttatggacgccccaccaatggagactctgattactgcgatggagcaattgtatacgctgggggcattagatgatgaggggctactgaccagactggggcgaagaatggctgagttccctcttgagcctatgttatgcaaaatgttgatcatgagtgttcacctgggttgcagcgaggaaatgctgaccattgtgagcatgctaagcgttcagaacgtgttttataggcccaaagacaagcaagctcttgctgatcagaagaaagcgaaattccatcagactgagggggatcaccttaccctgctcgccgtgtataattcttggaaaaataacaaattctcaaacccatggtgttacgagaacttcatccaagctcgttccctgcggagggcacaagacattcgcaagcaaatgttgggcatcatggaccggcacaagttggatgtcgtgtcctgcgggaagagtaccgtgcgggtgcagaaggcgatttgctctggtttctttcggaacgcagctaaaaaggatcctcaggaagggtaccgcacgctgatcgaccagcaggttgtttacatccaccctagctccgccctgttcaacagacagcctgagtgggttgtctatcatgagctcgtgcttacaacaaaagagtacatgcgcgaagtgaccacaatcgaccctcggtggctggtagagttcgctcctgctttttttaaggtgagcgaccccacgaagctaagcaaacagaagaagcagcaaagattagaaccactatacaatcgatacgaagagcccaatgcatggcgaatatccagggctttcaggcggaggtag

SEQ ID NO: 220383 - DNA, 3546 bp, Artificial Sequence
  Description of Artificial Sequence: Synthetic coding sequence
atggctgtggcagtcgccatggccggtgcgctcatcgggagtgagccgggacccgctgaagaactagctaagctcgaatatctgtccttggtgtctaaggtctgtaccgagttagacaatcacctaggcatcaacgataaggacctggcagaattcgtaatcagcctggcagagaaaaacaccaccttcgacacattcaaggcttctctcgttaaaaatggtgccgagttcacagactctctaatctcaaatttgctacggctgattcagacgatgcgcccaccagcgaaaccaagtaccagcaaggacccagtggtgaaacccaaaactgaaaaagagaagctaaaagagctgttcccagtgctttgtcagcccgataaccctagtgttcgtacgatgttggatgaggatgacgtgaaagtggccgttgatgtgctgaaagagcttgaggccctcatgccctcggccgctggacaggagaaacagcgtgacgcggagcaccgggatcgcactaaaaagaagaagcggtcaaggtctcgggacaggaatcgggaccgggaccgcgaccgcgagcgcaatcgggaccgcgaccacaagagaagacataggtcccgatcacgctcgcgcagccgtactagggagagaaataaggtcaaatccaggtatcggtctaggtcccgatcccagtcccctcctaaagaccgcaaagaccgtgacaagtacggcgaaagaaatctggatcgctggagggacaaacacgtggacagaccccctcctgaggaacctactatcggagatatttataatggtaaagtcacatccatcatgcagtttggctgcttcgtgcagttagaaggactgcgcaaaagatgggaaggccttgtgcacatatcggagctgcgaagagagggcagagtggccaatgttgccgacgtagtctctaagggccagagggtgaaggtgaaggtgctttctttcacaggaactaaaacttcactgtccatgaaagacgtggaccaggaaaccggtgaggatttaaaccccaaccgacgccgtaacttggtgggcgaaactaatgaggagacaagtatgcggaaccccgatagacccacacacctgtccctcgtcagcgcccctgaagtggaagatgattccctggagaggaagcgacttactcgcatcagcgatccagagaaatgggagataaaacagatgatcgctgccaacgttctgtccaaagaagaatttccagacttcgacgaggagactggaattctccccaaggtggacgacgaggaggacgaggatctggaaatcgagctggtggaggaagaaccgccatttctgagaggccacacaaaacagtccatggacatgtccccgattaaaatcgtgaagaacccagacggctctctctcccaggccgcaatgatgcaatcggctctggctaaggagaggagggaactcaagcaggctcagcgtgaggccgaaatggactctattcccatgggtcttaacaagcactgggttgatcctcttccggatgccgaaggccgacagatcgcagcaaatatgagggggatcgggatgatgccgaatgatatcccggagtggaagaaacatgcgtttggcggtaataaggcatcctacggaaaaaagacacaaatgtcaattttggaacaaagagagtcccttccgatctacaagttgaaggaacagttggttcaggcagtgcacgacaaccagattttaattgtgatcggcgagaccgggtctggaaaaactacccaaattactcagtatctcgctgaggctggatatactagccgagggaaaatcgggtgcacgcagccgcgacgcgtcgccgcaatgtctgtggccaagagggtctccgaggaattcggttgttgcctggggcaggaggtaggttatactatccgctttgaggactgcacaagtcccgaaacagtgataaaatacatgaccgacggcatgctgctgagggagtgtcttatagaccctgatctaacccagtacgcgatcatcatgttggatgaggcacacgaaagaactattcacacagacgttctatttgggttgctgaaaaaaacagtccagaaaaggcaagatatgaagcttattgtgacctccgcaacactggatgcagtgaagttctcacagtatttctacgaagcacccatatttactattcccggtaggacttatcccgtggaaatcctatacactaaggagcccgagactgattaccttgacgcatctcttataaccgtcatgcaaattcatttgaccgaacctcctggagatattctcgtattcttgacaggacaggaggagattgacaccgcttgcgagattctgtatgaaaggatgaaatccttgggccctgacgtgccagagttgattattcttccggtttacagtgcgctgccttccgagatgcagactaggatctttgacccagcaccacctgggtctcgcaaagtcgtgattgcaacaaatatcgccgaaactagtctgaccatcgacggcatctactacgtggtggacccgggattcgtcaagcaaaaagtttacaacagcaaaaccggcatagatcagctggtggtgacaccgatctctcaagcgcaggcaaagcagagagctgggcgtgcgggtcgaaccgggcctgggaagtgctatcgattgtacacagagcgcgcttatagggacgaaatgttgaccacaaatgttcccgaaattcagagaaccaacctggcatccactgtgctgagcctaaaggcaatgggcattaatgatctgttgagcttcgactttatggatgcgccacctatggaaacacttataaccgcaatggagcagctgtacaccttaggcgctctcgacgacgaggggctgctgaccagactggggcgtagaatggcagaattccccctggagcccatgctctgcaagatgttaatcatgagcgttcacctgggctgctcggaggaaatgctgaccattgtgtcaatgctctctgtccagaacgtcttttaccggccaaaggataaacaggccctggctgaccaaaaaaaggcaaagttccaccagactgaaggagaccatttgaccttactggccgtgtacaattcttggaaaaataataaattttccaatccctggtgttacgagaactttatccaggccagatccttgcgcagagcccaggatattagaaagcagatgctgggcatcatggacagacacaagctcgacgtggtgtcctgtggcaaaagtacagttagggtacaaaaagcaatttgcagcggcttttttcgcaatgcggctaagaaggacccccaggagggttatcggacactgatcgaccagcaggtcgtgtatatacacccctcatccgctctcttcaaccgtcaacccgagtgcccaaagcatttcctgcctgtcgtcgcagtggctgtttctctcgaacagtgcctgtctaagttcgaagatctgaataaggagctgggtctggtgacctgctag

SEQ ID NO: 220384 - DNA, 3813 bp, Artificial Sequence
  Description of Artificial Sequence: Synthetic coding sequence
atgggtgatgtgaagaatttcctctatgcatggtgcggtaaaaggaaaatgaccccctcttacgagattcgggcagtcgggaacaaaaacaggcagaaattcatgtgcgaggtgcaggtcgaaggttacaactacacaggcatgggtaactcgactaacaagaaggacgcccagtctaacgccgcaagggatttcgtgaactacctcgtgcggatcaatgagattaagagtgaggaggtgcccgcattcggtgtggcgagccctcccccactgaccgatacaccagatacaactgccaacgccgagggagacttgccaactacgatgggcggtccccttccaccccatttagctttgaaggccgaaaataattccgaggtcggggcaagcggttatggggtgccaggccctacatgggaccgcggtgctaacctaaaagactactatagcaggaaagaggagcaggaagtccaggcaactttagagagcgaagaagttgatctcaatgccggactccatggcaactggacattggagaatgctaaggcgcgattaaatcagtattttcaaaaagaaaaaatccagggcgaatacaagtatacgcaagtgggaccagaccataatcgctcattcattgcagagatgacgatatacatcaagcagcttggtaggcgcatcttcgcacgcgaacacggtagcaacaaaaaattagctgcgcagagctgcgcccttagtctggtgcgccagctgtatcaccttggggtagtggaggcctacagtggactgacaaagaagaaagagggggaaaccgtggagccctacaaagtaaacctctctcaggacctggagcatcagctacagaacattattcaagagctgaacctagaaatcttacctccgcctgaagacccctccgtgccagtcgccttgaacatagggaaactggctcagttcgaaccctctcagcgtcagaaccaggtgggggtggtgccttggtctcccccacaatccaactggaacccctggaccagcagtaatatcgatgaaggccctttggcatttgctacgcctgagcagatatccatggatctgaaaaacgagctgatgtaccagctagagcaggatcacgatcttcaggcaatactgcaggaacgagaactcctgccggtcaaaaaatttgagagcgaaatcttggaagccatatcacaaaactccgtggttattattcgcggagccaccggttgcggaaaaactacccaggtaccacaatttatcctcgatgatttcatccagaatgaccgggctgcggagtgtaatattgtggtaacccaacctcgacgcatcagcgcagtcagcgtggccgaacgagtggcctttgaacgcggtgaggaacctggcaagtcttgcggctatagtgttcgctttgaatccattttaccgaggccacacgctagcattatgttttgtacagttggcgtccttctgcgaaagctagaggccggaattcgtggtattagtcacgtgattgttgatgaaatccatgagcgcgacattaacaccgattttctactcgtggtattaagggatgtagtgcaggcgtatccagaagtgcggattgtgcttatgtcggccactattgatacaagtatgttttgtgaatatttctttaactgccccatcattgaagtgtatggtagaacttaccctgtgcaggagtattttttggaagattgcatccagatgacgcatttcgtaccacctccaaaggataagaagaaaaaagacaaggacgatgacggaggtgaagacgatgatgccaactgtaatcttatttgtggtgacgagtacgggccagagacccggttgtccatgtcacaactcaacgaaaaggagaccccattcgagctgattgaagccctgctgaagtatatagagacccttaatgtacctggagccgtgctggtgtttttgcccggatggaacctcatttacacaatgcagaagcacctggaaatgaaccctcactttgggagccataggtatcaaatcctccctttgcattctcaaattccccgagaggagcagcgaaaagtgtttgaccctgtccccgtgggggtcactaaggttattctctccaccaacatcgctgaaacttcgatcactattaacgatgttgtgtacgtgatagactcttgcaaacagaaggttaaactgttcaccgcccataacaatatgacaaactacgctactgtgtgggctagcaaaacaaacctggagcagaggaagggacgcgctgggcgagtgcggcctgggttctgttttcacttatgctcaagggctagatttgaacgattggagacgcacatgacacctgaaatgttccgaacacccctgcacgagattgcactgtcgatcaaattgctccggctcggtggcataggccagttccttgctaaagcgatcgagcccccaccacttgacgccgtgattgaggctgagcacaccctgagagaactcgatgcattagatgcaaatgacgagctgacaccccttgggcgtatcctcgcaaaattaccgatcgagcctcgattcggaaaaatgatgatcatgggatgtatcttctatgttggggacgccatatgtacgattgctgctgctacttgttttcccgagcccttcatcaacgagggcaagagactgggttacattcatcggaacttcgcaggaaacagattttcagaccacgtggcgctcctctctgtgtttcaagcctgggatgatgcccgaatgggcggagaggaagctgaaatcaggttctgtgagcacaagcgcttaaatatggccacactccggatgacctgggaggccaaagtgcaactcaaagaaattctgattaattctggcttccctgaggattgcctgctgacacaagtatttaccaacacgggcccagataacaatctggacgtcgtaattagcctgctggccttcggagtctaccctaatgtctgctaccacaaggaaaagcgaaagattctgacgactgagggaaggaatgccctcatacacaagtcctccgtaaattgccctttttcttcccaggacatgaagtatccatcccccttttttgttttcggtgaaaagatccgaaccagggcaatcagcgccaaaggaatgaccctggtgaccccactgcaactcctcttattcgcatcaaagaaagtgcagagcgacgggcagatagtgctggttgacgactggatcaaattacaaatttctcacgaggccgctgcttgcatcaccgggctgcgcgctgcaatggaagctctagtcgtggaggtcactaagcagcctgctattatcagtcagttggacccagtaaatgagcgtatgttaaatatgatccgtcagatcagtcggccttcagctgcaggtattaacctaatgatcggcagcactagatacggagatggtccgaggcctcccaaaatggcccgatacgataacggctccgggtaccgtcgcggaggtagcagttatagtggaggtgggtatgggggagggtattcatccggcggatacgggtccggaggctacggcggatccgcaaattcgtttagggctggatacggagccggtgtggggggaggatacagaggagtgtctcgcggtggctttcgcggaaattcaggtggtgattatcgaggacccagcggcggatacagggggtcaggcggattccaacggggtggagggcgaggtgcttatggaaccggctacttcggacaagggagaggcggaggaggatattag

SEQ ID NO: 220385 - DNA, 1800 bp, Artificial Sequence
  Description of Artificial Sequence: Synthetic coding sequence
atgggagacgtcaagaacttcctctacgcgtggtgcggtaagaggaagatgacaccatcatacgagatccgagcggtgggaaataagaatcgacaaaaattcatgtgtgaagtccaagtggagggatataattacactggtatgggcaacagcacaaacaaaaaggatgcccagtccaatgccgctagagactttgtcaactacctggttagaattaacgaaattaagtcggaagaggtgccagcatttggggttgcctcacctcctccattgactgacaccccagacacaaccgccaatgccgaaggtgatctgcccactaccatggggggtccactccctccccatcttgccctcaaggcggagaataattccgaggtgggagcctcagggtatggggtcccaggaccgacttgggacaggggcgcaaacctgaaagactattactcacgaaaggaagagcaagaagttcaggcaacgctcgaaagcgaagaggtggacctgaacgcaggtctgcacgggaattggacactggaaaatgccaaggcaagacttaatcagtacttccagaaagagaaaattcagggcgagtataaatacacgcaggtgggccctgatcacaatcgcagtttcatcgccgaaatgacaatctacattaagcagctgggcagaagaatattcgcacgcgagcacggaagtaacaaaaaactggctgcccagagctgtgccctatcactggtccggcagctttatcacctaggggtcgtggaagcctatagcgggttgaccaagaaaaaagagggtgaaacagtcgagccctacaaggtcaatttatcccaagacctcgagcaccagctccagaacatcatacaggaactgaacctggaaattctgcctccaccagaagacccatccgtcccagttgccctgaacatcggcaaactggcacagtttgaaccatctcagcgacaaaaccaggtgggcgtggtgccctggtcgccacctcagtccaactggaatccttggaccagcagcaatattgatgagggcccactggcttttgccacacccgagcagatctctatggatttaaagaacgagttgatgtaccagctcgagcaggatcacgatctccaggctatactgcaggaacgcgagctgttgcctgtcaaaaagtttgagagtgaaattttagaggctatcagccaaaattccgttgtaattattaggggagccaccggatgcggcaagaccacacaggttcctcaatttattttggatgacttcattcagaatgatcgggctgctgagtgcaacatcgtggtgacacagccccgtaggatctcagccgtcagcgtggcagaacgggtggccttcgagcgcggtgaagagcctggcaaatcatgtgggtattcagtccgatttgagtcgatcctacctagaccccatgcgtctattatgttttgcaccgtgggtgtcctgctccgcaagcttgaagccggaatccgcggtatctcccatgttatcgtcgacgaaattcacgagcgtgatatcaacactgactttttgctcgtcgttctgagggatgtagttcaggcctaccctgaggtgaggattgtcctgatgtcggcgaccatagatacatcgatgttctgcgagtatttttttaactgcccgattatcgaagtctacggaaggacgtacccggtgcaagaatattttctggaggactgtattcagatgacccattttgttccccctccaaaggataagaaaaagaaagacaaaaagaagaaatag

SEQ ID NO: 220386 - DNA, 1197 bp, Artificial Sequence
  Description of Artificial Sequence: Synthetic coding sequence
atgatgttaaaaggcattacccgccttatctctagaatccataagcttgacccgggacgattcctacatatgggcactcaggcccgacaatctattgctgcccacttggataatcaggtccccgttgaatcaccacgcgctatctcacgtactaacgaaaacgatccagcaaagcacggagaccagcacgagggtcagcactacaatatttccccgcaggaccttgagactgtctttccgcacggcctgcctcctcggtttgttatgcaggtaaagactttcagtgaggcctgtttaatggtcaggaaacctgccctggaactgctccactacctgaagaacacatcattcgcgtacccggctattcggtacctcctgtatggcgagaaaggcaccggcaagactctgtccttgtgccatgtgatacacttttgtgccaagcaagactggctgattctgcacattccagacgcgcatctatgggtgaaaaactgtagagatcttttacagtcctcatacaataaacagcggttcgatcagcctttggaagcctcaacatggttgaaaaactttaaaaccacaaacgaaagattccttaatcaaatcaaggtgcaggagaaatacgtttggaacaagcgcgagagcacagagaagggctctccgttgggagaggtggtggaacaaggaataaccagagttagaaacgccaccgacgccgtagggattgttctcaaggaacttaaaagacagtcatccctcggtatgtttcatttactggtggcagtcgacggaattaatgcgttgtggggtagaacaacgctgaagagagaggacaagtctccgatcgctcccgaagaactggcattggtccataatctcagaaagatgatgaaaaatgactggcacgggggtgcaatagtgtcagcgctgagtcagactggttccctttttaagccccgaaaagcctatttgccccaggagctactgggcaaggagggctttgacgcccttgaccctttcattccaattctggtgtctaattacaaccccaaggaattcgaatcctgcatacagtactatctggagaataattggcttcagcacgaaaaggcaccgaccgaggaaggaaagaaggagcttttgtttcttagtaatgcaaacccttccttgcttgagcggcactgcgcctacttgtag

SEQ ID NO: 220387 - DNA, 1197 bp, Artificial Sequence
  Description of Artificial Sequence: Synthetic coding sequence
atgatgctcaagggaataacaagattgatttctcgcattcacaaactggatcctggcaggttcctgcacatggggacacaggctcggcagagcatagccgcacacctcgataaccaagtgccagtggaatcaccacgggcaatatctcgaaccaacgaaaacgacccagccaagcacggggatcagcacgagggtcaacattataacatctccccccaggatctggagaccgtttttcctcatggcctcccacctcggtttgtgatgcaggttaagacattctctgaggcttgtctgatggtgcgtaagcccgcattagagctcctgcactatctaaaaaacacaagttttgcataccccgctatccgatatcttctgtacggggaaaaaggaaccggtaaaacgctgtcattgtgtcatgtaatccatttttgcgctaagcaggattggttgatcctccacattcccgacgcccacttgtgggttaagaattgcagagatctgctgcagtcgtcctataataagcagagatttgaccagcctctggaggcatccacttggctgaagaattttaagaccaccaacgagcgctttttgaatcagatcaaggtgcaagaaaagtacgtctggaataaacgcgagagtactgagaagggctcccctctgggtgaagtggttgaacaggggattactagagttcgcaatgccaccgacgcagttggaattgtccttaaagagctgaaacgccagtcctcactcggtatgttccacctcctggtagccgtagatggcatcaacgctctgtggggaaggactacactgaagcgggaagataagtcaccaatcgctccagaggaactcgctcttgtgcataatttgcgcaaaatgatgaagaacgactggcacggtggtgctatagtctctgctctctctcaaactggatccctttttaaaccaaggaaagcgtatctgcctcaggaattgctgggaaaggagggctttgacgctctagacccatttatcccgatactcgtatcgaactacaatccaaaggagttcgaatcctgcatccagtattacttggaaaataactggctgcagcatgagaaagccccaaccgaggagggcaaaaaagagttactctttcttagcaatgccaatccctccctcctggagaggcattgtgcttacctgtag

SEQ ID NO: 220388 - DNA, 1095 bp, Artificial Sequence
  Description of Artificial Sequence: Synthetic coding sequence
atgatgctgaagggaataaccagacttatttcccggatccacaaacttgacccaggacgcttcctgcacatgggaacccaagcccgacagagtattgccgcacatttagacaaccaggtgcccgttgagtcacctagagccatcagtcgcaccaacgagaatgacccagtcaaaaccttctctgaagcctgtttaatggtgaggaaaccagctctggagctgctccattatcttaagaacacatccttcgcttaccctgctatacggtacctgctgtacggggagaaaggcacaggtaaaacgctgtccctttgccacgtaatccatttttgcgctaagcaagactggctgattctgcacatcccagatgcacacctgtgggtgaagaactgcagggatcttctccagtctagttacaataagcaacggttcgaccaacctctggaagctagcacctggctgaaaaatttcaagacaactaatgaaagattcctcaatcagattaaagtacaggaaaaatacgtttggaacaagagagaatccacagaaaaaggttctcccctcggcgaagttgtggagcaggggattacacgggtcagaaacgcaacagacgccgtggggatcgtgttgaaggagctaaaacgacagtcttccctgggaatgtttcacttattggtggcagtcgacggtatcaacgcactgtggggaaggacaaccctgaagcgagaagataaaagtccgattgcccctgaggagctggccctggtgcacaacctccggaaaatgatgaagaacgactggcacgggggagcaatcgtcagcgccctgagtcagaccggatccctttttaagccccgaaaagcatatcttcctcaggagctgctgggaaaagagggctttgatgccctggacccattcatccccattttagtttctaactacaaccccaaggaattcgagagttgtatccaatactaccttgagaataactggctacaacacgagaaagctcccaccgaggagggcaaaaaagaactgctctttctgagcaacgcgaacccttccctgctcgaaagacattgcgcttacctgtag

SEQ ID NO: 220389 - DNA, 1074 bp, Artificial Sequence
  Description of Artificial Sequence: Synthetic coding sequence
atgatgctgaaggggattacaagactgatttcccgcatccacaaagccaaacatggggaccaacatgaaggccagcactataacatcagcccccaggacctggaaaccgtatttccacacggactcccccctcgctttgtcatgcaggtcaaaacctttagtgaggcttgtctcatggtgagaaagcctgcactggagctactccactatctgaaaaatacctcattcgcataccctgcaataagatacctgctgtatggagagaaggggaccggaaaaacgttatctttgtgtcatgtcattcacttttgcgctaagcaggactggttaatcctgcacataccggatgcccacctctgggtgaagaattgtagagatctcctccaatcctcttataataagcagaggtttgaccagccactagaagcaagtacttggctcaagaattttaaaaccaccaatgagcggtttctgaaccagataaaggtacaggaaaaatatgtgtggaacaaaagagagtctactgagaagggctctcctctgggcgaagtggtcgagcagggaattacccgagtgaggaatgcaacagacgccgtgggtatagtgctgaaggaactgaagcgacaaagttccttggggatgttccacctgctggtcgccgtcgacggaatcaacgctctatggggacgaacgacactgaaaagagaagataaaagccctattgctcctgaggagttggcccttgtccataacctaagaaagatgatgaagaatgactggcatggcggtgcaattgtctccgccttgtcacaaacaggaagtctgttcaagccaagaaaagcctacctgcctcaggaactcctcggcaaggagggattcgacgccctagatcctttcatacccatactggttagcaattataaccccaaagaattcgagagctgtattcaatattatctcgagaataactggctgcagcacgagaaggccccaactgaggagggcaaaaaagaactcttgtttcttagcaacgcaaacccatctttactcgagagacactgtgcatacctgtag

SEQ ID NO: 220390 - DNA, 1047 bp, Artificial Sequence
  Description of Artificial Sequence: Synthetic coding sequence
atggccggactgaaaagacgagcgagtcaagtttggccagaagaacatggcgaacaggaacacggcttatatagtttgcaccgaatgtttgacatcgtagggacccatctgacacatcgggacgttcgcgtgctgagcttcttgtttgttgacgtgatagacgatcatgagagagggctgatcagaaacggcagggacttcctgctcgccctcgagagacagggtaggtgtgacgaatccaatttccgccaagtccttcagttacttagaatcatcactcgccacgatctgctcccttatgtgaccctcaagcgccgtcgagccgtctgcccagatctggttgataaatatctcgaggaaacatccatcaggtacgtgacacccagggctctgtccgatccggaaccgagaccccctcagccctcgaaaactgttccacctcattatcctgtggtgtgttgtcccacctctggccctcagatgtgtagcaagcgcccagcgcgaggtagagcaactctgggctcccaaaggaagcgccgaaaaagcgttacgcccgatccaaaagagaagcaaacttgtggcgaagaggtccagggcttccagcgctggtccaggctcgaaggggagtacaaagagttactaggccactgggccgtgtatgcaattcagtacatcagattacgcgtgagggctgaatactgccagcacgaaacagcactgcagggcaacgttttctcgaataaacaggaccctctcgaacgacagtttgaaagattcaatcaagccaacactatcttgaagtccagggacttgggaagcataatctgtgatataaagtttagtgaactcacttacctagatgccttttggagggattatattaatggctctctgctggaagccctgaaaggggtgtttatcactgactcactgaagcaagcggtcggacacgaggctatcaaactcctcgtgaatgttgacgaggaggactacgaactgggaaggcagaagcttctgcgtaatctgatgctgcaggccttgccttag

SEQ ID NO: 220391 - DNA, 957 bp, Artificial Sequence
  Description of Artificial Sequence: Synthetic coding sequence
atggccggtctcaaacgccgagccagccaagtctggcccgaggagcacggggagcaagagcacgggctttactcacttcaccgtatgttcgatatcgttggaacccatttgacacatcgagatgtccgggtcctctcgtttctgttcgttgacgtcatagacgatcacgagcggggtctcattaggaatggaagggattttttgttggccttggaacgacaaggaaggtgcgatgaaagcaacttccggcaggtcctccagctccttcgcatcattactagacacgatctgctaccatacgtgactttgaagagaaggcgcgctgtatgcccagacttggtggacaaatatctggaagaaaccagcataagatatgttactcccagagctctgagtgaccccgagcctagaccccctcaacctagcaagacagtacctccccactaccccgtagtgtgctgcccaacttcgggtccgcagatgtgcagtaagaggcccgctaggggcagagccactctaggctcacaaaggaaaagaagaaagagtgtaactccggaccccaaagagaaacagacctgtgacatcaggttaagagtccgagccgagtactgccaacacgagacagctctgcagggaaatgtgttctccaacaaacaggatccacttgagcgacagtttgagaggtttaatcaggccaatactattctaaaatcccgggatctgggcagcatcatctgtgacattaagttttccgagctgacctacctggatgccttttggcgggactatatcaacggctccctgttggaagcactgaaaggcgtgtttattactgattctttgaagcaggctgtgggacacgaggccatcaaactgctcgtgaacgtcgatgaggaggattatgaactgggaagacagaagctgctgagaaacctgatgctccaggcgcttccctag

SEQ ID NO: 220392 - DNA, 1047 bp, Artificial Sequence
  Description of Artificial Sequence: Synthetic coding sequence
atggcagggctcaagcggagagcttcacaggtgtggccagaggagcacggggagcaggagcatggcttatactccctccacagaatgttcgacatcgtcggcacgcacttaacacaccgggatgtgcgcgttctgagcttcctgttcgtggacgtaattgatgaccatgagagagggcttattaggaatgggagagattttctccttgctctggaacgtcaggggcgatgcgacgagtctaacttcagacaggttctgcaactgctgcgcataatcacacggcatgatctcctcccatatgtcacgttaaaaaggcgacgggctgtgtgccccgatctggtggataaatatctggaagagacatcaattcgctatgtgacaccccgtgccctgagtgacccggagccaagacctccgcagccatccaaaactgtccctccccattaccctgttgtttgctgccccacctccgggcctcagatgtgcagcaaacgtcctgctcggggaagagctaccctgggcagccagcgaaaaaggcggaaatccgttacgccagaccccaaggaaaagcagacatgcggcgaagaagtgcagggtttccagcgatggtccaggctggagggcgagtataaggagttgctgggacactgggctgtctacgccattcagtatataaggctcagagtgagagcagagtactgtcagcacgaaacagccttgcagggtaatgtgttttctaataaacaggaccctctggaacggcagtttgaacggtttaaccaggctaatactatcctgaaatcccgggacctgggctctatcatatgcgatattaagttcagtgaacttacctacctggatgccttttggagggactacattaatgggtctctactggaagccctgaaaggcgtgttcatcacagattccttaaaacaggccgtaggacacgaggcaatcaagctcttggttaacgtcgacgaagaagattatgaactgggacgccaaaaacttctaagaaacttaatgcttcaggccctgccctag

SEQ ID NO: 220393 - DNA, 957 bp, Artificial Sequence
  Description of Artificial Sequence: Synthetic coding sequence
atggctgggctcaaaaggagggcaagtcaggtctggcccgaagaacacggcgagcaggagcacggtctgtatagcctgcaccgaatgtttgatatcgttggcacccatcttactcaccgagacgttagagtgctcagttttctgtttgtggacgtaatcgacgaccatgagagagggctgattcgcaatggcagggacttccttttagcactggagcgccagggtcgttgtgatgagtccaattttcggcaagttcttcagttgctgcgcatcatcacaagacacgatctccttccctacgtgaccctgaaaaggagaagagccgtgtgccctgacctcgtcgataaatacttagaggaaaccagtattcgttacgttaccccgagggccctatcggaccccgagccacgcccacctcagccctcaaagaccgtgccgcctcattaccctgtggtttgttgtcccaccagtggcccacaaatgtgcagcaaacgtccagcaaggggaagagccacacttggttcacagcggaaacggagaaagtcggtaactccagaccctaaggagaagcagacttgcgacataagactgcgggttcgtgcagaatattgtcagcacgagactgctctgcagggcaatgtgttctctaacaagcaggatccattagagcgtcaatttgaaagattcaaccaggcaaataccattctgaagtcccgggacctgggttctatcatctgtgatattaaatttagcgagctgacataccttgacgctttttggcgggactacattaatgggtcactattggaagccttgaaaggggtttttattacagattcactcaagcaggccgtgggtcatgaggccatcaaacttctggtgaacgtcgacgaagaggattacgagctcgggaggcagaaactgttgcgcaacctgatgctgcaagccctcccatag

SEQ ID NO: 220394 - DNA, 828 bp, Artificial Sequence
  Description of Artificial Sequence: Synthetic coding sequence
atggctggtctgaagagaagggcttcccaggtgtggcccgaagaacacggagagcaagaacacggcctgtatagcttgcatcggatgtttgacatcgttggaacccatttgactcatcgcgatgtcctccagctccttaggattatcaccaggcacgatttgctgccatacgtgacactcaagcgccgacgggctgtttgccccgatttagtggacaagtacttggaggaaacttcgatacggtacgtaaccccacgcgctctgagcgatcccgagcctcgccctccccagccaagtaagaccgtgccgcctcactacccagtagtgtgttgccctaccagtggtccccaaatgtgctctaaaagaccagctagggggagggctaccctgggttcacaaaggaaaaggaggaagagcgtcaccccagacccaaaggagaagcaaacctgtgacattcggttgcgagtacgagctgaatattgccaacatgagacggcactgcagggcaatgtattcagcaacaaacaagatcctctggaaagacaatttgaaagatttaatcaggccaacaccattcttaagtcccgcgatcttggcagcatcatttgtgatatcaaattctcggaattgacgtatctggatgcattttggcgcgactacatcaatggaagtctgttggaggctttaaaaggggtgttcatcaccgactccttgaagcaagccgtgggtcacgaagccatcaaactgctggtcaacgtggatgaagaagactacgagcttggtcgccaaaaacttctgagaaacctgatgctccaggctctgccttag

SEQ ID NO: 220395 - DNA, 957 bp, Artificial Sequence
  Description of Artificial Sequence: Synthetic coding sequence
atggccggtctgaagcgaagagcgtcgcaggtctggcctgaggaacacggagaacaggagcacggtctctatagtctgcacaggatgtttgacatcgtagggactcacctaactcaccgagatgtccgggtcctctcgtttctgttcgtggatgtcattgatgaccatgagcgcggtctgattaggaacggtcgcgatttcttattagctcttgagaggcaagggaggtgcgatgagagcaatttccgccaggtactccagttactgcgtattataacccggcatgacctgctgccttacgtcacactgaagcggagacgcgctgtgtgcccagatctggtggacaaatacctcgaagagacctcaataagatatgttacgcctcgcgctctatccgatccggaaccacggcctccgcagccctcaaaaactgtcccccctcactaccctgttgtgtgctgcccaacctccggaccacagatgtgcagtaagcgcccagcaagaggaagggcaactctgggctcgcagcgcaagaggcgtaagtcagtaacacccgacccgaaagaaaaacagacttgtgacatcaggctccgagtgagggcagagtactgccagcatgagacagccctccagggcaatgtgttcagcaataagcaggacccactcgaacggcagttcgagcggttcaaccaggctaacaccattcttaagagccgcgacctcggcagcatcatctgcgacattaagttttccgagcttacttacttagacgccttttggcgggattatatcaacggctccctgttagaagctctgaagggtgttttcataacagactcactgaagcaggccgtcggacacgaagctatcaagctgctcgtcaacgtcgacgaggaagattatgaactgggtaggcaaaagttgttgagaaatctcatgctgcaggctctaccttag

SEQ ID NO: 220396 - DNA, 957 bp, Artificial Sequence
  Description of Artificial Sequence: Synthetic coding sequence
atggcaggtctcaaacggagagcctcccaagtttggcccgaggagcacggcgagcaggagcatggcctttactccctgcataggatgttcgatatcgttggaactcacctgacacacagggatgtgagagtgctgagctttctgtttgttgacgtgatcgatgaccatgaaaggggactgattcgcaacggcagagacttcctgctagccttagagaggcaaggtaggtgcgacgagagtaatttccgccaggttttgcagcttttacgcataattacaaggcacgatctgctgccctacgtcacactcaaacgcaggcgcgctgtgtgcccagatctggtggataagtacctcgaagaaacctctattcggtacgtgacgccccgagcgctcagtgaccctgagcctagaccccctcaacccagcaaaacagttcccccacattacccagtggtgtgctgtcctacaagcggcccacaaatgtgttcaaaacgccctgccagaggacgcgctacattggggtcccaacggaaacggaggaagagcgttacccctgatcctaaggagaaacagacctgcgatattcgtttgcgcgtgagagccgaatactgccagcatgagactgctctccagggaaatgtctttagcaataagcaggatcctctcgagaggcagttcgaacggttcaatcaggccaacacgatactgaagtctcgagacctcggtagcattatttgtgacataaagttctctgagctgacataccttgacgcattttggagggactacatcaatgggagcctgttggaggcattaaagggtgtatttattacagactctctgaagcaggctgtcggccatgaagccatcaagttgctcgtgaacgtcgatgaagaggattatgaacttgggaggcaaaaactgttaagaaacctgatgctgcaagccctcccctag

SEQ ID NO: 220397 - DNA, 1917 bp, Artificial Sequence
  Description of Artificial Sequence: Synthetic coding sequence
atggacctttggcaattgcttctgactctggctctggccggaagttcggacgccttctctggaagtgaagcaacagccgcaatcctcagcagggcaccttggagtctgcagagcgtaaatcccggtctcaaaaccaatagctccaaagagccaaagttcacaaagtgtcgaagccctgagcgcgagaccttttcatgtcactggaccgacgaagttcatcacggaaccaagaaccttgggccaatacagctgttctacacaaggcggaacacacaggagtggacccaagagtggaaagagtgtccagattatgtctctgctggcgagaactcctgctattttaacagctcgttcacctccatctggatcccgtattgcatcaagttaacctcgaacggcggaacagtggacgaaaaatgcttctctgttgacgaaatagtgcagccagacccacctatcgcactaaactggaccctactcaacgtttctcttaccggaattcacgcagatatccaggtcaggtgggaagccccaagaaacgctgacatccagaagggctggatggtactggaatacgagctccagtacaaggaggtgaacgaaactaagtggaagatgatggacccaatactcactacaagcgttcccgtatactcccttaaggtcgataaggaatatgaagtgcgcgtccgttcaaagcagcgtaattcaggcaactacggcgaattctcagaggtactgtacgtgaccctgcctcaaatgagtcagttcacttgcgaagaggacttctacttcccttggctcctgatcataatctttggcattttcggattgaccgtaatgctgttcgtatttctgttctcgaagcagcaacgaattaagatgctgattctgccaccagtccccgtccctaagataaagggcattgatcctgatctgctcaaagagggaaagttagaagaggtgaacacaattctggctattcatgattcctacaaacctgagttccatagcgacgacagttgggtggagtttatcgaactggatatagatgagcccgacgaaaaaacagaagaatcagacaccgaccgtctgctctcttccgaccacgaaaagtcgcattcgaacctcggggtcaaagatggggactccggtcgaacatcatgctgcgaaccagacatactggagacagacttcaacgccaatgatatccacgaaggcacttcggaagtggctcaacctcaacgactgaaaggcgaagcagacttactgtgcttagaccaaaagaatcagaacaacagtccttaccatgatgcttgcccagctacccagcagccctctgtgatccaggccgagaaaaataaacctcagcctctgcccaccgaaggggctgaaagcacccatcaggccgctcacattcagttgtcaaacccaagttcactctcaaacattgacttttatgcacaagtttccgacattaccccggctggaagcgtggtcctctcccctgggcagaagaataaggccggaatgtcacagtgcgacatgcaccccgagatggtgtcactgtgtcaggagaactttctgatggataatgcatatttctgcgaagctgatgccaagaaatgtatcccagtcgcaccgcatatcaaagtcgagtctcatatacaaccgtcactcaatcaggaggatatatatattaccactgagtcacttaccacagctgccggacgtccgggaacaggggaacatgtgccgggatcggagatgcctgttcccgattatacaagcattcacatcgttcagtccccgcaggggctgatcctcaacgccaccgcccttcccctccccgataaagagttcctgtcctcctgcggatatgtgtctaccgatcaattgaacaaaattatgccatag

SEQ ID NO: 220398 - DNA, 1113 bp, Artificial Sequence
  Description of Artificial Sequence: Synthetic coding sequence
atgtttcaggcctctatgcgcagtcccaatatggagccattcaaacagcagaaagtcgaagatttctacgatatcggagaagagctgggctccggacaattcgctatcgtcaagaagtgccgcgaaaagtctacaggcttggaatatgccgcaaaattcattaagaagagacagagtagggcaagcagacgcggtgtgtctagggaagaaatcgagcgtgaggtaagtattttacggcaggtgcttcaccacaatgtcatcactctgcacgacgtctatgagaacaggaccgacgtggttctgatcctggaactcgtcagcggcggagagttattcgatttcctggcgcagaaggaaagcttgagcgaagaggaggccacctctttcatcaaacagatcctggacggagtgaattatctccataccaagaagattgcccacttcgacttaaaaccagagaacattatgctcctggataagaatattccaattccgcacattaagttaatcgactttggtctggcacatgaaatagaggacggcgtcgagttcaagaatatattcggtacaccagagtttgtcgcgcctgagattgtgaactatgaaccgctaggattggaggcagacatgtggtctatcggcgttattacctacattctgctgagcggcgcttcccctttcctgggcgacacaaagcaggaaaccctagcaaacatcactgcggtctcatacgacttcgacgaagagttcttctcacagaccagtgagctagctaaggacttcatccgaaaactgctcgttaaagaaaccaggaaacgacttactatacaggaggcgctgagacacccctggattactccagtagacaatcagcaggccatggtaaggcgagagtctgttgtaaacctcgaaaactttcgaaaacagtatgtgcggaggcgttggaagctgtctttttcaatagtttcattgtgcaaccacctgactagatcgctgatgaaaaaggtacacttgcgccctgacgaagatctccggaactgcgagagcgacactgaggaagacatcgcaaggcggaaggccctgcaccccagaaggagaagctctacctcctag

SEQ ID NO: 220399 - DNA, 1113 bp, Artificial Sequence
  Description of Artificial Sequence: Synthetic coding sequence
atgttccaggcatctatgagatccccaaatatggaaccattcaagcagcagaaggtcgaggatttttatgacatcggggaagagctaggatctggccagtttgccatcgtgaagaaatgtcgtgaaaaatcaacgggcttggagtatgctgcgaaatttatcaagaaacggcagagcagggccagtagacgtggagtgagccgtgaggaaatcgaacgggaggtcagcatccttcgacaagtgttgcaccataatgttattaccctccacgacgtatatgaaaatagaacagatgtcgtgctgattctggagcttgtgagtggaggcgaactgttcgacttcttggcccagaaggaaagccttagtgaggaagaggccacttcatttatcaagcagatcctcgatggagttaattatctgcacacgaaaaaaattgctcacttcgatctgaaacccgaaaatatcatgttgctggacaaaaacatccctatcccccatataaagctcattgactttgggttggcgcatgagatcgaggatggggtggagtttaaaaacatctttggaaccccagaatttgttgcgccagagattgtgaattatgagcccctagggttagaagctgacatgtggagcattggcgttatcacatacatcctgctttcgggcgctagcccttttttaggggacactaaacaagaaacgctcgcaaacattaccgcggtgtcttacgatttcgatgaggaattcttctctcagactagtgaactcgctaaagactttatccgcaagctgctggttaaagaaaccagaaagcgtctaactatccaggaagctctgcgccatccctggatcactccagtggataatcagcaagctatggtcaggagggaatctgtggttaacctagaaaattttcgtaagcaatacgtgcgcagaagatggaagttgtcattctcaatcgtctcgctgtgcaaccacctgacacggagcctgatgaagaaagtccatctcagaccagacgaggatttacgcaattgcgaaagtgacaccgaggaggacatcgccaggcggaaggcccttcaccccaggaggcgatcttctacatcctag

SEQ ID NO: 220400 - DNA, 246 bp, Artificial Sequence
  Description of Artificial Sequence: Synthetic coding sequence
atgttccaggcctccatgcggtccccaaatatggagcctttcaagcagcagaaggtggaggacttctacgacattggcgaggagttgggaagcggacaattcgccattgtgaaaaagtgcagggaaaaaagtacggggttggagtatgcggctaagttcattaagaagcgacagagccgcgctagtagaaggggtgtgtcgagagaagaaatagaacgcgaagtaagtattctgcggcaggtctag

SEQ ID NO: 220401 - DNA, 2223 bp, Artificial Sequence
  Description of Artificial Sequence: Synthetic coding sequence
atggcaactgcgaattcaattattgtcctggatgatgacgatgaagatgaggccgctgcacaacctggtccttcgcatcctctgcctaatgcagcatccccgggagccgaggcgccatcttctagtgagccacacggagcgcgtgggtcctccagcagtggtggaaagaaatgttataaactcgaaaacgagaaactgttcgaggaatttttggagctgtgtaagatgcagacggccgaccatccggaagtggtgcccttcttgtataaccggcagcagcgggctcactccctgtttttggccagcgcggagttttgtaatattctcagccgggtgttgtctagagcaaggtctaggcctgcaaagttgtacgtttacattaacgagctctgtaccgtgctgaaagcgcactctgctaaaaaaaaattgaacctggcccctgcagcaactacgagcaacgagccatcaggcaataacccccctactcacctgtcactggatccaaccaacgctgagaatacagcttcacagtctcctcgaacccggggaagccggaggcagatccagcggttggaacagcttctcgcattgtatgtggccgagatcaggagactccaggagaaagagttggatctgagtgaattggacgaccctgattctgcttacctgcaagaagccagattgaagaggaagctgatccgacttttcggtcggttgtgcgaactgaaggattgctcatctttaactggcagagttattgagcagcggatcccctacagaggtacgcgctatcccgaagttaatagaagaattgaaaggctgattaacaaaccagggcctgacacatttccagattatggcgacgtactccgcgcagtcgaaaaagctgcagcgcgacacagcctgggcctgccacggcaacagctgcagttaatggcacaagacgctttccgggacgtggggataagactgcaggagcggaggcatctggacttaatttacaactttgggtgtcacctcactgacgattacaggcccggtgtcgatccagccctcagcgacccagtcttggccaggcgccttcgcgagaatcgctccctggcgatgagccgcctggatgaggtaatttccaaatacgccatgctgcaggacaaaagcgaggagggagaacgaaaaaaaagacgtgccagactgcaagggacaagcagccattcagcggatacaccagaagctagccttgactctggtgaaggaccctctggcatggccagtcaggggtgcccctctgcgtctagagcagaaactgatgatgaagatgacgaggagtcggatgaagaggaagaggaggaggaggaagaagaggaggaagaggcgactgatagcgaggaagaggaggacctcgagcaaatgcaggaaggccaggaggacgatgaagaggaagacgaggaggaggaggcggctgcaggcaaggatggcgacaagtcacccatgtcctcactgcaaatatcgaacgaaaagaatctggagccgggtaagcagattagtaggtcctctggggagcagcagaacaagggcagaatcgtgagccctagcctcctgagcgaggagcccctggccccttccagtatcgatgccgagtcgaacggagagcaacctgaggaactgacgcttgaagaggagtcacctgtgtcccaattgttcgaactggaaattgaggcactcccactggacaccccaagctctgtggaaactgacataagctcgtcaaggaaacaatccgaagagccttttaccacagtgcttgagaacggcgctggtatggtttccagtacctccttcaatggtggagtgtcccctcacaattggggcgatagcggccctccctgcaaaaagtcccgcaaggagaaaaagcaaaccggatctggtcctcttggaaatagttacgtggagaggcaaaggagcgttcatgagaagaatggtaagaagatctgcactctgcctagccccccatcacctctggccagtctggcccctgtagcagatagtagcaccagggtcgatagtccctcccatggtctggttacctcgagcctgtgtatcccatcacccgctagactaagtcagacgccacattcacagccacctagaccaggtacgtgcaagacgtctgtcgccacccaatgcgatcctgaagaaattattgttctctctgattcagactag

SEQ ID NO: 220402 - DNA, 2223 bp, Artificial Sequence
  Description of Artificial Sequence: Synthetic coding sequence
atggcaacggctaactccattatcgtgctggatgacgatgacgaggatgaagctgctgcccagccgggacctagtcatccccttcccaatgccgcaagccccggtgccgaagcaccctctagttccgagccccacggagcacgcggttctagcagctcaggtgggaagaaatgctataagctagagaatgagaagctcttcgaggaattcctggaactgtgtaagatgcagaccgccgaccacccagaggtggtgccatttctgtacaatcggcaacaaagagcgcactctctgtttttagcctcagcagagttctgcaatatcctgtcccgggtcctgagcagggctaggagcagaccagccaagctgtacgtgtatatcaacgagctttgtacagttctgaaggctcatagcgcgaaaaagaagctgaatcttgctcctgccgcaacaacgtcaaatgagccatctgggaacaatcctccaactcacctgtcccttgatcctacgaatgccgagaacacagcctcacagtcacccaggacacggggaagcagaagacagatccagcggctcgagcaattacttgccctgtatgtggcggagattcggaggctccaggaaaaggaactcgacctgtctgaattagatgatcctgatagcgcttaccttcaggaggccaggttaaaacggaagctcatccgcctgtttggccgactgtgcgaactcaaagactgctctagcctaacaggcagggtcatcgagcaacgtatcccgtacagaggcacacgctaccctgaggttaataggaggatcgagagactaataaataagcctgggcctgacacgttccctgattacggtgacgtgctgagggctgtggaaaaggcagctgcccgacactccctgggcctgccgcgtcagcagctgcagttaatggcacaggatgcatttcgtgatgtcggcataaggctgcaggagaggcgtcatctggacctcatctacaactttgggtgtcacctaactgatgactatcgcccaggggtggaccccgctctgagtgatccagtgcttgcccgtaggctacgggagaatagatctctcgctatgtctaggcttgatgaggttatttccaaatatgcgatgctgcaggataaatcggaggagggggaacgcaaaaagaggcgcgctcgccttcaaggaacctccagtcactccgccgacacaccggaagcctctttggatagcggcgagggtccctctggtatggcttcacaaggatgtcctagcgcaagtagggcagagactgacgacgaggacgacgaggagtctgacgaggaagaagaagaggaagaggaagaagaagaggaggaagccaccgactccgaggaggaggaggacctggagcagatgcaggaggggcaggaagatgatgaagaagaggatgaggaggaggaggcagccgctggcaaggacggtgataagagcccaatgtcaagcttacagatttccaatgaaaaaaatctcgagccaggcaagcaaattagccggtccagtggggaacagcaaaacaaggggaggatcgtgagtcccagcctactgtctgaagaacccctggcgccttcttccattgatgcagaaagtaacggagaacagcctgaagaactaacactggaagaggagtcaccagtcagccagctcttcgaattggaaattgaggcgctccctttagacacaccctcatctgtggagaccgacatcagcagcagcagaaagcaatccgaagagcccttcaccaccgtgctggaaaatggcgcaggtatggtgtcctctacatctttcaacggaggggtgtcgccccacaattggggggactcagggcctccatgtaaaaagagccggaaagagaagaaacagaccggctcgggtccactcggcaattcatacgtggagcgccaacgctctgtgcatgagaagaatggtaagaaaatttgcacattgccctcccctccatcccctctcgcatctcttgcacctgtggctgacagcagtacacgggttgactctcccagccatgggctggttacatctagcctgtgcattccctctccagcgagattaagtcagactccccacagtcagcctcctaggccaggtacttgcaagacatcggttgcaacccagtgtgaccccgaagagattattgtactgagcgactctgactag

SEQ ID NO: 220403 - DNA, 2223 bp, Artificial Sequence
  Description of Artificial Sequence: Synthetic coding sequence
atggcaacagctaacagcataattgttctcgatgacgacgacgaagacgaggccgctgcccagcccggtccctcccacccactgcccaacgccgcttcccccggtgccgaggccccatcctcaagcgaaccacacggcgcaagggggtcaagttcatcaggcggtaagaagtgttataagttagaaaacgagaaattgttcgaagagttcttggagctatgcaaaatgcagaccgcggatcatcccgaggtggttcccttcctgtataatcgacagcagcgagcacacagcttgtttctcgcctccgccgagttttgcaacatcttgagccgagtcctgtcccgtgccaggagtcgccctgccaaactgtacgtttacattaacgagctctgcactgtgctgaaagcccactccgccaaaaagaaacttaatctagccccagctgcgactacctctaatgagccgtccgggaataacccgccaacccatttgagtcttgaccccactaacgcagagaacaccgcaagccagtccccacgcacaagaggatctagacgacagattcagaggctggagcagcttctggccctctacgtcgctgaaattcgacgcctgcaggagaaggaactggacctctcagagcttgacgaccccgattccgcgtatctgcaggaggccaggttaaaacggaaactcatcagactgtttgggaggctgtgcgaactgaaagattgctcctctttgactggccgtgtgattgaacaacgaataccctatcgcggaacccggtatcctgaggttaatcggcgaatagagcgtctaattaataaaccgggaccagatacttttccggactatggagacgtcctgcgggcagtggaaaaggccgctgccaggcattccttgggccttccgagacagcagctgcagttgatggctcaggacgcttttagagatgtcgggataagactgcaggaacggcgacacctggacctgatctacaactttggctgtcacttaacagatgactatcggccaggggtcgaccccgcacttagcgatcctgtgctcgcaagacggctccgtgagaataggtctctggccatgagtagactggatgaggttatttccaaatatgcgatgctccaggacaaatcagaagagggagagaggaagaagcggagagcacggctgcaggggacatccagtcactctgcggatacccccgaggcctctctggattccggtgaaggcccttctggcatggcctcccaggggtgcccgagcgcctcgcgtgctgaaaccgacgatgaggacgacgaggaatccgacgaagaggaagaggaggaagaagaggaagaagaagaagaagctaccgacagcgaagaggaagaagaccttgagcagatgcaggagggacaggaagacgacgaagaagaagatgaagaggaagaagccgctgccggaaaagatggggataaatcacctatgtcttccttacaaatctccaacgagaaaaacctcgagcctggcaaacaaatttcccgcagctcaggggagcagcaaaacaagggacgaattgtgagtccaagcctgctgagcgaggagcctctggcccctagcagtattgacgcagaaagcaatggagaacagccagaggagcttacacttgaagaggaatcccctgtctcccagctgttcgagctggagatcgaggccctacccctcgacaccccttcttcagtagagacagacattagttcaagcagaaagcagagtgaggagcccttcactaccgtgctggaaaatggggctggaatggtatcctctacctccttcaacggcggagtgagcccccacaattggggcgattccgggcctccctgtaagaagtctcggaaagaaaagaagcagacaggttctgggcctcttggaaactcttacgtggagcggcagcgctccgtgcacgagaaaaacggaaagaagatttgcacactgccaagtccacccagtccgctggcctctcttgcacccgtggctgacagctcaacacgcgttgactcccctagccacggcctcgtaaccagcagcctgtgtattccatcgcctgccaggctttcacaaacaccccacagtcaacctcccaggcctggcacctgcaagacctccgtggcgacacagtgtgacccagaggaaataattgtactgtctgacagcgattag

SEQ ID NO: 220404 - DNA, 2223 bp, Artificial Sequence
  Description of Artificial Sequence: Synthetic coding sequence
atggctacggccaattcaatcatcgtgctcgatgatgatgacgaagatgaagccgcagctcagcccggtccaagccaccccttgcctaacgcggcttctccgggtgctgaggctcccagttctagcgaaccccatggcgcacgcggatccagcagtagcggagggaaaaaatgctacaagctggagaacgagaagctgtttgaagagtttctggaactgtgcaagatgcagactgccgatcatcctgaggtggtgccgtttctgtataataggcagcagcgggctcacagcttgttcctggcctctgcagaattttgtaacatcttaagcagagttctctccagagctcgctctcggcctgccaaactgtacgtgtatatcaacgaactctgcaccgtgcttaaggcccattccgccaagaaaaagctgaatctcgcccctgccgctacaacatcaaatgagccctccgggaataacccgccaacccatttgagcctggacccaacaaatgctgaaaataccgcctctcagtctccccgaacaagaggctcacgcagacaaattcagagactcgagcagctgctggctctgtatgtggctgaaatccgaagactgcaggagaaggagctcgacctgtccgagctcgatgatccagacagtgcatatctccaggaggcacgactaaaaagaaaactcatccgcctttttggccgattgtgcgaattgaaggattgcagttccctgacaggaagggtgatcgagcagagaattccctacaggggtacaaggtaccccgaggtgaatcggagaatcgagcgtcttataaataagcccggtccagacaccttccctgattacggagacgtacttagagcagtagagaaggcggcagcacggcactcactcggccttcccaggcagcagctccagctcatggcccaggatgctttcagggatgtcggaattaggttgcaagaacggcgacatctggaccttatctacaatttcggctgtcacctcacagacgactacaggccgggagtggatccagctcttagtgacccggtgttggccagaagactgagagaaaatcgaagtctcgctatgagcaggcttgacgaggtaatcagtaagtacgctatgctgcaagacaagagtgaggaaggggaacggaaaaaaaggcgcgcaagactccaaggcactagctctcactcagccgacactccagaagcatccctcgattcgggggaaggacctagcggcatggcctcccagggctgcccatccgccagtagagcagaaactgacgacgaggatgatgaagagagtgacgaggaggaagaggaagaagaggaggaggaggaagaggaggccaccgattctgaggaggaagaggatttggagcaaatgcaagaaggccaggaagacgacgaggaggaggatgaagaggaggaggctgcagctgggaaagatggagacaaatctccaatgtcttcactacagataagcaatgagaaaaatctcgaaccaggcaaacagatctccaggtcctccggcgagcaacaaaacaaaggtagaatcgtgagccccagtctcctgtctgaggaaccactagcacctagtagtatcgacgctgaatctaatggggagcagccagaagaactcaccctcgaggaggagagtccagtatctcagctgttcgagcttgaaattgaggcactaccgctcgatactccctctagcgtggagaccgatatctcttcgtctcgtaaacaatctgaggagccgtttactacagtgcttgagaacggagcagggatggtgtcatcaaccagcttcaacggtggcgtttcaccacacaactggggtgactccggcccaccctgtaaaaaaagccgcaaagaaaagaagcaaacaggtagtggcccattgggcaattcatacgttgaaagacagcgttcagtgcatgaaaaaaacgggaagaagatctgtaccctgccttcccctcctagtccgttggcttccctagcaccggtagccgactcctccacccgggttgattctccgagccatggactagtaacctcgagtctgtgcattcctagcccggcacggttatcgcagactccacattcccagccaccacggcctggaacctgcaaaacaagcgtcgcaacccagtgcgatcccgaggaaatcatagtgctcagcgactccgactag

SEQ ID NO: 220405 - DNA, 393 bp, Artificial Sequence
  Description of Artificial Sequence: Synthetic coding sequence
atggccacggcaaatagtattattgtgttagatgacgacgacgaggatgaagctgccgctcagcctgggccatcccatcccctgcctaatgccgcttcacctggggcagaagccccatcaagctccgaacctcatggcgctcgagggtcgtcgtccagtgggggtaagaaatgctataagctcgaaaacgagaaactgttcgaagaatttctcgagctatgcaaaatgcagacagccgatcatcctgaggtcgtccctttcctgtacaacagacaacagagagcacacagcctctttctggcgtcagcggaattttgcaacattttgagcagggtcttgagccgggctcgctcaaggcccgcaaaattgtacgtgtatataaatgagctgtag

SEQ ID NO: 220406 - DNA, 147 bp, Artificial Sequence
  Description of Artificial Sequence: Synthetic coding sequence
atggctactgctaatagtattattgtgctcgatgatgatgacgaagatgaggccgctgcccagcctggccctagtcaccccctaccaaacgccgcaagccctggtgctgaggcccctagttcgagtgagcctcatggcgctcggtag

SEQ ID NO: 220407 - DNA, 393 bp, Artificial Sequence
  Description of Artificial Sequence: Synthetic coding sequence
atggctaccgccaactctatcattgtgctggatgacgacgacgaggatgaagctgctgcccagcctggtccctcccatcccctccctaatgcagcctctccgggagctgaagcaccctcaagtagcgagcctcatggcgcaagagggtcaagttcctcaggtggaaagaagtgctataaacttgagaacgaaaagctgtttgaggaattcctcgagctgtgtaagatgcagaccgcagatcacccagaagtggttccttttctgtacaatcgacagcagagggcccactctcttttccttgcgagcgcggagttctgtaacatacttagcagggtgctcagtcgcgcacgaagccgcccagccaagctttatgtctacattaacgaactttag

SEQ ID NO: 220408 - DNA, 147 bp, Artificial Sequence
  Description of Artificial Sequence: Synthetic coding sequence
atggccacggctaacagcattattgtgctggatgacgatgacgaagacgaggcggcagctcagcctggtccttcccaccctcttccgaacgccgctagccccggtgctgaagccccaagctcaagcgagcctcacggggctaggtag

SEQ ID NO: 220409 - DNA, 537 bp, Artificial Sequence
  Description of Artificial Sequence: Synthetic coding sequence
atggccactgccaatagcattatcgtgttagacgacgacgacgaagacgaggcagctgcccagcccggacccagtcacccgctgcccaacgcagcctctcctggggctgaggcgccttcttcttctgagccccacggagcaagaggcagctcatcaagcggcggaaaaaaatgttacaagctggagaacgaaaaactctttgaggaatttctcgaactgtgcaaaatgcagaccgctgaccatccagaggttgtgccgtttctctataataggcaacagagggcacattccctgtttctggcctctgccgaattttgtaatatcctttctcgcgttctcagtagagcacgcagccggcctgcgaagttatatgtgtatatcaatgagttgtgcaccgttctgaaggcacattccgccaaaaaaaagctgaacctggccccagcagccaccacatctaacgagccaagcggaaataatcctcccacacacttatctctggatcctaccaacgccgagaacactgctagtcaatcatag

SEQ ID NO: 220410 - DNA, 537 bp, Artificial Sequence
  Description of Artificial Sequence: Synthetic coding sequence
atggcaaccgccaactccattatcgtgctggatgacgacgacgaagatgaggcagcagcccaacccggaccgtcacaccctcttccaaacgcagcctctcctggagccgaagcgccttcatcttctgaaccgcacggcgctcggggatccagttcatccggcggtaaaaagtgctacaagttagaaaatgagaagctctttgaggagttcctggagttatgtaagatgcagactgcagatcatcccgaagtagttccttttctctacaacagacaacagagagcgcattctctcttcttggctagtgccgagttctgcaatattctttctagggtgttgtctcgggctaggtcaaggccggctaaattatatgtgtacatcaacgagctgtgtaccgtgctgaaagctcactccgcgaagaagaagctgaacctggcccctgctgccactactagtaatgaaccatcgggtaataatcctcctacccatctctcgctggacccaaccaatgccgaaaacacagcctcccagtcctag

SEQ ID NO: 220411 - DNA, 2223 bp, Artificial Sequence
  Description of Artificial Sequence: Synthetic coding sequence
atggccacagcgaattccattattgtgctggacgacgatgacgaggatgaagcggcagcccagccaggcccttcacatcctctgccgaacgccgcttcccccggagcagaggctccttcttcatctgaaccacatggcgcaaggggctccagctcatccggagggaaaaagtgctacaaactcgaaaatgaaaagctatttgaggagtttctggagctttgcaaaatgcagacagctgaccatccagaggtggtgcctttcttgtacaatcgccagcagcgggctcattctctcttcctggcttcagcagagttctgcaatattctcagtagggtgctttcacgggctaggagccgccctgccaagctttatgtgtatattaatgaactttgcacagtgcttaaggcccactccgcgaagaaaaagctgaatttagctcctgccgctacgactagtaacgagcccagcggcaacaaccctccaactcatctgtctctggaccctactaatgctgaaaacactgcatcccaaagccccagaacccgcggttctcgccgacagattcagcgcctagagcagctgcttgccctgtatgtcgctgagatcagacgactgcaggagaaagagttggacctgtccgagttggatgatcccgactccgcatacctgcaggaagctcgcctaaaacgtaagctgattagacttttcggccgtctgtgcgagctgaaggactgctcttctttgactggaagagtaatcgaacaacggattccttacagagggaccagataccctgaggtgaatcggagaattgaacgtctgatcaataagcctggacctgacacctttcccgattacggggatgtactacgggcagtagaaaaagcagcagccagacactccctgggactgccacggcaacaactgcagctgatggctcaagacgctttccgcgacgttgggatcagattgcaggagcgaaggcacctggacttgatttacaattttggctgccacctgactgacgattacagaccaggcgttgatcccgcactgtcagacccagtgttggctaggcgcctgagggaaaatcgaagcctggcgatgagccggttggacgaggtcatttcaaagtatgcaatgcttcaggacaaaagcgaagaaggggaacgcaaaaagcgtcgagccaggttgcagggcacatcctcacatagcgccgacacacctgaagcgtcactcgactccggcgaaggtccttctggaatggcatctcagggctgtccaagcgcatctcgggcagagacagatgatgaagacgatgaggaaagcgacgaggaggaggaggaagaggaagaggaggaagaggaggaggccaccgattcagaagaagaagaggacctcgagcaaatgcaggaagggcaggaggacgacgaagaagaggacgaggaagaggaagcagccgcaggtaaagatggcgataagtctccaatgagctcgttgcagatttccaacgagaagaacttagagccagggaaacaaatcagccggagcagcggagagcagcagaataagggccgaatagtgtcacccagcctcctgagtgaggaacctttggccccatcgagcatagacgcagagtctaatggggagcagccagaagaacttactctcgaagaggagagtccagtttcccagctgttcgagctcgagattgaggcactgcctctcgacacaccaagctccgtggagacagacatcagcagcagtcgaaaacaatctgaggaaccctttactacagtgttggagaacggggcaggtatggtgtcgtccactagttttaacggcggtgtatctcctcataactggggcgactcagggcctccatgcaaaaaatcccgcaaagagaaaaagcagactggctcaggccctttaggtaactcgtacgtcgagcgccagcgatccgtgcatgagaagaacggtaagaagatatgtacacttccgtccccaccgtctccgttggcttccttggctccggtggccgattcaagcacccgagtggacagcccttcccatgggctggtgacaagctctctctgtattccttctcccgctcgtctgtcccagacacctcacagccaaccgccaagaccgggaacatgcaaaacctccgtggctactcagtgtgacccagaggagatcatcgtacttagcgactcagactag

SEQ ID NO: 220412 - DNA, 2223 bp, Artificial Sequence
  Description of Artificial Sequence: Synthetic coding sequence
atggccacggccaacagcatcatcgtcctagacgatgacgatgaggacgaggccgcagctcagccgggtccgtcccaccctctacctaacgccgctagtccaggcgcagaggcccctagtagttccgagcctcacggagcccgtggatcttccagctcgggcggaaaaaaatgctacaaactggaaaatgagaagcttttcgaggagttcctcgaattgtgcaagatgcagacggcagatcaccctgaggtggtcccctttttgtacaaccggcagcaacgcgcacacagcttgtttttggcttcagcggaattctgtaacattctcagtagggtcctatctagagcacgttcccgtccagcaaagctttacgtgtacatcaacgagctttgtacggtgttgaaggctcactctgccaagaagaaactgaatctcgcaccagctgctacaacttctaacgaaccatccggaaataaccccccaacccacctgtccctcgatccgacaaatgctgaaaacacggctagccagtcccctcgcactcgaggcagcagacggcagattcagcgcctggaacagttgctcgctctctatgtggccgagatccgaaggttacaggagaaagaactggacctgtccgagctcgatgatcccgactccgcctacctgcaggaagccaggctgaagcggaaactgatccggctatttggcaggctctgtgaactaaaagattgcagctcattaactggtcgcgtcatcgaacagagaattccatacagaggtacaagatatcccgaggtaaatcgaaggatcgagaggttaatcaacaaacctggaccggacacatttccagattacggggacgtgttgcgcgctgtagagaaagctgccgcacgacacagcctgggactcccacgccagcaactgcagctgatggcccaggatgcattccgagatgttgggattagactccaggagaggcggcacttggatctgatctacaacttcggctgtcaccttacggatgattaccgtccaggggtcgaccctgccttgtcagatcctgtgctggctcgacgattgcgggagaacagatcactggctatgtcacgtctggatgaagtcattagtaaatatgccatgcttcaggacaagagcgaggagggagagcgtaaaaaaaggcgggcacggctccagggcacttctagtcacagtgccgatacgcctgaggctagcctggattcgggcgagggaccatccggaatggccagccagggctgcccatcagcctcccgggcagaaactgatgacgaggacgatgaggaatctgacgaggaagaggaggaagaagaagaggaagaagaagaggaggccactgatagtgaggaggaagaggatcttgagcaaatgcaagaagggcaagaggatgatgaagaggaggatgaggaggaagaagccgctgctggaaaggacggcgataaaagcccgatgtctagcttgcaaattagcaatgagaagaatctcgaacccggtaaacagatcagccgctcctctggggaacagcagaataaggggagaatcgtgtccccttcattactctctgaggaaccactggccccatcctcgattgacgctgaaagcaacggagagcagcccgaagagttaactctcgaagaggaaagtcccgtgtcacaactctttgaacttgagatagaggccctcccattggacacgccctcgagcgtggagaccgatatttccagttctagaaagcaatccgaggagccctttacaaccgtgctcgagaacggggcaggtatggtcagcagcactagcttcaacggcggtgtgtccccgcacaactggggtgatagcgggccaccatgcaagaagtcacgcaaagaaaagaagcaaaccggatctggaccactgggtaatagctacgtggaaagacaacgtagcgtacatgagaagaatggaaaaaaaatctgcaccctgccctcaccaccttcacctttagcgagcctcgccccagtggcagatagctcaacccgcgtagattcaccatctcacgggctggtgactagcagcctctgtatcccaagtccggcaaggcttagtcagaccccccactcccagccccctagacctggcacatgcaaaacatcagtagccacacagtgtgatcccgaggagataattgttctctcagattcagattag

SEQ ID NO: 220413 - DNA, 393 bp, Artificial Sequence
  Description of Artificial Sequence: Synthetic coding sequence
atggcaactgccaatagcataatagtgcttgacgatgacgacgaagatgaagccgcagcacagcccggaccctcccaccccctgccaaatgctgcatcgccaggggctgaggcaccctctagtagcgagccacatggcgctcggggtagttcttccagtggcggtaagaagtgctataagctagagaatgaaaaactgttcgaggaattcctggaattgtgtaaaatgcagacagcggaccaccctgaagtcgtgccgtttctttataacagacagcagagagctcatagcttgtttttggctagtgccgaattctgtaacattctaagccgggtgttatcccgcgctcgctcacgaccagccaaactttacgtttatattaatgagttgtag

SEQ ID NO: 220414 - DNA, 537 bp, Artificial Sequence
  Description of Artificial Sequence: Synthetic coding sequence
atggccaccgcgaactccatcatcgtgctggacgatgacgacgaagacgaagccgcagcacagcccggacccagtcaccccttgcccaacgccgcaagtccaggcgctgaggcgccaagttcctcggagccccacggagcccgtggatcaagtagctcaggcggaaagaagtgctataagctagagaacgagaaattgtttgaggagttcctggaactctgcaagatgcaaacagcagatcaccctgaagtagtgccgtttttgtacaaccgccagcaaagggcccattcactgttcttggcttcagctgaattttgcaatattctctcacgcgtgctcagcagggcaaggagcaggcccgcaaagctgtacgtctatataaacgaactatgcaccgttctgaaagcccacagcgcaaagaagaagctgaacctggcccctgctgcgaccacctccaatgaacccagcggcaataatcctcccactcacctgtccctggatcctactaatgctgaaaatactgcctctcagtcctag

SEQ ID NO: 220415 - DNA, 2223 bp, Artificial Sequence
  Description of Artificial Sequence: Synthetic coding sequence
atggccactgccaactcaatcatcgtattggacgatgacgacgaggacgaggccgcagctcagcctgggccttcccaccctctccctaatgctgccagtcctggcgctgaggccccttcgagcagcgaaccccacggagccaggggctccagctcttcggggggtaagaagtgctacaagttggaaaatgaaaagttatttgaggagttcctggagctgtgcaagatgcagactgcggaccacccagaggtggtgcctttcctctataacaggcagcagagagcacattcactattcctggcatcagctgagttttgcaacatcctgagcagggttctgagtcgcgcaagatcccggcctgcgaagctctacgtttatataaatgagttgtgtacggtcctgaaagcccacagtgccaaaaagaaactcaacctggcacccgctgctactacctccaatgagccaagcgggaataacccgccaacccatctttccctggacccaacaaacgccgagaacaccgccagccaaagcccaaggactcgcggatcacgcagacagatccagcgcctcgagcaattgctggcactgtatgtggcagagatccgtcgcctgcaggagaaggagttggacctgtctgagctcgacgaccccgactctgcatacttgcaggaggcgcgactcaaaaggaaactgatccgactgttcggccgattatgcgaactgaaggattgctccagtcttaccggcagggttatcgaacagagaatcccttaccggggtacccgctatcctgaggtaaaccgccgtatcgaacgcctgatcaataagccaggacccgacacctttccagattacggcgatgttcttagggcagtcgagaaggcagctgcacgccactcactgggtctacctcggcagcagctgcaactgatggctcaagatgccttcagagatgtgggaatccggctccaggaacggagacacctggacctaatctataatttcggttgccacctgactgatgactatcgccctggagtggatcccgctctgtccgaccctgtcctggccaggagactgagagagaaccggtctctggccatgtcacgtctggacgaggttattagtaagtatgcaatgctgcaggacaagagcgaggagggcgagagaaaaaaaagacgcgcaagactgcagggtacctcatcccatagtgccgacacgccagaggcctccctcgattctggagaaggccctagtgggatggcatcacagggctgtccctcagcctcgagagctgaaacagatgacgaagacgacgaagagagtgatgaagaggaggaagaagaagaagaggaggaagaagaagaggccaccgattccgaggaggaggaagacctggaacaaatgcaggagggccaagaggacgacgaggaggaggatgaagaagaggaagctgcagcaggcaaagatggggataaatccccaatgagttccttacagatctctaatgagaaaaaccttgaaccaggcaagcagatctcccgctcgagcggagagcagcagaacaaaggacgcattgtgagtccaagtcttttaagcgaggaaccattggcccctagttctattgatgccgagtcaaacggcgagcagcccgaggaactcactctagaggaggaatctcctgtgtcccaattgttcgagttggaaatagaagctctgcccctggataccccgtcctccgtggaaaccgacatctcttcttcccgaaagcagtccgaggagccctttacaactgtattagaaaacggcgctggaatggtctcaagcacaagcttcaatggaggcgttagcccgcataactggggggattctggccctccatgcaagaagtccagaaaagaaaagaaacagacgggttccggcccactcggaaactcctacgttgaaagacagcggagcgtgcacgagaaaaacggcaaaaagatatgcaccctgccgtctccgccaagccccctggctagcctggctcctgttgctgattccagtaccagggtagattctcccagccatggtctagtgacatcttcactgtgtatcccaagcccggctcgcctcagccagacccctcattctcagccaccgagacctggaacttgcaaaacgtccgtggccacacagtgtgatccagaagaaattattgtgctcagcgactcagactag

SEQ ID NO: 220416 - DNA, 147 bp, Artificial Sequence
  Description of Artificial Sequence: Synthetic coding sequence
atggccaccgctaatagtattatcgttctcgacgatgacgacgaggatgaggcggctgcacagccaggccctagccaccctctccccaacgcagcctccccgggagctgaggccccatcatctagcgaaccccacggagctcgctag

SEQ ID NO: 220417 - DNA, 393 bp, Artificial Sequence
  Description of Artificial Sequence: Synthetic coding sequence
atggctacagctaactccataatcgtgctagatgacgatgatgaggatgaagccgctgcacagcccggaccaagtcatccactcccgaacgccgcaagcccaggcgctgaggccccttcgagcagtgagccccacggagccaggggaagctcctcctctgggggtaaaaaatgttacaagttggaaaacgagaaactgtttgaagagttcctggaactgtgtaagatgcagactgcggatcacccagaggttgtgccatttctctacaatcgacagcagagggcccacagcctgtttctggcctccgcggagttttgcaacatcctctctagggtcctgagcagggcgagatcacgtccagccaaactctacgtttacatcaatgagctgtag

SEQ ID NO: 220418 - DNA, 537 bp, Artificial Sequence
  Description of Artificial Sequence: Synthetic coding sequence
atggctactgccaatagtataattgtcctggatgatgatgatgaagacgaggcagcagcacaaccgggaccatcgcaccctctcccaaacgccgcatctcctggtgctgaagcgccaagcagttctgagcctcacggcgcacgagggagcagctcttcaggcggtaaaaaatgctataaactcgaaaatgaaaaactctttgaggaattcctggaactatgcaagatgcagacagctgaccacccagaggtcgtgcccttcctctataaccgccagcagcgggctcactctttgtttcttgcctcggccgaattctgcaatatcctttcaagggttctcagtcgcgcacggtcaaggcccgcaaagctgtacgtctacataaacgagttatgtactgttctcaaggcccatagtgccaagaagaagctgaaccttgctcctgctgccacaacatccaatgagccatcaggaaataacccacctacccacttaagtctcgaccccaccaacgcagaaaatacggcctcccagagttag

SEQ ID NO: 220419 - DNA, 2223 bp, Artificial Sequence
  Description of Artificial Sequence: Synthetic coding sequence
atggcaactgccaatagcattattgtgctggacgatgacgacgaagatgaggctgcggctcagcctgggccaagccatccacttccaaatgcagccagcccgggagccgaagccccatctagctcagagccacacggggctaggggaagcagcagctctggaggtaagaagtgttacaaactagagaacgaaaaactgttcgaggagttcctggaactctgcaaaatgcagaccgcagatcacccagaagttgtgccgtttctctataatcgccagcagcgcgcacactctctgtttctcgcctccgctgagttttgtaacattttgtccagggtcctgtctagagcaaggtcaagacctgcgaagctttacgtgtatataaacgagctttgtacggtgctcaaggcccactcggcgaagaagaagctcaacttggcgcctgctgctaccacgagtaacgaaccctcaggaaataaccctcctacccatctgtccctggaccctaccaacgccgaaaatacggccagccagtcgccaagaacacggggatcaaggagacagattcagaggctggagcagctgctggccttatacgtggccgagatcaggaggctgcaagagaaggagttggatctgtctgagttagatgatcccgactctgcgtatctccaagaggccaggctgaagcggaaactaattcgattgtttgggagattatgtgaattaaaagactgttcttccctaaccgggcgagtcattgaacagcgcatcccataccggggaactcggtatccggaagtaaataggcggatcgaacgactgatcaataagccgggacccgacaccttccccgattatggtgacgtgcttcgggcagtcgagaaagctgcagccagacactccctcgggttaccccgtcagcagctgcagctgatggctcaggacgcattccgggacgttggaattcggctgcaggagaggcgccatctggatcttatctataactttgggtgccatcttaccgacgattaccgccctggcgtggatcccgctcttagcgaccctgtcctggctcgtagattgcgggagaaccgctccctcgccatgagtagattggacgaagtgatctccaaatacgccatgctacaagacaagtcagaagagggcgaacgcaaaaagcgtcgtgcacgcctgcagggaacgagttcccactcagccgatacaccggaagcttccctggactccggagagggtcccagcggcatggcttctcaggggtgccccagtgcctccagagcagaaacagatgacgaagatgacgaggaatctgacgaggaagaggaggaggaagaagaggaagaagaagaagaggctacagattctgaagaggaagaagacctggagcagatgcaggaggggcaggaagatgacgaggaagaggacgaagaagaagaagctgccgctggcaaggatggggacaaaagccccatgtcaagtttgcagattagcaacgaaaagaatcttgagccaggcaaacaaatttccaggtccagtggcgaacaacagaacaagggaagaatcgtgtccccaagcctgctcagtgaggagcccctggccccaagtagcatcgacgctgaaagcaacggcgaacaacccgaggagcttacgttggaggaggaaagccctgtgtcccagctgttcgagctggagatcgaagctctgccccttgatacgccgtcctctgtggaaactgacatctcgtcttccaggaaacagagcgaagagccgttcactacagtactggaaaacggcgcaggcatggtgagcagcacctcatttaatgggggagtctcaccccacaactggggagactcaggtccaccttgcaagaaatcccgaaaggaaaagaagcagaccggctccggccctctaggcaactcttacgttgagcggcagagaagcgtgcacgaaaagaacgggaaaaaaatatgcaccctaccctcaccgccttccccactggcaagcctcgcccctgtcgcagactcttcaacaagggtcgattcaccatcgcacggcctggtcacttcgtcactctgcattcccagccctgccaggctgagtcagacaccacattcccagcctccccgacccggtacatgcaaaacaagcgtggccacacaatgtgaccccgaggaaatcatagtactcagcgattccgactag

SEQ ID NO: 220420 - DNA, 147 bp, Artificial Sequence
  Description of Artificial Sequence: Synthetic coding sequence
atggctaccgcaaacagcataattgtgctcgatgacgacgacgaagatgaagccgcagcccagcccggaccgtcccacccgctacctaatgctgccagtccaggggctgaggcgccaagctccagtgagcctcatggggcacgatag

SEQ ID NO: 220421 - DNA, 1998 bp, Artificial Sequence
  Description of Artificial Sequence: Synthetic coding sequence
atgcagaccgcggatcaccccgaggttgtgccatttctgtacaatcgccagcaacgggctcatagtctttttctagcctctgcagagttttgcaacatactatcccgggtgttgtcccgggcacggagtcgccctgccaaactatacgtgtatattaatgagctgtgtacagtgctgaaggcccactccgccaagaagaagctgaaccttgccccagccgcaaccaccagcaacgagccatctgggaataacccacctacacacctgtccctcgacccgactaatgccgaaaatactgcgagtcagagccctaggacccgcggtagtaggcgccagatccagcgattggaacagttgttagctctttatgtcgcagagattagacgactgcaggagaaagagctcgacctgtccgaattggacgatcctgacagcgcttacttgcaggaagcacgcctgaagagaaaactgatcagactttttgggagactgtgtgagttaaaagattgttcttcgctgactggcagagtcatagagcagcgaataccctacagaggaacgcgctatccagaagtgaacagaaggatcgagcggctgatcaacaagcccggacctgacacctttcccgattacggggacgtcctccgtgcagtggagaaagctgcagctcggcatagtctagggctgccacgccagcagctgcagttaatggctcaagatgcctttcgcgatgttgggattcggctccaggagcggcgacacttggatctaatatataattttggctgccatctaacagacgactaccgtccaggggttgacccggcattgtcggaccccgtactagctagacgcctgcgcgagaaccgctccctcgccatgtcccggctcgacgaggtaatcagcaaatatgcgatgctgcaggataaatcagaagaaggcgagcggaagaagcggcgtgcccgtctgcaggggacaagcagccactctgctgacactcccgaggcgagcctggatagcggggaaggcccttcagggatggcatcacagggctgtcccagcgcgagcagggcagaaactgatgacgaagacgatgaagaaagcgacgaagaggaagaggaagaggaggaggaagaggaggaggaagctactgattctgaggaagaggaagacttggagcagatgcaggagggacaggaagatgatgaagaggaagatgaagaggaagaggccgcagccggaaaggacggggataagagtccaatgtcatcacttcagatctccaatgaaaagaatctcgagcccggtaaacaaatcagccggtctagcggggagcagcagaataaggggcgtatcgtgagcccttcactgctgagcgaagagcccctcgcccctagctcaattgacgccgagtctaatggtgaacaaccagaagaactaaccctggaagaagagagtcctgtatctcaactcttcgaacttgagattgaggcattgccattggatactccttcctctgtggagactgacatatcttcatcccgtaagcagtctgaggaacccttcacaactgtcttggaaaatggagccggaatggtgagttccacatcgttcaacggcggtgtgagtcctcacaattggggcgatagtggcccaccctgcaagaaaagccgaaaagagaaaaaacagacaggcagcggaccgctgggcaactcctatgtggagcggcagcggtccgtccatgaaaaaaacggtaaaaagatttgcacgctcccttcacctccatccccactggcgtctctagccccagtggccgacagctccacaagggtcgactctccttcacacggactggtgaccagctccctgtgtatcccgagtcccgcaaggctttcacagacaccccattctcagcccccacggccaggcacatgtaaaactagcgtcgcgactcagtgtgatccagaagagatcattgtgctgagtgatagcgactag

SEQ ID NO: 220422 - DNA, 1998 bp, Artificial Sequence
  Description of Artificial Sequence: Synthetic coding sequence
atgcaaaccgccgatcaccccgaggttgtcccctttttgtacaatcgccagcagagggctcactcactcttcctcgcctcggctgaattttgcaacatacttagccgcgttctgtccagggccagatcccgacctgcgaaattgtacgtgtacattaacgaactttgcacagttctgaaggcacactccgcaaagaaaaaacttaacctagccccagccgcaacaacatccaacgagccctccggcaataatccccctacccatctcagcctggaccccacgaacgccgagaatacagcgtcgcagtctccacgcacccggggtagccggagacagattcagagattggagcagctgcttgccctctacgtagcagagatccgtcgccttcaggaaaaggagctggacctgtctgagcttgacgaccccgattcagcctatcttcaggaggcaaggctgaaacggaaactcataaggctgttcgggcgtctatgcgagctgaaagattgttcatctctcaccggaagagtgatcgaacagaggattccttaccgaggcactcgatatccagaggttaacaggcggatcgagcgcctcattaataaacccggacctgacactttcccagattacggggatgtactaagggctgtcgagaaggccgctgcccgtcacagcctgggcctccccaggcagcagctgcagctgatggcccaggacgccttcagggacgtcggcatccgcttgcaggaaaggagacacctggacttaatttacaactttggctgccatctcaccgacgattatcggcctggtgtggatccagcactgtcggaccccgtgctggcaaggcgccttcgcgaaaatcgcagcctcgctatgagccggctggacgaagtgatcagtaaatatgccatgctccaggacaagtcggaggaaggtgagaggaagaagagaagagcacgcttgcaaggaacgagtagccatagcgctgataccccagaggcttctttagactctggagaaggaccatctggcatggccagccagggctgtcctagcgccagcagagctgagacggatgatgaggacgatgaggagtctgatgaagaagaagaggaagaggaggaggaggaggaagaagaggccacagactccgaggaggaggaggacttggagcagatgcaggaaggtcaagaggatgatgaggaagaggacgaagaagaggaagccgcagcgggaaaagacggggataaatctcctatgagctccctgcagatcagcaatgagaagaacctggaaccaggtaaacagatttcgcggtctagtggcgagcagcagaataaagggaggatcgtttccccaagtctgctcagtgaggaaccactggctccgtcctccatcgacgcagagtctaatggcgagcaacccgaagagctaactttagaagaggaatcaccagttagccagctcttcgagctggagattgaagccctcccattggacaccccatcctccgtcgagactgacatcagtagttctcgaaagcagtccgaagaaccattcacaacggtactcgaaaatggcgcaggaatggtcagctccacaagctttaatggaggtgttagtccccacaactggggggattccggcccaccatgcaagaaaagtaggaaggaaaagaagcagaccgggtctggcccattagggaacagctacgtagagcgtcagaggtccgtgcacgaaaagaatggaaagaaaatctgtacgctgccttcgccacccagccccctggcttcactggcccctgtagccgattcttcaacccgggttgatagtccctcccatggcctcgtcacttcttccctctgcatccccagtccagctagactgagccagactcctcattctcagccacccaggcctggtacctgtaagacttccgtggccacccaatgcgaccccgaagaaattatcgtgctgagcgatagtgattag

SEQ ID NO: 220423 - DNA, 1998 bp, Artificial Sequence
  Description of Artificial Sequence: Synthetic coding sequence
atgcagacagctgaccaccctgaagtagtacccttcctctacaatagacagcagcgcgcacattcactctttctcgcttcagcagagttctgtaatatcttaagccgggtcctgagcagagcacgaagtcgcccagccaagctgtatgtgtacatcaatgagttgtgtacagttctgaaggcacattccgcaaagaagaagcttaatctggcccctgctgcaacaactagtaacgaaccctcaggtaacaaccctccaacccatctcagtctggatcctaccaacgccgagaacacagcaagccagtcaccccgaactagaggctctcgcaggcagattcagcgcctggaacagctactcgcactgtatgtggctgagatccggaggctgcaggaaaaagagttagatctgtcagaactcgatgatcctgactccgcgtatctgcaagaggctaggctcaaaaggaaactgatacgccttttcggcaggctctgcgagctcaaggactgttcctctcttactggcagggtaatagagcagaggatcccttaccgcggtaccagataccctgaggtgaacaggcgaatcgaaagattaattaacaagcccggaccagatactttccccgactacggcgacgtgctgagagccgtggagaaagccgctgcgaggcattcacttggattaccgagacagcaactgcagttaatggcccaagacgctttcagagatgtggggattcggctgcaggaaagaagacacctggacctgatatataatttcggatgtcacctgaccgacgattatcggcctggagtagacccagccttgtccgatcctgtccttgcacgcaggttaagggagaatcggagcctggctatgagtcggttggatgaggtcatttcaaagtatgccatgcttcaggacaagtccgaagaaggtgagaggaaaaagcggagagctcggctgcaaggaacaagttcacattctgctgacactcccgaagcctccctcgatagcggcgaagggccatcgggaatggcctcccagggttgcccctcagcttcccgggcagaaaccgatgatgaggatgatgaagagagcgatgaagaagaggaggaggaggaggaagaggaggaggaagaagcgaccgattctgaagaggaggaagacctcgagcagatgcaggagggacaggaggacgacgaggaggaggacgaggaggaagaggctgctgcgggtaaggatggagataaaagcccaatgtcctctcttcagatttctaatgagaaaaatttggagcctggcaaacaaatctctcggagtagtggggagcagcagaataaaggccgaatcgtgtcaccgagcctcctctcagaggaaccactagccccttcctctatcgatgccgaatctaacggcgagcaacctgaagagttgacattggaggaggagtcgcccgtcagccagctgttcgaacttgagatcgaggccctgcccctggacaccccatccagcgtggaaactgacatatcttcgtccaggaagcagtcagaagaaccttttacaacagtgttggagaatggtgccggtatggtgtcgtccaccagtttcaatggtggggtatcaccccacaactggggggattccggccctccctgcaagaagtcacgaaaggagaagaagcagacagggtccggaccattgggaaacagctatgtggaaagacagcgcagcgttcatgagaagaacgggaaaaagatctgtactctgccaagccctccttcaccactggcatcacttgctcccgtggccgattcctccaccagggtggacagtccctcccacgggcttgtgacctcgagcctgtgcattccatcgccagcacgtttaagccaaacccctcattcccagcctccaagacctggcacttgcaagaccagtgtggccacacaatgcgatcctgaagaaatcattgtgctgtcagactctgactag

SEQ ID NO: 220424 - DNA, 1998 bp, Artificial Sequence
  Description of Artificial Sequence: Synthetic coding sequence
atgcaaacagccgatcatccagaggtagtgccctttctttataaccggcagcaacgggcacatagtctgttcctggccagtgcagaattctgcaacattctaagccgggtgctgagtagagcaaggtcacgcccagccaaattatatgtctatatcaatgaactgtgcactgtgctgaaagcccattcagctaaaaagaagctgaacctagcaccagctgccactacatcaaatgagccctccggaaataatcctcccacacacctctcactcgaccctaccaatgctgagaacacggcgtctcaatctcccaggactagaggttcacgccgacagatccagcgactcgagcaactcctggccttgtacgttgcagagatccggcgtttgcaagaaaaggaactggacttaagtgagctcgacgacccggacagtgcctacctgcaggaggcccgactgaaacgcaagttaatcaggctttttggccgactgtgtgagctcaaggattgcagcagtctgaccggaagagttatcgaacagcggatcccgtaccggggtactagatatcccgaagtcaatcgcagaatcgagcgcctgattaacaagcctggccctgatacttttcctgattacggcgacgtcttacgagcagtcgaaaaagctgccgctcggcattccctcggactaccccgacagcagctccaactcatggctcaggatgcgtttcgagacgtgggcattaggctgcaagagcggaggcatctggatctgatttataatttcggttgtcacttgactgatgactacagaccgggtgtggatcccgctctgtcagacccggtcttagcacgacggctgagagaaaaccgatcccttgcaatgagccgacttgatgaggtcatttccaagtatgccatgctgcaagataagagtgaggagggagagagaaagaagaggcgggcaagactgcaaggaacatcctcacactctgctgatacccccgaagcctctttggacagtggcgagggtcccagtggaatggcctctcaaggttgccccagcgcctcccgagctgagacagatgatgaggatgatgaggagtcagatgaggaagaagaggaagaggaggaggaagaggaagaggaggccaccgattctgaagaggaagaggatctggagcagatgcaagaaggtcaagaggacgatgaggaggaagacgaggaggaagaggcagcggctggcaaagacggagacaagagccccatgagctccttacaaatctccaacgagaagaatcttgaacccggaaagcaaataagtagaagcagtggcgagcagcagaataaaggacggatagtatctcctagtctgctgtccgaagagcccctggcccctagtagcatcgacgctgagagtaatggggagcaaccggaagaattgacactggaagaggagagcccggtgagccagctgttcgagcttgagattgaggccctgcctctcgatactcctagttctgtggaaacagacatcagttcgtctcgcaagcagagtgaagagccctttaccaccgttctcgaaaacggtgctgggatggtgtcctcaacttcatttaatggaggcgtgagtcctcacaactggggtgattccggacccccttgcaaaaagagtcgcaaagagaaaaagcaaaccggttctggaccactgggcaatagctacgttgaaagacagagaagcgttcacgagaagaatggtaaaaagatatgcacccttccttcacccccaagtcctctcgccagtctcgccccagttgctgactctagtacacgggtagacagtccaagccatgggctggtcacatcttctctgtgtataccttccccggctcgcttgtctcagaccccccatagtcagcctcctagacccggaacctgcaaaactagtgtggctacccagtgcgacccggaagagatcattgtgctgagtgatagcgactag

SEQ ID NO: 220425 - DNA, 1080 bp, Artificial Sequence
  Description of Artificial Sequence: Synthetic coding sequence
atgaaagccactataatactgctcctcctggcccaggtctcttgggcgggaccattccagcaacggggtctgtttgactttatgcttgaggacgaggccagcggtattggacccgaagtgccagatgatcgcgattttgaaccttccctgggcccagtttgtccattcagatgtcagtgtcatctccgtgtggtccagtgcagtgacctgggactggataaagtgccaaaggacttaccccctgatacgaccctactcgatttgcagaacaataagataaccgagatcaaagatggggattttaagaacctgaaaaacctgcatgcccttatactcgtgaataacaaaatcagcaaggtatctcccggagcttttacgccactggtcaagcttgagagactgtacctatccaagaatcagctaaaggaactgcctgaaaagatgcccaagacgcttcaagaacttcgagctcatgaaaatgaaatcactaaggtccgcaaggtgactttcaatggtctgaatcagatgatagtgatcgaacttggaacaaatcccttaaaatcttccgggatagaaaacggggcttttcagggaatgaagaagctctcatatatcaggatagcagacactaatataacctcaatcccacaaggactcccacctagtcttactgagctgcacctagacggtaataagatatcccgggttgacgccgcaagcttgaagggtttaaacaacctggcaaagctggggctctccttcaatagtatttcagctgttgacaacggctctcttgcgaacacaccccacctccgagaactacatctggacaataacaagttaaccagagtcccagggggacttgccgagcataaatacatacaggtagtatacctgcataacaataacatttctgtagtcgggagttctgacttctgcccacccggtcacaatactaaaaaggcctcctactcaggagtgagtctgttcagcaatcccgtgcagtattgggagatccaacccagcactttccgttgcgtgtacgtgcggtcagcgattcagctgggtaattacaagtag

SEQ ID NO: 220426 - DNA, 7092 bp, Artificial Sequence
  Description of Artificial Sequence: Synthetic coding sequence
atgccagtgctgggcgttgcctctaaattgcgccagcctgcggtaggctcaaaaccagttcatacagcactgccaatcccaaatctggggaccactgggtcgcagcactgctcatcacgacctctggaattaaccgaaacagagagctcaatgctgagctgtcagctggcccttaagagcacctgtgaattcggtgagaagaaacccctacaaggtaaagccaaggagaaggaggatagtaagatctacactgactgggcaaaccactacttggctaagtccggacataaaaggctcattaaagatctccagcaggatattgccgatggtgttttattggcagagatcatacagattattgccaacgaaaaggttgaggatattaacgggtgtcctaggtcacagtctcaaatgatcgaaaacgtggatgtgtgtttgagcttcctggccgcaagaggggtgaacgtgcaggggctatctgccgaagagataagaaacggaaatctcaaggcaattcttgggttatttttctctctttcccgctataaacagcaacagcatcaccagcagcagtattaccaatcattggtagagctgcaacagagagttacacatgctagccccccatcagaagcatcacaagcgaagacacagcaggacatgcagtcttccctggctgcacggtacgcgacacagtccaatcatagcggcattgctacatcgcagaagaaacccaccaggctccctggcccaagcagagtgccagccgcagggtccagttcaaaagtgcagggcgcttccaacctgaatcgtaggtctcaaagctttaactccattgacaagaacaaaccgcctaactatgctaatggaaacgaaaaggacagctccaaaggacctcagagctcttccggggttaacggcaacgtccagccacctagcacggccggtcagccacccgcatctgccatcccctcgccttcagctagcaagccctggagatccaaatccatgaacgtcaaacacagcgctacttcaactatgctaacagtaaagcagtcatccacagccacgagtcctaccccttcctcagaccgactgaaaccacccgtgtccgaaggggttaagacggcacccagcggccagaaaagcatgctcgaaaagttcaagctcgtcaacgcccgtactgcattacgccctccacagccgccaagttccggcccttcggatgggggaaaagatgacgacgccttctccgagtccggggaaatggaaggtttcaactctggccttaactcaggcggaagcaccaactcaagcccaaaagtttctccgaaactggctccacctaaggcgggtagtaagaacttgtctaataaaaaatccctgctgcagcccaaggagaaagaagagaagaacagggacaaaaataaggtgtgcacagagaaaccagttaaggaggaaaaagaccaggttacagagatggcacccaaaaaaacttctaaaattgcctcactgatccccaaggggagtaagaccacggcagcgaaaaaagaatccctgattccttccagcagtgggatcccaaagcctgggtctaaagtccccactgttaaacagaccatcagcccagggtctacggcctccaaagaaagcgagaaatttcgtactaccaagggttcgcctagtcagtccctcagcaagccaatcacaatggaaaaggcatccgcatcatcttgccctgcccctttggaaggaagggaagctggccaggcctcacctagcggatcctgtacaatgactgtcgcacagtcttctgggcagagtaccggtaatggcgctgtccaactgccccagcagcaacaacactctcaccccaatacggcgacagtagcaccgttcatctaccgtgcacactctgagaacgagggaacagccctgcccagcgccgattcctgcacgtctcccactaaaatggatctgagctacagcaagacggccaagcagtgcttggaggaaattagcggcgaagaccctgaaacccgccgtatgcggactgtcaagaacattgctgacttgcggcagaacttagaagagacaatgagttcactccgtgggacacagatttcgcattctacactggagaccactttcgatagcaccgtgactaccgaggtaaacggacgcaccatcccaaacctaacttcgcggccaactccaatgacatggcgcctcgggcaggcttgcccaagactgcaagccggagacgcaccatctctcggggctggttatccaagaagcggcactagcagattcattcacacggacccttcccggtttatgtacacaactccactgagacgcgctgctgtgtctcgcctgggcaacatgtcccagattgacatgtctgaaaaggctagctctgatttggacatgagctctgaggtagacgttggaggctacatgtccgacggagatatcctggggaagtcattaaggaccgatgacattaattccgggtacatgaccgatggaggactaaacctttatacacgaagtcttaaccgtattccagacaccgctacttcaagagatattattcagcgcggagtgcacgatgtgacagtggacgcagactcctgggacgactcttcttccgtctcatccggcttaagcgacacactggacaacatctcaaccgatgaccttaacacgacgagttcggtgagcagctacagcaacatcactgtccctagcagaaagaatacccagctgagaacagactcagagaaacggagtacaaccgatgaaacatgggactccccagaggagctaaagaaacctgaggaagatttcgatagtcacggcgacgctggcggaaaatggaaaaccgtcagctctggcctccctgaagacccagagaaagctggtcagaaggcttctctgagtgtgtcacagacaggctcatggagaaggggtatgagcgcacagggaggcgctccttcacgtcaaaaagcgggaacgtctgctctcaaaacgccaggcaaaaccgatgacgcgaaggcaagcgagaagggcaaagcgccactcaagggatcatccttgcagagaagcccttctgacgccggaaaaagctcgggagatgaagggaagaagcctccaagtggaatcgggaggtcaacagccacaagtagctttgggttcaaaaaaccctcgggagttggctccagtgccatgatcactagcagtggggcaacaatcacatccggaagtgcaaccctgggtaaaataccgaagagcgctgcaattggtgggaagagtaacgccggacgcaaaactagcttagacggaagccagaaccaggatgatgtagtactacacgtaagcagtaaaaccactctccagtaccgcagccttcctcggccatcaaagtcgagtaccagtgggattccgggacggggaggccataggagttcgacctccagtatagactctaacgtgagttcaaagagcgcaggagccaccaccagtaaattaagagagccaactaagataggtagtggacgatcgtcaccggtgaccgttaatcaaaccgataaagagaaagagaaggtcgccgtgagcgactcggaaagcgtatcactcagtggctcacccaaaagttcccctactagcgcctcagcctgcggcgctcagggtctccgacaacccggttccaagtaccctgacatcgcttcccccacttttcgcaggctattcggtgctaaggctggaggaaagtcagccagcgcccctaatacggagggcgtaaaatctagtagcgttatgccctcacctagtacgacactggcacggcaggggtctctggagagcccctcgagcggcacgggatcaatgggctccgccggagggctgagcggaagctccagcccattgttcaataagccctccgatttaaccaccgatgttatctcactcagccactctctggcaagcagtcccgcttctgttcatagcttcacgtctggcggtctggtctgggccgctaatatgtcatcctcctccgcgggatctaaagacactcctagttaccagtccatgacaagcctgcatacctcatctgaatcaattgatttgccactgtcgcaccacggatcacttagtggtcttactacgggaacacatgaggtgcagagtcttctaatgaggaccggaagtgtgcgctctaccctgagcgagagcatgcagctcgataggaatacactgcccaaaaagggtctgcgctatacaccttcttcaagacaggctaatcaagaggaaggcaaagaatggttacgcagtcactcaactggcggactgcaggacacagggaaccagtcgccactggtctcaccttcagcaatgagtagttcagctgccggtaaataccatttttctaacctcgtttctcctaccaatctgtctcaattcaatctcccaggaccatccatgatgcggagtaattcaatcccagcccaggatagtagcttcgatctctatgacgactcccagttatgcgggtccgccactagtctggaagagcggcctcgtgcaatttcacattcaggatctttcagggacagcatggaagaagtccatggaagttctctgagcctcgtgtcctcaacttcctctttatactctactgctgaggcaggcggatctctagagcagatccacaagctgcggagagaactggtggcctcgcaggagaaggtcgcaaccctcacatctcagctgtctgccaacgcccatttagtggcggcatttgaaaagtctctaggaaacatgactggaaggctgcaatctctcaccatgactgctgaacagaaggagtcagaactgatcgaactaagggagacaatcgagatgcttaaagcacagaactccgccgctcaggctgccattcagggggcactgaatggccctgaccaccccccaaaagacctgagaattcggaggcaacactcttcagaaagcgtttcgtcgatcaattcagctacctctcactcctccataggttcgggaaacgacgccgatagtaagaaaaaaaaaaagaagaattgggtgaactcgaggggcagtgagttgagatcttctttcaagcaggctttcggcaagaagaaatctacaaaaccaccttccagccattcagacatagaggagctgaccgacagtagcttgccagcgtctcctaagctaccacataatgccggagattgtgggtccgcatccatgaaaccctcccaaagcgccagcgccatttgcgaatgcaccgaggccgaagccgaaatcattctgcagctcaagtcagagctacgcgagaaggaactgaaacttaccgacatccgtctggaggctctgtcatccgcacaccatctggatcagatcagagaggctatgaaccggatgcagaacgaaatcgaaattttgaaggctgaaaacgatagactcaaggccgagactgggaacactgcaaaaccaaccaggccgccatcagagtctagctcctccacttcatccagcagctcacgccaaagcctcggtctttccctcaataatctcaacatcacagaggcagtgtcgagcgatatcctccttgacgacgcgggagatgcaaccgggcataaagatggacgatctgttaaaatcatcgtgtccatctccaagggttacggtagggctaaggaccagaaatcacaagcctatctgattggaagcatcggcgtgtccgggaagactaagtgggatgtgttggacggggtcatcagaaggctgtttaaagaatacgtgtttaggatagacacgagtacctcactcgggctctcttcggattgcattgcctcctattgcatcggggacttgattaggagtcataatctagaggtgcccgagctgcttccctgcggttatctcgttggcgataataatatcattacagtgaaccttaaaggcgtggaagagaactcactggactccttcgtgtttgataccctgatacccaaaccaatcacccagagatacttcaatctactgatggaacatcaccggatcatcctttcagggccatctggaacaggtaaaacgtacttggctaataagctggctgagtacgtgatcacgaagagtggtaggaaaaaaacagaagacgctatcgctacattcaacgttgaccataagagtagcaaggaactgcaacagtatttagcgaaccttgctgaacagtgttcggctgataataacggagtggaactgcccgtcgtcattatcctggacaacctgcaccatgttggaagcctgtctgacatctttaatggatttctcaactgtaaatataataagtgcccctacattattggcactatgaatcagggcgtgtcatcctctcccaacttggagctgcatcacaatttccgctgggtgctttgtgccaatcataccgagccggtcaagggattcttggggagatatcttcgcagaaagctgatcgaaatcgaaatcgagcgaaatattcgcaacaatgatctggtgaagataatcgattggatacccaaaacgtggcatcacctgaactccttccttgaaacacacagcagttcagacgtaaccattggccctcgccttttcctcccatgccctatggacgttgaaggaagcagagtgtggtttatggatctctggaactactcccttgtgccctacatcctggaggctgtgcgggaggggttacagatgtatgggaagcgaaccccttgggaggatccttctaaatgggtgcttgatacctacccttggtcaagcgccactctgccccaggagtcccccgctctcctgcaactaagacccgaagatgttggctatgaatcctgtaccagcaccaaagaagcaacaacgagcaaacacatcccgcagaccgacacagaaggtgatcccctaatgaacatgctaatgaagctgcaagaggcagctaattattcctctactcaatcttgcgattcagaaagtactagccatcacgaggacatactcgactcatcgttagagtctaccctctac

SEQ ID NO: 220427 - DNA, 519 bp, Artificial Sequence
  Description of Artificial Sequence: Synthetic coding sequence
atgaaggccaccatcattctcctgttactcgcccaggtgtcgtgggcgggtcccttccagcagagggggctctttgactttatgcttgaggatgaggcgtctggtatcggcccagaagttcccgacgacagagatttcgaaccttccctcggcccagtgtgtccttttagatgccagtgtcacctgcgcgtggtgcaatgcagtgatctgggcctagataaggtgcccaaagaccttccaccggatacgactttgcttgacctccaaaataataagatcacagagatcaaagacggcgatttcaagaacctcaaaaatctgcacgtggtctatctgcataataacaatatcagtgtcgtgggttcatctgatttctgtccaccaggccataatacgaagaaagcttcttacagtggagtctcattgtttagcaatccagtccaatactgggaaattcagccctcaacctttcgttgtgtatacgtgcgttcagccatccagctggggaactacaagtag

SEQ ID NO: 220428 - DNA, 1080 bp, Artificial Sequence
  Description of Artificial Sequence: Synthetic coding sequence
atgaaggccaccattatcctcctgcttttggcccaagtctcatgggccggacctttccagcagagaggcctgttcgactttatgctggaagatgaggcgtccgggatagggcctgaagtgccagatgatcgcgatttcgaaccatcccttggccctgtatgccccttccgatgtcagtgtcacctgagggtcgtgcaatgcagtgacctcggactggacaaggttcccaaagatctgcctcctgatacaacacttctggacctgcaaaataataaaataaccgaaatcaaggatggtgacttcaagaacctgaagaatctccacgcactcattctcgtcaacaacaaaattagcaaggtgagcccaggagccttcacaccattagtgaagctagaacggctgtacttatccaagaaccaacttaaagagctcccggagaaaatgccaaagacacttcaggaactcagagcacacgagaacgaaattactaaagtgaggaaggtgacgtttaacgggctcaaccaaatgatcgttattgagctgggcaccaaccccctcaaatcgagcggcattgagaatggggctttccagggaatgaaaaagttgagttacatccgaatcgcggataccaatattacctccatccctcagggcttgcctccgagtctcaccgaactgcatctggacggcaacaagatctccagggtggatgccgctagcctgaaagggctaaataacttagccaaactcggcctttcattcaactccataagcgctgtcgacaacggtagtttggctaacacaccgcacctaagggaactccatttggacaacaacaaattaaccagagtccccggaggactggcagagcacaagtatattcaagtggtataccttcataacaacaacatatccgtggtgggttcctccgacttctgtccgccaggccataatactaagaaggcatcatatagcggagttagcctgttttccaaccctgtacagtattgggagatacagcccagcactttcaggtgtgtgtacgttagatctgctattcagttaggtaactacaaatag

SEQ ID NO: 220429 - DNA, 753 bp, Artificial Sequence
  Description of Artificial Sequence: Synthetic coding sequence
atgaaggcaacaattattctgctcctcctggcccaggtctcctgggctggaccatttcaacagcggggactctttgatttcatgctggaggacgaggcatccgggattggacctgaagtaccagacgaccgcgattttgaaccatcccttggcccagtttgtccttttcgctgtcagtgtcatctgcgcgtggtccagtgcagcgaccttgagttgggtactaacccgctaaagagttcgggcatcgaaaatggcgcatttcaaggcatgaagaagctcagttacatcagaatagccgatacaaatattacctcaattccacagggccttccacctagtctgactgagctgcacttggacggaaataagatttctagagtggatgcagcatctttgaaaggcctgaacaatttggcgaagttgggtctgtcctttaattccataagtgccgtggataatggctctctggccaataccccgcacttgcgtgagcttcacctggacaataacaagttaactagggtaccagggggattggccgaacacaaatacatacaagttgtatatctgcataataataatattagtgtggtgggctcttcagatttctgccctcctggtcataatacaaagaaggcatcctattctggcgtatccttattttcaaatcctgtgcaatactgggaaatccaaccttcaacttttagatgcgtgtacgtacgttcagcaatccagcttggaaactataaatag

SEQ ID NO: 220430 - DNA, 639 bp, Artificial Sequence
  Description of Artificial Sequence: Synthetic coding sequence
atgaaggctacaatcattttgctcctactggctcaggtttcttgggcgggtccattccaacagagaggcctgttcgacttcatgttagaagacgaggcatcaggcattggccctgaagtgccagatgaccgcgactttgagccaagtctgggtccagtgtgtccttttaggtgccagtgccacctcagggtcgtgcagtgctcagacctcggactgcccccatcactgacagaactgcacctggacggtaacaaaatctcacgcgtcgacgccgcatccttaaaaggacttaacaatttagccaagctgggcctgtccttcaacagtatcagtgctgtggacaacggatctctggccaacactccgcatctgagagagcttcatcttgacaacaataagcttacccgggttcccggagggctggctgagcacaagtacatccaggtcgtgtacctccacaataataatattagcgtcgttggctcatctgatttttgtccccctgggcataatactaagaaagcctcctatagcggcgtctctttgttcagcaaccctgttcagtattgggaaatccagcccagcacctttaggtgcgtatacgtgagatccgctatccagctgggaaattacaagtag

SEQ ID NO: 220431 - DNA, 519 bp, Artificial Sequence
  Description of Artificial Sequence: Synthetic coding sequence
atgaaggcaaccatcatcttattactgttagctcaggtgagctgggccggtccattccagcagaggggactattcgacttcatgttggaggatgaagcctctggaattggaccagaagtacctgatgatcgggacttcgagcccagcctgggcccagtgtgtcctttcagatgccagtgccatctccgcgtcgtccagtgctctgatcttggccttgacaaggttcctaaggatctgccccctgatacaacactgttagacttgcagaataacaaaatcaccgagatcaaggacggtgacttcaagaatttaaaaaacttacacgtggtctatctgcacaacaataatatttctgtcgtggggtccagtgatttttgcccgcctggccataatactaagaaagccagctacagcggggtgagcctgttctctaatccggttcaatattgggaaatccagccaagcacttttcgctgcgtgtacgtaagaagcgcaattcagttggggaactataagtag

SEQ ID NO: 220432 - DNA, 228 bp, Artificial Sequence
  Description of Artificial Sequence: Synthetic coding sequence
atgaaagccacaattatcctgttactattggcacaggtgtcctgggctgggcctttccagcagcgtggtctcttcgatttcatgttagaggacgaagcctctggcattggcccagaagtcccagacgaccgagacttcgagccttctctgggaccagtgtgcccatttcgctgtcagtgccacttacgggttgtccaatgctccgacctgggctgtctgccctcctag

SEQ ID NO: 220433 - DNA, 639 bp, Artificial Sequence
  Description of Artificial Sequence: Synthetic coding sequence
atgaaagcgaccatcattctcctcctgctagcacaggtctcttgggcaggcccttttcagcagcgcggactctttgatttcatgctggaggatgaggcatcggggataggccctgaggtgcctgacgatagagattttgaaccctctctcggcccagtttgtcctttcaggtgccaatgccatctgcgagtggtgcaatgttcagatctaggtttaccaccttcccttactgagctgcatctagatggtaacaagatttctagagtggatgctgcttcactgaaagggttaaacaaccttgccaagcttggcctgtcctttaacagtattagtgccgtggataacggatctctcgctaacactccgcatttgcgggaactccacctcgacaataataagctgacaagggtccctggcggtctcgcggaacataaatacatccaggtggtgtatctacataataataatattagtgtcgttgggtctagcgacttctgcccaccaggacataacacaaagaaagcttcttacagtggagtttccctattttcaaaccccgttcagtactgggagattcagccgtccacctttaggtgcgtgtacgtcagatcagccatccaactggggaactataagtag

SEQ ID NO: 220434 - DNA, 540 bp, Artificial Sequence
  Description of Artificial Sequence: Synthetic coding sequence
atgaaggccacgattattctgctgctattggctcaggtaagctgggctggcccttttcagcagcgaggccttttcgactttatgctggaggacgaggcctctggaatcgggccagaggtgcctgatgaccgggacttcgagccatctttaggtcctgtgtgtccatttcgctgtcagtgccacctccgagtggtgcagtgttctgatctcggactggacaaggtccccaaagatttacctcccgataccacactgctggatctgcaaaataacaaaattacagagataaaggatggagatttcaagaatctcaaaaatctgcacgcgctgatactggtgaataacaaaataagcaaggtctcgccaggtgcttttactcctctggtgaaactggagagactgtaccttagtaagaaccaactaaaagagctgcccgagaaaatgccgaaaacccttcaggaattacgtgctcatgagaacgaaattaccaaagttaggaaggtgactttcaatggtctgaatcagatgatcgttatctag

SEQ ID NO: 220435 - DNA, 360 bp, Artificial Sequence
  Description of Artificial Sequence: Synthetic coding sequence
atgaaggccactattattctcctgctcctggctcaggtctcctgggccggacccttccagcaaagaggtttgtttgacttcatgcttgaggatgaggcctctggcattggaccagaagtccctgacgatagggattttgagccttcactgggacccgtttgtccttttcggtgccagtgccacctgagggtcgtgcagtgctccgacctgggactcgacaaggtgccaaaggacctgcctcccgatactactctactggacctccagaacaataaaattacggagatcaaagatggagattttaagaatctcaaaaatctacatgcgctcatcctggtgaacaataaaataagtaagtag

SEQ ID NO: 220436 - DNA, 525 bp, Artificial Sequence
  Description of Artificial Sequence: Synthetic coding sequence
atgaaagccactatcattctgctattgcttgcgcaggtgtcctgggcaggcccttttcaacaaagaggactcttcgactttatgttggaggacgaggcatccggaatcggccctgaagtcccggatgacagggatttcgaaccctccctagggcctgtgtgtccattccgctgccagtgccatctccgcgtcgtccagtgcagcgacctggggctcgataaggtgccaaaagacctgccacctgacactacactgcttgaccttcagaataataagataaccgaaattaaagacggagatttcaaaaatcttaaaaacttacatgcactcattttggtaaataacaaaatcagtaaggtgagccctggtgccttcacccccctggtgaagttagaacggctgtacctatccaagaatcaacttaaagagttgccagaaaaaatgccgaaaacactacaagaattacgggcacatgaaaatgagattactaaggtgcgtaaagtcacctttaatggattgaattag

SEQ ID NO: 220437 - DNA, 537 bp, Artificial Sequence
  Description of Artificial Sequence: Synthetic coding sequence
atgaaggctactatcattctcttactcctggcgcaggtttcttgggccggtccttttcagcagagaggacttttcgacttcatgcttgaggatgaggcaagtggaatcggccctgaagtgcccgacgatcgggatttcgagccctcgctcggccctgtttgtcccttcagatgccagtgccacctccgagtggtgcaatgctcagacctgggactggacaaggtgcctaaagacctaccaccagatactacactcttagatctgcagaacaacaaaatcacggagattaaagatggtgatttcaagaacttgaagaatcttcatgccctgatattagtgaataacaaaatatccaaggtctcccctggcgcttttaccccactggtgaaactggaacgcctctacttatcaaaaaaccagttgaaagagcttcctgaaaagatgccaaagacccttcaggaactcagggcacacgagaacgagatcactaaagtgcgcaaggtgacatttaacggcctgaaccagatgattgtttag

SEQ ID NO: 220438 - DNA, 1080 bp, Artificial Sequence
  Description of Artificial Sequence: Synthetic coding sequence
atgaaggccactataattctgctgctgttagcacaggtctcctgggctggccctttccagcagaggggactctttgacttcatgcttgaggatgaggctagtggtatcggtccagaagttcctgatgaccgagactttgagccgagcctggggccagtatgtccatttcgctgccagtgtcacctcagagtggtgcagtgcagcgatctcggacttgacaaggtaccaaaggacctgccaccagatacgaccctgctggatcttcaaaacaataagatcacagaaattaaagacggggacttcaaaaatttgaaaaacctccacgctcttatccttgttaataataaaatttccaaggtgtctcccggtgcttttacccccctggtaaagctcgagcggctgtatctgtcaaagaaccagcttaaggagctgcctgaaaaaatgcccaagacacttcaggagctgagagcgcatgaaaatgagattaccaaggtccgcaaggtgacattcaatggccttaatcaaatgatcgtgatagagctaggaaccaatccactgaagtcctcgggtatcgagaacggggcttttcagggaatgaagaagctctcttacattagaatcgccgatacaaatatcactagtatccctcagggtctgcccccttcactcaccgagcttcacctggacggtaacaaaatcagtagggtggacgctgcgtctttgaaaggactgaacaacctcgccaaactcggactctcttttaatagcattagcgcggttgataatggatctctggcaaacacgcctcacttgcgcgaattgcatcttgataacaacaaattgactcgggtccctggaggactagccgagcacaagtacatacaggttgtgtacctgcataacaacaatataagtgtggtggggtcctcagacttttgcccaccgggtcacaatacaaaaaaggcctcatactcaggcgtttctctgttctccaatccagtgcaatattgggagattcagccatctacatttcgctgtgtgtacgtccgaagtgccatacagctgggcaactacaagtag

SEQ ID NO: 220439 - DNA, 5598 bp, Artificial Sequence
  Description of Artificial Sequence: Synthetic coding sequence
atgacgcggtgggtgccgactaaacgggaggagaaatacggagtggctttttataattatgacgcacgcggagcagacgagttgtctctgcagattggcgatactgtgcatatcctcgaaacctatgaggggtggtacaggggatacaccctcagaaagaaaagtaaaaaagggatcttccctgccagttatatccacttaaaggaggccatcgtggagggtaaaggccagcacgagaccgttatccctggagatttacctctgatacaggaggttactaccactttacgcgagtggtccacgatctggagacagctgtacgttcaggataatcgagaaatgttccgctccgtgcggcacatgatttatgatctgatcgagtggagaagccagattctgagcggaactctcccacaagatgagctgaaggagctcaaaaagaaggtcaccgctaagattgactatggcaacaggattctcgacctggatcttgtggtgcgagacgaagatgggaatattcttgatccagagttgacatccaccattagcctgttccgcgcacacgagattgccagcaagcaagttgaagaaaggctgcaagaagagaagagtcagaagcagaacatcgacataaaccgccaggccaaattcgctgccacaccaagcctggcgctgtttgtaaacttgaagaacgttgtatgcaagatcggcgaagatgccgaggttctgatgagcctgtacgaccccgtggaatccaagttcattagtgaaaattatctggtcaggtggagctcgagtggtctcccaaaggacatcgatcgactgcataacctgagagcagttttcaccgacctggggagtaaagacttaaaacgtgaaaaaatcagtttcgtgtgtcaaatagtaagagttggaagaatggagctgcgtgacaacaacacacggaagctaacttctggtctcaggcgaccttttggagtcgctgtgatggacgtcactgatatcatcaatggcaaggttgacgacgaggacaaacagcactttattccatttcagccagtggcaggggaaaatgacttcttgcaaacagttatcaataaagttatcgccgcaaaagaagtcaaccacaaggggcaagggctctgggtgacattgaagttactaccaggtgacattcaccagatccggaaagaatttcctcatttggtagaccggacaaccgcagtcgccaggaaaactgggttcccagagattataatgccaggtgatgtgcggaacgatatctatgtcacactggtgcagggcgattttgacaagggatctaagacaaccgccaagaacgtggaggtgaccgtgtcagtctacgatgaagacggaaaacggctggagcatgtgatattcccaggcgctggcgatgaagctatctctgagtacaaatctgtgatctactaccaggtaaagcagcccaggtggtttgagacggtcaaggtggccatccctattgaagatgtgaaccggtcccacctgcggttcacctttcggcacaggtcttcacaggatagcaaggataaaagtgagaagattttcgccttagcctttgtgaaactcatgcggtacgatggcactacacttcgagacggagaacacgatctcattgtttacaaggccgaggctaaaaaactcgaggatgctgctacttatctctctctgcctagtacaaaggctgagctcgaggaaaagggtcacagcgcgacgggaaaaagtatgcagtcactgggtagctgcacaataagcaaggactcattccagatcagcaccctcgtgtgttcaacaaagttgacccaaaatgtggacctgttgggcttgctgaaatggcgctcaaatacatcgctgcttcagcaaaacctgaggcagctgatgaaagttgacggcggtgaagttgtcaagttccttcaggataccctggatgccctcttcaacatcatgatggagaacagcgaatcggagactttcgataccctagtgttcgacgctctggttttcatcataggactgattgcagacaggaaattccagcacttcaaccctgttctggagacatatataaagaaacatttttcagccaccctggcctacacaaagctaaccaaggtgttgaagaactatgtagacggagccgaaaagccaggagtgaacgaacagctctacaaagccatgaaagcattggaatccatttttaaattcattgtgaggagccgcattttgtttaatcaactctacgaaaacaagggggaggctgactttgtcgagtcactcctgcagctgttccggtccattaacgatatgatgagctccatgagcgaccagacagtacgcgtgaagggcgcagccttgaaatacctgccgacaatcgtgaatgacgttaagttggtgtttgacccgaaagagctgtccaagatgtttacagaatttatcttaaacgtccccatggggcttcttaccatacagaaactgtactgtcttatagagatcgttcatagcgatctgttcacccagcatgattgccgggagatactactgcctatgatgacggatcagctcaagtaccacttggaaaggcaggaagatctggaagcgtgctgccaactgttaagccacattttagaagtcctttaccggaaagacgtcggtcctacccagcggcacgtacaaatcattatggaaaaactgctgcggaccgtgaatagaacggtgataagtatgggcagggacagcgagctaatagggaacttcgttgcatgcatgactgccatacttcggcagatggaagactaccactacgctcaccttatcaagacttttgggaaaatgcggacagatgtggttgatttcctgatggaaacatttatcatgttcaagaaccttatcggcaagaacgtttacccctttgactgggtgattatgaacatggttcaaaacaaagtttttttgcgcgcaattaaccaatacgctgacatgctcaacaaaaagtttcttgaccaggccaattttgaactgcagctttggaacaactatttccaccttgcagtagccttccttacacaggaaagtctacagctagaaaatttctcatcggccaaaagagctaagattttgaataagtatggcgacatgagaaggcaaatcggctttgagatcagggatatgtggtacaacttaggccagcacaaaataaaatttatccctgagatggtcggacctatcttggaaatgaccttgatccccgagacagagctgcgcaaagccactatcccaatttttttcgacatgatgcagtgtgagtttcattctacaagaagtttccaaatgtttgagaacgaaattattacaaaactggatcatgaggtggagggtggcaggggagacgagcagtataaagtgctgtttgacaagatcttgctggagcactgccgcaagcacaaatacctcgcaaaaaccggcgagacattcgtaaaacttgtggtgcgacttatggaacggctgcttgattatcgaacaatcatgcacgatgaaaataaagaaaataggatgtcttgcacagtcaatgtgctgaacttttacaaggaaatcgagagagaggaaatgtacatccgctacctatataagctctgcgatctacacaaggagtgcgataactacaccgaagcagcgtatactcttttgctgcatgccaaactgttgaagtggtcggaagatgtgtgcgtcgctcaccttacgcaaagagatggctaccaggctaccacgcaggggcagctgaaagagcagctgtatcaagaaataatccactactttgacaagggcaagatgtgggaggaggctatcgcgctgggaaaagaactcgctgagcagtacgaaaacgagatgtttgattatgaacagctgtctgagctgctcaagaagcaggcccaattttacgagaatatagtgaaggttatacgcccaaagcccgactacttcgccgtgggctattatggacagggattccctactttcctgaggggaaaggtttttatctacaggggcaaggaatacgaaagaagagaagacttcgaggccagactgctgacccagtttcctaacgccgagaagatgaagaccacaagcccccctggcgatgacataaagaactctcctggacagtacattcagtgtttcactgttaagcctaagctggatctgcctcccaaatttcaccgcccagtgtccgagcaaatcgtgagcttctaccgcgtcaatgaggttcagcgcttcgagtatagcaggccaattcgtaaaggcgagaaaaatcctgataatgagtttgcaaacatgtggattgaaagaaccatctatacgaccgcatataaactcccaggtatcttacgctggtttgaggttaaatcagtgttcatggttgagatatcacctctagagaatgctattgagaccatgcagcttactaatgataagatcaacagtatggtacagcagcatctggatgatccctcactcccaattaatccactcagtatgttgctgaatgggatcgtggacccagcagtgatgggcggattcgccaattacgagaaagccttttttaccgaccgttatttacaggagcacccagaagctcacgagaagatcgagaagctgaaggacctgattgcatggcagatccccttcctcgccgagggcatccgaattcacggtgataaggtgaccgaagcccttaggccctttcacgaaaggatggaagcatgcttcaagcagttgaaagaaaaagtcgaaaaggagtatggggtcagaatcatgccgtcatccctggatgaccgcagaggctcccgcccaagaagcatggtgcggtcctttactatgcccagctcaagccgcccactctctgttgcctccgtgtcctccctctctagcgatagcactcctagccggccagggagcgatgggtttgcactagagcctctgctgccgaaaaaaatgcacagtagatctcaggataagttagacaaggacgatcttgagaaggaaaagaaggacaagaaaaaagagaaaagaaatagcaagcaccaggaaatattcgagaaagaattcaagcctacggacatctccctgcagcagtcggaagccgtcatattgtccgagaccataagtcctctccgtccccagcgccctaagagccaagttatgaacgttatcggctcggaacgtaggttctccgtgtcccctagctctcctagctcccagcaaacaccgcctcccgtgacacccagggcgaagttatcattcagcatgcagagctcacttgaattaaacggtatgacgggcgcagatgtcgccgacgtgcctccaccactgccattaaagggaagcgtggcggattacgggaatttaatggagaaccaagatctacttggcagccccactccccctcctcctcctccgcatcaacgccacctgcctcctccacttccttcaaaaaccccaccccctccccctcctaagacaaccagaaagcaggcctccgtggactccgggatcgtgcagtaa

SEQ ID NO: 220440 - DNA, 6561 bp, Artificial Sequence
  Description of Artificial Sequence: Synthetic coding sequence
atggccggtgaacgcacacggcgatttacccgaagtctcttgcgtccgggtcaggcagcagagctcagacactccgccgcttccgcagctgccgtggcagtgtcctcgagacagcagcagcggcaggaaaaaccccgtctgctcgaacctctggattacgagacagttatagaagagctagagaagacctacaggaacgatcctttacaggacctgctgtttttcccatccgatgatttctccgccgcaactgtgagttgggatatccgaacactgtatagcacagtgccggaagatgctgagcacaaagcagagaatcttctggtgaaagaggcttgtaagttctactccagccaatggcatgtcgtcaattacaagtatgaacaatattctggcgacatacgacaactgcctcgcgctgaatacaaaccagaaaagctcccatcccacagcttcgagatcgaccacgaagatgctgataaagacgaggacacaacttctcactccagctccaagggcggtggtggagcgggaggaacaggcgtatttaaaagcggttggctgtacaagggaaactttaactccaccgtgaacaacacagtcactgtacggagctttaagaagaggtattttcagctgactcagctccccgataacagctacatcatgaatttctataaagatgaaaaaatcagcaaggagcctaaaggctgtattttcctcgactcttgcaccggcgtcgtccagaacaataggctgcgcaagtatgcttttgagttgaaaatgaacgacctaacctactttgtcctcgccgctgaaacggaaagtgacatggatgagtggattcatactctaaacagaatcctccagatcagcccagaaggtccactccaagggagacgttccaccgaattgactgatctgggactcgattcgctggataactcagtcacttgtgaatgcactcccgaggagaccgatagcagtgagaacaacttgcacgctgactttgctaagtatttgactgagacagaggatactgttaaaacaaccaggaatatggaacgcctaaacttgttctcacttgatcccgatatcgacacgctgaaactgcagaaaaaggacctcttagagcctgaaagcgtcattaagccatttgaggaaaaagcagcaaagcgtatcatgatcatttgcaaggctctaaattcaaacctacaaggatgtgtgaccgagaacgagaacgatcctattacaaatatagagcctttctttgtgtctgtggcactttatgacctgagagacagccggaagatatctgcagacttccacgtggacttaaaccacgcggctgtgcgccaaatgctgctcggtgcaagtgttgccctggagaacgggaacattgacaccataacaccgagacagtctgaagagcctcacatcaaagggctgcccgaggagtggttaaagttcccgaaacaggcagtctttagcgtgtcaaacccccactccgagatagtactagtggccaaaatcgagaaagtgctgatgggaaacatcgcctccggtgcggaaccctatatcaagaatcccgacagtaataaatacgcccagaagatccttaaatccaatcggcagttttgcagcaaacttgggaagtaccgcatgcctttcgcgtgggcagtgagatcagttttcaaggacaaccagggaaacgtggaccgggacagtagatttagcccgctctttagacaggaatcgtcaaaaattagcacagaagaccttgtcaagctggtgtcagactatcggcgagctgacaggatatccaagatgcaaacaattcctggaagcttagatattgctgtggataacgtgccactggagcacccaaattgcgtgacttcatcctttatcccagttaaaccttttaacatgatggctcaaacggaacccaccgtcgaggtggaagagtttgtttatgattccaccaagtactgcaggccttatcgcgtgtataagaaccagatttacatctatcccaagcatctcaagtacgattcccagaaatgttttaacaaagcaagaaatattacagtctgtattgaattcaaaaacagcgatgaagaatctgccaaaccacttaaatgtatctacggcaaacctggaggtccactgttcacttctgccgcatatacagcggtcctgcatcacagtcagaatcccgacttcagcgatgaggtgaaaatagagctgccaacgcagctgcatgaaaagcaccacatcttattctcgttctatcatgtgacctgtgatattaacgccaaagccaatgctaagaaaaaagaggccctggagacttccgttgggtatgcttggctgcctttaatgaaacacgaccagatcgccagccaggaatataacattccaatcgccacctcactaccaccaaactatttatccttccaagattccgcctctggcaagcacggcggttcagatattaaatgggtggacggcggaaaacccttattcaaggtgtcaacttttgtggtttcaaccgtgaacacgcaggacccacacgtcaatgcgttcttccaagaatgtcagaagagagaaaaggacatgagccagagcccaactagcaactttataagaagctgcaaaaatctcctgaatgtagaaaagattcatgctatcatgtcttttttgcctattatcctgaaccagctttttaaggtcctcgtccaaaatgaagaggacgaaatcacaacgacagtcacccgggtactcactgacatcgtggctaagtgccacgaagagcaactggaccattcagtgcaaagctacattaagtttgtattcaaaactagagcttgcaaggagcggacagtgcacgaagaattggctaagaacgtaacgggccttctgaagtctaacgattcaaccacggtgaagcacgtgctgaagcactcctggttctttttcgccatcatactgaagtcgatggctcagcacttgatcgataccaacaagatccaactccccaggccccagagattccccgagagttaccagaatgaattggacaatctggttatggttctcagcgaccacgtgatttggaaatacaaggacgcactggaggaaacccgaagggccaatcacagcgtcgcaaggtttctcaagaggtgctttacttttatggacagggggtatgtgttcaagatggtcaacaactatatatccatgttctcttccggcgacctgaagaccctctgccagtataagttcgatttcttacaagaggtatgccaacatgagcacttcatccccctttgtctgccaatccgaagtgcaaatatccctgatccactgacacctagcgagtcaacccaggagttgcacgcttccgacatgccagagtactccgtgaccaacgagttttgcaggaaacatttcttgataggcattctcctgcgcgaagttggctttgccctacaagaagatcaggacgttagacacctagctttggctgttcttaaaaacctaatggctaagcactcattcgatgatcgttacagggagccacggaaacaagctcaaattgcatctctttacatgcccctctacggaatgttgctggacaacatgccgaggatctatcttaaggacttgtatccttttactgtcaataccagcaatcaaggtagtagggacgatctctctaccaatggcggatttcagtctcagacggcaataaagcatgcaaatagcgtggacacgtctttctctaaggacgttctgaattctatagcagcattctctagcatagccatctcaactgtgaaccacgctgacagccgggcttcacttgcatcccttgattcaaacccttccactaatgagaaaagctctgagaaaaccgacaattgtgagaaaattcctcgtccactgtcgctcatagggagcacattaaggtttgacaagctggaccaggcagagacccgttcccttctcatgtgtttcctgcatatcatgaagacgattagctacgaaaccctaattgcatactggcagagagcgccttctccagaagtcagcgacttcttctccatactcgatgtgtgcctgcagaactttaggtatctagggaaacggaacatcattcgaaagatcgccgctgcatttaagttcgtccaaagcactcagaacaacgggactttgaaaggatcaaacccttcatgtcagacctctggcctgctgtcacagtggatgcactctactagttctcatgagggacacaagcagcataggtctcagacactacctattataagaggcaagaatgcactgagtaacccaaaactgctccagatgctggataacactatgacatccaatagcaacgaaatcgatatcgtgcaccatgttgacactgaggccaacattgcaacggaagtgtgcctgactattctggatcttctgtccctgtttacacaaacacaccagagacaactacaacagtgcgattgccagaattctttaatgaaaagggtgttcgatacctacatgctgttctttcaagtgaaccaatcagccaccgcgctgaagcatgtgtttgcctccctaagactgttcgtgtgcaaatttccaagcgcatttttccagggccctgccgatctttgcggttcgttctgctatgaggttctgaaatgctgtaatcaccgctctcgctcgacacagaccgaagcctctgcgctgctgtatttcttcatgaggaaaaactttgagtttaacaaacaaaaaagtatcgtccgcagccatctgcaactgattaaggccgtgtctcagctgatcgccgacgccggaatcgggggtagtcgattccagcactccctagccataacgaacaacttcgccaatggggataagcagatgaagaactccaactttccagctgaagtgaaagatttaacaaagcgaattcgaacggtcctgatggccacagcacagatgaaagaacatgaaaaggaccctgaaatgcttgtcgatctgcagtacagccttgctaattcctatgcatctactccggaactgcgccgaacatggctcgagtctatggcaaaaattcatgctaggaacggagatctctctgaggctgcgatgtgctatatccacatcgcagcgctgatcgccgaatatcttaaacgaaagggctattggaaagtggagaaaatttgcacggccagtctgctaagcgaggacacacatccatgcgacagtaattcactgcttactacaccatcagggggatccatgttctctatgggctggccagccttcctctcaataacgcctaacatcaaagaggagggagctatgaaagaagattccggcatgcaagatacaccttacaatgaaaatatcctggtagagcagctgtatatgtgcgtggaattcctgtggaagtcagagaggtatgaactaatcgccgacgtaaacaaacctattatagccgtattcgaaaagcagagggactttaagaaactgtctgacttgtactatgatattcacagatcatatctaaaggtggccgaagtcgtcaacagcgaaaaacgtctatttggtcggtactacagagtcgccttttacggacaggggttctttgaggaagaggagggcaaggagtatatctataaggagccaaagctgacggggctcagcgagatcagccaacgactgctgaagttgtacgcagataaattcggcgcagacaatgtgaaaattatccaggactctaacaaagtgaatccgaaggacctggatcctaagtacgcttatattcaggtgacatatgtcactccatttttcgaagaaaaggaaatagaggatagaaagacagactttgagatgcaccacaatattaatcgcttcgtgtttgagacaccatttactctgagcggaaagaagcacgggggtgtcgccgaacagtgtaaacgcaggaccatccttactaccagtcacttatttccctatgttaaaaaaagaatccaagtcatcagccaaagttcaacggaacttaatccaatagaagtagcgatcgacgagatgagtaagaaggtgtcagaattaaatcagctctgtacaatggaggaggtggacatgatccggttgcagctcaagctgcaagggtccgtcagcgtgaaggtgaatgcgggtccgatggcctacgcaagagcttttctggaagagacaaatgccaaaaagtatccagataaccaggtcaaactgcttaaggaaattttccgtcagttcgccgatgcctgcggccaggccctagacgtgaatgagcggctcatcaaagaggatcagctcgaataccaagaggagctgagatctcactataaggacatgctgagtgagttgtctactgtgatgaatgaacagatcacaggcagggacgatctgagtaaaaggggcgtggaccagacctgtacaagggtcatttccaaggccacccccgctctgccaactgtgagtatctcctcctctgcagaggtctag

SEQ ID NO: 220441 - DNA, 2103 bp, Artificial Sequence
  Description of Artificial Sequence: Synthetic coding sequence
atgacaagtaattccaatgagatagacattgtgcatcatgtcgatacagaggctaacatagcaacagaagtatgcttaacaattctggacctcttgtcccttttcacgcaaacccaccagagacagctgcagcagtgcgattgccagaatagcctgatgaaacgggtgtttgatacctacatgcttttcttccaagttaatcagtcagctacagcactcaagcatgtcttcgccagtctgcgcctcttcgtttgcaagttcccctcggctttctttcaggggccagcagatctgtgtggctcattctgctacgaagtgctcaagtgctgtaatcaccggtccagatcaacacagactgaagcatccgctttactctacttttttatgaggaagaatttcgagttcaacaaacaaaagtctattgtgaggagccatctgcagctgattaaagcagtttctcagctgatcgcagacgccggtatcggtggatcccgtttccagcactcactggctatcaccaataacttcgcgaatggggacaaacaaatgaaaaatagtaactttccagccgaggtgaaagatttaaccaagcggattagaactgttcttatggccacagcccagatgaaggagcatgagaaagatccagagatgttggtggatttgcagtactctctggctaacagctatgcttctactcccgaactgagaagaacttggttagagtccatggccaaaatccatgctcgcaacggcgatttatctgaggctgctatgtgttatatccacatcgccgctcttatcgcagagtatctaaaacgcaagggcatgttcagcatggggtggcctgccttcctgtcgattactcctaatataaaggaggaaggggctatgaaggaggatagtgggatgcaagacacaccatacaatgagaatattctagtagagcagctgtacatgtgtgtggagttcctatggaaaagcgaacggtacgaacttatcgccgacgttaacaaacccatcatcgctgtgttcgagaaacagagagatttcaagaaactgagcgatctatactacgatatacatcggtcatacctgaaggtcgccgaggtcgtgaatagcgaaaaacgactgtttggacgttactaccgggtggccttttacggccagggtgtcggattttttgaagaggaggaaggcaaggagtacatatataaggagcccaagttgacaggattgtccgagattagtcaacggctgctgaagctttacgccgataagtttggcgctgacaacgtaaaaataatccaggactcaaacaaagttaatccaaaggacttggacccaaaatacgcctacattcaagtgacctacgttaccccattctttgaggagaaggagatagaagaccgcaagacagatttcgaaatgcatcataatatcaacaggtttgtattcgaaacccctttcacgttgtccgggaagaagcatggcggtgttgctgagcaatgtaaacgcaggacaattcttactacttcacatttgttcccatacgtcaagaagagaatccaagtcatcagccagtctagcaccgagctgaatcccatcgaggtcgctatagacgaaatgagtaaaaaggtgtccgaactaaatcagctgtgcaccatggaggaagttgatatgatcagacttcagttaaagctgcagggcagcgtgtcggtgaaagtcaacgccggtcccatggcgtacgccagagctttcctagaggagactaacgcgaaaaagtaccccgataaccaagtaaaattgcttaaagagatcttccgccagttcgccgacgcctgcggacaggccctcgacgtaaacgaaaggctgattaaggaagatcagctggaataccaggaggaacttcgcagccactataaggacatgttaagtgagcttagcacagtgatgaacgagcagctttgccgcggaccgtgtttgtacagcttctgttcctcggtgtcatcaatctcactgagtacagtttccaagagtgactacggccagggaaggccagtgaaagctagatccggcccaaaccttcactcctcaaactag

SEQ ID NO: 220442 - DNA, 6542 bp, Artificial Sequence
  Description of Artificial Sequence: Synthetic coding sequence
atgtcttttaggggcaaggtgttcaaaagagaaccttccgagttctggaagaagcgtagaaccgtcaggcgggtgaaccaggaggaaattcaccgcttctctagtcaggagaaacctcgcttgcttgaaccactggactatgaaaccgtgatcgaggagctggaaaaaacctacaggaacgacccactgcaggacctcctttttttcccttcagatgatttttctgccgcaacggtctcctgggatatccgcacactctactcaactgtgccggaagacgccgagcataaggctgagaatcttctagtgaaagaggcctgtaaattttacagctctcaatggcacgttgtaaattacaagtacgaacaatactcaggcgatatccgccagttgccaagggcagaatataaaccagagaagttaccttctcatagttttgaaatagatcacgaagatgccgacaaggatgaagacaccacaagccactctagttccaagggcggtggcggagctggcggaactggagtgttcaagtctgggtggctgtataagggcaatttcaatagcaccgtgaacaacactgtcactgtccggtcatttaaaaagcgctattttcaactcacccaacttccagacaattcctatattatgaacttttataaggacgagaagatctcaaaggaacccaaaggatgtatatttcttgactcctgtaccggagtggtgcagaataatcggcttcgaaagtacgcatttgagttgaaaatgaatgatttgacgtattttgtcctggccgctgagaccgagtcggacatggatgaatggatacacacactcaataggattcttcaaatcagcccagaggggcctctgcaggggagacgaagcacagaactaacagacctcggactcgactccttggataacagtgtgacttgcgagtgcacaccggaggagacagacagctctgagaacaaccttcacgcagactttgctaagtacctgactgagactgaagacacagtcaagacaactagaaatatggagcgcctcaatttattttctctcgaccccgacatcgatacgctgaagctccagaaaaaagacttactggaaccggagtccgtgatcaaaccttttgaggagaaggcagctaaacggatcatgatcatctgtaaggcgctgaactccaatttacagggatgcgtaactgaaaacgagaacgatcccataacaaatatcgagccatttttcgtctccgttgcactgtacgatctgcgtgactctaggaagattagcgcagatttccacgtggatctcaatcacgccgcagttcgacagatgttgttgggcgcttctgttgcgttagaaaacggcaacatagatacaatcactccacggcagtctgaggagccacacattaagggactgcccgaggaatggctgaaatttcccaagcaagccgtcttcagtgtgtcaaatccccactcggagattgtcctcgttgctaaaatcgaaaaggttctaatgggcaatattgcgtcgggcgcagagccctatattaagaatcccgattccaacaagtatgcccaaaagatcctcaaatcaaaccggcaattctgctccaagctgggcaaatatagaatgccatttgcctgggccgtgcgctctgtgtttaaagataaccagggcaacgtagacagagatagccgcttcagtccactgtttcgccaggaatcaagcaagatttctacagaagatctcgtgaaattggtgtcagactacaggcgcgctgaccggattagcaagatgcagacaattcctgggagcctggatatagccgtggataacgttcccctggagcacccaaactgcgtgacctctagctttataccagtaaagccatttaacatgatggcccagacggaaccaacagtggaggtggaggagttcgtctacgacagcacaaaatattgccgtccatatcgggtatataagaaccaaatttatatctacccgaagcacctgaaatatgattcacagaaatgttttaataaagccaggaacattacggtgtgtatcgaattcaaaaactccgacgaagagagcgctaagcctctgaagtgtatctatggcaagccgggtggccctttgtttaccagcgctgcatatactgccgtactccatcacagccagaatcctgacttctcagacgaagtcaagatcgagcttccgactcaacttcatgagaaacatcatatcctgttttcattctaccatgtgacctgtgatatcaatgcaaaggccaatgccaaaaaaaaagaagccctggagactagcgtcggctacgcttggctacccctgatgaagcatgaccaaatagcttctcaagagtacaatattccaatcgccacctctctgccaccaaactatttgtctttccaggatagtgcaagtggcaagcacggtggttccgacataaagtgggttgatggcggaaagcctctgttcaaagtcagtacctttgttgtcagcactgtaaatactcaggatccgcacgtgaatgccttttttcaagaatgccagaagagagaaaaagatatgtcccaaagtccaactagcaattttatccgctcttgcaagaacctgctcaacgtcgaaaaaatacacgcaataatgagcttcttgccaatcatactgaaccagctgttcaaggtgctggtgcagaatgaggaagacgagatcaccaccacggtcactcgtgtgttaaccgatatagttgcgaagtgtcacgaagaacagctagaccacagcgtgcagagttatattaaattcgtgttcaaaaccagagcctgcaaggaacgaaccgtgcacgaagagttggctaagaatgtcaccgggctcctgaagtccaacgattccactactgtgaagcacgtgctgaagcacagctggtttttcttcgctatcattctcaagtctatggctcagcatctgatagatacgaataagatccagttgcctcggccacaaaggttccccgaatcttaccagaacgagttggacaatctggtgatggtgctgtctgatcatgtgatttggaagtacaaggatgctttggaggagactaggcgggcaaaccactccgtagcaagatttctgaagcggtgcttcactttcatggatcgcggatacgtcttcaagatggtgaacaactacatttcaatgttttcatccggcgacctgaaaacactttgccagtacaaattcgatttcctccaggaagtgtgtcaacacgaacactttatcccgttatgtctccccatccggtcagccaatattcccgatcctcttacccctagtgagtccacacaggaactacacgcttcagacatgccagaatatagcgtgactaatgagttttgccggaaacacttcttaattgggatccttcttcgcgaggtcggtttcgcactacaagaggaccaggacgtgcgacacttggctctggccgtgctgaaaaatctcatggctaagcacagcttcgatgacaggtatagagaacctcggaagcaggcccagatagcaagcctgtatatgcccctgtatggtatgctgttggacaatatgcctcgcatctacctgaaagatctctacccattcaccgtgaacacgtcaaatcaaggttctcgcgatgacctgagtacgaacggaggtttccagtctcagaccgccatcaaacacgctaactcagtcgacacaagtttttctaaggatgtgttgaatagtattgccgctttcagtagtatcgcgatttcaacagtgaaccacgcagatagcagagcttcacttgctagtcttgattccaatcccagtactaatgagaagagcagcgaaaagacggataattgtgagaagattcccagaccattatccctgattggttccacgctgagattcgataaacttgatcaggcagaaacccgctctctgctgatgtgtttccttcacattatgaagaccatttcttatgagactctgatcgcttattggcaaagggccccttccccagaggtctctgactttttttctatactggacgtctgtttgcaaaacttccgctacctcggtaaaaggaatattattcgaaagatcgctgcagcatttaagtttgtccagagcactcaaaataacggcacactgaaaggctctaacccttcttgccagacgtctggtctgctctcacagtggatgcactcaacaagctcacatgaggggcacaaacaacaccggagtcagacgctgcccattatcagaggcaagaacgctttatcgaacccaaaattactgcagatgctcgacaacactatgacctcaaactccaatgaaattgacattgtgcaccatgtagatactgaggcaaacatcgccacagaagtgtgtctcaccatcttggatcttctcagcctattcacacaaacccaccagcgtcagcttcaacagtgtgactgtcaaaactccttgatgaagcgcgtgttcgatacgtatatgctgttttttcaagtgaaccagagcgctactgccctgaaacatgtgttcgcctcactgcgattattcgtctgcaagttcccatctgccttctttcaaggaccagcggatttgtgcggtagcttttgctacgaagtgctcaagtgctgcaaccaccgcagtcggtcgacccagaccgaggcaagtgctctcttatacttctttatgaggaaaaactttgagttcaataagcagaagagcatcgtgcgttcccacctgcaactgattaaggccgtgtcacagctcattgccgatgctggaatcgggggtagcagattccagcacagcctggccatcaccaacaacttcgctaatggcgacaaacagatgaagaactcgaattttcccgctgaagtgaaggacctgactaaacggatacgcaccgtcctgatggctaccgcccagatgaaagagcacgaaaaggacccagaaatgctggtggacctgcagtacagcctggcaaatagctatgcttctactccagagctgcggaggacatggctggaaagtatggcaaaaatccatgcccgtaatggcgacctgagcgaggccgctatgtgttacatccacatcgcggcactgatcgcggagtacctgaagaggaagggatactggaaagttgagaaaatttgtactgcttccctcttaagcgaggacactcatccgtgtgacagcaatagccttctgactacaccgagtggaggatccatgttctcgatgggctggcctgcctttctttctatcacccccaacatcaaggaggagggggcaatgaaagaggactcaggtatgcaagatactccctataacgagaacattttagtggagcaattatacatgtgcgtggagtttctttggaagtccgaacgctacgagttgattgccgatgtgaataagcctattatagcagttttcgagaaacagcgagatttcaaaaagctcagcgatctgtactacgatattcatagaagttacctcaaagtggccgaagtggtcaattctgagaaaaggctctttggacggtactaccgcgtcgcattttacggccaggggttcttcgaagaagaagagggaaaggaatacatctataaagagcccaaactcaccgggctctctgagatctcccaacgacttcttaaattgtatgcagataagtttggggctgacaatgtgaagataattcaggatagtaataaggtcaatcccaaggatcttgacccgaagtatgcctacatacaggtgacatacgtgacaccattcttcgaggaaaaagaaattgaagaccgcaagactgacttcgagatgcatcataatatcaaccggtttgtcttcgaaactccttttacgctcagcggaaagaaacatgggggagtagcagagcagtgcaaaaggaggaccatcctcactacatctcacctttttccttacgtgaaaaaacgcattcaggtgatttcgcagtcctcaacggagctgaatcctattgaggtggcgattgacgagatgagtaaaaaggtttccgaactgaatcagctctgcactatggaagaggttgacatgatcagactgcagcttaagctgcaaggcagtgtctcagttaaggtaaatgcagggcctatggcatacgcaagagccttcttggaagaaaccaatgccaaaaaatacccagacaatcaggtgaagctgcttaaggaaatcttccgtcaatttgcagacgcttgcggccaggcgctggacgtgaacgaacggctaatcaaggaggaccagctggagtatcaggaagagctgcgctcgcactacaaggacatgctgtccgagctgtcgaccgttatgaatgaacagattacaggccgtgacgatttatccaagcggggagtagaccagacatgtaccagagtgatcagcaaagccacgcccgcactgcctacggtgtctatttcgtcctctgccgaagtgta

SEQ ID NO: 220443 - DNA, 5493 bp, Artificial Sequence
  Description of Artificial Sequence: Synthetic coding sequence
atggcaccgtggcgcaaggcagacaaggaacggcacggtgtcgccatctataacttccaagggtccggagcccctcagctctccctgcagatcggcgacgtcgtccgcatccaagaaacgtgcggcgactggtatcgagggtacctcatcaagcataagatgctccaaggtatatttcccaaatcatttattcacatcaaagaagttaccgtagaaaaaagacgcaataccgaaaatatcatccctgcagagattcctttggcccaagaggtgaccacaacactttgggaatggggctctatctggaagcagctctatgttgcttcgaaaaaagagcggtttctgcaggtccagtccatgatgtacgacttgatggagtggcgcagtcagttgctctcgggtacactaccaaaagatgaacttaaggaactaaagcaaaaagtaaccagcaagatcgactatggcaacaagatactcgaactggaccttatcgtaagagacgaagacgggaacattctcgaccccgacaacacctctgttattagcttgtttcacgcccacgaagaagcaaccgacaaaattacagagagaattaaagaggagatgagtaaggatcagcccgactatgccatgtactccagaatttcttccagccctacccactctctgtatgtgttcgttcgcaacttcgtctgcagaatcggggaggacgcggagttgttcatgagtctgtatgaccctaacaagcagacagtgataagtgagaactatctagttcggtggggttcgcgcggatttcccaaagagattgaaatgctgaacaacctgaaggtcgtcttcactgatctgggaaacaaggaccttaacagagacaaaatttatctgatttgtcagatagtgcgggtgggcaagatggacttgaaagatacaggggctaaaaagtgtacacagggacttagacggccttttggcgtggctgtgatggacattacagacattatcaagggtaaggccgagagcgacgaggagaaacaacactttatccccttccacccggtgaccgctgaaaacgatttcctgcactctttactgggcaaggtgatcgccagcaagggcgactctgggggacagggcctctgggtcaccatgaaaatgcttgtcggggatattattcaaatccgaaaggattaccctcatctggtggatagaacgactgttgtcgcacgaaagctcggctttcctgaaataattatgccaggtgatgtcagaaatgatatttacattacattgctgcaaggtgatttcgataagtacaataagaccacgcagagaaacgtggaggtgataatgtgcgtgtgtgctgaagatggtaaaactctgccaaatgctatctgtgtgggggcaggtgataagcctatgaatgaatatagatccgttgtttattaccaagtgaagcagccaagatggatggaaacagtgaaggttgccgtcccgatcgaggatatgcagcggatccatctccgattcatgtttcggcaccggagttccctcgagtcgaaggacaaaggtgaaaagaatttcgccatgtcatacgtaaagttgatgaaggaagacggtaccaccttgcatgacggatttcatgatcttgtggtcctgaagggggattcaaagaaaatggaagatgccagtgcctacctgacattgccatcttatcgccaccatgtggaaaataagggtgcaaccctgagccgatcgtcaagctctgtagggggtctgtccgtgagctccagggacgtgttttctattagtaccctggtgtgttctactaaattgactcaaaacgtaggcctcctcggccttttaaagtggcgcatgaagccccagctgctgcaggaaaacctggaaaaattgaagattgtagatggtgaagaagtggttaaatttctacaggatactctggacgcactgtttaacatcatgatggagcacagccagtcagatgagtatgacatcctggtattcgatgccctgatctacatcatcggactaattgccgaccggaagtttcagcacttcaatacggtgctggaagcttacatacaacagcatttcagtgctacactagcctacaagaagctcatgacagttctgaaaacttatctggataccagttcacgcggagaacaatgtgaacctatcctacgcacattgaaggccctggagtacgtgtttaagtttatcgttagatctcgaaccttgtttagtcaactctatgagggcaaggagcagatggagtttgaggagtctatgcgaaggttgtttgagagtattaataacctaatgaagagtcagtataaaaccactatcttactgcaggtggccgcactgaagtacattccatctgtccttcacgatgtagagatggtgttcgatgccaagctgctgtcacagctcctctacgagttttatacatgtattccacctgtgaagttgcagaaacaaaaggttcagtcgatgaatgagatcgtccagtccaatcttttcaaaaagcaggagtgcagggacatactcctgccagtcatcacgaaggaactgaaagagttgctagagcagaaggatgacatgcaacaccaggtgctggaacgaaagtattgtgtagagctgcttaacagcatcttggaggtgctgtcttaccaagacgctgccttcacctaccatcacatccaggagataatggtgcagctgttgagaaccgttaatcggaccgtgattactatgggtcgtgaccatattctcatatctcatttcgtggcgtgtatgacagccatcctaaatcagatgggcgaccagcattacagcttttatattgaaacttttcagacctcctctgagcttgtcgacttcttgatggaaacctttattatgttcaaggaccttatcgggaagaacgtgtatccgggtgattggatggctatgtccatggtccaaaacagagtgttcttgagggccataaataagtttgctgagacaatgaatcagaagttcctcgaacacacaaactttgaattccagctctggaataactattttcatttagccgtagcatttatcactcaggattctctccagctggagcagttcagtcatgctaaatacaacaaaatcctgaataagtatggtgatatgaggaggcttatcggattcagcatacgagatatgtggtacaagctggggcagaacaaaatttgcttcataccgggtatggttggtcccatcctggagatgacactgatcccagaggcagaactgcgcaaggccacgattcccattttttttgacatgatgctctgtgagtatcagcgcagcggagatttcaaaaaatttgagaacgagattatccttaagcttgatcacgaggtggagggcggtcggggagacgaacagtacatgcaactcctagagtccatcctcatggaatgtgccgcagaacaccctacaattgctaaaagcgtcgagaatttcgtcaatcttgttaaggggttactggagaaacttctggactatagaggcgtgatgacggacgaaagcaaggacaataggatgagctgtaccgtgaatctgttaaatttctacaaagacaacaatagagaggagatgtacataagatacctttacaaattgagagatctgcatctggattgcgacaactacactgaggcagcctacactctgctgctgcacacctggctgctcaaatggagtgatgaacaatgcgccagccaagtgatgcagaccgggcagcagcacccacagacccacagacaactcaaggagacactgtatgagaccataattgggtattttgacaaaggcaagatgtgggaggaagccatttccctgtgcaaggagctggcggaacaatacgaaatggagatctttgactatgagctgctgtcacagaatctgatccagcaggcaaaattttacgagagtattatgaagatccttcggcctaagcccgactatttcgctgtaggatactatggtcagggcttcccttctttcctcaggaacaaggtgttcatatacaggggcaaggagtacgaaaggcgggaggacttccagatgcagctaatgacacagtttccaaatgctgagaagatgaacacgacatctgcaccaggtgacgacgttaagaatgctcctggacagtacatccagtgctttactgtgcaacctgtgctagatgaacaccccaggttcaagaacaaaccggttcccgatcagatcataaacttttacaaaagtaattacgtccagcgctttcattattctcggcctgtcagacggggtactgtagaccccgagaatgaattcgcatccatgtggatagaaaggactagttttgtgaccgcttataaactgcctgggatcctccggtggttcgaggtcgtccacatgtcgcagacgacaatcagccccttggaaaacgccatcgagactatgtccactgcaaacgaaaaaatcctcatgatgatcaaccagtaccaatcagatgagaccctcccaatcaatcctctcagcatgctcctgaacggcattgttgatcctgccgttatggggggttttgctaagtatgaaaaggcattttttacagaagaatatgtccgtgatcaccctgaagaccaggacaagctgacgcacctcaaggacttgattgcttggcagatcccctttttgggggcaggaattaagatccatgagaaacgcgtgtctgacaatcttcgcccatttcatgacagaatggaggaatgttttaagaatctgaaaatgaaagtggagaaggagtacggcgtcagagagatgccagatttcgacgaccggcgagtgggacggccacgatcaatgcttcgtagctataggcagatgagtatcatttctttggcttcaatgaacagcgattgttccacaccaagcaaacctacaagtgaaagtttcgacctggagttggcttcacccaagactccacgggtcgagcaggaagagccgatctctcccggttcaaccctgccagaagtcaaattgaggaggtcgaaaaaaagaactaagcgaagttccgttgtattcgccgatgaaaaagccgctgcagagtccgacttgaagcgattgagtaggaaacacgagttcatgagtgacactaatctttcagagcacgcggcaatccccctcaaggcttctgtgctcagtcagatgtcctttgctagtcagagtatgcctacaatcccggctctggcactgtccgtggctggtattcctgggcttgatgaggcaaacacatcccctcgtctgagccaaacttttctccagttgtccgatggagataagaagactctcacccgcaaaaaggttaatcagttcttcaaaactatgctagccagcaaatctgccgaagagggtaagcaaatcccagattcacttagtacagacctgtat

SEQ ID NO: 220444 - DNA, 1011 bp, Artificial Sequence
  Description of Artificial Sequence: Synthetic coding sequence
atgtgcgtctgtgcagaggatggaaagacactgccggttgcagtccctatagaggatatgcaacgaattcacttgagatttatgtttcgccaccgctcgtcactggagtccaaggataaaggcgaaaagaattttgcgatgagttacgtgaaactcatgaaggaagatgggaccaccctccatgacggatttcacgatttagtggtcctgaagggtgattccaaaaaaatggaggatgccagcgcctatctgactcttcctagctaccgccatcatgtcgagaataaaggagctaccctctctagatccagttcttcagtcggagggctttctgtgtccagtagggacgtattctcaatcagtacacttgtgtgtagtaccaaattaacccaaaatgtcggacttctcgggctgctcaaatggcgcatgaaaccccagctcgaggagtccatgagaagactcttcgagagtattaacaatctcatgaaaagccagtacaaaacaactattcttctacaagtcgccgcacttaaatacattccaagcgtgctgcacgatgtggaaatggtgttcgatgcaaagttgctgagccagctgctgtatgagttctacacgtgtatccctccggtgaaactgcagaagcagaaggtgcaatctatgaatgaaatagtccagagcaatttatttaagaaacaggaatgccgggacatcctgctacccgtgatcactaaagagctgaaagagctgctcgaacagaaagacgacatgcaacatcaagtcttggaaagaaaatactgcgtggaattgcttaatagcattctggaggtgctgtcttaccaggatgccgcttttacttaccatcacatccaggagatcatggtccagctgttgcgcactgtgaacaggaccgttatcacaatgggaagagatcacatactcatcggagcttgctgtaattgcgggttcccctcttccactccccactcacttattcagtggctgtggggctag

SEQ ID NO: 220445 - DNA, 2676 bp, Artificial Sequence
  Description of Artificial Sequence: Synthetic coding sequence
atgaccgcaattctgaaccagatgggcgaccagcattacagcttctacattgagacctttcaaacctcctcagaacttgtggattttctgatggagactttcatcatgttcaaggatctgatcggcaaaaacgtgtacccaggggactggatggctatgtctatggtgcagaaccgggtgttcctgcgcgcaattaacaaattcgccgagacaatgaatcaaaagtttctggaacacacaaattttgagttccaactttggaacaactactttcacctggcagtggcttttataacacaggacagccttcagttggaacagttttcacacgcaaagtacaataagatcttgaacaaatatggagatatgagacgtctgattgggttctcaatcagggacatgtggtataagcttggccagaacaaaatttgctttatccctggaatggttggccctattctggagatgacacttattcctgaggcagagttacggaaggcaaccattccaatcttctttgacatgatgttatgtgaataccaacgatccggcgatttcaaaaagtttgagaacgaaataatcttgaagttggatcacgaagttgaaggcggacggggtgatgagcagtatatgcagttgctggagtccattctgatggaatgtgctgctgagcatccaaccattgccaagtccgtagaaaatttcgttaatttagttaagggtttattggagaaactgctggattacaggggagtcatgacagacgagagtaaggataatagaatgagctgtacggtcaatctcctgaacttctataaggataacaaccgagaggaaatgtacatccgctatctgtacaagttacgggatctgcacctagactgtgacaactacaccgaggctgcctataccctcctcctgcacacatggctgctaaaatggagtgatgagcagtgcgcctcccaggtgatgcaaactggacaacagcatccacaaacgcatagacaactgaaggagacattgtacgagactattattggctacttcgataaaggaaagatgtgggaggaggctatcagtctctgcaaagagctggccgaacagtacgagatggagatcttcgactacgagttactgagccaaaatcttattcagcaggcgaagttctacgagagcattatgaagatattgagacccaaacctgattattttgccgtggggtactatggccagggttttccctcattcctccgaaacaaggtctttatatatcgcggtaaggaatatgagaggcgagaagactttcaaatgcagctgatgactcagttcccaaatgccgaaaagatgaacactacgtccgccccaggcgatgatgtgaagaatgcaccgggacagtatatccaatgcttcactgtgcagcctgtgttggacgaacatccacggtttaagaataagccagtacccgatcaaatcatcaacttctataaatccaactacgttcagcggttccactacagtagacccgtgcggagaggcactgtagaccctgagaacgagtttgcatctatgtggatagagcgtacgagcttcgtcactgcctataaactgcccggaattctgcgatggtttgaagtcgtccatatgagtcaaaccacgattagtccgcttgaaaacgccatagagacgatgtccactgccaatgagaaaattctaatgatgattaatcagtatcagtcagacgagaccttaccaatcaatccgctcagcatgcttctcaacggcattgtcgaccccgctgtgatggggggtttcgcgaaatacgaaaaagctttttttactgaagaatatgttagagaccatccagaagatcaggacaaactcacccacctgaaggatctgattgcttggcagatcccattcctcggggctggcattaaaatccacgagaagcgtgtgagtgataacctcagaccgttccacgaccggatggaagaatgttttaagaatttaaagatgaaagtcgagaaagaatacggtgttagggaaatgcccgattttgatgatcgtcgagtgggaagacccagatcaatgctccggtcttatagacaaatgtcaattatttcactagcctctatgaattccgactgctctacaccatccaagcccacatcagaatctttcgatcttgagctggcaagcccgaagacccctcgggtcgaacaggaagagcctattagcccgggttctaccctgccagaggtgaagctcagaaggtcaaagaaaaggacgaaacggtcatcagtagtcttcgccgatgagaaagccgcagccgagagtgatctgaagcgcctctctagaaaacacgagtttatgtctgatactaacctgagtgaacatgctgcaatcccactgaaggcgtcggtgcttagtcagatgtcttttgcatctcagtctatgcctacaatccccgcactagccctctccgtcgccggaataccaggtctggacgaagcaaacactagtcctaggctctcccagacctttctgcagctgtccgatggtgacaaaaagaccctgactcgcaagaaagtaaaccaatttttcaagactatgctagcatctaaatccgctgaggaggggaaacaaattcccgatagcctgtctaccgacttgtag

SEQ ID NO: 220446 - DNA, 6093 bp, Artificial Sequence
  Description of Artificial Sequence: Synthetic coding sequence
atgtggacgcctactgaagaagagaaatatggtgtggtaatctgcagcttccgcggatcggtaccccagggcctggtgttggagataggggaaacagtgcagatcctggagaagtgcgaggggtggtaccgtggagtgagcaccaaaaaacccaatgtcaagggaatcttccctgcaaactacattcatttgaaaaaggccatagtatcgaataggggacaatatgaaacggtcgtaccacttgaggactccatcgtaaccgaggtcactgcgacactgcaggaatgggcctccctatggaagcaactctatgtaaagcataaagtcgacttattctacaaactacgccacgtcatgaacgaattgatcgatctacgcaggcagctgctgagtggccatttgactcaggaccaggtgagggaagtaaaacggcacattacagttcgccttgattggggcaacgagcatcttgggctcgacctcgtaccccgaaaggattttgaggtagtggactctgatcagatatctgtatccgacctgtacaaaatgcacctgtccagtcggcagtccgtgcagcagtctacatcacaggtggacacgatgcggccacgccacggcgaaacctgtcgcatgcccgtgccccatcacttctttctatctctcaagtctttcacatataacaccatcggtgaagacactgatgtatttttctcactctacgatatgcgcgaaggcaagcagatcagtgagcgttttctagtgagactgaacaagaatggcggtccgaggaaccccgaaaagattgagcggatgtgcgcacttttcacggatctgtcctctaaagacatgaagcgggatctctacattgtagctcatgtcattagaattggtaggatgctactgaacgactcaaaaaagggcccaccccacctgcattaccgccgtccatatggctgcgcagttctttccatcctggacgttctgcagtcactgaccgaggtgaaagaggaaaaggactttgtgctgaaagtgtacacatgcaacaatgagagcgagtggtcccagatccacgaaaatatcattcgtaaaagctctgcaaagtatagcgcacctagcgcaagtcacggactcatcatcagcttgcagcttttacggggtgacatggagcagattaggcgcgagaatcccatgattttcaacagaggtttggctatcacgaggaagctggggttccccgatgttattatgccaggcgacattagaaacgacctgtatctgaccctggagaagggtgatttcgagaggggagggaagtccgtccaaaaaaatattgaggtcaccatgtacgtgctttatgcggatggcgaaatcctgaaggactgtatttcgctgggatcaggcgaaccgaaccgctccagctaccacagtttcgtcctctatcattctaattctccacgatggggagagatcattaaactgcctattcccatcgacagatttcgcggatcgcacttacggtttgagtttcggcattgctctacaaaggataagggcgagaagaaactgttcgggtttgcattttctaccctcatgcgagatgacggcaccacactcagtgacgatattcatgaactgtacgtttacaaatgcgacgaaaacagtacttttaataaccacgcattgtacctgggcctgccctgctgtaaggaggattataatgggtgtcctaatattccctccagcctgatctttcaacggtccaccaaagaatcttttttcataagtactcaactctcaagcaccaaactgacccagaatgtggacctgctggcactgctgaaatggaaagccttcccagacagaatcatggatgtactcgggaggttacggcacgtatctggcgaggagatcgttaaatttcttcaagatatcctagacaccttattcgtgatcttagacgataatacagagaaatacggcttgctggtgtttcagagcctagtgttcattattaacctgctcagagatattaagtattttcacttcagacccgtcatggacacttacatacaaaaacattttgccggtgcgctggcctataaagagttaattaggtgcctgaagtggtatatggactgttccgccgaactgatcagacaggaccacatccaggaggcgatgcgggcactagagtatctctttaaatttatcgtgcaatcccgcattctctatagcagagctacctgcgggatggaagaggaacagtttcggagtagtattcaagagctgttccagagtattcgtttcgtactgagtctcgattctcgcaacagcgaaacactgctcttcacccaggctgccctcctgaattcttttcccaccatcttcgacgaattgctgcagatgttcactgtgcaagaggtggccgagttcgtgcgcggtacccttggcagcatgccgtcaacggtgcacataggccagtccatggacgtcgtcaagctgcagtctattgctcgaaccgtggatagcaggctgttcagtttcagcgagtctcgcaggattctacttcccgtagtgctgcatcacatccacctgcacctcaggcaacagaaagagttgttaatctgttccggcatcctcgggtcaattttctctattgtcaaaacaagtagcttagaagcggatgtgatggaggaggtggagatgatggtcgaatcactcttggacgtgctgctgcagaccctcctgaccatcatgagcaagagtcacgcccaggaagccgttcgcggacagagatgcccccagtgtaccgccgagattacgggggaatacgtgtcatgtttactgagccttctgcggcagatgtgcgacacacactttcagcacctgctggataactttcagagcaaggatgaactgaaagagttcctgctgaaaatcttctgtgtcttcaggaacttaatgaaaatgtccgtgtttcctcgcgattggatggtcatgaggctgctcaccagcaacattattgtgacaacagtgcaatatctatcgagtgcactgcacaagaacttcacggagacggactttgattttaaagtgtggaacagttacttcagcctggccgtgctcttcatcaatcagccttccctgcagctggaaatcattacgtccgctaagagaaaaaagatcctggataaatacggtgacatgcgcgtgatgatggcctacgagcttttctccatgtggcagaatctgggcgaacataaaatccacttcattccagggatgattggccctttcctgggggtgactctggttcctcagccagaagtcagaaacatcatgattccaatcttccatgatatgatggattgggaacaaagaaaaaacgggaattttaaacaggtggaggctgaattgattgataaactggacagtatggtgtccgagggaaagggtgatgaatcttacagagagttattctctcttcttactcaactgtttggtccgtacccatcgctgctagaaaaggtggagcaggagacatggcgcgagaccggcatctccttcgtgaccagtgtcacgagacttatggaacgcctcttggactaccgcgactgtatgaaaggtgaggagacagagaataaaaaaataggttgcactgtgaatctgatgaatttttataaaagcgagattaataaggaggagatgtatatacgttacatccacaaactgtgtgatatgcacctgcaggcagaaaactacacagaggccgcattcaccctgctgctgtactgcgaactgctgcagtgggaagacaggcccctaagagagtttctgcactacccgagccagactgaatggcagaggaaggagggtctgtgccgcaaaattatacattatttcaacaaagggaaatcttgggagtttggtatacctttgtgccgtgagttggcttgccagtatgagtccctgtacgactaccagagtctctcctggatcaggaaaatggaagccagctactatgataatatcatggaacagcagcgacttgaacctgaattttttcgagtgggcttctatggcaggaagttccctttctttctccgtaataaggagtatgtttgccgtgggcacgactatgagcgactagaggctttccaacagcgaatgttaagcgaattcccacaggccgttgcaatgcagcatcccaaccacccggacgacgccatactgcagtgtgatgcacagtatctgcagatttacgctgtaacacccatccctgattatgtggacgtcttacaaatggaccgcgtgccagacagggtcaagtccttttaccgggtcaataacgtaaggaaatttcgctatgaccgcccttttcataaagggcctaaggataaggagaacgagtttaagtctctttggattgagcgcacgacactgaccctgactcattctctgccagggatatctagatggttcgaagtcgagcgcagagagctcgttgaggtatccccactggagaatgccatccaggtcgtggaaaacaagaaccaagagctgcggagcctgatctcacagtatcaacataaacaggtccacggcaacatcaacttgttgagtatgtgcctgaacggcgtcattgatgccgctgttaatggagggatcgcaagatatcaagaggccttttttgataaagattacataaataagcaccccggtgacgctgagaaaataactcaacttaaagagctgatgcaggaacaagtgcatgtcctgggagtgggtctcgcggtgcacgaaaagtttgtccacccagagatgcgccctctgcataagaagctgatcgaccagtttcaaatgatgcgcgcttccctgtaccacgaatttccaggtttagacaagctgtccccagcctgttctggtacctcgacccccaggggcaatgtcctcgcaagtcatagtccaatgagcccagagagcattaagatgacccacagacattctcctatgaatctgatggggacgggacggcactcctcctcgtcactatcttcccacgctagttctgaggctggcaatatggtgatgcttggagacggatctatgggggacgctcccgaggacctgtaccaccacatgcagctggcctaccctaatcctagatatcaagggtcagtgactaatgtgagcgtcctctccagcagccaagcttccccttcttctagttccctgtctagcacccactcagctccctcccagatgattacatcggcaccaagctccgcacggggttctccaagcctgccagataagtatagacatgcacgggagatgatgctgctgttgccaacgtatagagatagacctagctctgcaatgtatccagccgctattctggagaatggacagccgcctaacttccagcgtgctctctttcagcaagtcgttggagcctgcaaaccatgttctgacccgaacctttcagttgcggagaagggacactactccctacatttcgacgcctttcaccatcctctgggcgatacccctccagccctgcctgccaggactttgcgcaagtctcccctgcacccaatcccggcaagcccaacttctccccagtcgggtttagacggatctaactcaacactatcaggttccgctagttcaggagtgtcctcgctctccgaaagcaactttggccactcctctgaagcgcctcctcgcaccgacacaatggattccatgcctagccaggcatggaatgcagacgaagacctggagccaccttacctgcccgtgcattattccctaagtgaatcagccgtgctggattctattaaagcccagccatgccgcagccactcagccccaggatgtgtaataccacaagaccccatggatccgccagctctaccccctaaaccttaccatcctaggttgcctgctctggagcacgacgaaggcgtgctccttcgtgaggagactgaacgcccacgtggtttacatcggaaggccccattgcctccgggaagcgctaaggaagaacaggccagaatggcctgggaacatggacgtggggaacagtag

SEQ ID NO: 220447 - DNA, 1785 bp, Artificial Sequence
  Description of Artificial Sequence: Synthetic coding sequence
atgccaaagtggctcgaggagaccgagaataagaaaataggctgcacggtcaacctcatgaatttctacaaaagcgagatcaacaaagaggaaatgtatataaggtatattcataagctgtgtgatatgcaccttcaagccgaaaactacaccgaagcggcatttacccttcttctgtattgcgaactgcttcaatgggaagatcggccattgcgggagttcttgcattacccgagtcagaccgaatggcagcgtaaggaggggctttgtcggaaaataatccactacttcaacaaggggaaatcttgggagtttggcataccgctctgccgcgagctggcctgccagtatgaatcactgtacgattaccagtcactaagttggatccgcaagatggaggctagttactatgacaatataatggagcagcagaggctggagccggagtttttccgcgtcggcttctacgggagaaaatttcccttctttctcagaaataaggagtacgtgtgtagggggcacgactacgagagattagaagccttccagcagcgaatgctgagcgagttcccccaggccgtggccatgcagcatccaaaccacccagatgatgccattctgcagtgcgacgctcagtacctgcagatctatgccgtaacacccattcccgattatgttgacgtgcttcaaatggaccgcgtccccgacagagtaaagtcattctaccgggtgaacaatgtgcgaaaatttcggtatgacaggccattccacaaaggcccaaaagataaagaaaacgagtttaaatctctatggattgaaaggacaacattgacgctgacacacagtcttcctggtattagtcgatggttcgaggtcgaaagacgggagctggtggaagtgtctccccttgaaaatgccatccaggtggttgagaataagaatcaggaactgagatctctgatatctcagtatcagcacaagcaagttcacgggaacattaacctgctgtccatgtgcctcaacggagtgatcgacgccgcagtgaatggcggtattgcgaggtaccaagaggcattcttcgataaagactatatcaataaacacccgggtgacgcggagaagatcacccagctgaaggaactgatgcaagagcaggtgcacgtcctcggggttggccttgctgtccatgagaagttcgtgcatcctgagatgcgcccattgcacaaaaagctgatagatcagttccagatgatgagagcaagcctttaccacgagtttccaggactggataagctctctcctgcttgcagtggcacaagcacgccaagggggaacgttctggcctctcattcgcccatgagtcctgagtctatcaagatgacccaccggcactcccccatgaacctgatgggcacaggcagacacagctctagtagtctctccagccatgcaagttctgaagcgggaaatatggtgatgctgggcgatgggtcaatgggagacgctccagaggatctctaccatcacatgcagctggcatacccaaacccccgataccaggggagtgtgacgaacgtgtctgtgttatcctcttctcaggcaagcccatcgagtagctctttgtcatcaacccatagcgcaccatctcagatgattacgtccgctccttcctccgcccgaggtagcccctctctgcccgacaagtatcgccacgccagggagatgatgcttttgctgccaacctatagagatagacctagcagtgctatgtatcccgcagcttag

SEQ ID NO: 220448 - DNA, 5777 bp, Artificial Sequence
  Description of Artificial Sequence: Synthetic coding sequence
gtgattgcttctttccgaggcactgtcccatatggtctttctctggaaattggagacacagtccaaatcctggagaagtgcgacggatggtatagaggattcgccctgaaaaatcctaacataaaaggtatcttcccttctagctacgtgcacctgaagaacgcttgcgttaaaaacaagggtcagttcgagatggtgattcccactgaagatagtgtgattactgagatgacttcaacactaagagactggggcacaatgtggaaacagttgtacgtgcgtaacgagggtgacctatttcacagactgtggcacatcatgaacgaaatcctagatctgagaaggcaggtgctcgttggccacctgacgcatgacaggatgaaggatgtgaagcgtcatatcacagccaggctcgactggggaaacgaacagctcggcctcgatctggtgcctcgcaaagaatacgccatggtggacccagaagatatcagcatcacggagctgtatcgcctaatggagcatcgacatagaaagaaggatacacccgtgcaggcctcctcccaccacttgtttgtacagatgaaaagtctcatgtgctctaatctcggtgaagaactggaggtcatctttagtctgttcgactccaaagaaaataggcccatttcagaaaggttcttcctccggctcaacagaaatggcctgccgaaagccccagacaagccagagcgacattgcagtctgttcgtggatctggggagcagtgaactgcgcaaagatatctatattaccgtccatattatccgcattggccgaatgggggcaggcgaaaaaaaaaacgcttgctccgtgcagtataggcggccttttggatgtgctgtgctttcaatagcggacctcctgacgggagagacaaaagatgatttaatcctgaaagtgtacatgtgcaatacggaaagcgagtggtaccagatccatgagaatatcattaagaagctcaacgcacgctataatttgacaggcagtaacgccggactggctgtctccctgcagttgctgcatggagatatagagcagattcgaagggagtattctagcgtgtttagtcatggcgtgagcatcactcgtaagttaggttttagcaacatcattatgcctggcgaaatgcgcaacgatttatacattaccattgaaagaggcgagttcgaaaaaggcggaaaatcagtggcacgtaacgtcgaagtcacaatgtttattgttgatagtagtggccagaccctcaaggattttatcagctttggttctggagagcctcccgcttccgaataccactctttcgtactttatcataacaatagcccaaggtggtccgagctcctcaagttgccaataccagtcgacaagttcagaggtgcacacatcaggttcgagttcaggcactgttcgacgaaggagaaaggagagaaaaagctcttcggttttagttttgtgcctctgatgcaagaagacggcaggaccttgccggatggcacccatgaactgatcgtgcacaaatgcgaagagaatacaaacctccaggacactactaggtatcttaaactgcccttttctaaaggaatctttctcgggaataacaatcaagccatgaaagcgaccaaagagagcttctgcattacgtcatttttatgtagtacgaagctcacgcaaaatggagatatgttggatttattgaaatggagaactcatccagataaaataacgggttgcctgtccaagctgaaagaaattgacggatcagagatagtgaagtttctccaagatacattagacacccttttcggaattctggacgaaaacagtcagaaatacggatcaaaggtattcgactcgcttgtgcacatcataaatctcctgcaggacagcaaattccaccactttaaaccagttatggacacatacatcgagtcccacttcgcaggcgctcttgcgtacagggatttgatcaaggttctgaagtggtacgtggatcggatcaccgaggccgaacgacaagaacacattcaggaggtgctgaaggctcaggaatacatattcaagtacatcgtccaaagcaggcgtttgtttagcctggcaacagggggtcaaaacgaggaagaattccgttgctgcatccaagaacttcttatgtctgtccgctttttcctctcacaggagtctaagggttcaggagcgctttctcagtctcaggcggtgttcctgagctcctttccagcagtgtactcagagttacttaagttgtttgatgtacgggaggtagcgaatctggttcaagacactctggggtctctgccgacgattctgcacgttgacgactccttacaagcaataaaattacagtgcattgggaaaacagtggagagtcaactctacaccaaccctgacagtcggtatatcctcctccccgtggttctccatcacttgcacatccacctgcaagaacagaaagatctcataatgtgtgcacggattctgagtaacgtattctgccttattaaaaagaattcaagcgaaaagagcgtcttagaggaaattgatgtgatagtcgcgagcctgctggacatactgttgagaacaattttggagataacatcccgtcctcagcctagctccagcgccatgcgcttccagtttcaagatgtgaccggcgagtttgtggcatgtctgcttagtcttctgagacagatgacggacaggcattatcagcagttattagactcgtttaacacaaaggaagaactcagggatttcctgttgcaaatattcacggtattccggatcttaattcggccagaaatgttccccaaggactggactgttatgcgcctagtcgcaaacaacgtgatcatcacaacagtgctatacctgtccgacgcactgagaaagaatttccttaatgagaacttcgactacaaaatctgggattcttacttttatctggcggtaattttcattaatcagttatgcctccagctcgaaatgtttactcccagtaagaagaagaaagtgttggaaaaatacggcgatatgcgcgtcactatgggctgcgaaatcttcagtatgtggcagaacctgggtgagcacaagctccattttatacctgcccttatcggcccttttctggaagtaacacttatacctcagcccgacctccgcaacgtcatgatcccgatattccacgacatgatggattgggaacagagacgcagcgggaattttaaacaagtggaagctaaactgattgataagctggacagtctgatgagcgagggcaagggcgacgaaacctaccgggaactctttaattcaattataccattgttcgggccatatccctccctgctgaaaaagattgagcgggaaacttggcgcgagtctggcgtaagtctgatagccactgtgacccgacttatggagcgtctcctggattaccgagattgtatgaagatgggggaggttgacggcaagaagatcggttgtacggtaagcctgcttaacttctacaagaccgagctaaacaaggaggagatgtacatccggtatatccataagctttacgacctgcacctgaaagcacagaattttaccgaggccgcatacacactcctactgtatgacgagctgctggaatggtctgatcggccactgcgcgaattcttgacctaccccatgcagaccgaatggcagcgtaaagagcaccttcacctcactattatacaaaacttcgatcgcggtaaatgctgggagaacggaataattttgtgcagaaagatcgccgaacagtacgagagttattacgattaccgaaacttgtccaaaatgcggatgatggaggcaagcctgtacgacaaaatcatggatcagcagcggctggaaccggagtttttcagagtggggttctacggaaagaagttccccttctttctacgaaataaggagttcgtgtgtaggggtcacgattacgagaggttggaggccttccagcaacggatgctcaatgaattccctcatgccattgccatgcagcatgctaatcagcccgacgagactatcttccaggctgaagctcaatatcttcagatctatgcggtcaccccaatccccgagagtcaagaagtgttacagagagagggagtcccggataacattaagtcattttacaaagtgaaccacatctggaagtttagatacgacaggcccttccataaggggacaaaggacaaggagaatgagtttaaaagcctctgggtagagcggacatccctctacctcgtccaaagtctgccgggtatatcgaggtggttcgaggttgaaaagagggaggtggtggaaatgtctcccctagagaatgcaatagaggttctagaaaacaaaaatcagcagctgaagacactgatatcccagtgccagactcgccagatgcagaacatcaatccactcactatgtgtttgaacggtgtcattgacgccgcagtgaacggcggtgtttcccggtatcaggaagcctttttcgtgaaggagtatatcctctctcaccctgaggatggggagaaaatcgcacggctcagagagttgatgcttgaacaggcgcagattctggagtttggacttgccgtgcatgagaagttcgtgccacaagacatgagaccactacacaagaagctcgtggatcagttttttgttatgaagtcgtctctcgggatccaggagttttctgcatgcatgcaagcaagtcccgtccacttcccaaatggtagccccagagtttgtaggaactcggccccagccagcgttagtcccgatggtacacgtgtcatcccaagacggtcccccctgtcttatcccgctgtgaacagatactcatcctcttctctttcctcccaggcttcagccgaggtcagcaatattaccggacaatcagagtcttcggacgaggtgttcaacatgcagccctctccctcgacctcctcactttcctcaacgcactccgcctcaccgaacgttaccagttccgcccctagttcggctcgtgcctccccactgctttctgataagcataagcactcgcgagagaacagttgtctttccccaagagaaaggccttgtagcgctatttatcctaccccagttgagcccagccagagaatgctatttaatcatattggggatggagctctgcctcgctcagatcccaacctgtcagcccctgagaaagcctccccagccaggcataccactagtgtctcaccatctccggctgggaggagccccttaaaaggtagcgtccagtcttttacccccagcccggtggagtatcattcccctgggctgattagcaactcaccagtgctgtccggttcatattcctcaggaataagttcgctgtcccgctgctccacatcggagaccagcggctttgagaatcaagttaacgagcaaagtgctcccctccccgtccccgtgccagtgcctgtgccgtcctatggtggtgaggaacctgtgaggaaagagagcaaaactcctccaccatacagtgtgtacgagcgcaccctccgacggcctgttccactgcctcactcactttcgatccctgtaactagcgaaccacctgccttacccccaaagccactagccgcaagatcatcacatcttgagaatggtgcaaggcgcacagatccaggtccgagaccgcgaccactgcctcgcaaggtctcccaactcta

SEQ ID NO: 220449 - DNA, 5864 bp, Artificial Sequence
  Description of Artificial Sequence: Synthetic coding sequence
gttatcgcaagctttagaggcacagttccatacgggttaagtttggaaattggcgatactgtgcaaatcctagagaagtgtgacggatggtataggggttttgctctgaaaaatcccaacattaagggcattttccctagtagctacgtgcatttaaagaacgcctgcgtgaaaaataaggggcagtttgagatggttattcccactgaggactccgtgattaccgaaatgaccagcaccttgagggactggggcactatgtggaagcaactgtacgtgcgcaatgaaggagatttgttccaccgcttatggcacataatgaacgaaatattagacctgcgcaggcaggtgctcgttggacacctgacacacgatcggatgaaggacgtgaaacgccacatcactgccaggctagactggggtaacgagcagctgggcctggacctggtgccccgtaaagaatatgctatggtcgatcctgaagacataagtattacagaactgtataggctcatggaacaccggcatagaaagaaggacacaccagtgcaggctagtagtcatcatctattcgtgcaaatgaaaagcctgatgtgctccaacctaggagaagagttagaggtcatcttcagcttgtttgattccaaagagaaccggccaatctcagagcgtttctttctgaggctcaaccgcaacgggttacctaaggctcctgataagccggagcggcattgctctcttttcgtggatctgggaagcagcgagttgcggaaagatatttatattacagtgcatatcattcggatcggcagaatgggcgcaggcgagaaaaagaatgcatgcagcgtgcagtatcggagaccttttgggtgtgctgtactgtctatcgcagatctccttactggggaaacaaaggacgatctcatcctcaaagtgtacatgtgcaacacggagtcagagtggtaccaaattcacgagaatatcattaagaaactcaatgctcgatacaatctgactggatctaatgctgggttggccgtcagtcttcaactcttacacggcgacatagagcagattcgtagggaatattcgtccgtcttttctcacggtgtaagtatcactaggaagctgggattctccaatatcatcatgccgggagaaatgcgcaatgacctgtatatcacgatcgaaagaggagagtttgaaaaggggggaaagagcgtcgcccgaaatgtagaggtcacaatgttcattgtcgactcttccggacaaactctcaaggattttatctcttttggatcaggagagcctcccgctagcgagtaccactcctttgtgctttatcataacaacagccctagatggtcagagctgttgaagctgcctatccccgtggacaagtttcgaggggctcatatccgcttcgagtttcggcactgttccaccaaagagaaaggcgaaaagaagcttttcggattttcattcgtccctttgatgcaagaagacgggagaaccctgccggatggtacccacgaattaatagtgcacaagtgcgaagagaataccaaccttcaggacaccactaggtacctgaaactccctttctcaaaaggtatatttcttggaaacaacaaccaagccatgaaggccacaaaagaaagcttctgcataacctcattcttatgttctactaagctcactcagaacggtgacatgcttgatctcctcaagtggagaacccaccctgacaagattaccggatgtctttccaagttgaaagagatcgatggtagcgaaatagtaaaatttcttcaagatacactggacactcttttcgggatcctggacgaaaactctcaaaaatacggatctaaagtttttgattccctcgttcatatcattaatcttctccaggatagcaagttccaccactttaagcccgtcatggatacgtacattgagagccatttcgccggagcattggcctacagagacctcatcaaagtcctcaagtggtatgttgacagaatcactgaagcggagcgacaggagcacatccaggaagtgctcaaagcccaggaatacattttcaagtacatagtgcagtcgcgtcgcctgttttctttggccacaggtggccagaacgaagaggaatttagatgctgcattcaggagctgctgatgtcggtgcgcttttttctgagtcaagaatctaaggggagcggcgctttgagccaaagccaggctgtgttcttgtcaagttttccagctgtctatagcgaattactgaagcttttcgacgtgcgcgaagtcgcgaacctggttcaggacacgctcggatctttgcctaccatccttcacgtggatgatagtctgcaggcaattaagctgcagtgcattggaaagactgtggaaagtcagctgtacacgaacccagattcccggtatattctgctgcccgttgtattgcatcatcttcatatacacttgcaggagcagaaggatctgatcatgtgcgctagaattttgtccaacgttttctgtttgattaaaaaaaacagtagcgagaagtccgtgctagaggagattgacgtgattgtcgcaagcctcctggatatactcttacggactatcctggaaatcaccagcaggcctcaaccttcctccagcgccatgaggttccagttccaggacgtaactggagagttcgtagcttgcctgctgtcactgctccggcagatgacagaccgacactaccagcagctcctggactctttcaatactaaagaggaactgagagattttctgcttcagattttcactgtcttcagaatcctcattagacctgaaatgttccccaaggactggactgtgatgagactggtggctaacaacgtgataattaccacagtactgtacctttccgacgctctccggaagaattttctgaatgagaattttgattacaagatttgggactcctatttctatctcgccgtgatcttcataaaccaactgtgtctccagctcgagatgttcactccaagtaagaagaaaaaagtactcgaaaaatatggtgacatgagagtgaccatggggtgtgagattttcagtatgtggcaaaaccttggtgaacacaaactgcactttataccggctcttatagggccattcttggaggtgaccctgattcctcaaccagacctcaggaatgtcatgatccctattttccatgatatgatggattgggaacagcgcagaagcggcaattttaagcaggtggaggcaaaattgatcgataagttggattctctgatgtcagaaggcaaaggggacgaaacttacagagagctgttcaattctattcttttgaagaaaatagaacgcgagacttggcgagagtctggcgtgtctttgattgccacggtgacacgattaatggaaaggctgttagactaccgtgattgtatgaaaatgggcgaagtggatggtaagaagatcggctgcacagtctcccttttgaacttttacaagactgagttaaacaaggaggagatgtatattcggtatattcacaagttatatgatctgcacttgaaagcgcagaactttaccgaagctgcctacaccctactactctacgacgaactgctcgaatggtctgacagaccccttcgcgagtttttgacctaccccatgcaaaccgaatggcagcgaaaagaacacctccatctgactattatccagaattttgaccggggtaagtgctgggaaaatggcatcattctttgtcggaaaatcgcggagcagtatgaaagttattatgattaccggaacctgtccaagatgaggatgatggaagcaagcctgtacgacaagattatggaccaacaacggctggagcctgaattctttagggtggggttctacggtaaaaaattcccttttttcttacgtaataaggagtttgtgtgtaggggccacgattacgaaaggctggaagctttccagcaacggatgctcaacgagtttcctcatgccattgccatgcagcacgctaatcagccagatgagacaattttccaggcggaggcccagtacttacaaatttacgcagttacccccatcccggagtcacaggaggtgttgcagcgagaaggggtgccggataatattaagtccttttacaaagtgaaccacatatggaagtttcggtacgatcggccttttcataaggggacaaaagataaagagaatgagttcaagtctttgtgggtcgaaagaacaagtctttatcttgtgcagagtttacccggaatcagccggtggtttgaagtggagaaacgtgaagtggtggagatgtcacccctagaaaacgcaattgaagttcttgagaataagaaccaacagctcaagaccctcatttcgcagtgccagactagacaaatgcaaaatattaatcccttgaccatgtgtctgaacggagtgatcgatgcggcagtcaacgggggagtgtcaagatatcaggaggccttcttcgtcaaggaatatattctgtcgcatcccgaggacggggaaaaaatcgcacggctcagagagctgatgctggaacaggcccaaatactggagtttggactggccgttcatgagaagtttgttccccaggatatgcggcctctgcataaaaagcttgtcgaccagttctttgtcatgaagtcgtcccttggaatccaggaattcagtgcctgcatgcaggcttcccccgtgcactttcccaacggatctccaagggtctgccgaaatagcgcgccagcatcagtctcccctgacggaacccgagtcatcccaaggaggagtcctttgtcctaccccgctgtcaatcggtactcttcaagttccctgagttcccaggcctctgcagaggtgagtaacatcactggccagtcggagagtagcgatgaggtcttcaacatgcagccttcccccagtacaagcagcctgtcatccactcatagtgcctcacctaacgttaccagcagcgccccatcatcagctagagccagcccacttctctccgacaaacacaaacatagcagagagaactcttgcctttccccaagagagcggccatgtagtgcaatttacccaactccagtcgagccatctcagcggatgttgttcaatcatatcggagatggtgctttacctaggtctgatcctaacctgagtgctcctgagaaagccgtaaatccaactccatcctcctggtccctcgactcaggaaaggaggccaaaaatatgtctgacagcggcaagctgatttcccctccagtacccccacgcccaacacaaaccgcttcccctgctagacacacaaccagtgtgtctccaagtcccgctggcaggtctccactgaagggatccgttcagagctttacccctagcccagtagagtaccattctccaggactcatttctaacagtcccgtcctgagtgggtcctactccagcggaatcagttctctgtcacggtgctcaacctcagaaacttccggattcgagaaccaagttaatgagcaatctgctcctctgccagtccccgtgcccgtgccagttccctcatacggcggagaagaacccgtgcggaaggaaagtaaaacccctccaccttattccgtgtacgaaagaacattgcgaaggcccgtgcctttgccgcactcattgtctatacccgttacttcagaaccaccagctcttccaccgaagcccctggccgctcgcagctctcatcttgaaaatggggcaagaaggacggatccaggacctcggcctcgaccccttccgaggaaggtgtctcaactgta

SEQ ID NO: 220450 - DNA, 5927 bp, Artificial Sequence
  Description of Artificial Sequence: Synthetic coding sequence
atgtggatacccaccgagcatgaaaaatacggcgtggtgatcgccagttttcggggtactgttccttatggactttccctcgaaataggcgatacagttcagattctggagaaatgtgatggctggtaccgcggattcgcattaaaaaaccccaacatcaagggcatcttcccgagttcctacgtgcacctcaagaacgcatgcgttaagaacaaagggcaattcgagatggtgattcctacagaggatagtgtgattactgaaatgacatctacgctgcgggactggggaaccatgtggaaacagctctatgttcggaacgagggcgacctgttccaccggctctggcacatcatgaacgaaatcctagacctccgtcgtcaggtcttggtcggccatctgactcatgatcgtatgaaagacgtcaaacgacacattacggcgcgactggattggggcaacgaacaattagggttagacctggtgcctcggaaggagtatgctatggtggatcctgaggacatatcgatcacagagctctatcggctcatggaacaccggcataggaagaaggacactccagtgcaggcctcctctcaccatctctttgtgcagatgaagtctttaatgtgcagcaacctgggtgaggagctggaagtcatttttagcttattcgattccaaagagaatcgccctatctcagaaagatttttcctgcgactgaatagaaacggcctcccgaaggccccagacaagccggagcggcactgttccctgttcgtggatctcgggtcctctgagctgagaaaggacatctacataacggtgcatatcataaggatcggtaggatgggagcaggtgagaaaaaaaatgcatgtagcgttcagtaccggaggccattcggctgcgccgtgctgtccatcgcagatctgctgactggtgaaaccaaagatgatctcatcctaaaggtgtacatgtgcaatacagagtctgagtggtatcagattcatgagaatattattaagaaacttaacgccaggtacaacctgacaggctctaatgcgggtctggccgtgtcactgcagttattacacggggatattgagcagattcgtcgggaatactcatcagtgttcagtcacggagtgagcattacaagaaaactcgggttctcaaacatcataatgccgggtgaaatgaggaacgatctatacattaccatcgaaaggggcgagttcgaaaaaggcggtaaatccgtggctagaaatgtagaggtcacaatgtttatagtggacagttcagggcagaccctgaaagactttatcagttttggttccggagaaccacccgcttccgaatatcactccttcgtcctgtaccataacaatagtcctaggtggtcagaactcctgaaattgccaatccccgtggataagtttcgcggagcccacataagattcgagttccggcactgctccacaaaggaaaaaggcgagaaaaaactgttcgggttctcatttgttcctctgatgcaagaagatggacggacactgccagatggcacacacgaactgatcgtccacaagtgtgaggaaaacacgaacctccaggatacaacccgatatctgaaactcccatttagtaagggaattttcctgggaaataataaccaggccatgaaggctaccaaggaaagtttttgtataaccagcttcctgtgctctaccaaactcacccagaacggcgacatgctggaccttctgaaatggcgtactcaccctgacaaaattactgggtgcctatcaaaattgaaagagattgatggcagtgagatcgtgaaattcctccaggacactctcgataccctgttcgggattttagacgaaaattcacagaaatacggtagcaaggtgtttgacagtctggtgcatatcatcaatctgctccaagatagcaagtttcatcactttaaaccagtcatggacacttacattgaaagccacttcgcaggtgccctcgcctaccgggacctgattaaggtgctgaaatggtatgtcgacaggattactgaggcagagagacaggaacacattcaggaggtcctgaaagcgcaggaatatatcttcaagtacatcgtgcagtctcgcaggctcttctcgctcgctaccggagggcagaacgaagaagagttcaggtgttgtatccaggagctgttgatgtctgtcaggtttttcctgagtcaggagagcaagggcagtggcgcattgtctcaatctcaggcagttttcctgtcatcctttccggctgtgtactcagagctgctcaaactattcgacgtgagagaagttgccaacctagttcaggataccctcggctccctccccaccatactacacgtggatgattccctgcaagctattaagctgcagtgtatcggcaaaacggtggaaagtcagctatatacaaatcctgactctaggtacattcttctaccagtggtactgcaccacctgcacattcatctgcaggagcagaaagatctgattatgtgcgccagaatcctttccaacgtgttttgtctgatcaaaaaaaactcttctgagaagagcgtcttggaggaaattgacgtaattgtggccagtctgctggatatcttgttaaggacaatcctagaaatcactagccggcctcagccttctagcagcgctatgcgctttcagtttcaggacgttaccggggagttcgtggcttgtctcctgagccttcttcgccaaatgactgatcgccattatcaacaactgttagacagtttcaacacaaaggaggaactgagagactttctgctgcaaattttcactgttttccgaatactgatcaggccggaaatgttccccaaagattggacagtgatgcggcttgtagccaacaacgtgataatcaccaccgtgctgtacttgtccgatgctctgagaaaaaattttctgaacgagaacttcgattataagatctgggatagttacttctatctcgccgtgatttttatcaatcagttatgtctccaactggaaatgttcaccccatcaaaaaagaagaaggttctggagaaatatggcgacatgcgggtgacaatgggctgtgaaatattttctatgtggcaaaatctgggcgagcacaagttacatttcatccccgcactgattggaccgtttctcgaagtcaccctgattccccaacctgatctgagaaacgtcatgatcccaatcttccacgacatgatggattgggagcaaagaaggtccggcaatttcaagcaggttgaggctaagttaatcgacaagctggacagtttgatgtcagagggaaagggagacgagacatatcgtgagctttttaacagtatcattcctctgtttggcccatacccttcactgttgaaaaaaattgaaagggagacatggcgtgaaagtggcgtgtcactgattgccacggtgacccggttgatggaaaggttactcgactatagagattgcatgaaaatgggtgaggtggatggaaagaaaataggctgtacagtgtcgttgttgaacttctacaaaacggagctgaataaagaagagatgtacattcgttacattcacaaactctatgatcttcatttaaaggcccaaaatttcacagaagctgcatatacactgcttctttacgatgaattgctcgagtggagtgatcgccctctgagagaatttctcacatatcctatgcaaaccgagtggcagagaaaggagcatctccatctgaccattatccagaacttcgataggggaaagtgctgggagaatggtatcatcctgtgccgaaagatagctgaacaatacgaaagctattacgattatcgcaatctgagtaagatgcggatgatggaagcttctctatatgacaaaatcatggatcaacagagactggagccagagtttttccgcgttgggttctacggaaagaaattccccttctttttgcgaaataaggaattcgtgtgccggggacatgactacgagcgcctggaagccttccaacagcgtatgctcaatgagtttcctcacgccatcgccatgcagcacgccaaccagccagatgagactatatttcaagcagaggcccagtacctgcaaatctacgcagtaacccccatccctgaaagtcaggaagttcttcagagggagggcgtccccgacaacataaaatcattctacaaagtaaaccatatctggaaattcagatacgaccgaccctttcacaaaggaactaaggacaaggagaatgaatttaagtcgctctgggtggagaggaccagcttgtatctggttcagagcctccccggtatcagccggtggttcgaggtggagaagagggaagtcgttgagatgagcccactggaaaacgcgatcgaggtcctggagaacaaaaaccagcagctgaaaactttgatctcacagtgtcagacccgccaaatgcagaatataaaccctctcacaatgtgtcttaacggagtaattgacgcagctgtgaacggaggagtaagccggtaccaagaggccttttttgtcaaggagtatatactgtctcacccagaggatggtgaaaaaattgctcggttgagggaacttatgctagagcaagcacagatactggaattcggactggctgttcatgaaaagtttgtgccccaggacatgaggccactgcataaaaagctagtggatcagttcttcgtcatgaaatccagtttagggattcaggagttttcagcctgcatgcaggcttctcccgtacacttccctaatgggagcccaagggtctgtcggaacagcgcccctgcaagcgtgagccctgacgggacgagagtgatccccagacggtctcccctgtcctatccagccgttaataggtattcctcatccagcttatcaagccaggcatctgctgaagtctcaaatattactggtcagtccgagtcctcagatgaggtttttaatatgcagccttctccctccaccagcagcttgtcttcaactcacagcgctagccctaatgtcacttcctccgccccatcatcggcaagagctagccccttactctctgataagcacaagcacagcagggagaactcgtgtctgtcccctcgtgagaggccgtgctcagcaatttaccccacacccgtggaaccttcccagagaatgctctttaatcacatcggcgacggagctttgcctaggtctgatcctaacctgtctgctccggagaaggcagtgaatcctacgccctcatcttggtccctagactctggcaaagaggctaaaaatatgagcgacagcggaaagctaatatcccccccagtcccgcctcgccctacccaaacagcctctccagcacggcatacaacctctgtatctccctctcccgctggaagatctccactgaaaggctctgtgcaatctttcacaccatcaccagtcgaataccatagccctggcctcatctccaatagccccgtgctgtccgggtcatacagcagtggcatatcctccctgtcacggtgcagcacgtctgagaccagtggtttcgaaaaccaagtcaatgaacagtccgctccactgccagtgcctgtgcccgtgcccgtgcctagctacggcggtgaggaacctgtgcggaaagaaagcaaaactccccctccttactcggtatacgaacgcaccctgagacgccctgtaccattgccacattccctgtctatccccgtcacatcagaacctcccgctctgcctcccaagcccctcgcagccagaagtagtcacttggaaaacggagccagacggactgacccgggtccacgccctcggccactgccccgtaaggtgtcccagctgta

SEQ ID NO: 220451 - DNA, 5900 bp, Artificial Sequence
  Description of Artificial Sequence: Synthetic coding sequence
atgtggatccccaccgaacatgaaaagtacggcgtggttattgctagtttcaggggcacagtcccatacggattgtccttggagattggagataccgtccagattctggagaaatgcgatggttggtaccgcggttttgccctgaaaaaccccaacatcaagggcattttcccctcatcctacgttcacctgaaaaacgcctgcgtcaagaataagggacagtttgagatggtaataccgactgaggattcggtcataacagagatgacatctactctcagagactggggtactatgtggaagcagctctacgtacgaaacgaaggtgacctattccatcgtctgtggcacattatgaatgaaattctggatttgcggaggcaggttttggttggtcacttaacccatgacaggatgaaggatgtgaagcggcatattaccgcccgtttagattggggaaacgagcagctgggcctggaccttgtgcccaggaaggagtacgccatggtggaccccgaggacatctctattactgagttatatagacttatggaacacaggcatcgcaaaaaggacacacctgtgcaggcatccagtcaccacctttttgtccagatgaagtccctgatgtgttcgaatctaggcgaggaacttgaggtaatcttctctctgtttgatagcaaagagaatcgccctatttcggagcgcttcttcttgcgcctgaatcggaacgggctgcctaaggcaccagacaaacctgagagacactgttcgttattcgtggatctcgggagcagcgagctaagaaaggatatttacatcactgtacacatcattcgcatcgggcgtatgggtgcaggcgaaaaaaagaatgcctgttccgtccagtataggagacctttcggttgcgcagtcctgtccatcgcagacctactcactggcgaaaccaaggacgacctaattctgaaagtttacatgtgtaatacagagagtgagtggtaccagattcacgagaacataataaagaaactgaacgcccgttataatttgaccggctctaacgccggtcttgccgtgtctctgcagctcctgcatggcgatatagagcaaattcgcagggaatactccagtgtgttctctcacggagtgtccataacacgcaagcttggcttctccaatataattatgccgggagaaatgcgcaatgatctctacattaccattgagagaggcgaattcgaaaaagggggaaagtcagtcgccaggaatgtggaggttaccatgtttatcgtcgatagctccggacagaccttgaaggatttcatctcattcgggagcggtgagccacctgccagcgaataccactcctttgtcctgtaccacaacaacagcccacggtggagcgagctgctgaagttacccatccctgttgataagttccgtggggcacacatccgcttcgaattcaggcattgttccactaaagaaaaaggggaaaagaaactattcgggtttagcttcgtgcctctgatgcaggaagacggaagaactctgccggacggaacacacgaactcattgtccacaagtgtgaggagaacaccaatctgcaagacacgacacgctatcttaagctgccattcagcaagggcatttttctcggcaacaataaccaggccatgaaggctacaaaagaaagcttctgcatcaccagctttctgtgttctaccaaacttacccagaacggggacatgctggacctgctgaaatggcggacccaccccgataagatcaccgggtgtctgtctaagctgaaagagatcgacgggtctgagatcgtcaagtttctccaggacactctggatacattgtttggcattctggatgaaaattcccagaaatatggaagcaaagtattcgattcactggttcacatcatcaacctcctccaggattcaaagttccaccattttaagccagtcatggatacctacatcgagtctcatttcgctggggctctggcttatcgggacttaataaaagtgttgaagtggtacgtggacaggatcactgaggcggaaagacaagagcatattcaggaggttctgaaggcgcaggagtacatattcaagtatatcgtccagagcagacgactgtttagcctcgccactgggggtcagaatgaggaggaatttcgttgctgtatccaagaactcctgatgtctgtgaggtttttcttgagccaggaatccaaagggagtggagctctgagtcagtctcaggctgtctttttatcctcattcccagccgtgtattctgagctccttaaactgttcgacgtccgggaagtagccaatctggttcaagatactctgggctcactgccaactatcttacatgtagatgactccctgcaggccataaaattgcaatgtatcggaaaaacagtagagagccaactgtacactaatccagatagcagatatatcctactccctgttgttttgcaccacctgcatatccacttacaggaacagaaggatctgattatgtgcgcgagaatactgtccaacgtgttttgcctcataaaaaaaaacagctctgaaaagtccgtgctcgaggagatagatgtcattgtggctagcttgttggacatactcctgcgaacaattctggagattacaagcagaccccagcctagtagtagcgccatgaggttccagtttcaggacgttaccggagagtttgtcgcctgcctactgagcctgttgcggcagatgaccgaccgtcattatcaacagctgttggacagttttaacaccaaggaggaattacgcgacttcctcctccagatctttactgtctttcggatccttattcgtccggagatgttccctaaagactggacggtcatgaggttggttgctaataatgtaataattactactgtattatatctgagtgacgccctgaggaagaatttcttgaacgaaaatttcgattacaaaatctgggacagttacttctacctcgccgtgatattcatcaaccagctttgtctgcaattggagatgttcacaccctccaaaaaaaaaaaggttctggaaaaatacggggacatgcgggtaactatgggttgtgaaattttctccatgtggcagaatctcggggaacataagcttcattttatccctgctctcatcgggccattcctggaggttacccttattccccagcctgatctgcgcaacgtcatgatccccatattccatgacatgatggactgggaacaaagacgatccggcaatttcaaacaagtggaagctaaacttatagacaagctcgattccttgatgagcgaaggtaagggagatgagacatacagggagctgtttaactctatccttttgaagaagatcgagcgtgaaacctggagggagagcggagtgtcgctgattgcgaccgtcaccaggcttatggagcgcctgctcgattacagggattgcatgaagatgggcgaggtggacggaaaaaagattggctgcacggttagtctgctgaacttttataaaaccgagttgaacaaggaggagatgtatataagatatatccataagctatacgacctccatctgaaagcccagaattttacagaggccgcatatacactgctgctatacgatgaactgctggagtggagcgatagaccactgcgcgagttcctgacataccccatgcagacagagtggcagagaaaagagcatctccacctgacaatcatccagaatttcgataggggaaaatgttgggaaaacggaatcatcctgtgtcgcaagatcgcagagcaatatgagagctattatgattaccgaaacctgtcgaagatgcgcatgatggaagcatccctgtatgataaaatcatggaccagcaacgattagagcccgagttctttcgcgtaggtttttacggcaagaagttccccttcttccttcggaataaggaatttgtctgtaggggacatgactacgaaagattagaggcctttcaacaaagaatgttaaatgaattcccacacgccattgctatgcagcatgcaaatcagccagacgagacaatttttcaggctgaggctcagtatctccagatttatgccgtcacaccgatccccgagagccaggaagtacttcagcgggagggcgtgcctgacaacatcaaaagtttttacaaagtcaaccacatttggaaatttagatatgatcggccatttcacaaggggaccaaggacaaagagaatgagtttaaatctctctgggtggagcggacctcattgtacctcgtgcaaagtctgccaggaatttcccgctggttcgaagtggaaaagagagaagtggtcgaaatgtcacctctggaaaacgctatagaggtgctcgagaataaaaatcaacaactcaagaccctaatatctcaatgccagacccggcagatgcagaacatcaatcccctgaccatgtgcctaaacggagtcatcgatgctgccgtgaatggtggggtgtcacgatatcaagaagcctttttcgtgaaggaatacatcctgtcccacccagaggatggcgagaagatagctagacttagggagctgatgctggaacaggcacagatccttgagtttggactggccgtgcacgagaagttcgtgccccaggacatgcggccactgcacaagaagcttgtagatcagtttttcgtcatgaaatctagtctggggattcaggagttcagcgcttgcatgcaggcatcacccgtccactttcctaatggtagccccagagtctgtcggaattctgccccagctagtgtctctcccgacgggacccgcgtgataccaaggcggagccccctttcataccccgctgtaaatcgttactccagctccagccttagctctcaggcgtctgccgaagtgtctaatatcacgggtcagtcagagtcatcagacgaggtatttaacatgcagccaagtccgagtactagctccctgagcagcactcattcagcgagccctaatgttacaagttccgccccatcctctgccagggcatcaccactgctgtcagataaacacaaacattctcgggagaattcttgtctgtcgcctcgagagcgaccttgctcagccatatatcctacccccgttgagccctcccaacggatgctcttcaatcacatcggggatggagctctgccgagatcagaccccaatctgtcagccccagagaaagccgttaatccaacacccagctcctggagcctggatagtgggaaagaagctaagaatatgtcagatagcgggaagctaattagcccccctgtgccgcctcgtccaacccaaacggcttcacccgctcgacataccacctcagtcagtccttctcccgcaggtaggagccccctgaaggggagcgtccagtcctttacaccctccccagtagaatatcatagtcccggactgatcagtaattcaccagtactcagtggctcctactcttcaggtatctcaagcttgtcccgatgctccacaagcgaaaccagcggattcgagaaccaggtcaacgagcagagcgctcccctaccagttccagtgcctgtacctgtaccgagctatggcggagaagagcccgtgcggaaagagagcaagacaccccctccatattccgtgtacgagcgcaccctgcggaggcccgttccattaccccatagcctaagcatccccgtgacctcagagccacccgcattaccccctaaaccactcgccgctagatcgtctcatctagaaaatggagccagacgcacggatcctggacctcgcccaaggcccctacctagaaaagtcagtcagctgta

SEQ ID NO: 220452 - DNA, 2550 bp, Artificial Sequence
  Description of Artificial Sequence: Synthetic coding sequence
atgaagatgcacagtaccgaaaggattccactctttggaccttatccttctctactgaagaagatagaaagggagacctggcgcgaaagcggagtgtcacttatcgccaccgtgactcggctgatggaaaggcttttggattacagagactgtatgaagatgggcgaggtggacggaaagaagattggatgcaccgttagcctgctgaacttttataaaaccgaattgaataaggaggaaatgtacatcaggtatattcacaaattatacgacctgcatctgaaagcccagaactttactgaagccgcttataccttactcctgtatgacgagctcctggaatggtccgaccggccattgcgggaattcctcacataccccatgcagaccgaatggcagaggaaagagcatctgcatctaacaattattcaaaactttgaccgcggaaaatgctgggagaatgggattatcctgtgtaggaaaattgccgaacagtatgaaagttattacgactatcgtaatctgagtaaaatgcgcatgatggaggctagtctgtatgataagattatggaccagcagcggctagaaccagagttctttagagttggattttacggaaaaaaattccccttctttctcagaaacaaggagttcgtgtgcagggggcacgactacgaacgccttgaggccttccagcagcggatgctcaatgagtttccccatgccatcgccatgcagcatgcgaaccagccggacgagactatttttcaagcagaggcccagtacctgcagatctatgctgtgacaccaataccagaaagccaggaagttctacagagggagggggtgccggataatattaagtctttctataaggtgaaccatatatggaaattcagatatgatagaccgttccataaaggtaccaaagacaaagagaacgaattcaagagcctttgggtcgaacgcacatcattgtatcttgtccaatccctccctggtatttcgagatggttcgaggtggagaaacgggaggtggttgagatgtcaccactggaaaacgctatcgaggtcctcgaaaataagaaccagcagctcaagacactgattagtcagtgtcaaactagacagatgcagaacatcaatcccctcactatgtgtctaaacggggtcatcgatgctgctgttaacggcggagtgtccagatatcaggaggctttctttgttaaggagtacatcctctcacatcccgaagatggagaaaaaatcgcaagactgagggagctaatgctggagcaggcccagatactcgagtttggactcgcagtccatgaaaagttcgtaccacaggatatgaggcccctgcacaaaaaactggtcgaccaattctttgtaatgaaatcttctctcggtattcaggagttttccgcatgtatgcaggccagcccagtccatttccctaatggcagccctcgcgtctgccgtaatagtgcacccgcaagcgtgtccccagatgggacccgcgtgattccgaggaggagtcccctgagctacccagccgttaacagatacagctcatcatctttgtcctcacaggcgtccgcagaggtttccaacatcacagggcaatcggaaagttccgacgaagtgttcaacatgcagcctagccccagcacctcaagcctatcctcgactcacagtgcaagtcccaacgtcacatcatctgcaccttcttccgccagggctagccctctgttatccgataagcacaaacatagccgggagaactcctgcttgagtccacgggaacgtccatgttctgccatctatccgactcctgttgagccaagccagagaatgctgttcaaccacatcggtgacggtgccttaccacgcagtgatcccaacctgtctgcacccgagaaggccgtaaaccccaccccaagcagttggtctcttgactcagggaaggaagccaaaaacatgtccgactctggcaaactcatttctccccctgtccctccacgacccactcagactgcttcccccgctaggcatactaccagtgtctctccgtcgccagcagggaggtcccccttgaaggggagtgtgcagtcctttactccaagcccagtcgaatatcatagccctggtttgatctcaaactcacctgtgctgtctggctcttactcctctggcatttctagcctgtcccggtgcagcactagcgagacaagtgggttcgaaaaccaagtgaacgagcaatcagctcccctaccagtccccgttcctgtgcccgtgccgagttatggcggtgaagagcccgttcggaaggaatcaaagaccccacccccttactcggtgtatgaacgcaccctgcgaaggcccgtaccgctgccccacagtctgtccatccccgtcacgagtgaacccccagctttgcccccaaaacccttagcagctcgctcgagtcatttggagaatggcgctaggcgaaccgatcccggtccgaggcccagaccactgcccagaaaagtaagtcagctttag

SEQ ID NO: 220453 - DNA, 3318 bp, Artificial Sequence
  Description of Artificial Sequence: Synthetic coding sequence
tggatcccctctgagaagcaaacattttttaccgttattgcatctttccgtgggaccgtcccgtacggtctcagcttagagattggcgatacggtgcagattctggaaaaatgtgatggatggtacaggggatttgccctcaaaaacccgaacatcaaaggaatttttcccagtagctacgtgcatctgaaaaatgcttgtgttaaaaacaaaggccaatttgaaatggtgatcccaaccgaagacagtgttattaccgagatgaccagcaccctgagggactggggtaccatgtggaagcagctgtatgtccgaaacgagggtgacctattccatcgtctatggcacataatgaatgagattcttgatttgcggagacaggtgcttgtgggccacctcactcacgacaggatgaaagatgtgaagagacatatcacagcccgactggattggggaaatgaacagctgggtctcgacctggtgccgaggaaagaatacgcaatggtggatcctgaggacatctcgataacagagctctatcggctcatggagcaccggcataggaaaaaagatacaccagtccaggcgagcagccaccacttatttgtacagatgaagtcactgatgtgttccaacctaggtgaggaacttgaagtcatattttcacttttcgactccaaggagaataggcccatttccgagaggttcttccttcggctaaaccggaacggactcccaaaggctcccgacaagccagaaagacactgcagcttattcgtggacttaggatccagcgagctccggaaagacatctatattacagtccacatcattcgcattggaaggatgggagccggagagaagaagaacgcctgttctgttcagtaccgaagaccattcggatgcgcagttctgagcattgccgacctactcacaggtgaaactaaggatgatctaattctgaaagtatatatgtgcaatacagagagtgagtggtaccaaatccacgaaaacatcatcaagaaattaaatgcacggtacaacctgaccggctctaatgccggtttggccgtctctctccaactgctgcacggggatattgagcagatcaggagggagtactcatctgtcttttcacacggggtgtccataacgagaaagctcgggttttccaatattatcatgcccggagaaatgaggaatgacctgtatatcactatcgagcgtggggagtttgagaaaggcggaaaatctgtggccaggaacgtcgaagtcaccatgttcatcgtggactcttcaggtcaaacgctcaaggactttatttccttcggatccggggaacctcctgcttctgagtaccactcttttgtgctctatcacaataactcccccaggtggtcagaactgttaaagcttcccatccctgttgataaattcaggggggcacatattcgcttcgagtttcgtcactgcagcacgaaagagaagggagagaaaaaattgtttgggttcagcttcgtccctctgatgcaggaagacggtaggacattacctgatggaacacacgagctgatcgtgcataagtgtgaggaaaacacaaatctccaggacacaacaaggtaccttaaactaccattctctaaaggaatctttctcggaaacaacaaccaggctatgaaagcaaccaaggagagtttttgtataaccagttttttgtgctctacaaaactgacccagaacggtgatatgctggacttgctcaagtggcgtacccaccccgacaaaatcacggggtgtctctctaaactaaaagagattgatggtagcgagatcgttaagtttctgcaggacaccttggatacactgttcggcatcctagacgaaaacagtcagaaatacggctctaaagtgtttgacagcctggtccatataataaatttactgcaggactctaaattccaccactttaagcctgtaatggacacatatatagagagtcactttgccggtgccctggcctacagggatttgatcaaagtgctgaaatggtatgtagaccgaataactgaggcagagcggcaggagcacatccaggaagtgctcaaggcccaggaatatatcttcaagtatatcgtgcaatcccgaaggctgttttccttagcaacggggggacagaatgaggaggaattccggtgttgcatccaggagctactgatgagtgtccggtttttcttatcgcaggagagcaaaggaagcggcgctctgtcccagtcccaagctgtctttctctcaagttttccagctgtctacagtgaactcctcaaattatttgatgtgcgtgaagtcgccaacctggtgcaggatacactgggaagcctgcctactatcctgcatgtggatgactcactgcaggcaattaaattgcagtgtatcggcaagaccgtggagtcgcaattgtacacaaaccccgactctaggtatatcctgctgcctgtggtccttcaccatctccatattcacctacaagagcaaaaagaccttatcatgtgtgctaggatattgagcaacgtcttttgtctgattaagaagaattcctccgagaagagtgttcttgaagaaatcgatgtcattgttgccagtctcctcgacatcttgcttcgtacaatccttgagatcaccagtcgtcctcagccatcatcatctgctatgagatttcaatttcaggacgtgacaggagaatttgtagcttgcttattgtccctgctgaggcaaatgacagatcgccattaccagcagttgctcgattcattcaacacgaaggaggaactcagagacttcctccttcaaatattcacggtgtttaggattttgattcgccctgaaatgtttcccaaggattggactgtgatgcgcctggtagccaataacgtgataatcacaacggtactgtatttgtcggatgcccttagaaaaaacttcttgaatgaaaatttcgattacaagatctgggatagctacttttatctggccgtcatctttatcaatcagttgtgcctgcagctggagatgttcacgccctcaaaaaagaagaaagtcctggaaaaatacggcgatatgcgtgtaacaatggggtgcgaaatattctcaatgtggcaaaacctgggcgaacacaaactgcatttcattcccgctctgaggcaggagaaccgactcaacctgggcggaggcggttgctccgagccaagagcatgtcactgcacccccgcttgggctacaaagcgtgactgcgtgagcaagaagaaagagaagaagacatag

SEQ ID NO: 220454 - DNA, 6144 bp, Artificial Sequence
  Description of Artificial Sequence: Synthetic coding sequence
atggcagcatccgaacgccgagcatttgcgcacaagataaacagaactgtcgccgctgaggtgcgaaagcaggtttctagagagcgcagcggcagcccccacagcagccgaaggtgctcatctagtctcggggtcccactcaccgaggttgtcgaacccctggacttcgaggacgtactgctctcccggccacctgacgctgaaccaggccctctgagggatctggtggaattccccgcagatgatttagagcttctgctccagcccagggaatgcaggaccaccgagccgggaattcctaaggacgagaaactcgacgcccaagtgagagctgccgtcgagatgtatatcgaggattgggtgatcgtgcatcggcgataccaatatttgtccgccgcatatagccccgtgacgacggacacacaaagggagcgccagaagggcctgcctagacaggttttcgagcaggacgcttccggcgacgagaggagtggcccagaagattctaatgacagccggaggggttcaggatcaccagaggacacaccaagatcaagtggtgctagcagcatcttcgatttgagaaatctcgccgcagactccctccttcctagcctcctagaaagggccgcacctgaagatgtagatcgaagaaatgaaacgctccgaagacaacatcgtccgcctgctctgctgactctctatcccgcaccagatgaagacgaagccgtggagcggtgtagccggccagagcctcctagagaacacttcggtcagcgcatcctggtcaagtgcctgagcctgaaatttgagattgagattgaaccaatctttggcatcctcgctctgtacgacgtccgggagaaaaaaaaaatcagtgagaatttctactttgatctgaactctgatagcatgaagggattacttagggctcatggaacccacccggcaatctccaccctcgcacgaagtgccatcttcagtgtcacataccccagtcctgatatctttctcgttatcaaactggaaaaagttttgcagcaaggagatatatctgagtgttgtgaaccctacatggtactcaaagaggtcgacacggccaagaataaagaaaagctggagaaactccggctggccgctgagcagttttgcactcgtctgggcagatatcggatgccttttgcatggaccgccgtgcatctggccaatatagtttcctccgctggacagctcgaccgcgactccgactcagagggggagcgtcgacctgcctggactgaccggcgtcgcaggggaccccaggaccgggcatcgtccggcgatgacgcatgttcattcagtggttttcgcccagctaccctgactgtgacgaacttttttaagcaggaggccgagcggctgagtgatgaggacctcttcaaattcctggcagacatgcgccgtccctccagcctgcttcgcagactacgtcctgttaccgctcaactcaagatcgacatctctccagctccagagaaccctcatttctgcctttcccccgaactgttgcatatcaagccctatcctgaccccaggggccgacctaccaaggagatcctggagttcccggcacgggaggtgtacgcccctcacacctcttatcgaaacttactatatgtctatccccactcattgaatttttcctcgcggcaggggtctgtccggaatctagctgtgagggtacagtacatgacgggggaagacccttcccaagcacttcctgttatcttcggaaaatcttcttgttccgagttcaccagggaggccttcacaccagttgtgtaccataacaagtctccagaattctatgaagagttcaagctgcacctaccggcttgtgtcactgagaatcaccacctgctgttcacattctaccacgtgtcctgtcagccaagacccggtacggctctagaaacccctgtcgggttcacatggatacctctattgcagcacggacgcctgcgcaccgggccattctgcctcccagtgtcggtggatcagccgcctccgagttattcagtgctgacgccggacgttgccctgcccggtatgcggtgggtggacggacataaaggcgtgtttagcgtggagctgaccgcggtctcttctgtccacccacaggacccctacctggacaaattttttacactcgtgcacgtgctggaagagggagctttcccatttcgattaaaagataccgtactctcggaagggaatgtagaacaagagttaagagccagtctcgccgcacttcggctcgcgtctcccgagcctttagtggcattctcacatcatgtattggataaactagttcggctcgtgattaggccccctattatcagcggccagattgtcaacttggggagaggcgctttcgaggccatggcacacgtcgtctcacttgttcacaggtccctggaagcagcacaggatgcccgaggacactgtcctcagctcgccgcatacgtacattatgcctttcggctccctggtacagagccatcattacccgacggagcccctcctgtgaccgttcaggctgcaactctcgcccgtggaagtggcagacctgcctccctgtatcttgcccgatccaaaagcatctcttcttctaatcctgatctggccgtggcgcctggctccgttgatgacgaagttagtaggatccttgctagcaaactcttgcatgaggaattggcactccaatgggtggtctcctcatccgctgtgcgcgaagccatactacagcacgcatggttcttttttcagctgatggtgaaaagcatggccttacacttactgctcggacagcgtctggatacgcctaggaaactccggtttcccggtcgctttctcgatgatattactgccctggtagggagcgtggggctagaggtgattacccgggttcacaaggacgttgaactggcagagcaccttaatgcaagtctggcttttttcttatcagacttactgtctctggtggatcgtggattcgtctttagcttggttcgagctcactataagcaggtagctaccagactgcagagttcccccaaccccgctgccctcttgactttgcgcatggagttcactagaatactttgctcgcatgagcactacgtgacacttaatttgccatgttgccctctgagcccccctgctagcccatcaccaagtgtgtcatccaccaccagtcagtctagcaccttctcttctcaggccccagaccctaaggtaacatctatgtttgagctgagtggaccattcaggcaacagcatttcctggccggtctcctcctcaccgagctggcgctggccctggagccggaagcagagggtgctttcctgttacataagaaggccatctcagcagtgcattctctgctctgcggccatgacacggatcccaggtacgccgaagccacagtcaaagctagggtcgcagagctctacctgcctttattaagcatcgctagggataccttaccacggctgcatgatttcgctgaagggcctggccagcggtcccgcctggcttccatgcttgactccgacacagaaggtgaaggcgacattgctggaaccattaacccttccgttgcgatggccattgccggaggacccctggccccaggctcacgagccagcattagccagggacctccgacggcttctcgtgccggttgcgccttatccgcagagtccagcaggactctcctggcctgcgtgctctgggttttgaaaaacacagaacctgctttactgcagcgatgggccacagatttaaccttgccccagctgggtagacttctggatctgctgtacctgtgtctggccgcttttgagtacaagggtaagaaagcctttgaaagaatcaattccctgacttttaagaagagcctcgacatgaaggcacggctcgaagaagcgatactcggcactattggtgcaagacaggagatggttcgaaggtcaagggaaaggagtccctttgggaatcccgagaacgtgagatggcgcaaatcagtcacacattggaaacagaccagtgaccgcgtagataagacaaaagacgagatggagcatgaggcgctggtcgaggggaacctagctaccgaagcttctcttgtggtcctggacaccctggagatcattgtgcagactgtgatgctgtcggaagccagggagtcagtacttggggctgttctgaaggttgtgttgtactcgctgggctctgcacagtcagcccttttcctacagcatggtctggcaactcagagggctcttgtgagcaagtttcctgagctcctgttcgaagaagataccgagctgtgtgccgatctctgcttacggctgctgcgccactgcggatcgagaatttctactattagaacccacgcctccgctagtctatacctgctgatgagacagaactttgagatcgggcataactttgccagggttaaaatgcaggtgacaatgagtctgagcagcctcgtggggaccactcagaatttcagcgaggaacacctgcgtcgatctttaaaaaccattctcacctatgctgaggaggatatgggcctgagggattcgacattcgctgaacaggtgcaggatctgatgtttaatctccacatgatcctgaccgatacggttaaaatgaaagaacaccaggaggaccccgagatgctgattgacctcatgtatcggattgccagggggtaccagggctccccagatcttaggctgacatggctgcagaatatggccggaaagcatgccgagttgggcaatcacgctgaggcagcacaatgtatggtacacgccgctgccctcgtggccgagtacttagcactcttagaagaccaccggcacctcccagtcgggtgcgtaagcttccagaatatctcttccaacgtgttggaggaaagtgccatcagcgacgacatcttgagtcccgacgaagagggattttgctccgggaaacactttacggaactaggactggtcggcttactcgaacaggccgctggatacttcactatgggtggcctgtatgaagcagtcaatgaggtgtacaaaaatctcatccctatactagaggcgcacagggattacaaaaagctcgccgctgtgcacggcaagctgcaggaagcctttactaagatcatgcaccagagctcgggttgggagagggttttcgggacttacttccgggtgggtttctacggggctcacttcggtgatctggacgaacaggaattcgtttataaggagccctcgatcaccaaacttgccgagatttctcataggttggaagagttttacactgaacgattcggagatgatgtggttgagatcatcaaggacagcaatcccgtggacaagtcaaaactagattctcaaaaggcttacatccagattacttatgtggagccctactttgacacttatgaactgaaagatcgcgtcacctattttgatcggaactatggcctcagaacttttctgttctgtacccctttcacgccagatgggcgtgctcacggagagctgcctgaacaacacaaaaggaaaacactgcttagcaccgaccacgccttcccttacatcaagacccgcatccgggtctgccacagagaagaaactgtgctcacaccagttgaggtggctatcgaggatatgcaaaaaaaaactagggaactggcattcgctacagagcaggatcctcctgacgccaaaatgctacagatggtccttcaaggctcagtgggacctactgttaatcaggggcctctggaggtggcccaggtgtttctggccgaaattccagaagaccctaagttgttccgccaccacaacaagctgaggttgtgctttaaggacttctgcaaaaaatgcgaagatgccctgcgaaaaaataaggctcttattggtcctgatcaaaaggagtaccatagggaactggaacgaaactattgcagactgcgggaggcccttcaacccctgctgacacagaggctgccccagctcatggcaccaacaccccctggtcttcgaaactctctgaacagagcaagctttcggaaggccgatctctac

SEQ ID NO: 220455 - DNA, 4161 bp, Artificial Sequence
  Description of Artificial Sequence: Synthetic coding sequence
atgcgctgggttgatgggcacaaaggggtcttttcagttgagctgaccgctgttagctccgtccacccacaagatccatacctagataaattttttacgcttgtgcatgttctggaggagggggcattcccatttcgattgaaggacacagtgttgagcgagggaaatgttgaacaggagctccgagcatcgctagcggcacttcggctcgcaagccccgagcccctcgtggctttcagccaccacgtgttggacaaattagtgagactggttatccggccacctatcatcagcgggcagatagtgaatctgggcaggggggcattcgaagctatggcccacgtcgtgtccctggtccaccgatctctggaggcggctcaggacgctaggggacactgcccgcaactggcggcatatgtgcattatgcctttagactgccagggaccgaaccctccctccccgacggcgcacctcccgttacggtgcaggccgcaaccctggcacgaggaagtgggcgacccgcttcactatacctcgctagaagcaagtcgattagcagctcaaatcccgacttagcagttgcccctggctcagttgatgatgaagtatcgaggatccttgcatccaagggaatagatagaagtcactcctgggtgaatagtgcctacgcccctgggggtagtaaggccgtgctgagaagggcaccaccttattgtggggcagacccaaggcagctccttcatgaggaactcgccctccaatgggtggtcagtagttctgctgtgcgggaagcgattcttcagcatgcatggtttttcttccagctaatggtgaaaagtatggcgctgcacctgctcctggggcaacggctagatactccaagaaagcttcgcttcccagggagattcctggacgacataacagccctggtcgggagtgtcggcctcgaggtgattactagagtccacaaggacgtcgaactcgccgaacatctgaacgcctcactggccttctttctgtcagacctcctgtcgttagtggacagaggctttgtgttctctctggttcgcgctcactataaacaggtggccaccaggctgcagagtagccccaaccccgctgcgctgttaaccctccgtatggagtttaccagaatcctttgcagtcacgagcactacgtcacccttaacctcccatgttgtcctctgtcaccacccgcttctccatcaccttcagtatctagcaccacttcacagtcctcgactttttcgagccaggcccctgatcctaaggtaacttcaatgtttgagctatctggcccttttcgtcagcagcatttcctggctggtctgctgctgaccgagctcgctctggcattagagcccgaagccgaaggggcatttcttcttcataaaaaagcgatttctgccgtgcatagcctgctgtgtgggcacgataccgatcccaggtatgcagaagcaactgtgaaagccagggtagcagagctatacctccctctgctgtccattgctcgagacacattgcccagactgcacgattttgccgagggtcctggccagaggagccggctagccagcatgttagactctgacaccgagggagaaggagatattgcagggacaattaatccatcagtcgccatggcgatagctggcggaccactcgctcctgggtccagggcctccatctcccaggggccacctaccgcctcccgagccggatgcgctctgtccgccgaaagctcccgaaccctgctggcttgtgtgctttgggtcttgaaaaacaccgaacccgctctgttgcaaagatgggctaccgacctgacgctccctcagctaggtcgactgctcgaccttctgtacttatgcctggcggcttttgaatataaggggaagaaagcgttcgagagaattaattcgctgactttcaaaaagtccctcgacatgaaggctcgcctggaggaagctatcctcggcacgatcggggcaagacaggagatggttaggcggagtagagaaagaagccctttcggcaacccagaaaatgtgcggtggcgaaaaagtgtgactcactggaaacaaacatcagacagagtggataagaccaaggacgaaatggaacacgaagctcttgtcgaaggaaatcttgccactgaagcaagcttggtggtccttgacaccctggagatcatcgtccagacagtcatgctgtctgaggctcgcgagagtgtcctgggcgcagtcttgaaggtggttttgtactccctgggaagtgctcaaagtgctctcttcctgcagcacgggctggctacccaacgagcactggtgagcaaatttcctgaacttctgttcgaagaagatactgagctgtgtgcagatctctgcctccgcctcctgcgacactgcggttccagaatctccaccatcagaacccatgcctcggcctctctgtatctcctgatgaggcagaatttcgagatcggtcataactttgccagggttaagatgcaagtcacaatgtctctgtcatcacttgtcggaacaactcagaactttagcgaagagcacttaagacgttcgctgaagacaatcctcacttacgctgaagaggacatgggacttagggattcgacatttgccgagcaagttcaggacctgatgttcaacctccatatgatccttactgacaccgtcaaaatgaaggaacatcaggaggaccctgagatgctgattgacctgatgtataggatagctcgtgggtaccaaggttctcctgatctcagactgacctggctgcagaacatggctgggaaacatgccgagctgggcaaccatgccgaagcagcccagtgtatggtgcacgcagctgccctggtggccgaatacctggctctgttggaggaccacaggcacctccccgtgggctgtgtgtcatttcagaacataagcagcaatgtgctggaagaatcagccatttccgacgatatcttatctcctgatgaggaaggcttctgttctggaaagcatttcacagagttaggcctggtcggcttgcttgaacaggccgcaggatacttcacaatgggcggactctacgaagccgtgaacgaggtgtacaaaaacctgattcctatactcgaggcacatagggattacaaaaagcttgccgcagtgcacggtaagcttcaagaggcttttacgaaaattatgcatcagagtagcggctgggagagagtcttcggaacttatttccgggtagggttttatggagcacatttcggcgacctagacgaacaggaatttgtctataaggagcccagtattactaagttggccgaaatctcccataggttggaagagttctacacagaacggtttggtgacgacgtggtggagatcatcaaagactccaacccggtcgataagagcaaactcgactcccagaaggcctacattcagataacatatgtagagccttacttcgacacctacgagctcaaagaccgagtcacctacttcgatagaaattacggcctccgaacctttctgttctgcaccccttttactcctgacggccgagcccatggggagctgccggagcagcacaagaggaaaacactgctgtcaaccgaccatgctttcccttacatcaagactagaattagagtgtgccaccgcgaagaaacagtgttgaccccagtggaagtcgctatcgaagatatgcagaagaagacccgtgagttggcttttgccactgaacaggaccctcccgatgccaagatgctacagatggtgctccagggatctgtcggcccaactgtgaaccagggacctctggaggtcgcacaggttttcctggctgagatacctgaggatcccaagttgtttcgacatcacaataagttacgactgtgctttaaggacttctgtaaaaaatgtgaagatgccctccgcaagaacaaggcgctcatcggtccagatcagaaagaatatcatcgagagctggaacggaactactgccggctccgcgaggccctgcagccacttctcacccagcggttgccgcaactgatggccccaacaccacctggtctgagaaattctttgaaccgggcttcatttcggaaagccgacttatag

SEQ ID NO: 220456 - DNA, 5973 bp, Artificial Sequence
  Description of Artificial Sequence: Synthetic coding sequence
atggctaccctcccatccgccgaaagacgcgcatttgccctgaaaatcaaccgatacagttccgccgagataagaaagcagtttactttgcctccaaacttggggcagtaccatagacagagtatctccacatctggctttccctcactgcagctgcctcagttctacgatcctgtggagccagtggatttcgagggcttgttaatgactcacctgaattctctggacgtgcaattggctcaagagttgggcgactttaccgacgatgacttagacgtcgtattcacccccaaggagtgtcgcacactccagccgtctctgcccgaggaaggggtggaacttgatccccatgtgagggactgtgtacagacatatatacgcgagtggctgatcgtcaaccgcaaaaatcagggctcccccgagatttgtggattcaaaaaaacagggtcaagaaaggatttccataaaacgcttcctaaacagacatttgagtccgagacactggagtgctccgagccagccgcacaggctggcccacgacacctcaacgtgctctgtgatgtctccgggaagggacctgtgacggcatgtgattttgatctccggtccctgcaacctgacaagcgtctcgagaacctcctccagcaggtgagcgccgaagactttgagaaacaaaacgaggaggcacggcgaacaaacaggcaggcggaattgttcgctctgtatccctctgtggacgaagaagacgccgtggagattcgtccggtgcctgagtgcccgaaggaacacctgggcaatcgaatattagtgaaactgctaactctcaagtttgagattgaaatcgaacccctgttcgccagtatagcactgtatgatgtcaaagagcggaagaaaattagtgaaaacttccactgcgacctgaacagcgatcagttcaaaggctttcttcgggctcatactccttctgtcgcggcaagctcccaggctagaagcgctgtgttttctgtcacatacccaagttctgacatatatctggttgttaaaatcgaaaaggtcctgcagcaaggcgagatcggcgactgcgccgagccatatactgtgattaaggaatccgatggcggaaaaagcaaggaaaagatcgagaagctgaaattgcaggccgagagcttttgtcagcggctaggcaagtatcggatgccctttgcctgggcccctattagcctttcatccttcttcaacgtcagcaccttagaacgggaggtaacagacgtggattccgttgtaggtcgatcttctgtgggagagcgtcgcactttggctcagagtcgtcggttatccgagcgtgccctttccttggaggagaatggtgtcggttctaacttcaaaacctccaccctgtcagtcagcagtttttttaagcaggagggagaccggctgagcgatgaggacctcttcaaattcctggccgattataaacgctcctcttcgctgcagaggagggtcaagagcatccccggactcctccggcttgaaattagcacagctccagaaatcatcaattgttgtttaacacctgaaatgctgcccgttaaaccctttcccgagaacaggacacgccctcataaggaaatcctggagttccctacacgagaagtttacgttccccatacagtgtatcgaaatctgctgtatgtttacccgcagcgcctaaatttcgtgaataaactggctagcgccaggaacattactataaagatccagtttatgtgcggcgaggacgcttctaatgctatgccggtcatcttcggcaaatcctctgggccagaatttctgcaggaggtctataccgcggtaacctatcacaataaaagccccgatttttatgaagaagttaagatcaagctgccggctaagctgaccgtgaaccaccacctcctgttcactttttaccatatctcatgtcagcagaagcagggagctagtgtggagacactactgggctactcatggctgccgattctgctgaatgagcggctccagacggggtcctactgtctgcctgttgctctggaaaagcttccaccaaactactctatgcattctgccgaaaaagtgcctttacaaaaccctcccatcaagtgggctgaggggcataaaggagttttcaatattgaggttcaggcggtgtcctctgttcacacccaggacaatcacctggagaagttctttaccctgtgtcacagtttagagtcacaggtcaccttccccattcgagtcctcgatcagaagatcagcgagatggccctggagcatgaactcaaactgagcatcatctgcctgaattcctcgcgccttgaacccttagtgctctttctgcacctggttctggacaagcttttccagctatccgtacagcctatggtcatcgcgggtcaaactgccaattttagtcaattcgcatttgagtccgtggttgccattgctaacagtctgcataatagcaaagacctctcaaaggatcagcatggcaggaattgtctcctagctagttacgtgcactacgttttccgactgcccgaggttcagagagatgtgcctaagtcaggagcacccactgctctgttagacccaagatcctatcatacctatggacggactagtgccgctgccgtgtcgtcgaagctcttacaggcgcgtgtgatgagctcttctaatcccgacttggcagggacccacagcgccgctgacgaggaggtgaagaacatcatgagctcaaagcatttccatgaggagcttgcactccaaatggtagtgagcaccgggatggttcgggagacagtgttcaagtacgcgtggttcttcttcgagctcctggttaaaagcatggcgcagcacgtgcacaacatggacaagcgggactctttccgacggactaggttctcagaccgctttatggacgacataacaactatagttaacgtggttacaagcgagatagccgctctcctggtgaagccacagaaggagaacgaacaagcggagaaaatgaatatcagcctggcattttttctgtacgatttactgtcccttatggataggggctttgtgttcaaccttatacgccactactgctcacagctcagcgctaagctttccaatctgcccacgcttattagcatgcgactggagttcctcagaatactctgtagtcatgaacactaccttaatctgaatctgttcttcatgaacgccgacacagccccaacatctccttgtccaagtatcagttctcagaactcgagtagttgctcttcttttcaagaccagaagatagctagcatgttcgatcttacctcagagtatcggcagcaacacttcttaaccggcttgctgttcaccgagttggcagcggctttagatgctgaaggcgagggaatctcaaaagtgcagagaaaggcggtatccgccattcatagcctgctgagtagccacgatctggatccaaggtgtgtgaagcctgaagtgaaggtgaagatcgccgctctatacctcccactggttgggattatcctagacgcgctgccacagctttgcgatttcacagtagcagacacacgcagatacaggaccagcgggagcgacgaggagcaggagggtgctggcgcaatcaaccagaacgtggctcttgccatcgctggaaataacttcaacctcaagactagcgggatcgtcctctcctccctgccatataaacagtacaacatgcttaatgccgacacgactcgcaacctgatgatctgcttcttatggattatgaaaaacgccgaccagtccctaatcagaaagtggattgcagacctgccaagtacccagctgaacaggattctggacctgctttttatctgtgtgctgtgcttcgagtacaagggcaaacagagctctgataaagtttccacccaggtcctgcagaagtctcgcgacgtgaaagccaggctcgaggaagctttgctacggggagaaggcgcacggggagaaatgatgcgtcgacgtgcacccggaaacgatcggtttcccggtcttaacgagaacctgcgctggaagaaggaacaaacccactggcgccaggccaacgagaagcttgataagacaaaggccgaactcgaccaggaagccctcatttccggcaatttggccaccgaggctcaccttattatcttagacatgcaagagaacattatccaagcatcttcggccctcgactgtaaagactctcttctcggaggtgtactccgcgttctcgtgaactctttgaattgcgatcaaagcactacatacctcactcactgctttgcaactcttcgcgctctcattgcaaaattcggcgatctcctgtttgaggaagaggttgaacagtgctttgacctatgtcaccaggtgttgcaccattgttctagctccatggatgtgacccggtcccaggcctgcgcaaccctgtatctacttatgcgattctccttcggggcaacctcaaatttcgcgcgagtgaaaatgcaggtgaccatgagcctcgccagcctggtgggacgtgccccagatttcaacgaggagcacctgagacgatctcttcggacaattctggcctacagtgaagaggacacagccatgcagatgaccccctttcccacccaggtggaagagctgttgtgcaaccttaatagtattctctatgacacggttaagatgcgggaatttcaggaggaccccgaaatgttaatggatcttatgtacagaatagcaaagtcttaccaggcttcccccgatctgagacttacttggttacaaaacatggccgagaaacatacgaagaagaagtgttacactgaggccgctatgtgtctggtgcatgcagccgctctcgtggctgagtacctgtcgatgctggaggaccattcatatctccccgttggatccgttagtttccagaacatttccagcaacgtcctggaggagtcggtagtgagcgaagataccctgtctcccgacgaggacggggtctgcgctggccagtatttcactgagtcaggattggtgggcctcctggaacaggccgctgagctattctcaacaggtggcctctacgagaccgttaacgaagtctataagctagtcattcctattctagaggcgcaccgagagttccgaaaactgaccctgactcatagcaagctccaacgtgcttttgattctattgttaacaaagaccacaagcgcatgtttggcacttactttcgagttggcttcttcgggtctaaatttggagacttagacgagcaagagttcgtgtataaagaaccagctatcacgaagctgcctgagatttcacaccggctggaggccttttacggacagtgttttggtgctgaattcgttgaggtcattaaagactccactccagttgacaagaccaagctcgaccctaataaagcatacatacaaattactttcgtcgagccttactttgacgagtatgaaatgaaggatagggtgacttattttgaaaagaactttaacttacgacgcttcatgtacaccacgccttttacacttgaaggacgccctcggggagagctccacgaacaatatagaaggaataccgtcctgacaacaatgcacgcattcccctacattaaaacacgaatctccgtaatccagaaagaagaatttgtgctcacccccatcgaggttgcaattgaggacatgaagaagaaaacactgcaattggcagtcgccataaatcaagaaccaccggacgctaagatgctgcagatggtgctgcagggtagcgtgggcgctacagtgaaccagggcccactcgaagtagctcaggtgtttctggcggagattccggctgaccccaagctttatagacaccacaataaactaaggttgtgctttaaggaattcatcatgtag

SEQ ID NO: 220457 - DNA, 6095 bp, Artificial Sequence
  Description of Artificial Sequence: Synthetic coding sequence
atgacacaccttaactcactggacgtacaattagctcaggagcttggggatttcacagatgacgatctcgacgtggtgttcacgccaaaggaatgtagaacactgcagccatccttgccggaagagggagtggagctggatccccacgtccgagattgcgtgcaaacgtatatccgggagtggctgattgtgaatcgaaagaatcaaggcagcccagagatctgcggcttcaagaagaccggaagcagaaaggacttccataaaacactccctaagcagacgtttgagtccgaaaccctggaatgcagtgaacctgcagcacaggccggaccccgacacctgaatgttctctgcgacgtatccggtaaagggccagtgaccgcctgcgattttgacctgaggtctcttcagccggacaagcgtctcgaaaatctcttgcagcaggtatcggccgaagattttgagaaacagaatgaagaagccaggcgaacaaataggcaggccgagctattcgcgctgtacccctctgttgacgaggaggacgcggtggaaataaggccggtgcccgagtgtccaaaggaacacctcggtaataggatactggtgaaactgcttacgctaaagtttgagatcgagatcgagcccctgttcgcaagcatagccctctatgacgttaaagagcggaagaaaatctctgaaaattttcattgtgaccttaattccgatcagttcaaaggctttttgagagcccatacaccttctgttgccgcaagctcacaggctagaagcgcggtgtttagcgttacctacccatcatctgatatctatctcgtcgtcaagatagagaaagtgctacagcaaggcgagattggtgattgtgcagagccctatactgttattaaggaatcagatgggggtaaatctaaggaaaaaatagaaaagctgaagctgcaggccgaatctttctgtcagcggctggggaaatataggatgccgtttgcttgggcacctatctctctttcatcattcttcaatgtctccacactggagcgtgaggtgaccgacgttgactcagttgtgggcagaagctccgtgggtgaacgcaggacgttggcacagtcacgcagacttagcgagagagcgctgagccttgaggaaaatggcgtagggagtaactttaagacttctacgcttagcgtgtccagcttcttcaaacaggaaggcgatagactaagcgacgaggacctctttaaattcttagcagactacaagcgcagcagttctttgcagaggcgggttaaatcgattccaggcttgttgaggctagagatatccacagcacccgagatcataaactgctgtttgacccctgaaatgctccctgtcaaaccctttcccgaaaatcggacaagaccccataaagagatcctggagtttccgacaagggaggtctatgttccccacacagtttatcgtaacttactgtacgtgtatccacagagactcaattttgtcaacaagctggcctcagctcggaacatcactatcaagatccagttcatgtgcggagaagatgcgtctaacgcaatgcccgtgatttttggcaagtcttccggcccagaattcctccaagaagtttatacggcggtgacctatcacaacaaatcacctgacttctacgaggaagtgaagatcaaactccccgctaaattaactgttaaccaccatctgctgttcacattctaccatatttcttgccagcagaagcagggagcttcggtggagactctcctcggctactcgtggcttccaatcctgctgaatgagcgccttcagactggaagctactgtctccctgtcgctctggagaaacttccccctaattactcaatgcatagtgctgaaaaggtgccactccagaaccctcctatcaaatgggcagagggccataaaggcgtgttcaacatcgaggtgcaagctgtgagctcagtgcatacccaggacaatcatctggagaagttttttacactttgtcattcattggaaagccaagtcactttccctattagggtgttagatcagaagatttctgagatggctctggagcatgagctgaaacttagcataatttgcttgaatagctcccgtctcgaacctctggtactgttcttacacctcgtactagataagctgttccagctttctgtccagcccatggtgattgccggacagaccgcaaacttctctcagtttgcatttgagtccgtcgtggcaatcgctaactctttacacaattccaaggacctgagcaaggatcagcatggtaggaactgccttttggcgagctacgtgcactatgtcttccgcctgcccgaagtgcagagagatgtaccgaaaagtggcgcaccaaccgcgctgctggacccgagatcatatcatacctacggaaggacttccgccgctgcagtgtccagtaaacttctgcaagcccgagtgatgagcagctcaaaccctgacctggccggaacccattccgcagccgatgaggaggtgaagaatattatgtcaagcaagattgccgacagaaactgtagcagaatgtcctattattgttcaggttcttctgacgccccatcttctcccgctgcccctcggccagcaagcaaaaagcactttcacgaggagcttgctctccaaatggtggtctccactgggatggtaagagaaactgtgtttaaatatgcatggttctttttcgagctcctggtcaagagcatggctcagcacgtgcacaacatggataagcgcgactcctttcggaggacccgcttcagcgataggttcatggacgatattaccactatagtgaacgtcgtgacaagtgagatcgcagcgctccttgtgaagccccagaaggaaaatgagcaggcagagaaaatgaacattagtttggccttttttctatacgatctgctgtcgctgatggatcggggtttcgtgtttaatttgatccgccattactgcagtcaactgtccgcaaaactatctaacttaccaactttgatttctatgagactcgaattcctgaggatcttatgtagccatgagcattaccttaatctgaaccttttttttatgaacgctgataccgcccctacatctccctgccctagcattagtagccagaactccagcagctgttccagtttccaggaccagaaaatcgccagtatgttcgacttaacatctgagtatagacaacagcactttttaacagggctgctgtttaccgagcttgctgctgccttggatgctgagggcgaggggatctccaaagttcagcgcaaagcagtaagcgccatccactccctcctctccagtcacgacctggaccccagatgtgtgaagcctgaagtaaaggtgaaaattgcggcattgtatctccctctggttgggataattctcgatgccctgcctcagctgtgcgattttaccgtcgccgacacccgccgttatcgaacatcaggcagcgatgaagagcaagagggagcaggtgcaattaatcagaacgttgcattggccatcgctggaaacaatttcaatctcaaaacttcaggaattgtgctgtctagcttgccatacaagcaatataatatgctgaacgcagacacaacccgcaatctaatgatttgttttctctggatcatgaaaaacgcagaccagtccctgatcaggaagtggatcgctgacctccctagtacacaactgaacagaatacttgatctgctgtttatctgcgtcttatgcttcgagtataaaggaaaacagagtagcgataaggtgagtacacaggtgctgcaaaagtctcgagatgtgaaggcacgactggaagaggcgctcttaagaggtgagggggcacgtggggagatgatgcgtcggcgtgcacctgggaacgaccgttttcctggcttgaatgaaaatctgcgctggaagaaggaacagactcattggaggcaggcaaacgagaagctggacaagactaaggctgagctcgatcaggaggctctgatatcagggaacctggcaactgaggcacacctcatcatcctggacatgcaggagaacattatccaggcctctagcgccctcgactgtaaagactccctcttgggcggagtgctgagggtcttagttaacagcttaaactgtgatcaaagcaccacttacctcacccattgttttgccactttgcgtgcactgatagccaagttcggagacctgctgttcgaagaggaagtggaacagtgctttgatctgtgccaccaggtgctgcaccactgctcctcgagcatggatgtaacacgtagtcaggcctgcgcaaccctgtatctgctgatgcgattctcttttggtgctacttcaaattttgcccgtgtgaaaatgcaggtcacaatgagcttggcctccctggtggggagggctcctgatttcaacgaggaacatctgaggcgatctcttaggactattctggcgtattccgaagaagacaccgccatgcagatgaccccattccccacacaagtcgaagagctgctctgcaacctcaatagcatactttatgatacagttaagatgcgggagttccaggaagatccagaaatgttgatggatctgatgtacaggattgccaaaagctatcaagctagcccagacctgagactgacttggctccaaaatatggcagaaaagcataccaagaagaagtgttatactgaggccgcaatgtgcctggtgcacgccgcagcgctggtggccgagtatttgagtatgctggaagatcatagttatctgccagtgggtagtgtctcctttcaaaacatctcctctaatgtcttagaagaatctgtagtaagcgaggatactctatcaccagacgaagatggcgtctgcgccggtcagtactttacagagagtggacttgtgggactgctggaacaagctgctgagctatttagtaccggtggactgtacgagaccgtgaacgaagtatataaacttgttatcccaattctggaggctcatcgcgaatttagaaagttgacactcacacatagtaaactgcaacgagccttcgatagcatcgtcaacaaagatcataaacggatgtttggcacatattttcgcgttggtttctttggctccaaattcggggacctcgacgagcaagaatttgtgtacaaggagccggcaatcacaaaattacccgagatttctcacagacttgaagcgttctacggccagtgtttcggtgctgaattcgttgaggttatcaaagactcaactcccgttgataaaactaaactcgacccgaataaagcatacattcagatcacatttgtagagccctacttcgacgagtatgaaatgaaagatagggtgacctactttgagaaaaacttcaacctgaggagatttatgtatactactccgtttacactggaggggcgacccagaggagagctccatgagcagtacagacgcaacacagtgttgaccaccatgcacgcttttccatatattaagacacgtatcagtgtcattcagaaagaggagtttgtacttactccaattgaggtcgccattgaagacatgaaaaaaaagacattgcaattggccgttgctatcaatcaggaacccccagatgctaagatgcttcagatggtcctccagggaagcgtgggggcaacggtcaaccagggccctctcgaggtggcacaggtgttcctggcagagatccccgcagaccctaagctgtatcggcatcacaacaagcttaggttatgtttcaaggagtttatcatgaggtgcggcgaggcagtggagaaaaacaagcgactgatcactgctgatcaaagggagtaccagcaggaattaaagaagaactataacaagctcaaggagaatctccgacccatgattgaacggaaaatcccagagctatacaaacccattttcagggtagagagccaaaaaagggactccttccatcggtcctcatttcggaagtgtgaaacacagttatctcaggggtctta

SEQ ID NO: 220458 - DNA, 6299 bp, Artificial Sequence
  Description of Artificial Sequence: Synthetic coding sequence
atggccaccctcccttccgccgaaaggcgggcatttgctttgaagattaatcgctacagcagtgccgaaatcaggaaacaattcaccctaccccctaatttgggacagtaccatagacaaagtatttccacaagcggatttccaagcttgcaactcccacagttttatgaccctgtggaacctgtggactttgaggggcttctgatgacgcacctgaattccctagacgtacagcttgcccaggagctgggcgacttcaccgacgacgacctcgacgtcgttttcacgcccaaagaatgtaggacccttcagcctagcctgcctgaggagggcgtagagctggatccccacgtgagagactgtgtccaaacctatattcgcgaatggctgatagtgaatagaaaaaatcagggatccccggaaatttgcggtttcaagaaaaccggtagccgaaaagatttccacaaaacactgcctaagcaaaccttcgagtcagagacgctggagtgtagcgagcccgcagcacaagccggtcctagacatctcaatgttctgtgcgatgtgtccgggaaagggcctgttacggcttgcgatttcgatctaagaagcttgcaacccgacaagcggttagagaatttactgcagcaggttagcgccgaggacttcgaaaaacagaatgaggaggcccgtcgaactaacagacaagcagagctatttgcactgtatccaagtgtcgacgaggaagacgcggtggaaatccgacccgtacctgagtgcccaaaagagcatttaggcaaccgaatcctggtgaagctcctgaccctgaagtttgagatcgagatcgagccgcttttcgcaagcatagcgctgtatgacgtaaaggagagaaagaagataagcgagaactttcactgtgatttgaatagcgaccagttcaagggttttctgcgagcacatacccccagcgtggctgcttcatcacaggcacgttcagcggttttttccgtgacctatccaagctccgatatctacctggtggttaaaatcgagaaagtgctgcagcagggggaaatcggtgactgcgctgagccctacaccgtgattaaggagagtgatggtgggaagtcaaaggagaaaatcgaaaagttgaagcttcaggccgagtctttttgccaaagactcggcaaatatcgcatgccatttgcctgggctcctatatctctgagctcattctttaatgtctccactttggaaagggaagttacggatgttgacagcgtcgtgggccgaagtagtgtaggagaaaggagaactctcgctcagtcacgtcgcctaagcgaaagagccctcagcctcgaggagaacggagttggcagcaacttcaaaacatctactctaagcgtgtcctctttctttaaacaggaaggagacaggctgagcgacgaggatctgttcaagttcctggcagactacaaaaggtccagttccctgcaaagacgcgtgaagtctatccctgggctactgcgtctggagatttccaccgctcccgagattattaattgctgtctgacccccgagatgctgcccgtaaagccatttcctgaaaatagaacccgcccacacaaggagattctggagttccctacgcgggaagtttacgtccctcatacggtgtaccgcaacctgttatacgtgtatccccagcgcctgaactttgtgaataagctggcctccgcccgtaacataacaattaagatccagtttatgtgtggagaggatgcaagcaatgcaatgcctgtaatctttggtaagtccagcggacctgagtttttacaagaggtttataccgcagtcacataccataataagtccccagacttctatgaggaggtgaagattaagcttccagcgaaactaactgtaaaccaccaccttctgttcaccttttatcacatcagttgtcagcaaaagcagggggcttctgtggagacccttctaggttattcatggttgcctatcctgcttaatgagcgtctacaaaccggtagttactgcctgcccgtcgctctggagaagctgccacctaattacagtatgcactcagccgagaaagtgcccctgcagaatcctcctatcaagtgggctgaaggtcacaagggcgttttcaatatagaggttcaggctgtgtcctccgttcacactcaagacaatcacctggaaaagttcttcacactatgccactctttggaatctcaggtcacattccccatccgggtgctcgaccagaagatttccgagatggctctagaacacgaactcaagctgtctattatttgtcttaactcttcacgtcttgaacctttagtgcttttcctgcacctcgtgctggataaactgttccaactgagcgtgcagccaatggtcatagcgggacagacggcgaacttttctcaatttgcattcgagtctgtagtggcgatcgccaatagcctgcacaattctaaggatttgtccaaggaccagcacggacgtaattgccttctggcctcttacgtccattacgtattccggctgcctgaggtgcagagggatgtgccaaaatcaggggctccgactgccctgctggaccccagatcataccacacctacggcagaacctccgctgctgccgtatcatcaaagcttttacaggcaagagtgatgtcctcaagcaaccctgatcttgcgggtacccactccgctgcagacgaagaagtgaagaatatcatgtcctccaagatagccgatagaaattgctctaggatgagctactactgctctggctcgagtgacgcaccgtcatctcccgctgcccctcggccagcgagtaaaaaacactttcacgaggagctggctctgcaaatggttgtttcaacaggaatggttcgggagactgtgttcaaatacgcatggttttttttcgagctgctggtgaagagtatggcgcaacacgtacacaatatggataagagggactccttccggagaacacggttctcagatcgctttatggatgacatcaccactattgtgaacgtggtgacgagcgagattgccgcattgctggtaaagccacagaaggagaacgaacaggctgagaagatgaatatctctctggctttttttctttatgatctgctaagcctgatggaccggggatttgtttttaatctgattcgacattattgtagtcagcttagcgctaagctcagcaatctgccaacattgatctcgatgcgacttgaatttttaagaattctgtgctcacacgaacactatctcaacttgaacctcttctttatgaacgccgacactgctcccacctccccgtgtccaagcatctcaagccaaaattcttcctcctgcagctccttccaagatcaaaaaattgcctctatgtttgatcttacaagtgaatacagacaacagcactttctgactggtctcttgttcactgagcttgcggcagccctggatgccgaaggcgagggcatttccaaggttcaaagaaaggctgttagtgccatccatagccttttgagcagccacgaccttgacccacgatgtgtgaagccagaagtaaaagtgaaaatcgcagctctctatctgcccctcgtggggattatccttgatgcactcccacagctgtgcgacttcactgtggccgacactcgcaggtacagaacaagtggatccgatgaagagcaggaaggagccggagctataaaccagaatgtggccctggcgattgccggaaacaatttcaacctgaaaacaagcggtatagtgctgagtagcctcccgtacaaacagtacaatatgctgaacgcagacaccacgcgcaatctcatgatatgttttttatggataatgaagaatgctgaccagtctttgattagaaagtggatagccgacctgccgtccacgcagctcaataggatcctggacctgctgttcatctgcgtgctttgctttgagtataagggtaaacagtctagcgataaagtgagcacccaggtactgcagaaaagtagggatgtgaaagccaggcttgaggaggccctgctgcgaggcgagggagctcggggagaaatgatgagaaggcgcgctcccggaaatgatagattcccaggactgaatgaaaacctccggtggaaaaaagaacagacccactggagacaggcaaatgagaaattggataagacaaaagcagagctagatcaagaagcactgatcagtggcaatctcgccaccgaggcccacttgattattctcgatatgcaggaaaacatcatccaggccagttcagccctagattgcaaagatagcctcctgggtggcgtgctgcgcgtcctggtgaattcacttaattgtgatcagagcaccacttacttgactcactgtttcgctaccctacgggctctcatcgccaaatttggagacctgctgtttgaagaagaagtggagcagtgcttcgatctctgccaccaggtgctgcaccactgctcaagtagtatggacgtgactcgatcacaggcctgcgctaccctgtaccttctgatgaggttctcatttggggcaacatcaaacttcgcccgtgtgaagatgcaggttacaatgagtttggcctcccttgttggtcgggctcctgactttaatgaagaacacctgcggaggagcctgagaacaattctagcgtattctgaggaagatacggctatgcagatgactcccttcccaacccaggtggaggaacttctctgcaacttgaactcaatcttgtacgacacggtaaaaatgcgagaatttcaggaggaccccgaaatgctgatggacttgatgtaccgaatcgctaagtcttatcaggccagcccggaccttaggcttacctggctgcagaatatggccgagaagcacaccaagaagaaatgctatacagaagccgctatgtgcctcgtgcacgctgctgccctggtcgctgagtacctgagcatgttagaagatcatagctatctccccgtcgggtctgtgagttttcagaatatctccagcaatgtgttagaggagtccgtagtatccgaagacactctgtcacctgacgaggatggtgtatgtgccggacagtactttacggagtctggtctggtcggtttattggaacaggccgctgagctcttcagcaccggtggcctctacgagacagtgaacgaagtttacaaattggtcataccaatactcgaggcccacagggaatttcggaaactgactctgactcactctaaactgcagcgggcattcgattcaatcgtgaacaaggatcataaacgcatgtttgggacttacttccgggtgggcttctttggctccaaatttggagacttagatgagcaggaatttgtatataaagaacccgcaataactaagctgcctgaaatttcccatcgattggaggccttctatggccagtgtttcggcgcagagttcgtcgaagttattaaagactctacccccgtagacaagacaaaactcgatccaaacaaagcttacatccagatcactttcgttgaaccttactttgacgagtacgaaatgaaggacagggtgacatactttgaaaagaatttcaatcttcgcagatttatgtataccacccctttcaccctcgagggtcgtccacggggtgagctacatgagcagtacaggagaaacacagtccttactaccatgcacgcattcccgtatatcaagacccggataagcgtcattcaaaaggaggagtttgtgctgacacccatcgaagtagccatcgaggacatgaagaaaaagactctgcagctggcagtagccattaaccaagagcctcccgacgctaagatgttacagatggtgctccagggttctgtcggagccaccgtaaaccagggacctttggaggtggcccaggtctttctggcagaaattcctgcagacccaaaactgtatcgccaccacaataagctgaggctgtgctttaaagagttcattatgaggtgtggcgaggcggtcgagaagaataagcgattgatcaccgctgaccagcgtgagtaccagcaagaactgaagaaaaactacaataaactgaaagaaaatctgcggcctatgattgaacggaagatccctgagctgtacaaaccaatctttagagtggagtcccaaaagagggattcattccatcggtctagtttccggaaatgtgagacacagctatcacaggggtcgta

SEQ ID NO: 220459 - DNA, 5999 bp, Artificial Sequence
  Description of Artificial Sequence: Synthetic coding sequence
atgacacatctgaatagtctcgatgtccagctcgcacaggagttgggcgacttcacggatgacgacctggatgtggtgtttaccccaaaagaatgccgcactctgcagcctagcctcccagaggagggcgtagaattagacccccatgttcgcgactgcgtccagacatacatccgcgagtggctgattgtgaatcggaaaaaccaggggtccccggaaatttgcggcttcaagaagaccggatcgcggaaggactttcacaagacacttcccaaacagacttttgaatcagagaccctagaatgctccgagcccgctgcacaagctggacctagacacctcaacgtactgtgtgacgtgtcaggcaaggggcctgtcaccgcctgcgatttcgatttgcggagtcttcagccggacaagaggctcgagaaccttttgcagcaggtttccgctgaggatttcgaaaaacagaatgaggaggcccgaagaacaaatagacaggcagagctgtttgctttatatccttcggtggatgaggaagacgcagtggagatcagaccagtgccagaatgccctaaggaacacctggggaatcggatactcgtgaaacttctgaccctcaagtttgaaatcgaaattgaaccactgtttgccagcattgcactgtatgatgttaaagagaggaagaaaatctcagaaaactttcactgcgatctgaacagcgatcagttcaagggttttcttagggctcacaccccctccgttgctgcaagctcccaagcgaggtcagcggtcttttctgtgacttatccttcatcagacatctacctggttgtcaagatagagaaagtgctgcaacaaggggaaattggcgactgtgcggaaccttatactgtgatcaaggagtcagacggcggaaaatccaaagagaagattgagaaactcaagttacaagccgagagcttttgccagcgtctcggcaagtacagaatgcccttcgcttgggccccaataagtttgtcatcttttttcaacgtatctacgctggaaagggaagttacagatgtggattcagttgttggtcgtagttccgtcggcgagcgccgtactcttgcgcaatccagacgactctctgagcgagcattgagcctcgaggaaaacggagttggctctaactttaagacctccacattatcagtcagctcattctttaagcaggagggtgaccgtctttctgacgaggatctgttcaagttcttggccgactacaagcgctcctcctccctccaaaggagggtgaagagcattcctgggcttcttagactcgaaatttcaacagccccagaaattattaattgttgtctaacccccgagatgctgcccgtcaagcccttccctgaaaaccggaccagaccacacaaggagatccttgaattcccgacccgggaagtgtatgttccacataccgtgtacagaaacctgctgtatgtctatccccagcggctgaacttcgtaaacaaactagccagtgctcggaacatcacgattaagatccagtttatgtgcggcgaagacgcgtccaatgctatgccggtgattttcggtaagagctccggcccagaattcctgcaggaagtctacaccgccgtaacatatcacaataagtcaccagatttctatgaggaggtcaaaattaaattgcccgctaaactgactgttaatcatcacctgctgttcaccttttaccatatatcttgccagcagaagcaaggagcatccgtcgagactctgcttggctactcctggttacccatactgcttaatgaaaggctgcagacaggtagctattgcttaccagtggcgctggagaagctccctccaaattattctatgcatagtgcagaaaaagtgccccttcagaatcccccaattaaatgggccgagggtcacaagggggtgttcaatatagaggtccaggctgtctcaagtgttcacacgcaggacaatcacttggagaagttctttactctgtgccactccttggaaagccaagtgaccttccccatcagagtgctcgaccagaagatttcagaaatggccttagagcacgaactgaagctgtctatcatctgcctgaacagttctagacttgagcccctggtccttttccttcatctggtgttggacaagttattccagctgagcgtgcagcctatggtcatagccggtcaaactgcaaatttttctcagtttgcttttgaatctgtcgtagccatagcaaacagcctccataacagcaaagacttgagtaaagatcagcatggcaggaactgtcttttagcaagctatgtgcactacgtattccggttgccggaggtgcagcgagacgtcccaaagagcggtgcaccaacagctttgttggatcccagatcctatcatacctatggaagaactagtgcggcagctgtgtctagcaaattgttacaggcacgagtcatgagtagtagcaaccccgatttggccggtactcactcggccgctgatgaggaagtgaagaatatcatgtcctccaaacacttccatgaagagttggcgctgcaaatggttgtaagcactggcatggtgcgtgagactgtcttcaaatacgcatggttttttttcgagttgctggtcaagtctatggctcaacatgtgcacaatatggataaaagggacagtttccgaagaacccggtttagcgacaggtttatggatgacatcacaacaatcgttaacgtcgttacctccgagattgcagccctacttgtgaaaccacagaaagagaatgagcaggctgagaagatgaacatctctttggccttttttctctatgatctgctctccctgatggaccgtggttttgtcttcaatctcataagacactactgctctcaactctctgcaaagctgtccaacctaccgacccttatttctatgagactggaatttctcagaattctatgttctcacgagcactacctcaatctgaaccttttctttatgaatgctgataccgcaccgaccagtccgtgtccatcgatctccagtcaaaacagtagtagctgctccagcttccaggaccagaaaatagcatctatgtttgacctgaccagcgagtataggcagcagcatttccttaccggtcttctctttactgaattggctgccgcactggatgccgagggcgagggaataagcaaagtccagcggaaagccgtctccgccatccatagcctcttatcttctcacgatttagacccacggtgcgtgaaaccagaggtcaaggttaagattgcagccctctacctgccgctcgtgggaattattctggacgctttgcctcagctctgcgacttcacagtggccgacacgcgaagataccgaacgtccggttcagatgaagagcaggaaggggcaggagctatcaaccaaaatgtggccctagccatcgcaggtaacaacttcaatctcaaaacttccggcatagttctctcatctctgccgtacaaacagtacaatatgctcaatgccgacacaacgcgaaacctgatgatctgtttcttatggataatgaagaacgcagatcagtcactgattaggaagtggatagcagacctccccagtacacagttgaaccgaatcctcgatcttctatttatatgtgtgctgtgctttgagtataaaggaaagcagtcctccgataaagtgtcaacccaggtcctgcaaaaatccagagatgtgaaagccagactcgaggaggccttgctgcggggtgaaggagcccgtggagagatgatgcgacggagggcccctggtaatgacagatttcctggtctcaacgaaaacctgcggtggaagaaggagcaaactcattggcgtcaggccaacgaaaagctggacaagacgaaagccgaactagatcaggaggccctgatatcaggaaatcttgcaaccgaggcccatctgatcattttggatatgcaggaaaatataattcaggcgtcatctgccctagactgcaaagatagcttgctggggggagtccttagggtgttagtgaacagcctgaactgtgatcaaagcacgacatacttgacacactgctttgcaaccctgagggccctcattgctaagttcggtgatttgttgttcgaagaagaagtggagcagtgcttcgacttgtgtcaccaggtcttgcatcactgctctagctccatggatgtgacccggagccaggcctgtgcaacgctgtatctgctgatgcggttcagtttcggagctacttcgaattttgcgcgagtcaaaatgcaggtcaccatgtcccttgcatccctggtcggtagagcacctgatttcaatgaggagcatttacgtcggagcctgcgcaccattctcgcctactcggaagaggataccgccatgcagatgaccccttttcccactcaggttgaagaattattatgcaacctgaattctatcctctatgatactgtgaagatgagggaattccaggaggacccagaaatgctgatggatctgatgtatagaatcgctaagtcataccaggcctcccccgatctgaggctaacatggctccagaacatggctgaaaaacacaccaaaaaaaaatgctacaccgaggctgctatgtgtctcgtacacgcggctgcactggtagcggagtaccttagtatgctcgaggaccattcgtatctgcctgtggggtccgtgagttttcagaacatctctagtaatgtgctggaagagtcagtggtttccgaagacaccctgagccccgacgaagacggagtttgcgccggacagtacttcaccgaaagtggactggtcggtctattggagcaggcggctgagctattttccaccggcggactttatgagaccgtgaatgaggtgtataagctcgtgataccaatcctcgaagcccatcgtgagttccgcaaactaaccctgacccactcaaagttgcagcgggcttttgattccatcgtcaacaaagatcacaaacggatgtttggcacttattttcgtgtggggttttttgggagtaagttcggcgacttagacgagcaggagtttgtctacaaggagcctgccataaccaaactgccagagatttctcaccggctggaggcattttacggacagtgtttcggcgctgagtttgttgaagtcatcaaagactccactccagtggataagaccaaactggatccaaacaaggcctacatccagatcacctttgtggagccctacttcgacgaatacgaaatgaaagaccgtgttacgtattttgaaaagaattttaatctgagaagatttatgtacacaacccccttcaccctggaagggcgtcccaggggagaattgcatgagcagtatagaaggaatacagtgctgaccaccatgcacgccttcccatacattaaaacgcggatctcagtgatccagaaggaggaatttgttcttactcccattgaggtggcaatcgaagacatgaagaagaagactttacagctcgcggtggccatcaaccaagaaccacctgacgctaaaatgctccagatggtcctccagggctccgtcggtgcaactgtgaaccaaggccctttggaagtagcacaggttttcctggcagagattcccgcagaccctaagctctatcgacaccacaataagcttcggctgtgctttaaagagttcattatgcgctgcggagaagctgtcgaaaaaaacaaaagattaataaccgcagaccagcgtgaataccagcaggaactcaagaagaattacaacaaactcaaggagaatctgcgccctatgattgagagaaaaatcccagaattgtacaagccaatttttagagtagaatctcagaaacgggattcctttcatcggagttcctttcggaaatgtgaaactcagctgtctcagggcagtta

SEQ ID NO: 220460 - DNA, 1182 bp, Artificial Sequence
  Description of Artificial Sequence: Synthetic coding sequence
atgaaacggacaagagacgaggtcgatgctactttacagatcgccaagctgaatgctgctgagcttctcccagccgtccattgtctgggcttcggccctggtgcatcgggcgctgccgctggggatttttgcctactcgagctcgagcctactttgtgccagcaacttgaggacggtcacagcctggtgatacgtggtgacaaggatgagcaggcagttctctgttccaaagacaaaacttacgatcttaagattgctgatactagtaatatgttattgtttatccctgggtgcaaaacacccgaccagcttaagaaagaagactcacactgcaatattattcacacagagatatttgggttctccaataattactgggagctgagacggagacgaccgaaactgaaaaaactgaagaagctgttgatggagaacccatacgaggggccagatagccagaaggagaaggattctaacagctccaagtacacgactgaagatttactggatcaaatccaagcatccgaggaggagattatgactcagctgcaggtgcttaatgcctgtaaaattggtgggtattggaggatcctcgagttcgattatgagatgaagttgctgaatcacgtaactcagctggtggactccgaatcatggtcttttggtaaggtgcctctcaatacttgtctgcaggagcttggccctctggagcccgaagagatgatcgaacattgcctgaaatgttacggcaaaaaatacgtggacgaaggcgaagtgtactttgagctggatgcggataaaatctgtcgggctgctgccagaatgttattacagaacgccgtcaaattcaacttagctgaatttcaggaggtgtggcagcagagcgtccccgaaggtatggtgacctccctcgatcagttaaagggcctggcgttagtggataggcactcacgccctgagatcatcttcctgctgaaagtagacgatttaccagaggataaccaagagcgctttaactccctctttagcctgagagagaagtggaccgaagaagatatcgctccatatatacaggacttgtgtggcgaaaagcagaccatcggagcgcttcttaccaagtattcccactctagcatgcagaatggtgtcaaggtatacaactctagacggcctatctcctag

SEQ ID NO: 220461 - DNA, 342 bp, Artificial Sequence
  Description of Artificial Sequence: Synthetic coding sequence
atgagcgcctctgtagtgagcgttatcagcaggttcctcgaggagtatctgtcatcgacgccccagagactgaaactgttggacgcctatttgctgtacatactactgacaggagcattgcagttcgggtattgtctcctggtggggactttcccctttaacagttttctgtcaggattcatcagctgcgttggatcattcatactggccgtgtgtctgcgcatccaaatcaatccacagaataaggcagactttcagggtatttcaccagaaagagcattcgccgacttcttattcgcgtcaacaattctccacctggtagtgatgaactttgttggctag

SEQ ID NO: 220462 - DNA, 285 bp, Artificial Sequence
  Description of Artificial Sequence: Synthetic coding sequence
atgaggacactggcaatacttgccgcaatcctgttggtggccctccaggcacaggccgaaccgcttcaggccagggccgatgaagttgcagctgctccagaacagattgcggctgatattccggaagttgtcgtctccctggcgtgggacgagtcactggcccctaagcacccaggaagcagaaagaacatggcttgttactgtagaattccggcatgtatcgccggagaacgtcgttacgggacttgcatttaccaaggtagattgtgggctttttgctgctag

SEQ ID NO: 220463 - DNA, 285 bp, Artificial Sequence
  Description of Artificial Sequence: Synthetic coding sequence
atgcggactctggccattctcgcagccatcttgctggtggctctgcaggcacaggccgaacctcttcaggcacgggctgatgaagtggcagctgcaccagagcagatagctgcggacatccccgaggtggttgtgtcactggcctgggacgagtcacttgctccaaagcatcccggaagtaggaagaacatggcctgctactgtcgaatccctgcatgcattgccggtgagaggagatatggaacttgcatttatcaggggagactctgggccttctgctgttag

SEQ ID NO: 220464 - DNA, 294 bp, Artificial Sequence
  Description of Artificial Sequence: Synthetic coding sequence
atgcgcattatcgccctgctcgccgcaatacttctggttgcattgcaggtgcgcgcaggcccactccaggcgcgtggtgacgaggcccctggacaagaacagagaggaccagaagatcaggatatctcaatatcctttgcatgggacaagagcagcgcccttcaggtctccgggtctactagagggatggtgtgctcctgtagattagtgttctgccggagaacagaactgagggttggtaattgtttgataggtggggtgtcatttacttattgctgcactcgtgtcgactag

SEQ ID NO: 220465 - DNA, 285 bp, Artificial Sequence
  Description of Artificial Sequence: Synthetic coding sequence
atgagaacaatcgcaatattggctgccattctcctggtggcactgcaggcccaggcagaatcgctgcaggagagggctgatgaggcgaccacccagaagcaatctggggaggataatcaggaccttgccatctcttttgccggaaacgggctctcagcactcaggactagtgggagtcaggccagggccacttgctactgtaggactggtaggtgcgcaaccagggagtcactgagtggggtctgtgaaatctcaggtcggttatacagactctgttgcagatag

SEQ ID NO: 220466 - DNA, 303 bp, Artificial Sequence
  Description of Artificial Sequence: Synthetic coding sequence
atgcgaacccttactatactcacggcagtattactggtggctctgcaggccaaagccgagcccctccaggctgaagacgaccctcttcaggccaaggcctacgaggcggacgctcaagagcagaggggtgctaacgaccaggatttcgcagtctcgtttgctgaagatgcctcgagtagcctgagggccctgggtagcacgcgcgcttttacgtgtcactgccggcgtagctgttactccactgagtactcttatggtacctgtacagtcatgggaattaatcaccgtttttgctgcctatag

SEQ ID NO: 220467 - DNA, 207 bp, Artificial Sequence
  Description of Artificial Sequence: Synthetic coding sequence
atgcggacctcgtacctgctgctatttactctctgccttctcctctcagagatggcttctggcggaaatttcctgacagggttaggccatagaagtgatcactataattgtgtctctagcgggggacagtgtctgtactccgcttgtccaatttttaccaagatacagggaacatgctatcgcggaaaggctaagtgctgtaaatag

SEQ ID NO: 220468 - DNA, 372 bp, Artificial Sequence
  Description of Artificial Sequence: Synthetic coding sequence
atgaagttgctgctattagctcttccgatgctggtgctgctgccccaggtaatccctgcctatagcggagagaagaaatgctggaaccggtccggccattgccgtaagcagtgcaaggacggggaggcagtcaaagacacttgtaaaaacctgagagcgtgttgtataccatctaatgaggaccaccggcgtgtccccgctacatcacctacccccctgagtgattctaccccgggaataatagacgacatactgaccgtgcggtttactaccgattacttcgaagtgtccagcaagaaagacatggtggaagagagcgaggctggcagaggaactgagactagtctgcccaacgttcatcactccagctag

SEQ ID NO: 220469 - DNA, 1002 bp, Artificial Sequence
  Description of Artificial Sequence: Synthetic coding sequence
atgagttggataaaagaaggggaactgagcctgtgggagaggttttgcgccaacatcatcaaggcaggtcctatgcccaaacacatcgccttcatcatggacggtaaccggaggtatgcaaagaagtgtcaagtggagaggcaggaagggcacagccagggcttcaacaagctcgccgagacactgaggtggtgtctgaatttgggcattctggaggtcacagtgtacgccttcagtatcgagaacttcaagcgctccaagagcgaggttgacggcctgatggacctcgcccgtcaaaagttttctcgcctcatggaagagaaagagaagcttcagaaacatggagtgtgtatccgcgtactgggagacctccatttgttacctctggacctgcaggagttaattgcacaggctgtgcaggctacgaaaaattataacaagtgtttcctgaatgtgtgcttcgcctacactagccgacacgaaatctcaaatgccgtgcgggagatggcatggggagtcgaacagggactgctggacccttctgacatttccgagagcctgctggacaagtgtctgtataccaaccgctccccccatccagacatcctcattaggaccagtggagaggtgaggctgtcggacttcctgctctggcaaaccagtcacagctgcctggtgttccagccggtcctttggccagagtatactttttggaacctattcgaagccatactgcaatttcagatgaatcactccgttctgcagaaggccagggacatgtatgctgaggaacggaaaagacagcagttggagagggatcaagcaaccgtgaccgaacaactgctgagagagggattgcaagcttcaggggatgcccagttgcgtcggacaaggttacacaagctgagcgcccgtagggaagagcgtgtccagggattcttacaggctctggagttgaaacgggcagactggctggcgcgactgggaacagccagcgcttag

SEQ ID NO: 220470 - DNA, 1005 bp, Artificial Sequence
  Description of Artificial Sequence: Synthetic coding sequence
atgtcctggatcaaggagggtgagctgagtctatgggaacgcttctgcgctaacattataaaagccggaccaatgcctaaacatatcgcattcataatggacggcaatcgaagatatgctaagaagtgtcaagtggaacgccaggaagggcacagccagggatttaataaactcgcagagaccttaaggtggtgtctgaacctcggtattttggaagtcaccgtgtacgccttctctatcgagaacttcaagcggagcaaatcggaggtcgatggactgatggatcttgccaggcagaaattttccagactaatggaggaaaaggagaaactccagaagcacggcgtgtgtattagggtactgggggacctgcatttattgccactcgacctccaggaactcatagcccaggcagttcaagccaccaagaactataacaagtgcttcttgaatgtatgcttcgcctatacttcaagacacgaaatcagtaacgctgtgagagagatggcctggggcgtagaacagggactgcttgatccgtccgatatcagcgagtccctccttgataagtgcttgtacacgaaccgctcccctcacccagacatcctcatacggacttccggcgaagtcaggcttagcgattttctgctctggcagacttcacattcttgcctggtgtttcagccggtgctgtggcccgagtatacattctggaacttgtttgaggctatattgcagttccagatgaaccacagtgtgctgcaacaaaaggctcgagatatgtacgctgaagagagaaagcgacagcaattggagcgggaccaggcaacagtcactgagcaactgctcagagaaggcctacaggcgtccggagacgcacagctgcggagaacccgcctgcacaagctgagtgctagacgcgaggagcgggtgcagggcttcttacaggctctggagctcaagcgagccgactggctggccaggctggggacggcatccgcctag

SEQ ID NO: 220471 - DNA, 516 bp, Artificial Sequence
  Description of Artificial Sequence: Synthetic coding sequence
atggatctggccaggcagaagttttctcgtcttatggaggaaaaggagaagctgcagaaacacggagtgtgcattcgggttttgggagatctgcacctccttcccctcgacctgcaggagctcatagctcaagccgttcaggccacaaagaattataataatgatattagtgagtcgttgctggacaaatgtctttacaccaaccggtccccccaccccgacattcttattaggacgtccggggaggtaagacttagcgatttcttactgtggcaacagaaggcacgtgacatgtacgcagaggagaggaaacggcaacagttggaaagagaccaggccacagtgacagaacaactgttgcgtgaagggctgcaggcctctggggacgctcagctgagacgaaccaggctgcacaagttgtccgcgagacgcgaggagcgagtgcagggcttcctgcaagcccttgagctgaagcgagctgactggctcgcacggctcggaaccgcctccgcctag

SEQ ID NO: 220472 - DNA, 501 bp, Artificial Sequence
  Description of Artificial Sequence: Synthetic coding sequence
atggacgggaaccggagatatgcaaaaaagtgccaggtggagcggcaggaggggcacagccaaggattcaataaactggccgagactcttaggtggtgtcttaatttaggcattctcgaggtcacagtgtacgctttctcaattgagaattttaaaagatctaaatcagaagtggacggcctgatggatctcgcccgacagaaattttcacgcctgatggaggaaaaggagaaattacagaaacacggggtgtgcattagggtgcttggggatctacacctgctgcctctagacttgcaggagttgattgcccaggcagttcaagcaacaaagaattacaacaagtgcttcctgaacgtctgtttcgcttatacgagcagacacgagattagtaacgcagtgagagagatggcttggggagtcgagcaaggactcttagacccttctagagatcgattccaccacatcggacaagcttctctcgagttactgacctcttag

SEQ ID NO: 220473 - DNA, 546 bp, Artificial Sequence
  Description of Artificial Sequence: Synthetic coding sequence
atggaggagaaggaaaagctccaaaaacacggggtgtgcataagggtcctgggggatctgcacttgcttccccttgacttgcaggagctgattgcccaggcagtgcaagcaactaaaaactataacaaatgcttcctgaacgtttgcttcgcatatacttccaggcacgaaatctcaaatgccgtgagggaaatggcatggggtgtcgagcagggcctccttgacccctccgatatttcggagtccttgcttgacaagtgtctgtacacaaacagaagtcctcacccagacatcctcatcagaaccagcggcgaagtgaggttatccgactttcttctgtggcaaacctctcactcttgtctggtatttcagccagtcctgtggcctgaatatacattttggaacctcttcgaggccatccttcagttccagatgaaccattcagtgctgcaacacccaggtagccttctgacaaaggcctggaaaaagcccttccagcaggatggagagttatatggcaattgctccagccccaaatcatcctag

SEQ ID NO: 220474 - DNA, 669 bp, Artificial Sequence
  Description of Artificial Sequence: Synthetic coding sequence
atgagctggattaaggagggggaattatcattgtgggaaaggttttgtgccaacataatcaaggcaggcccaatgccgaaacatatcgcctttataatggacggaaaccgtcggtatgccaagaaatgtcaggtggaaaggcaggagggtcattcccagggtttcaacaagctggcggagacactccgctggtgtctaaacttgggcatcctggaggttactgtctacgccttttccattgaaaacttcaagcggtccaaatctgaagtcgatggacttatggatctggccagacagaaattctctaggctgatggaggagaaggagaaactgcagaagcatggcgtctgcatacgggttctcggtgaccttcatttattacctttagatctgcaggaactcatcgcacaggcggtccaggctacaaagaattataataagtgttttttaaacgtctgcttcgcatatactagccgacatgagatctcgaacgccgtgagagagatggcctggggggtggaacagggcctgcttgatcctagataccccgatgatatcagcgagtcgctgttagacaaatgcctctatacaaacaggagtcctcaccctgacattctgatccgaacttcaggcgaggttagactatcagacttccttctttggcaatag

SEQ ID NO: 220475 - DNA, 369 bp, Artificial Sequence
  Description of Artificial Sequence: Synthetic coding sequence
atgagttggatcaaggagggagagttgtccctctgggagcgcttctgcgctaacatcatcaaggccggtcctatgcccaagcacatcgccttcataatggatggcaacaggaggtacgccaagaagtgtcaagtagagagacaggaaggtcattctcagggttttaataagctggctgaaactctgcgctggtgtctgaatctgggaatcctcgaggtgacagtgtatgcatttagcattgaaaactttaaacgctctaagagtgaagtggacggcttaatggatttagcccgacagaagttttccaggctcatggaggagaaagagaaactgcaaaagcatggagtttgtatccgcgtgctcggttag

SEQ ID NO: 220476 - DNA, 216 bp, Artificial Sequence
  Description of Artificial Sequence: Synthetic coding sequence
atgtcatggataaaggaaggcgagctgtccctgtgggagcggttctgtgccaatatcatcaaggcgggtcccatgccaaaacacatcgcctttatcatggatggcaataggcggtacgcaaaaaagtgtcaggtagaaagacaggaggggcattcccagggcttcaataagctggctgagactcttaggtggtgcctgaatctcggaatcctctag

SEQ ID NO: 220477 - DNA, 258 bp, Artificial Sequence
  Description of Artificial Sequence: Synthetic coding sequence
atgagctggattaaggaaggagaactgtccctttgggaacggttttgcgcgaacatcattaaggctggccctatgcctaaacatattgccttcataatggacggaaaccggaggtacgccaagaagtgtcaggtggagcggcaggaaggccacagccaggggttcaacaagcttgccgagactctccgatggtgcctgaacctcggtatactggaagttaccgtgtacgcattctctatagaaaatttcaaacgatag

SEQ ID NO: 220478 - DNA, 885 bp, Artificial Sequence
  Description of Artificial Sequence: Synthetic coding sequence
atgtcctggattaaggaaggagagctctccctttgggagaggttttgtgcaaatatcattaaagcaggaccaatgcccaagcacattgcttttattatggatggtaatagacgctatgctaagaaatgccaggtagaaagacaagagggccattctcaaggtttcaataagcttgcggaaactctccgctggtgccttaacctgggcatcctggaggtgacagtgtacgcattctcaatcgagaattttaagaggagcaaaagcgaagtagacggtctgatggacctcgcacgccagaaattttcccgcctgatggaggagaagtgctttctcaacgtgtgcttcgcctacacctctcgtcacgagattagcaatgcggtgcgggaaatggcctggggggtggagcaagggctactggatcccagtgatatatccgagtcgttgcttgataagtgtttatatactaaccggagccctcacccagacattttgattcgcactagcggggaagtgcggctttccgatttcctgctttggcaaacaagtcattcatgcctcgtcttccagcctgtgctctggccagagtacactttctggaacttgttcgaggccatcctacagttccaaatgaaccattccgttctccaaaaagccagagatatgtatgccgaagagcgtaagaggcaacagttggaaagggatcaagccacagtgactgagcaattgctccgagagggcttacaggccagtggcgatgcccagctgcggcgtactcgtcttcacaagctaagtgcccgaagagaagaaagagtgcaggggtttctgcaagctcttgagcttaaaagagcggactggctggcgaggttaggcaccgcttccgcttag

SEQ ID NO: 220479 - DNA, 183 bp, Artificial Sequence
  Description of Artificial Sequence: Synthetic coding sequence
atgagctggatcaaggaaggggagctgagtttatgggaaagattctgtgccaatatcatcaaagctggaccgatgcctaaacacattgccttcatcatggatggcaatcgcaggtatgccaagaaatgccaagtcgaacgtcaggaaggacactctcagggcttcaacaaactggcggaatag

SEQ ID NO: 220480 - DNA, 396 bp, Artificial Sequence
  Description of Artificial Sequence: Synthetic coding sequence
atgtcctggatcaaggaaggagagctcagtctgtgggagagattttgcgctaatattatcaaagctgggccaatgcctaagcatatcgcatttattatggacggcaacagacgctatgcaaagaaatgtcaggttgaacggcaagagggccacagtcaaggcttcaataaattggcagaaacactgcgctggtgcctcaatttaggcatcctggaggtgaccgtttacgctttctccatcgagaatttcaaacgctccaaatctgaagttgatggcttgatggatctggcacgtcagaagtttagcaggttaatggaggaaaaagaaaagctccagaagcatggagtgtgtatccgtgtgctcggagatcttcatctcctgcccctcgacctttag

SEQ ID NO: 220481 - DNA, 501 bp, Artificial Sequence
  Description of Artificial Sequence: Synthetic coding sequence
atgtcatggattaaggagggagaactgtccttatgggagcggttttgcgcgaatatcataaaggctggcccaatgcctaagcacatagccttcattatggatggaaaccggagatatgcgaaaaagtgtcaagttgaaagacaagagggccattcgcaagggttcaacaaattggcagagacactgcgctggtgcttaaaccttggcatcttggaggtgaccgtgtatgctttctcgatcgagaatttcaaacgcagtaagtccgaagttgatggcctgatggatctcgcacggcagaaattttcccgccttatggaagagaaagagaaactgcaaaagcatggagtgtgtattcgagtactgggcgacctgcacttattacccctcgacctgcaagaattaattgctcaggccgtgcaggcgacaaagaattacaataaatgcttcttaaacgtgtgtttcgcttatacctcgagacatgagatatccaatgccgtgtag

SEQ ID NO: 220482 - DNA, 909 bp, Artificial Sequence
  Description of Artificial Sequence: Synthetic coding sequence
atggtgtggaagaggctcggcgcactggtgatgttccctctgcaaatgatttacctggtggtcaaagccgcagtggggctcgtgctcccggctaagcttcgcgacctttctcgggaaaatgtcctcatcacgggaggtggccgtgggatcggtaggcagctggcacgtgagttcgccgaaaggggggctcgaaagatcgttttatgggggaggaccgaaaagtgccttaaagaaacaaccgaggagatcaggcagatgggtactgaatgtcattacttcatctgcgacgtgggcaatcgtgaggaagtgtaccagacagcaaaagccgtgagagagaaagtcggagatataaccattctcgtgaataacgccgcagtggtgcatggcaaatcactgatggattctgacgacgatgctctgctgaagagtcagcatattaataccttaggacaattctggaccaccaaagcctttctacctagaatgttggagctccagaatggccatatcgtgtgtcttaattccgtgcttgccctgtcggcaatcccgggtgccatcgactactgcaccagtaaggcatccgcctttgcatttatggaatctctgacacttggtcttttggattgtccaggcgtatcagcgacgaccgtgctccctttccacacctctacggagatgtttcaaggaatgcgagttcgttttcccaatttgttcccgcctctcaaacccgagaccgtcgcacgccgaacagtggaagccgttcaactcaatcaagctctgctgctgctgccttggacaatgcacgcacttgttatcctgaaatccattctgccacaggctgcccttgaagagatccataagtttagcggcacttacacttgcatgaatacctttaaaggtcgcacatag

SEQ ID NO: 220483 - DNA, 444 bp, Artificial Sequence
  Description of Artificial Sequence: Synthetic coding sequence
atgggaactgaatgccattacttcatttgcgacgtggggaatagggaggaagtatatcagactgcgaaggcggtgcgagagaaggtcggtgacattaccatcttagtgaataacgcagccgtggttcacggaaagtcccttatggattctgacgacgatgccctcctcaaaagtcagcatataaataccctaggtcagttctggaccaccaaagcttttcttcctcgtatgttggagttgcaaaatgggcatatcgtctgcctgaatagcgtgctagccttaagcgctattcctggagccatcgattactgcacatccaaagcatctgccttcgctttcatggagtccctgactctgggcttactggactgtccaggagtgagcgcaacaacggtgttgcctttccacactagcacagagatgttccagggcatgcgggtgtag

SEQ ID NO: 220484 - DNA, 423 bp, Artificial Sequence
  Description of Artificial Sequence: Synthetic coding sequence
atggctagttccggaatgacccgacgggatccactggcaaacaaagtcgccctggtgaccgcgagtaccgacggaataggctttgctattgccagacggctggcccaggacggagcacacgtcgttgtgtcttcacggaaacagcagaatgttgaccaggctgtcgcaaccctccagggagaagggctgagcgtgacgggcaccgtttgtcacgttggaaaagccgaggacagggagcgactggtggcgactctgtggatggacaaagagaaagaggagtctatgaaagagacgttgaggatacggaggctgggtgaacccgaagactgcgcagggattgtctcatttctctgcagcgaggacgctagctatatcactggtgagaccgtggtcgtgggtggaggcactccttccaggctatag

SEQ ID NO: 220485 - DNA, 837 bp, Artificial Sequence
  Description of Artificial Sequence: Synthetic coding sequence
atgcacaaggccggtctactgggcctgtgcgccagagcttggaacagcgttcgcatggcgagcagcggaatgacccggcgtgatcccctggcaaacaaggtagcacttgttacggcatccaccgacgggataggctttgctattgcccgaaggctggcccaggacggggctcatgtggtggtgagcagccgcaagcaacagaacgtggatcaggcagtggccacccttcaaggggagggcctgtccgtcactgggacagtgtgtcatgtgggcaaggctgaagacagggagcgactggtggccactgctgtcaaactccacggaggaattgacatactggtgagcaacgctgcagttaaccctttcttcggttccatcatggacgtgaccgaagaggtctgggacaaaactctagatataaatgtgaaggctccagcactcatgactaaggccgtggttcctgagatggagaaaagaggcggtggctcggtagtaatcgtgagtagcattgccgcttttagtcctagtcccggtttcagtccatataacgtatctaaaacagctctgctcggacttacgaagactcttgcgatcgagctcgcaccgcgaaatattagggtgaattgccttgcacccggactgattaaaacatctttctctcggatgctctggatggacaaagaaaaggaggagagcatgaaggaaacccttcggataaggcggctgggggagcctgaggactgtgcagggatcgtcagtttcctgtgcagcgaggacgcctcatatatcacaggagagacagttgtcgtcggagggggtacaccctccaggctgtag

SEQ ID NO: 220486 - DNA, 513 bp, Artificial Sequence
  Description of Artificial Sequence: Synthetic coding sequence
atggcatcctcagggatgacccgcagggatccgttagctaacaaggttgccctcgtgacagctagtacggacggtatcggctttgctattgccagacgcctggctcaggatggcgcacatgtagtcgtgtcctccaggaagcagcagaacgtggaccaggctgtagctacactgcagggggaagggctgtccgttacagggactgtctgtcatgtgggaaaggcagaggaccgggagcgtctcgtggcaacagctgtcaagctgcacgggggaatcgatatccttgttagtaacgccgcagtgaacccttttttcgggtctataatggatgtgactgaagaggtgtgggacaagcgcaggctttccggagacagggttttccactccagccttcagtcaataagctcgctcgacggccagggaaagcgcggaaaacacgaacggaaccctgccgacaagaaagtgcggagggcccgaggtctgtgctggcatcgcgtgttccctgtactgtag

SEQ ID NO: 220487 - DNA, 546 bp, Artificial Sequence
  Description of Artificial Sequence: Synthetic coding sequence
atggctagtagcggcatgactcggagagaccccctcgcgaataaggtggctctggtcacagcgagtacagacggaatcgggttcgccattgctcgcaggctggctcaggacggtgcccatgtggtggtgagttctagaaagcagcaaaacgttgaccaagccgttgcgaccctgcaaggagaaggccttagcgtcaccggcaccgtatgtcatgtggggaaagccgaggaccgggagagacttgtggcgacaacgttagatatcaatgtgaaggcgcctgccctgatgaccaaggctgtggtccccgagatggagaagaggggaggcggaagtgtcgtaatcgtgtctagtatagcagcatttagcccatcaccactttggatggataaggaaaaagaggagagcatgaaggagactctgcggattcgcaggttgggcgaacccgaggattgtgctggcatcgtgtctttcctttgttctgaggacgcatcctatattactggagagacagtggtggtagggggaggaacccccagtagattgtag

SEQ ID NO: 220488 - DNA, 477 bp, Artificial Sequence
  Description of Artificial Sequence: Synthetic coding sequence
atgcataaagcgggacttctaggtctgtgtgccagagcttggaattccgttcgtatggcatcatccggaatgacgaggagggatccactggcgaacaaggtcgctcttgttacagcctctacagatggcattggtttcgcgattgcaagacgcctcgcccaggacggtgctcacgtcgtcgtgagttccagaaaacaacagaatgtagaccaagccgttgcaacactgcagggagagggactctcagtgaccggtactgtctgccacgtagggaaggcagaagatcgggaaagactggttgcaacattatggatggacaaagagaaggaggagtcgatgaaagagacgctacggatcaggaggctgggcgagcctgaggattgcgcaggaattgtgagctttctgtgctccgaagacgcctcttacatcactggagaaaccgttgtggtcgggggagggaccccgagtaggctttag

SEQ ID NO: 220489 - DNA, 579 bp, Artificial Sequence
  Description of Artificial Sequence: Synthetic coding sequence
atgcataaggcaggcctgcttggcctctgtgctagagcgtggaattctgttcggatggcgtcctccggcatgacgcgaagggaccccctggctaataaagtggccttggttaccgcttcaacagacggtatcgggttcgccatcgctagaaggctggctcaggacggagcacacgtggtcgtttcatccaggaagcagcagaacgtcgatcaggccgttgccacactacagggcgagggactgtcagtgactggcaccgtctgccatgtggggaaagcagaggatcgcgagcggcttgtcgctaccgcggtgaagctgcacggtggcattgatatcctcgtttcaaacgctgcagttaatccatttttcggaagcattatggatgttacagaggaagtatgggataaattgtggatggacaaggagaaagaagagtcgatgaaggagactttgcgaatacgacgcttgggtgagccagaggactgcgccggtattgtctcattcctttgtagcgaggacgcgagctacatcaccggcgaaacagtagtggtaggagggggaacaccaagccgcttgtag

SEQ ID NO: 220490 - DNA, 681 bp, Artificial Sequence
  Description of Artificial Sequence: Synthetic coding sequence
atggcttcttcaggaatgacgcgacgggatccattggcaaacaaagttgcactggttaccgcaagcacagatgggattgggtttgctatcgccagacgcctagcccaggacggagcccacgtggttgtgtcctctcgaaaacagcagaatgttgaccaagctgtggctaccctgcagggagagggactgtccgtaaccggaactgtttgtcacgtaggcaaggctgaggacagagagaggctggtcgcaacaactctcgatattaatgttaaagcccctgctctgatgacgaaggcagtagtccctgaaatggaaaagcgaggcggtgggagtgttgttattgtgagctcgattgccgcattttccccttcccctggattctctccctataatgtgtcaaaaactgctttgttgggcctgactaaaaccctggccattgagttggccccacgaaatattcgagtgaattgtctagctcctgggctgattaaaacgtctttctccaggatgctctggatggataaagaaaaggaggagtccatgaaggaaaccctgcggattcggaggctcggtgagccagaagattgcgccggaatcgtcagttttttgtgctctgaggacgcatcctacattacgggggagacagttgtggtggggggtggcaccccgagccggttatag

SEQ ID NO: 220491 - DNA, 567 bp, Artificial Sequence
  Description of Artificial Sequence: Synthetic coding sequence
atgcataaggcgggacttctgggcctgtgtgcacgggcttggaacagcgtcaggatggcaagttcggggatgacccggagagaccccttggcaaataaagtggcgcttgttacagcgtccaccgatggaatcggcttcgccatcgcacggcgtctcgctcaagacggggctcatgtcgtcgtgtcaagccgtaagcaacagaacgttgatcaggcagtggcaaccctgcaaggggaaggcctgtccgttacgggtaccgtttgtcacgtaggtaaggcggaggaccgcgagagactggtggccaccgccgtcaaacttcacggaggaattgacattctggtttcaaacgctgcagtaaatccgtttttcgggagcattatggatgtcacagaagaggtgtgggacaagaggcggctctccggagacagggtgtttcactcttctctgcagagcatctcctcgcttgacggccagggcaagcgtggaaagcacgagcggaaccccgctgataaaaaggtcaggagggccagagggttatgctggcatagagtatttcctgttctctag

SEQ ID NO: 220492 - DNA, 600 bp, Artificial Sequence
  Description of Artificial Sequence: Synthetic coding sequence
atgcacaaggctggactactgggcctctgtgcaagagcatggaactcagtacgcatggcctcaagcggcatgacccgacgagaccctctggcaaacaaagtggcattggtcacagctagcacagatggtattgggttcgcaattgccagaaggcttgcccaagatggtgctcatgtagtggtctcatctcgaaagcagcagaatgtagaccaggctgtcgccacccttcagggcgagggtctctccgtgacgggtacagtgtgtcatgtaggcaaagccgaggatagggagaggttggttgccaccaccctagatatcaatgtgaaagccccagcactgatgaccaaagcagttgtcccagagatggagaagaggggcggaggttctgtagttatagtcagctcaattgccgcatttagtccatcacccttgtggatggacaaggagaaagaggagagcatgaaagaaacgctgcgcatccgccgattgggggagcccgaagattgcgccggtatagtttctttcctgtgctctgaagatgcttcctatattacaggggagacagttgtcgttggtggcggtactccttctagactatag

SEQ ID NO: 220493 - DNA, 1374 bp, Artificial Sequence
  Description of Artificial Sequence: Synthetic coding sequence
atgcgatcagccgctgttctggccctgcttctttgtgcaggtcaggttaccgcccttccagtaaattcccctatgaacaaaggcgacactgaggtcatgaaatgcattgtggaagtcatcagcgacaccctcagcaaaccaagcccgatgcctgttagccaggaatgtttcgaaactctgcggggagacgagcgcatcctgagcattctgcggcaccagaacctgttaaaggagcttcaggatctggctttacagggggcaaaagagcgcgctcaccaacaaaaaaagcacagcggctttgaggatgagctcagcgaagttctcgaaaaccagagctcacaggccgagctcaaagaagccgtggaggagccgagtagtaaggatgtgatggaaaaaagagaagactctaaggaggcggaaaagtctggcgaggctacggacggtgccaggcctcaggccctgcccgagccaatgcaggaatctaaagcagagggtaataaccaggctcctggcgaagaagaggaagaggaagaggaggccaccaacacgcatccccctgccagcctcccaagccagaagtaccctggccctcaggccgaaggcgattcagagggcctttcccagggcctcgtagaccgagagaaagggttgagcgcagagcccggatggcaagccaagagggaagaggaagaggaggaggaagaagaggcggaagctggcgaggaggcagtgcctgaagaggaggggcctacggtcgtcctgaatccacacccctcactcggctacaaggagattcgaaagggagaatcaaggagcgaagccctggcagtggatggagcgggtaaacctggtgccgaagaggctcaggatccagaggggaagggagaacaggaacacagtcagcagaaggaagaggaagaggagatggccgtcgtgccccagggcctgtttcgaggagggaagtctggcgagttggaacaggaggaggagcgactttctaaagagtgggaagactccaagagatggagcaaaatggatcagctagccaaggagcttaccgccgaaaaacggctggaaggtcaggaagaagaagaggacaacagagattccagcatgaagctatctttcagggccagagcatatggatttcggggtcctgggcctcagctcagacggggatggagaccctccagcagggaagacagcctggaggcgggactgcccctccaggttagaggctaccccgaagagaaaaaggaagaggaaggcagtgctaaccgtcggcctgaggaccaggagttggagagtctgagtgccatcgaggcagaattggaaaaggtggcccaccagctccaggctttaagaaggggatag

SEQ ID NO: 220494 - DNA, 1128 bp, Artificial Sequence
  Description of Artificial Sequence: Synthetic coding sequence
atgaattgggagcttctgctgtggttactggttctatgcgcgttactcctgcttttggtccagcttctccgtttcctgagagccgatggggacctgacacttctgtgggccgagtggcaaggacgaagacccgagtgggagttgactgatatggtagtttgggtgactggcgcatcgagcggcatcggagaggagcttgcataccagctatcaaagcttggagttagcctagtgctgtccgccagacgtgttcacgaacttgagcgggtcaaacggaggtgtctggagaatggcaatttaaaagaaaaagatatcctcgtgctgcctctggaccttaccgatacaggctcacacgaggccgctaccaaggcagtgctgcaggagtttggcagaatcgacatactcgttaacaatggcggaatgtcacagaggagcttgtgtatggatacatccctggacgtctacaggaagctgattgagctcaactatttggggaccgttagcctcacaaaatgtgtcttaccacacatgatagaacgtaagcaggggaaaattgtcactgtgaattcaatcctcgggattattagtgtccctctgtcaattggatactgtgccagtaagcatgccctgcggggttttttcaacggccttagaacagagcttgctacctatcctgggattatcgttagtaacatctgccctggacctgttcaaagcaatatcgtcgagaatagtcttgcaggagaggtaaccaagaccataggcaataacggagaccagtcccataaaatgactacctccagatgcgtgaggctcatgctgatctcgatggccaacgatctgaaggaggtctggattagtgagcagcctttcctgctggtaacctatctttggcagtacatgccgacttgggcatggtggatcacccgatggggccgaaaaggcttgagaaccctgcgggtggtgtggatgcagaccctgttaatactgaagagtcttaggcagaatatgaccgagaagtccacttgcacctttcaggcaactggcggacggaatggcaagcatgagaactccaatctgctgatgctgctcaacaatcagcgcctgatctgtgatttcaccttttag

SEQ ID NO: 220495 - DNA, 870 bp, Artificial Sequence
  Description of Artificial Sequence: Synthetic coding sequence
atggtcgtgtgggtcacaggcgcttcaagcgggatcggcgaagagcttgcctaccaactgagcaagctgggggtgtctctggtgctaagtgctcgcagagttcatgagttggagcgcgtgaagcggagatgcttagagaatgggaacttaaaggaaaaggacatcctggtgcttcctcttgatctgacggacacgggcagtcatgaagccgcaacaaaggctgtcctgcaggagttcggtcggatcgacatcctggtgaataatggcggaatgtcccagcggtccctgtgcatggataccagtttagatgtttaccggaaacttatcgaactgaactacctgggaacagtgtcactcacaaagtgcgtactgccacacatgatcgaaagaaagcagggtaagatcgtaaccgttaactccatactgggaatcattagcgtacctctttcgattggatactgtgcatcaaaacatgccctgcggggattctttaatgggctgagaacagaattggcaacatatcccggtattattgtttcaaacatctgccccggtccagtgcagtctaatattgtggaaaactccctcgcgggtgaagtgactaagacaattgggaataatggagaccagagtcacaagatgacaaccagccgctgcgtgcggttaatgttaataagcatggccaatgacctgaaagaagtgtggatttctgaacagccttttctgctcgttacttatctgtggcagtacatgccgacatgggcatggtggatcactaacaagatgggtaaaaaaagaatcgaaaatttcaaatccggtgtggatgctgacagctcctacttcaaaattttcaaaacgaagcatgattag

SEQ ID NO: 220496 - DNA, 1020 bp, Artificial Sequence
  Description of Artificial Sequence: Synthetic coding sequence
atgaactgggagctgctcttgtggctgctggtgctttgcgctctcctgctgcttctcgttcagctactaaggtttctgcgcgctgacggcgacctgaccctcctgtgggcagaatggcaaggtcgtagacctgagtgggaactcacagacatggtcgtctgggtcaccggagccagcagtgggattggagaagaactggcataccagctgtccaaactgggcgtcagcctcgtcctctcagcaaggcgggtgcacgaactcgaaagagttaagcgaagatgcttagagaacggcaatttgaaggagaaggacatcctggtgctgcccttagatctgacagatactggctcacacgaagccgctactaaggcagtcctgcaggagtttggacggatcgacatcctggttaacaacgggggtatgtcacagagatcactgtgcatggacactagcctcgatgtataccgtaagctcatcgagcttaattatctcgggacggtgtcattaacaaaatgcgtactgccccacatgatagaacggaagcagggcaaaatcgtgaccgttaattcaatactgggtatcattagcgtgcccctgtccatcgggtattgtgcatccaagcatgcactgcgcggattttttaatggactccgcacagagctcgcgacctaccctggcattattgtgagcaacatatgtccgggaccggtgcaatccaacatcgtcgagaactcattagcaggggaggtgaccaagacaatcggaaataacggggaccagtcacacaaaatgaccacaagtaggtgtgttcggctgatgctgattagtatggctaacgacctgaaagaagtgtggatttcagagcagccttttctcttggtgacttatctgtggcagtatatgcctacctgggcctggtggatcaccaataagatgggcaagaaaagaatcgagaacttcaagagtggcgtcgacgctgattcgtcttatttcaagatcttcaagactaagcacgattag

SEQ ID NO: 220497 - DNA, 186 bp, Artificial Sequence
  Description of Artificial Sequence: Synthetic coding sequence
atgaattgggaactgctgctgtggttactggtgctgtgcgccctcctccttcttctggtgcagctgctgcgatttctccgagcagatggcgacctgacgctgctgtgggctgaatggcaagggcgacgccctgagtgggagctgaccgatatggtagtgtgggttactggagcatcctcgggatag

SEQ ID NO: 220498 - DNA, 960 bp, Artificial Sequence
  Description of Artificial Sequence: Synthetic coding sequence
atgttgttttgggtcctgggactgctgatactttgtggctttttatggacccgaaaagggaaactcaagatcgaagatattaccgataagtacattttcataacaggatgcgattctggcttcggtaacctggctgcacggacttttgacaagaagggcttccacgtgatcgccgcatgcttgactgaatctggctcaactgccctcaaggcagagacctctgagcgactaagaacagtccttctggatgtcactgatcctgagaacgttaagcgcacagcccagtgggtgaagaaccaggtaggtgagaagggactctggggcctgatcaataatgccggtgtgccaggcgtccttgcacctaccgactggctgactctggaagattacagagagcccattgaagtgaacctctttggattaatatccgtaacgctgaatatgttacctttagtaaagaaggcccaggggagggtcattaacgtgagcagcgtagggggtcggctggctatcgtgggaggcggatatacgcctagtaaatacgccgtggaggggttcaacgacagtcttagacgagatatgaaagcattcggagtccacgtgtcgtgtattgaaccaggtttgttcaagacgaatctcgcagatcccgtgaaagtgatcgaaaagaagctggcgatttgggagcagttgagtcccgacattaagcagcagtacggtgagggctacatagagaagtctttagataagctgaaaggtaacaagtcatacgtgaatatggaccttagtccagtcgtcgagtgcatggaccatgctctgacaagtctgtttccaaaaacccactacgcagctgggaaggacgccaagattttctggatcccgctgagtcatatgccagcagccttgcaagattttctgctcctcaagcaaaaggcagagctggccaatcccaaggcagtgtag

SEQ ID NO: 220499 - DNA, 960 bp, Artificial Sequence
  Description of Artificial Sequence: Synthetic coding sequence
atgcttttctgggtgctcggattgttaattctgtgcggctttttatggaccaggaagggaaaactgaaaattgaagatataactgacaaatacatattcattaccgggtgcgattcaggctttggcaacttagcagcaagaacctttgacaagaagggcttccacgtgatagctgcatgccttacggaatctggctctactgcccttaaagccgaaacaagcgaaaggctcaggaccgtgttgcttgacgtgacagaccccgagaatgtgaagaggaccgcgcagtgggttaagaaccaggtgggagaaaaggggctgtgggggctcatcaacaatgccggagtccctggagtactggcaccaactgattggctgaccttagaagattaccgtgagccgatcgaagttaacctgttcggattgatctctgtgaccctgaatatgctgcctctcgtaaagaaggcccaggggagggttattaatgtttctagcgtgggaggccgactggcgatcgtgggcggagggtatacgccaagcaaatatgctgtcgagggtttcaacgattcactgaggcgtgacatgaaggctttcggcgtacatgtgagctgtatagaacccggtctgttcaagaccaacctcgctgacccggttaaggtgattgaaaaaaagctggctatttgggaacagttgtccccagatatcaaacagcagtatggcgaaggctatatcgaaaagtccctggacaagctgaagggcaataagagttacgttaatatggacctgagtcctgtggttgaatgcatggatcacgccctaacttctcttttccctaagacgcactacgctgcaggtaaggatgcaaaaatcttctggatacccttgagtcatatgcccgctgcacttcaggactttctgctccttaaacagaaggctgagcttgccaacccaaaggccgtctag

SEQ ID NO: 220500 - DNA, 960 bp, Artificial Sequence
  Description of Artificial Sequence: Synthetic coding sequence
atgctgttttgggtcctgggcctgctcattctgtgcgggttcttgtggactcgtaagggcaaactgaagatagaagacattaccgacaagtacatcttcatcaccggctgtgattccggttttggaaaccttgctgcccgaacatttgataagaagggttttcatgtgatcgcagcttgtctgactgagtctgggagcacagcactcaaggccgagacctcggaacggttgcgcactgtgctccttgatgtgacagatcctgagaacgtaaaacgtacagcgcaatgggtgaaaaatcaagtcggcgagaaggggctgtggggactcatcaataatgctggcgtgcctggcgtgttggctccgacggactggcttacactggaagattaccgcgaaccgatcgaagttaacttgtttggactgatttccgtgactcttaatatgctgccactggtgaaaaaagcccagggacgtgtcataaatgtgtcatcagtcgggggacgactggctatcgtcggaggcggatacacgccctccaagtacgctgtggaagggttcaatgatagcctccggagggatatgaaagccttcggggtgcacgttagctgtatcgagccaggtcttttcaaaactaatttggctgaccctgtgaaagttattgagaaaaagctcgctatttgggagcaactttccccagatatcaagcagcagtatggggagggatacattgaaaaatccctggacaagctaaaagggaataaaagttacgtgaacatggatctctctcctgtggtggagtgcatggaccacgccttaacctccctgttccctaaaacacactatgcggctggaaaagacgcgaagatcttctggatccccctctcacacatgcccgctgctctccaggactttctgcttctgaagcagaaggccgaacttgccaatccaaaagccgtctag

SEQ ID NO: 220501 - DNA, 519 bp, Artificial Sequence
  Description of Artificial Sequence: Synthetic coding sequence
atgcttccactcgtcaagaaggcccagggaagggtcatcaatgtgtcttccgtaggagggcgactcgcaatcgtggggggaggttataccccaagtaagtatgccgtagaaggattcaacgactccctgcggcgagacatgaaagcgtttggtgtacacgtgtcatgtatcgaacctggtttatttaagaccaatttggcggaccctgtcaaggtgatcgaaaagaagctcgctatctgggaacagcttagccccgatatcaaacagcagtatggagaggggtatatcgagaagagtctcgacaagctcaagggcaacaaatcctacgttaacatggacctaagccctgtcgtcgagtgtatggaccacgcacttacctcgctgttccctaagactcactacgcggcaggcaaggatgcaaaaatcttctggatccctctgtcacacatgccggctgccctgcaggactttctccttttgaagcaaaaggctgagctcgccaaccctaaagcagtgtag

SEQ ID NO: 220502 - DNA, 960 bp, Artificial Sequence
  Description of Artificial Sequence: Synthetic coding sequence
atgctcttctgggtcttagggctgctgatcctctgtggtttcctctggacccgaaagggaaaactgaaaatcgaggatattactgataaatacatatttatcacaggatgcgatagcgggttcggaaatttggctgcgaggactttcgataaaaaagggtttcacgtgatcgcggcttgcctgacggagtcaggtagcaccgccctaaaagcagagacctctgaacgactgcggacggtactcttggacgtgacggaccctgagaacgtcaagcgcaccgcgcagtgggtgaagaaccaagtgggcgaaaagggcctgtggggcctgatcaataatgctggagtgcccggtgttctcgcccctaccgattggttgacgctggaagactacagagagcctattgaggttaatctcttcggcctgatttctgtgactctgaacatgctgcccttggtgaaaaaagcacaagggagggtcatcaatgtgagcagtgtcggtggacgcctcgctattgtgggtggtggatacacgccatccaaatatgccgtggaaggtttcaatgacagcctacggcgtgatatgaaggccttcggggtccatgtgagctgtatcgagccaggcctttttaagaccaatctggcagatccagtcaaggtgattgaaaagaagctcgccatttgggaacagctctcacctgacattaaacaacagtatggggaaggttacatcgaaaagagtctggataagttgaagggtaataaaagctatgtcaacatggacttgagtccagtcgtggagtgtatggatcacgcccttacttctctgtttccaaagacccactacgctgccggaaaggatgcaaaaatcttttggatacccctctcacacatgcccgcagcacttcaggattttctccttcttaagcagaaagctgagctggctaatccgaaagccgtgtag

SEQ ID NO: 220503 - DNA, 1140 bp, Artificial Sequence
  Description of Artificial Sequence: Synthetic coding sequence
atgccagagggaaggtcacattgcgcatgctccattacttctctcacacttctcgtctctcttaccagggtgaccctggacatccttcagaaactcgaccctcctcaaccggctcactggcgacatcacctactggtgctgtataagaagggagtgtatctaagccacactggagggaagatgctgttttgggttctgggcctgctgatcctatgcggattcctatggactcgtaaaggcaaattgaagattgaggatatcacagataaatatatatttatcactggatgcgatagcggatttggaaacctggcagccagaacgtttgataagaaggggttccacgtaatagcagcatgtctcactgagagtggctctacagccctaaaggcagagacatccgagcggctgagaaccgtgctgttagatgtgaccgatccagaaaacgttaagcgcactgctcagtgggtgaagaaccaggtaggagagaaagggctttggggactaattaataacgcaggcgtcccaggggtactggcccctactgactggttaactctagaagattatagagaaccaatcgaggtaaacctgtttgggttaatcagtgtcacgctgaacatgctgcctttagtgaagaaggctcagggaagggtgattaatgtgagttccgtgggcggacgactggcgatcgtaggtggtggttatacacccagtaagtatgctgtcgaaggattcaacgactcgctccggcgagatatgaaggcttttggcgtgcatgtaagctgtattgagccaggcctttttaagaccaatttggctgaccctgtcaaggttattgaaaagaaactcgccatttgggagcagctctcacctgatatcaagcagcagtatggggagggatacatcgagaaatctttggacaaattaaaaggaaataaaagctatgtcaatatggatctgagtccggtcgtggagtgcatggaccatgcactgactagtctgtttcctaaaacccactacgccgctggtaaggatgccaagatcttctggatcccgctgtctcacatgccagcagccctgcaagactttctgctattgaagcagaaagctgagctggctaaccctaaggccgtctag

SEQ ID NO: 220504 - DNA, 960 bp, Artificial Sequence
  Description of Artificial Sequence: Synthetic coding sequence
atgttgttttgggtgctgggacttctgatactgtgtggttttctgtggaccagaaagggcaagctgaaaatagaggacatcacagacaaatatatatttatcaccgggtgcgatagcggcttcggcaacttagcagctcgcacctttgataagaaggggtttcacgttatcgccgcttgtctgaccgaatcggggagcaccgccctcaaggccgaaacatccgagcgactcaggacagtgctcctggacgttacggatcctgagaatgtcaagcgtacagcacagtgggtgaagaatcaagtcggcgaaaaagggctttggggcctgattaacaacgctggggtgccaggtgtcctggcccctaccgattggctgaccctcgaggattatagggaacccatcgaagtgaatctgttcggtctgattagtgttaccttgaacatgctgccactggttaaaaaggctcagggcagagttattaatgtttcctccgtgggcggtcgactcgccatcgttgggggagggtacacacccagcaagtacgccgttgaaggattcaatgactctctgcgccgagatatgaaagcctttggggttcatgtctcttgtatagaacccggtttgtttaagactaacctggccgatccagtaaaggtcatcgaaaagaagttggctatctgggagcagctgtcaccagatatcaagcaacaatatggagaggggtatattgagaagagtctcgacaaactcaagggaaataaaagctatgtgaacatggacctcagtccggtggtcgagtgcatggaccatgcactgaccagcctatttccaaagacccattatgctgctggcaaggacgccaagatcttctggatccccctctctcacatgccggcagccctgcaagacttcttgctgttgaaacagaaagccgaacttgccaaccccaaagcagtatag

SEQ ID NO: 220505 - DNA, 201 bp, Artificial Sequence
  Description of Artificial Sequence: Synthetic coding sequence
atgcttttctgggttctagggctcttgatactgtgcgggtttctttggacccgtaagggcaagcttaagatcgaggatatcaccgataaatacatttttatcacaggttgtgatagtggctttgggaatctggcagctcgcacttttgacaagaaggggttccacgtgatcgctgcttgcttgacagagtcaggatcttag

SEQ ID NO: 220506 - DNA, 486 bp, Artificial Sequence
  Description of Artificial Sequence: Synthetic coding sequence
  Description of Combined DNA/RNA Molecule: Synthetic coding sequence
atgggactcccacagcctgggctctggctcaagcgactgtgggtgcttctggaggttgccgtgcatgtagtcgtcggtaaggtgcttttgatactgttcccagaccgggtgaaacgtaacattctcgctatgggcgaaaaaactggcatgacacggaacccacacttcagccacgataattggatcccgactttcttctcaactcagtatttttggttcgtgttgaaggttcgatggcagcggctggaggacaccaccgaattgggagggctggcccctaactgtcccgtggtgaggctgtccggacagcgctgtaacatttgggagttcatgcagggaaatagacctctcgtgctgaactttgggtcttgtactugacccagtttcatgttcaagttcgaccagtttaaacgcttgatagaggacttctcctctatcgctgatttcttagtgatttatattgaagaagctcacgcttccgggtag

SEQ ID NO: 220507 - DNA, 750 bp, Artificial Sequence
  Description of Artificial Sequence: Synthetic coding sequence
  Description of Combined DNA/RNA Molecule: Synthetic coding sequence
atgggactccctcagcctggcctgtggcttaaacgcctgtgggtgcttctggaagtcgccgtccacgtcgtcgtaggcaaagtgctgttaattttgtttcctgacagagtgaaacggaatattctggccatgggcgaaaaaactggcatgactcgtaaccctcacttttcacacgacaattggatacccactttttttagcactcagtacttctggttcgttctgaaggttcgctggcagagattagaggatactacggagctcggtggtctggccccaaattgcccagtggtaagactgagcggccagcggtgtaatatatgggaatttatgcaaggcaatagaccactcgttctgaattttgggagttgtaccugaccttcattcatgttcaaatttgaccagttcaaaaggctgatcgaagattttagcagcattgcagacttcttggtcatctatatcgaggaagctcacgcaagcgatggctgggcctttaaaaacaacatggacattcggaaccaccaaaatctccaggatagactgcaagcagctcatcttcttttagcccgttccccccagtgtccagtcgttgtagacacaatgcaaaaccaaagctcacagctttacgcggcactaccggaacgcctctatattattcaagaaggcaggatcctgtacaaggggaagtctgggccttggaactataacccggaggaggtgcgcgcagtcctcgaaaagcttcattcctag

SEQ ID NO: 220508 - DNA, 606 bp, Artificial Sequence
  Description of Artificial Sequence: Synthetic coding sequence
atggggctgccacagcccggtctctggttgaaaagattgtgggtcctgctggaagtggctgtccatgtggtagtcggcaaagtcctattgattctgtttcctgacagggtaaaaaggaatatactcgctatgggagaaaaaacaggcatgacccgtaacccacatttcagccacgataattggatcccaactttcttttctacacagtacttttggtttgttctgaaggttaggtggcagcgcctcgaggatacgaccgagcttgggggtctggcaccgaactgtccagttgtgaggctctcgggacagagatgtaacatatgggagttcatgcaagacggctgggcctttaagaacaacatggacattagaaaccatcaaaatctacaggaccgtctgcaggccgctcatctgttactggccagatccccacaatgccccgtggtcgtggatactatgcagaaccagtcatctcagctttatgcagcattgcctgaaagactgtacataattcaagaaggccgtatactgtataagggtaagtcaggaccttggaactacaaccctgaggaagttcgcgctgtcctggagaaactgcacagctag

SEQ ID NO: 220509 - DNA, 363 bp, Artificial Sequence
  Description of Artificial Sequence: Synthetic coding sequence
atgttcaaatttgaccagtttaaacgtctgatagaagacttcagctccatcgcagacttcctggttatctacattgaggaggcgcatgcctccgacgggtgggcattcaagaataatatggacatcaggaatcatcaaaatctgcaagacagactacaggccgctcatttgttgcttgcacggagtcctcaatgccccgtggtcgtggacactatgcagaatcagtcatcccagctatacgccgcacttcccgaacgattgtacatcatccaggaggggaggatcttgtacaaagggaaaagcggaccatggaattacaacccagaggaggtccgcgctgtgctcgagaaactgcacagttag

SEQ ID NO: 220510 - DNA, 558 bp, Artificial Sequence
  Description of Artificial Sequence: Synthetic coding sequence
  Description of Combined DNA/RNA Molecule: Synthetic coding sequence
atgggcctaccacaaccgggactgtggcttaaacgactctgggttctgcttgaggtggctgtgcacgtggtggtggggaaggtcctgttgatcctctttcccgatagggtgaagcgcaacatcctggccatgggcgaaaagactggtaaccgccctttggtacttaacttcggatcatgcacaugaccctcatttatgttcaaattcgaccagttcaagcgcttgatcgaagatttctcatcaattgctgatttcctggtcatttatattgaagaggcgcacgcttccgatgggtgggccttcaagaacaatatggacatccggaaccatcaaaacttacaagatcgcctgcaggctgcccacctgttactcgctcgctctccccagtgccctgttgtggtggatactatgcaaaaccagagcagtcagttgtatgcggcactaccggaacggctgtacatcattcaggaaggcagaattctctacaaggggaagagcggtccttggaattacaatcccgaggaggtgcgggcagtgttggaaaaactccatagttag

SEQ ID NO: 220511 - DNA, 342 bp, Artificial Sequence
  Description of Artificial Sequence: Synthetic coding sequence
atggggttgccccagcccggtctatggctgaaacggctgtgggtactcctggaagtggccgttcatgtggtggtgggcaaggtgctgctcatcctgtttcccgatcgcgttaaacgcaacattctggcgatgggcgaaaagacaggtatgacacggaacccacatttctcacatgacaattggattcccacattcttttccacccagtatttttggtttgtccttaaggtgcggtggcaacggcttgaggacaccacagagctcggtggtctggcgcctaactgtccagtggtacgtctaagcggacagcgatgtaatatttgggaatttatgcaaggctag

SEQ ID NO: 220512 - DNA, 270 bp, Artificial Sequence
  Description of Artificial Sequence: Synthetic coding sequence
atgggaatcctgtctgtggatctcctcattaccctccagatactcccagtgttcttctctaattgcctgtttctggcattgtacgatagtgtcatcttattaaagcacgtggttctactcctatcccgctcaaagtccacccgcggagagtggaggcgaatgttaaccagcgaaggtcttcgctgcgtttggaagagttttttgctggacgcgtacaaacagttgaattgtcctccgagtggttttagcaaggacgggcatatactgtag

SEQ ID NO: 220513 - DNA, 399 bp, Artificial Sequence
  Description of Artificial Sequence: Synthetic coding sequence
atgggcatcctgagcgtcgatttactgatcactctgcagattctgccagtgttttttagcaactgtctgttcctggccctgtatgacagtgttatcctcctgaagcacgtcgtgttgctgctatccaggagcaagtccacacggggagaatggcgtagaatgctgacgtcggagggcctgaggtgcgtctggaaatccttcttgcttgatgcatataagcaagtaaaactgggcgaagatgcacccaactcttccgtggttcatgtctcatcaactgaaggcggtgacaactctgggaatggcactcaagagaaaatcgcggagggcgctacctgccacctgctggacttcgcctcccccgagcgacctttagtggttaacttcggatcagctacttag

SEQ ID NO: 220514 - DNA, 822 bp, Artificial Sequence
  Description of Artificial Sequence: Synthetic coding sequence
  Description of Combined DNA/RNA Molecule: Synthetic coding sequence
atggggatactgtctgtggatctcctgattactttgcaaatacttccggtgttttttagcaattgcctgttccttgccctttatgatagcgtgatcctcctgaagcacgtggttttgcttctctcaaggagcaagagcacacggggtgagtggagacgcatgctcacgagcgaagggctgaggtgcgtgtggaaatctttcttactcgatgcttataagcaggtgaagctcggagaggatgcccctaattcctcggtcgtgcacgtatccagcaccgagggcggagacaactcaggaaatggtacacaggaaaaaatcgcagaaggggctacatgtcacctgcttgacttcgcaagtcctgagagacccttggtcgtcaatttcggatctgctactugacccccattcacttctcagctgcccgctttcaggaaactggtggaagaattctcatctgttgctgatttcctgctggtctatatcgacgaagcgcacccaagcgatggatgggcaatacctggcgattcttccctctccttcgaggttaagaagcatcagaaccaagaggatcggtgtgccgctgcccagcagctgctggagaggtttagcctccccccacagtgtagggttgtcgccgaccggatggataacaatgccaatattgcctatggggtggcgtttgaacgggtatgcatcgtgcagcggcagaagatcgcatacttgggcggtaaaggtcctttcagctataatttgcaggaagtaaggcactggctggaaaagaacttcagcaaaaggugaaagaagacacgcttggccggatag

SEQ ID NO: 220515 - DNA, 21 bp, Artificial Sequence
  Description of Artificial Sequence: Synthetic coding sequence
atggggatcctgtctgtctag

SEQ ID NO: 220516 - DNA, 21 bp, Artificial Sequence
  Description of Artificial Sequence: Synthetic coding sequence
atgggcatattatccgtgtag

SEQ ID NO: 220517 - DNA, 168 bp, Artificial Sequence
  Description of Artificial Sequence: Synthetic coding sequence
atgggcatcctcagtgttgaccttctgatcaccctgcagatactgcctgtattctttagcaattgcctatttttagccttatacgactcagtgattcttcttaaacacgttgttctgctcttgagtaggtcaaaatctacccgtggcgagtggcgtaggatgctgtag

SEQ ID NO: 220518 - DNA, 930 bp, Artificial Sequence
  Description of Artificial Sequence: Synthetic coding sequence
  Description of Combined DNA/RNA Molecule: Synthetic coding sequence
atgggtattctttccgtggacttattgatcacattgcaaattctgccagtgtttttttccaattgcctctttctcgccctttatgacagcgtgatacttctcaagcacgttgtattactgctctcgaggtctaaatccaccaggggcgagtggcggagaatgctgacctctgaagggctccgctgcgtttggaaatctttcctcctggatgcatataaacagctcaactgtcctccatcagggttttcgaaggacggccacatcttgugactggtgtacgaagcctacaagtctcggttgctcgtgtactctcatctggatctgtggatggtgaaattgggagaggacgcacctaatagtagcgttgtgcacgtctctagcacagagggaggagataattccggcaacggcacccaggaaaagattgctgagggggcaacctgccacttgttagatttcgcaagccccgaacgacctttggtggttaacttcggatctgcaaccugacctccttttacaagtcagttgccagcattcagaaaattagtcgaggaattttcctctgtggcggacttcctgctggtgtatattgacgaggcacatccttccgacggctgggccatccccggtgacagtagcctgtcatttgaggtaaaaaaacatcagaaccaggaagatcgatgcgccgctgcccagcagttgctcgagagattttcattaccacctcaatgtagggtggtcgcagacagaatggataataacgcaaatatagcttatggagtcgcttttgaaagagtgtgcatcgtgcagaggcagaagatagcttatctgggaggcaagggcccttttagctacaacctccaagaggtgcggcattggctggaaaaaaatttttctaagagaugaaaaaaaacgcggcttgccggatag

SEQ ID NO: 220519 - DNA, 822 bp, Artificial Sequence
  Description of Artificial Sequence: Synthetic coding sequence
  Description of Combined DNA/RNA Molecule: Synthetic coding sequence
atgggaatattaagcgtcgatctgctgatcaccctccagattctgccagttttcttttcaaactgtcttttccttgccctgtacgacagcgtcattctgttgaagcacgttgtgctcctactttccagatcaaagagcacgcgaggagaatggaggagaatgctcacgtccgagggtctgagatgtgtctggaagtcattcctcttggatgcctataaacaggttaaattaggcgaggacgcacccaactcttcagtggtgcatgtatctagcaccgaaggcggagataattcaggtaacgggacccaggaaaagattgctgaaggcgcaacatgccacctccttgacttcgcatcccctgaaaggccgctggttgttaacttcgggagcgcaaccugaccaccatttacatcacagctaccagcattccgcaagctggtggaagaattctcttccgtcgcagattttttgctggtgtatatagacgaggcccacccttcagatgggtgggccataccgggagactcttccctttctttcgaggtcaagaagcatcaaaaccaggaggatcgatgcgcagctgcacaacaactgctggaacgattctccctgcccccacagtgccgagttgtggctgatcgaatggataataatgccaatatagcttatggtgtcgcctttgaaagagtgtgtatcgtgcaacggcaaaagatcgcgtatctcgggggaaagggacctttctcttacaacctgcaagaagtgcggcattggctcgagaagaacttctctaagcgaugaaaaaagacacggcttgcgggttag

SEQ ID NO: 220520 - DNA, 915 bp, Artificial Sequence
  Description of Artificial Sequence: Synthetic coding sequence
  Description of Combined DNA/RNA Molecule: Synthetic coding sequence
atgcctagacaggccactagtaggctcgtcgtgggtgagggcgagggctctcagggagcaagcggaccagcagcaaccatgctgcgttctctgctgcttcactcgctgcggctttgtgctcaaacagcatcgtgcctggttctatttcctcggttcctggggactgcattcatgctgtggctgctggacttcctctgtatcaggaaacactttcttgggaggagaaggaggggccagcccgagccagaagtcgagctgaactctgagggcgaggaggtcccgcctgacgatccgccaatctgcgtctccgatgataacagattatgtactcttgcctcgctgaaagcggtatggcatggacagaagctcgacttttttaaacaggcccacgaaggcggacccgctcccaatagtgaggtggtgctgcccgatggtttccaaagccagcatatcctggattatgcccagggcaaccgcccactggtcttaaatttcgggagttgtacaugaccacctttcatggcaaggatgtccgcctttcagcgcctcgtgaccaaataccagcgggatgtggatttcctcattatctacattgaggaagcacacccttctgacggatgggtcacaactgactcaccgtacattattccccagcacagatcactggaggaccgggtttccgccgctcgggtcctgcagcagggcgcacctggctgcgcgctggtcttagacaccatggctaactcctcttcttccgcctatggcgcatattttgaaagactatacgttattcagagcggcaccattatgtatcagggcggaagaggcccagacggttaccaggtgagtgaattgaggacctggctagagcgttacgacgagcagctacatggtgcacgacccaggcgcgtttag

SEQ ID NO: 220521 - DNA, 1026 bp, Artificial Sequence
  Description of Artificial Sequence: Synthetic coding sequence
atgagtgctagtgcacctgccgcagaaggagaaggcacccctacacaaccagcgagcgagaaagagcccgagatgcccggtcctcgtgaggaatcggaagaggaagaagatgaggacgacgaggaagaggaagaggaggagaaggggaagggacaaaagttgtgtgagatcgagaggatccacttctttctgagtaaaaagaaaacagatgaactccgaaacctacacaagttgctttataatagacctgggacagtctcgtctttgaagaaaaacgtcggacagttttctgggttccctttcgagaaggggtctgtgcaatacaagaaaaaggaggagatgctcaagaagttcaggaacgcaatgttaaagagcatctgtgaggttctggacctggagagatccggggtcaatagcgaactggtcaaacgtattctcaacttcctgatgcatccgaaaccaagcggcaaacccttgccgaaatccaagaagacatgctcaaagggaagcaaaaaggagaggaacagctcggggatggcaagaaaagccaaacgcacgaaatgtcctgagatcctgagcgatgagagctctagcgatgaagatgagaagaagaataaggaggagagcagcgatgacgaagacaaggagtccgaagaagaaccacccaagaagactgccaaacgggaaaagccaaagcagaaagcaacttcaaagtcaaagaagtcagttaaatccgctaacgttaaaaaggctgattccagtacaaccaagaaaaatcagaattcaagtaagaaggagagcgagagtgaagatagctccgacgacgaaccactgatcaagaaacttaaaaagcctccaactgacgaggagctgaaagagactataaagaaactgcttgcaagcgctaatttggaggaagtgacaatgaagcaaatctgcaagaaggtttatgaaaattatccaacctacgatctgacggagcgcaaggacttcatcaagaccacggtcaaggagttgatttcttag

SEQ ID NO: 220522 - DNA, 1128 bp, Artificial Sequence
  Description of Artificial Sequence: Synthetic coding sequence
atgagcgcttccgcgccagccgcagagggcgagggcacacccacacagcccgcatctgagaaggagcccgagatgccaggcccaagagaagagagcgaggaagaggaggatgaggatgatgaagaggaagaggaggaagaaaaagaaaaatcactcatcgtggagggcaagcgagagaagaagaaggtggagaggctaaccatgcaagtttctagtctacagcgggaaccctttaccattgctcagggaaagggccagaagttgtgcgagattgagagaatccattttttcctgagtaagaaaaaaacagacgagctgaggaacctgcataagctcctgtacaaccgtcctgggacagttagctcgttaaaaaagaacgttggccagttctccggctttcctttcgagaaagggagcgtgcagtataaaaagaaagaagaaatgcttaaaaaatttcggaatgctatgcttaaatccatttgtgaagtgttagatctcgaacgatcaggcgtgaactcagagctggtcaaaagaatcctgaatttcttgatgcacccaaaaccctcaggaaaacccctgcccaaaagcaaaaagacctgctccaaagggagcaaaaaagagcgcaattcttctggtatggcacgaaaggcaaagcggacaaaatgtcctgaaattttgtcggacgaaagttcatcagacgaagacgaaaagaagaacaaggaagagtcttcagacgatgaagataaggagagtgaggaggagccccctaagaaaactgccaagcgtgagaagcccaagcaaaaggctacttctaagagcaagaaatctgtgaaatccgctaatgtgaagaaggctgactccagtacaaccaaaaagaaccagaattcctccaaaaaggagtccgaatccgaggactcttcagatgacgagcccctgataaagaaattaaaaaagccccctacagacgaggagttgaaagagactatcaaaaagctgttggcttctgccaatctagaagaggtgacgatgaagcagatctgtaaaaaggtatacgaaaattaccccacttatgaccttacagaacggaaggatttcattaaaactacagtcaaggagcttatttcctag

SEQ ID NO: 220523 - DNA, 1101 bp, Artificial Sequence
  Description of Artificial Sequence: Synthetic coding sequence
atgagcgcagccaacccagaaacacctaacagtactatctcaagagaggcctctactcagtccagcagcgcagccgcaagtcagggctgggtgctacctgagggcaagatcgtacctaataccgtcttcgtaggcggaatagatgccaggatggacgagaccgagatcggctcctgttttggtagatacggtagcgtcaaagaggtcaaaatcataacaaaccggaccggcgttagtaaaggctacggatttgtgtcattcgtgaacgacgtggatgtacagaaaatcgtgggatctcagatccacttccacggcaagaaactaaagctggggccagcaataaggaaacaaaaactgtgtgcaaggcacgtgcagccccgacctttagttgtcaacccaccgcctcccccacagtttcaaaacgtgtggcggaaccccaatactgaaacttacctgcagcctcagattacccccaatccggtgacacagcatgtgcaggcatacagcgcgtatccgcacagccctggacaggtcattaccgggtgccagctgctggtttacaattaccaggaatatcctacgtatcccgactctgccttccaggtgactacaggatatcagcttcccgtttacaactaccaaccctttcctgcatatccaagcagccccttccaggtgaccgccggttaccaattgcctgtctacaattaccaggcctttccagcttaccccagttcacccttccaggtgacaactggatatcagctgcctgtgtataattatcaggcattccctgcctacccaagttcgccatttcaggttacaaccggataccaactacccgtctacaattatcaggccttccccgcataccccagttcaccctttcaggttacgacagggtaccaacttccagtgtacaattaccaagcatttcccgcataccccaacagcgccgttcaggttactacaggataccagttccatgtctataactatcaaatgccccctcagtgccctgtgggggagcaacgccgaaatctgtggactgaggcctacaagtggtggtatctggtgtgtctgattcagaggagggattag

SEQ ID NO: 220524 - DNA, 1605 bp, Artificial Sequence
  Description of Artificial Sequence: Synthetic coding sequence
atgtctgccgcaaaccccgagacaccaaacagcacaatttcccgggaggcaagcacgcaatcatcttccgcagcggctagccaaggatgggttctgcctgagggcaaaatagttcccaacaccgtttttgtcggaggtatcgatgcaagaatggatgagacagagatcggtagttgctttggtaggtacgggtccgtcaaagaggtcaagataataacaaatagaacaggcgtgtccaaaggctacggttttgttagttttgtaaacgacgtcgatgtgcagaagatcgtcggttctcaaatccactttcatgggaaaaaactgaagctgggaccggctattcgtaagcagaaactatgtgctcgccacgtgcagccacgtcctctggttgtgaacccccctccacctccacagtttcaaaacgtgtggaggaatccaaacacagaaacctatctgcagcctcagatcactcctaaccccgtgacgcagcacgtgcaggcctattcggcatacccgcattcccctggacaggttatcaccggttgccagctcttggtgtataattatcaggagtaccctacctaccccgattcagcctttcaggtgaccacaggatatcagctgcctgtttacaactaccagccattccccgcttacccacgatcgccctttcaagtgactgcaggctaccagcttccggtatataactaccaggcttttcctgcatatcccaactctcctttccaggttgccaccggttatcagtttcctgtctacaactaccagccattccccgcttatccaagttccccgttccaggtaacggctggctaccaactccccgtgtataattaccaggcatttcctgcttaccctaatagtccttttcaggtggccacaggttatcagtttcctgtttataattaccaagcatttccggcatacccaaactctccagtgcaggtaactaccgggtatcagctgcctgtgtacaactatcaggcatttccagcctacccctcttctcccttccaggtcaccaccggctatcagctccctgtctacaattatcaagcgttccctgcataccccagcagcccatttcaggttaccacaggatatcaactgccagtttataattaccaagcattcccagcttatccgtcttccccgttccaggtcactaccggctaccaactacctgtctataactaccaggcctttcccgcatacccctcatcacctttccaggtcaccacaggataccagctgcctgtgtacaattaccaagcctttccggcatatcccagttcccctttccaagttacaactggttatcaactacccgtctacaactatcaggcattccctgcttaccctagcagtcccttccaagtgaccactggataccaacttcccgtatataactaccaggcatttcctgcttaccctaactcagctgtgcaggtgaccactgggtatcagttccacgtctataactatcagatgcccccacaatgccctgtgggagaacagcgcagaaacctgtggactgaggcttacaaatggtggtatctggtatgtctcattcagcggagggattag

SEQ ID NO: 220525 - DNA, 1821 bp, Artificial Sequence
  Description of Artificial Sequence: Synthetic coding sequence
atgtccgccgcaaaccccgagacccctaacagtaccatcagccgcgaagcctctactcagagtagctctgctgctgcttctcagggttgggtgctcccagaagggaaaattgtgccaaatacagtatttgtgggagggattgatgccagaatggatgaaacggagataggctcttgtttcggtaggtacggatctgtgaaggaggttaaaatcataactaacaggaccggtgtctcgaaaggctacggattcgtttccttcgtcaacgatgtagacgtgcagaagatcgtgggctcccagattcattttcacggaaagaagctcaagctaggccctgctatcagaaagcagaaactgtgtgctcgccacgtccaaccccgtcctctcgttgtgaatcctccccctcctccccagtttcagaacgtgtggagaaatccaaacactgagacctacctgcagcctcagataacacccaaccccgttacccaacatgtccaggcatactcagcgtatcctcacagtcccggtcaggttatcaccggttgccagcttctggtgtataattaccaagaatacccaacctatccagactccgccttccaggtaacaaccggttatcagttgcctgtgtacaactatcagccctttcccgcttatcccagatctccctttcaggtgaccgcaggatatcagctcccggtgtacaattaccaggcgttccctgcttatcccaactctccctttcaggtggcaacagggtaccaatttcccgtgtataattaccaacctttccctgcttatccgtctagccccttccaggtcacagccggataccaactgcccgtctacaactaccaggctttcccagcctatcccaattcccccttccaggttgctacgggttatcagtttccggtttacaactaccagccgtttcctgcctacccttcttccccatttcaggtgactgctggataccagctgcctgtgtataactatcaggccttccctgcctaccctaattcgcctttccaggttgcgacaggttaccaattcccagtctacaactatcaagcattcccagcctatcctaacagccctgtccaagtgactactggatatcagctccctgtctacaactatcaggcatttcccgcttaccccaattctccagtgcaggtgactaccggatatcagttgcctgtgtataattatcaggcctttccagcttatccatcctcgccctttcaagtaacaacaggataccagcttccagtgtacaattaccaggccttcccagcctaccccagcagccctttccaggttaccactgggtatcagctgcctgtttataattaccaggcctttccagcatacccctcatctccttttcaggtaacaacaggctaccagttgcccgtttacaactaccaggcgtttccggcataccctagctccccatttcaagtcaccacaggctatcaactcccggtttataactatcaggcctttcccgcataccccagtagtcctttccaagtgacaactggttatcagctgccagtgtacaactaccaggcttttccggcatacccatcttccccctttcaggtcaccacggggtaccagttaccggtgtataattaccaggcctttcccgcttaccctaacagcgccgttcaggtgacaacaggataccaattccacgtctataattatcaaatgccaccacagtgtcctgtgggtgaacagcggaggaacttatggactgaggcttataaatggtggtatctggtgtgcttaatccagcgaagggattag

SEQ ID NO: 220526 - DNA, 1461 bp, Artificial Sequence
  Description of Artificial Sequence: Synthetic coding sequence
atgagtgccgctaatcccgaaacccctaatagtactatctctagagaagctagcacacaatcctccagcgcagcggcttcccagggctgggttctgccagagggaaagattgtgcccaataccgtatttgtggggggaatagatgccagaatggatgaaaccgagataggctcttgttttggcaggtatggctccgtcaaagaagtgaaaatcattacaaaccgtaccggcgtgagcaaggggtacgggttcgtcagctttgtcaacgacgtggacgtccagaaaatcgttggctctcagatccatttccacggaaagaagctgaagctcggacccgctatccgcaagcagaaactgtgcgccaggcacgtgcagccacgcccactcgtggtgaaccctcctcctcctccccagttccagaacgtgtggcgcaaccccaacacagagacctatttgcaaccccaaatcactccaaacccagtgacgcaacacgttcaggcgtactcggcatacccgcattctccaggtcaggtgatcactggctgtcagctactggtgtataactaccaagagtaccccacataccctgattctgctttccaggttaccaccggatatcagctgcccgtttataattaccagccgttccccgcatatccccgttctccattccaagtcaccgccggataccaactgcccgtttacaactatcaagcttttcccgcatatccaaatagcccctttcaggtggccaccggttaccagttccccgtgtacaactaccagcccttccctgcctacccctccagtccctttcaggtcactgctggctaccagctgccagtttacaattatcaggcttttcctgcgtatcctaactctccctttcaagtggcaactggatatcagtttcccgtatataactaccagcctttcccagcttacccgtcgagtccatttcaagttaccgcaggctaccaactgccggtctataattaccaggctttcccagcgtatcccaatagtcccttccaggtcgccacgggataccaattcccagtctacaactatcaagcgtttccagcttaccctaactcaccagtccaggtgacaacaggctatcagctcccagtgtacaactaccaagctttccctgcttacccgaactctccctttcaggttgctaccggctatcagttcccagtgtacaattaccaggcatttcccgcatacccgaactccccagtgcaagtcactaccggttaccaactgcccgtttacaactatcaggcctttcctgcctacccaaatagcgccgtccaggtgaccactggctaccagttccacgtttacaactatcagatgccaccacagtgccctgtcggcgaacagagacgaaatctttggactgaagcctataaatggtggtacctagtctgccttatccagagaagggactag

SEQ ID NO: 220527 - DNA, 1677 bp, Artificial Sequence
  Description of Artificial Sequence: Synthetic coding sequence
atgagtgcagcaaaccccgaaaccccgaacagcaccatatctagggaggcaagtacccagagcagctcagcggctgcatcgcaaggatgggtgctgcccgaaggaaaaatagtgcccaatactgtgtttgtcggagggatagacgccagaatggacgagactgagatcggctcctgctttgggcgttacggcagcgtcaaggaagtaaaaattatcactaatcgcactggagtaagcaaaggctatgggttcgtgtcgtttgtgaatgacgtcgacgtgcagaagattgtgggctcacagattcatttccacggtaagaaactcaagctgggtcccgctatcagaaaacagaagctttgcgcgcgtcacgtgcagccacgaccacttgtggtgaatccaccaccaccacctcaattccaaaacgtctggcggaatccaaacacagagacctatctacagcctcagattactcctaacccggttacccagcacgtgcaggcatacagcgcctaccctcattctccaggacaggttatcacaggctgtcagctgttagtgtacaactaccaggagtatcctacttatcccgactccgcattccaggtcacaacgggctatcagctgcccgtgtacaattatcagcctttccccgcttaccccagatcccctttccaggtgacggctggttatcaattgcccgtctataactatcaagcatttcctgcctatcctaactctccatttcaggtggcgactggatatcagttccctgtatacaactatcagccctttcctgcttacccttccagccccttccaggtcacagctgggtatcaactgccagtgtataattatcaagcttttccggcatatcccaactctcctttccaggtggccactggataccagttccccgtctacaactaccaagcttttccggcttaccccaatagtcccgtccaggtaacgactgggtaccagttgccagtgtacaattatcaggctttccctgcataccccaattccccagtccaggtgacaacaggttaccaactgcccgtctacaactaccaggcttttccagcctatccatccagtcccttccaggtgactaccgggtatcagcttccagtgtacaattaccaggcattcccagcttacccatcctcacctttccaagttacaactggttaccaactgccggtgtataattaccaagcgttccccgcatacccaagttcgccttttcaggttacaacaggctatcagttgcccgtctacaactaccaggcctttcctgcataccctagctcccccttccaagtgactaccggctaccagttacccgtatataattatcaggcctttcccgcatatcctagcagcccgtttcaggtgactaccggctaccagctcccagtttataactaccaagcgtttcccgcatatccgtcctctcctttccaagtcactacagggtatcaactgcctgtctacaattaccaggcattccctgcatatcctaactctgccgtccaggtgacaacgggataccagttccatgtgtataattatcagatgcctccacaatgtcccgttggtgagcaaaggcggaatctgtggaccgaggcttacaaatggtggtacctcgtatgcctcatccagcgccgtgattag

SEQ ID NO: 220528 - DNA, 1086 bp, Artificial Sequence
  Description of Artificial Sequence: Synthetic coding sequence
atgagcgcagcgaatcccgagaccccaaattccacaatctctcgcgaagcgagcactcagtcatcatccgccgcagcctcccagggatgggtgctgcccgagggcaaaatcgttccgaatacggtgtttgtcgggggaattgacgctcggatggatgagacagagatcggcagctgctttggaagatacgggtcggttaaagaggtgaagatcattacaaaccgaacaggcgtgagcaaaggttatggatttgtgtccttcgtgaacgacgtggacgttcagaagattgtcggttctcagattcacttccatgggaaaaaattgaaactgggaccagcgattaggaagcagaaactgtgtgccagacatgtgcaaccacggcctttagtggttaatcccccaccaccaccgcagttccagaacgtctggcggaacccgaatactgagacatatctgcagcctcagattacccccaatcctgtgacgcaacacgttcaggcttactcagcctaccctcactcccccggacaggtgataacagggtgccagctccttgtctacaactaccaagagtacccaacataccctgattccgcctttcaggttaccactgggtatcagctgccagtctataactaccaacctttcccggcatatcctaggtctccgtttcaggttacagcaggttaccagctgcctgtatacaattaccaggccttcccagcgtatccgaacagccccttccaggtcgcaactgggtatcagttccccgtttataattatcaaccgttccctgcatacccctcctcaccgtttcaggtcaccgcagggtatcagctccctgtatataattaccaggcatttcccgcttatccaaacagccccttccaggtggctacgggttaccagttccctgtgtataattaccaggcctttcctgcttaccctaatagcccgttccaggtggccacgggctatcagttcccagtttacaactatcaagccttccccgcataccccaattctcctgtgcaagtcacgaccgggtaccagctgccagtgtataactaccagatgcccccatag

SEQ ID NO: 220529 - DNA, 1965 bp, Artificial Sequence
  Description of Artificial Sequence: Synthetic coding sequence
atgagtgcagccaaccccgagacaccaaattccacgattagtagggaggctagtacgcagtcctctagtgcagctgcaagccagggctgggtgctccccgaagggaagattgtcccaaatactgtgtttgttgggggaatcgatgccagaatggatgagactgagatagggagctgttttggtcggtatgggagtgtgaaggaggtgaagatcattacgaataggaccggcgtgagtaaaggctatggcttcgtaagtttcgttaacgatgtagacgtccagaagatagttggttctcagatccactttcacggaaaaaaactgaaattaggcccagccatcagaaaacagaagctttgtgctcgccacgtgcaaccgcgaccattggtggtaaatccgccacccccaccgcagttccaaaacgtctggaggaacccaaatacagaaacatatctacaaccgcagatcaccccaaacccagtgacccaacatgtacaggcctatagtgcctacccccattcaccaggccaggtgatcacgggatgtcagctgctggtctataactatcaagagtatcccacctaccccgattcggcttttcaggtgactaccgggtatcaactgccagtgtacaattaccagccctttcctgcctatccaaggtctcccttccaggtaactgccggttaccagctgcccgtatataactaccaggcatttcctgcctatcccaactctccatttcaagtggccacgggctaccagttccccgtctataactatcagccttttcccgcttatccatccagccctttccaggtgaccgccggatatcagctccctgtgtataattatcaggcctttcctgcttacccaaatagtccctttcaggttgcgacgggataccagttcccagtatataactaccaaccttttccggcttacccttccagtccgtttcaggttactgctggctaccagctgcccgtgtataattaccaagctttccccgcttacccgaacagccccttccaagtagcaaccggctatcaattcccggtgtataattaccaggccttccctgcctaccctaactcacccgtccaggtcacaaccggataccagttaccggtctataactaccaaccattccctgcttacccacgatccccttttcaggttactgcaggctatcagctgcctgtgtacaactaccaggcgtttcccgcttaccccaacagtccatttcaagtggccaccgggtaccagtttcctgtctataactaccaggcgtttccagcttaccctaattccccggtacaggtgacaacaggttaccagctgcccgtgtacaactaccaggccttccccgcatacccaagttcaccattccaggtgacaaccgggtaccagctgccagtatacaactaccaggccttccctgcctatccttcaagcccctttcaggtcaccacaggctaccagctccctgtgtataattaccaagcctttcccgcataccccagcagtccattccaggtgactaccggataccagctgcctgtttacaattatcaggcgtttccagcctatccatcgagtcccttccaagtgactacaggataccagctaccggtgtacaactatcaagcttttcccgcatacccaagctcaccatttcaggttaccaccggctatcagctccccgtgtataactatcaggcctttccagcatatccatctagcccctttcaggtcaccactggataccagctgcctgtctataattatcaggcatttcctgcctacccaaactcggctgtccaggtcaccaccgggtatcagttccacgtctataactaccagatgccgccacagtgtccagtaggggaacagcgcaggaatctgtggactgaggcttacaagtggtggtaccttgtctgcttaatccaacgccgagattag

SEQ ID NO: 220530 - DNA, 1605 bp, Artificial Sequence
  Description of Artificial Sequence: Synthetic coding sequence
atgtcagcagcgaatcctgagacacctaactcaacaatcagcagagaagccagtactcagagctcttcagctgccgcatcccagggatgggttctccctgaagggaagatcgtcccgaataccgtctttgtaggaggaattgacgctcgtatggatgagaccgagatcggttcgtgctttggacgctacggtagcgtgaaagaggtaaagatcataaccaatcgcaccggagtgtcaaagggctatggattcgtgagtttcgtcaatgacgttgatgtgcagaagatcgtagggagccagatccattttcacgggaaaaagctcaaacttggccctgctattagaaaacagaagctgtgtgccagacacgtgcaaccgaggccgctggtggtcaacccccctcccccaccccaattccagaacgtgtggcggaatcccaataccgagacctaccttcagcctcagatcactccaaatccagtcacccaacatgtgcaagcctactcagcatatcctcactcgccgggacaggtaatcaccggttgtcaactgctcgtctataactaccaagagtacccaacatacccggacagcgcgtttcaggttaccaccgggtaccagctcccagtttataactatcagccctttcctgcatatccacgctccccctttcaggtgactgctggttaccagcttccagtctataattaccaagcgttcccagcttaccctaactccccctttcaggtagctactgggtatcagttcccagtctataattatcagcctttccctgcctacccctccagcccatttcaggtgactgcaggctatcaattacccgtgtacaattaccaggcatttccagcgtaccccaactcacccttccaagtcgccaccggctaccagtttccggtctataattatcaggccttcccggcataccccaatagtccagtgcaggtgaccacaggctaccaactgcccgtctacaattaccaagctttccctgcttacccctcaagtcctttccaagtgaccactggataccaactgcccgtgtataattaccaggccttcccggcatatccgagcagccccttccaagtaaccactggttatcagcttccagtttataattaccaggcctttccggcttatcccagctccccttttcaagtgactaccggctaccagttgcccgtttataactaccaggccttccctgcctacccatcctccccgttccaggttacaaccggctaccagctacctgtgtacaattatcaagccttcccagcttacccttcaagcccttttcaagtaaccaccggctaccagctacctgtatacaattaccaagcctttccagcctacccctcttcaccgtttcaggtgacaacaggctaccagttaccggtgtacaactaccaggctttccccgcttatcctaactctgcagtccaggtgaccactggctaccaattccatgtgtataattaccagatgccaccccaatgccccgttggcgaacaacggagaaatctatggacagaagcttacaaatggtggtatcttgtgtgtctaatccaaagaagggactag

SEQ ID NO: 220531 - DNA, 1317 bp, Artificial Sequence
  Description of Artificial Sequence: Synthetic coding sequence
atgagtgcggctaatccagaaacaccgaacagcaccatttcccgggaggcaagcacacagtcttccagtgcagctgcctcacagggctgggtactgccagaaggaaaaatcgtgccaaacaccgtgtttgtagggggaattgacgcaaggatggatgaaaccgagatcggttcatgttttggccgatacggatcagtcaaagaggtcaagataatcaccaaccggaccggtgtttccaaagggtacggattcgtatcattcgtgaacgacgtggacgtccagaagattgttggaagccaaatccacttccatgggaagaaactaaaacttggccctgcaatccgtaagcagaaactgtgcgctcgccacgttcagcctagaccacttgtggtgaatccaccacccccaccccagtttcagaacgtttggaggaatccgaacacagaaacttatttgcagccacaaatcactcctaatcccgtgactcagcatgtgcaagcttactcagcatatccacattctccgggacaagtgatcacaggctgccagctgcttgtgtacaattaccaggaatatcccacataccccgatagcgcctttcaggtgactacagggtaccagctccccgtgtataattatcagcccttccccgcttatcctagatccccgttccaggtgacagctggataccagttacccgtttacaactaccaagcttttcccgcttatccgaattccccctttcaggtcgcaaccggctaccagtttcctgtctacaactatcaggccttcccagcctatcctaatagccctttccaggtggccaccggataccagttcccagtgtataactatcaggcgttccccgcataccctaatagccccttccaggtcgccaccggctatcagttcccagtctacaactaccaagctttccccgcttatcctaactcaccggtgcaagtaacgacaggataccagcttcccgtctataattaccaagctttccctgcctatcctaattcccccttccaagttgccaccgggtatcagttccctgtctacaattaccaggcctttcctgcatatcccaactcacctgtgcaggtaacgaccggctaccagctcccagtctataattatcaagcattcccagcttaccctaattctgctgtccaggttaccacaggttatcagtttcatgtctacaactaccagatgccaccccagtgtcctgtgggtgaacagcggagaaatctgtggaccgaagcttataagtggtggtacctggtgtgcttgatccagcgaagagactag

SEQ ID NO: 220532 - DNA, 1173 bp, Artificial Sequence
  Description of Artificial Sequence: Synthetic coding sequence
atgtctgcggctaacccagaaactccaaactcaacaatctcccgagaggccagcacccaatcgtcctcggctgctgcttcacagggctgggttctccctgaaggcaaaatagtgccaaacacagtgtttgtgggcggtatagatgctcgaatggatgagacagagattgggtcatgtttcggccgttatggaagcgtgaaagaggtcaaaataattacaaaccgcaccggcgtgtctaaaggatatggatttgtgtctttcgtgaacgatgtggacgtacagaaaattgtgggtagccaaattcatttccacgggaaaaagctgaagctaggccctgcaatacgaaagcagaagttgtgtgctaggcacgtgcagcctaggccccttgtggtcaatccaccccctccgccacagttccagaatgtttggcgaaatccaaacaccgagacttatttacagccccaaatcacccccaatcccgtcacacaacacgtacaagcctattcagcttaccctcactcccccggtcaagtgattacgggatgccagcttctcgtttataattatcaggaataccctacctaccccgacagtgcattccaggtgaccaccgggtatcagctgccagtctacaactaccagcccttcccagcctaccccagaagccctttccaagtcacagctgggtatcaactgcccgtttacaactaccaggctttcccagcataccccaacagtccttttcaggtcgctaccggttaccagtttccagtgtataattatcagccattccccgcatacccttcctcccctttccaggtgaccgcgggttaccagctgcctgtgtacaactatcaggcctttcccgcttaccccaattccccttttcaggtcgctactggctaccagttcccagtgtataattatcaggcttttccggcatatcccaattctccagttcaggtcacgacgggctaccagctccccgtttacaattatcaggcctttcccgcatacccaaatagtgcagttcaagtaacgaccggatatcaattccacgtgtacaactaccagatgcctcctcagtgcccggtcggcgaacagcgacgcaacctctggacggaagcctacaaatggtggtatctcgtctgcctgattcaacgcagagattag

SEQ ID NO: 220533 - DNA, 1746 bp, Artificial Sequence
  Description of Artificial Sequence: Synthetic coding sequence
atgatggacgagacagagatcgggtcctgcttcggacggtatggctctgtcaaagaggtgaagattattaccaatcgcactggagtgagcaaaggttatggattcgttagctttgtgaatgacgtcgatgtccagaaaatcgtaggttcccagatacactttcacgggaagaaactaaagctcggacctgccattcgcaagcagaagctttgcgctagacatgtgcagcccaggccactggtggtaaaccctccccctccaccccagtttcaaaacgtttggcggaatcctaatacagagacttatctccagccacagatcacacctaatcccgtgacccagcacgtccaggcttacagcgcctacccccactccccagggcaggtcatcaccgggtgccaactgctcgtttataactatcaggagtatcctacctaccccgattcagcgtttcaagttacaaccgggtaccaactgcccgtctacaattaccaacctttccctgcttaccctagatcccctttccaagttacagccggatatcaactgccagtatataactaccaggcattcccagcttacccaaactccccgtttcaggtggcgactggctaccagtttcccgtgtacaattaccagccgtttccggcatacccatccagtccctttcaggttaccgcgggatatcaactgcctgtgtataattaccaggcattccctgcttacccgaatagtccatttcaagtagcgaccgggtaccagttccctgtttacaactatcaggcattcccagcataccccaactccccattccaagttgccaccgggtaccagtttcctgtttataactatcaggcatttccagcctaccccaactccccagtgcaagtgacgactggttaccagctgccggtctacaattatcagcccttccctgcctatccacggtcaccattccaggtcacagccggataccagctacctgtctataattaccaggcctttcccgcatatcctaactctcccttccaggtggctaccggttatcaattccccgtgtataattaccaggcatttccggcatatccgaatagtcccgtgcaggtaacaactggataccagctccctgtctataactatcaggcctttcccgcttatccgagtagcccatttcaagtcacaaccggatatcagctgccggtgtacaattaccaagcttttccagcctacccctcttctccctttcaggttaccaccgggtatcagctgcctgtgtataactatcaggcctttcccgcttatccctctagccctttccaggtgacgacgggctatcagctccccgtgtataattaccaggcctttccagcatatcccagctccccattccaagtgacaactggctatcaattgcctgtatacaattaccaggcttttccagcctatccgtctagtccattccaggtgactacaggttatcagctacctgtgtataactatcaggcgtttcctgcatacccctcaagtcctttccaggttaccactggatatcagcttccggtctacaactatcaggctttcccagcctatccgaatagcgcagtgcaagtgaccacaggttatcagtttcacgtctataattatcagatgcccccacagtgcccagtcggtgagcaacggagaaatctgtggactgaggcatataagtggtggtatctcgtgtgtttgattcagcgaagagactag

SEQ ID NO: 220534 - DNA, 1014 bp, Artificial Sequence
  Description of Artificial Sequence: Synthetic coding sequence
atgtccgcagcgaaccccgagacacctaacagtactataagcagggaggcatccacccagtcctcaagcgccgcagcctctcaggggtgggtcctgcctgagggcaaaattgttcccaacaccgtcttcgtcggaggcatcgatgccagaatggatgagaccgaaatcgggtcctgctttggcagatacggaagcgtgaaggaggtcaagatcataaccaataggacaggggtttcaaaaggatacggattcgtgtcgtttgttaacgacgtggatgtgcagaaaatcgtgggctcccagattcacttccacggtaagaagttgaagctgggaccggctattcgcaagcagaagctctgcgccagacatgtccaaccaagacctttggtggtgaatccaccaccacctccacagttccagaacgtttggcgtaacccgaatacagaaacttacctgcaacctcagattacccccaaccccgtgacgcagcacgttcaggcctacagtgcttatcctcacagccccggtcaggtgatcaccgggtgtcagctgttggtctacaactatcaggagtaccctacatatcctgacagtgcgttccaggtgacgaccggttaccagctaccagtgtataattatcaaccattccctgcgtaccccagatctcccttccaagtgacagccggttatcagctgccagtctataactaccaagcgtttccagcatatcctaacagtccctttcaggtagccactgggtatcaattcccagtctataactaccaggctttccccgcatacccaaactccccagtgcaagttacaaccgggtatcagctacccgtctataattatcaggcttttccagcatacccgaattcgcctttccaggtagcgactggctaccagttccctgtgtacaactaccaggcatttcctgcctatccaaacagcccagtgcaagttaccaccggctaccagctgcccgtctacaattatcagatgccgccatag

SEQ ID NO: 220535 - DNA, 1101 bp, Artificial Sequence
  Description of Artificial Sequence: Synthetic coding sequence
atgagtgccgctaatccagaaacaccgaactccacaatctcaagggaagcgtccactcagagctctagcgccgcagcttctcagggatgggtcctgcctgaggggaagatcgtgcccaatacagtattcgtcggaggtattgatgcgaggatggatgaaactgaaataggctcatgctttggtagatacggctccgtcaaggaagtcaagattatcactaaccgaaccggcgtgtcaaagggatatggctttgtgtcttttgtgaacgatgtcgacgtgcagaagattgtgggtagtcagattcactttcacggcaagaagctcaaacttggacccgctatccggaagcagaagttatgcgctaggcacgttcagccgcgacccctggttgtgaatcctccccctccaccacagtttcaaaacgtatggcgaaatccaaatacagaaacgtacctccagccccagattacaccaaaccccgtgacacagcacgtacaggcctatagcgcctacccacatagcccaggccaggtgattaccggatgccagctcctggtttataattatcaggagtacccaacatatcctgattctgcattccaggtgactacgggatatcaattgcccgtctataactatcagccttttcccgcatatccgagaagcccctttcaggtgaccgcaggttatcagctacccgtgtataattatcaagccttcccggcttatcccaactcccctgtgcaggtgaccacggggtaccaattgcctgtttataattaccaggcatttcctgcttaccctaactcccccgtgcaggtgacaaccggctatcagctgccggtctacaactaccaagctttccccgcttaccctaactctcctgtgcaagtgaccacgggctatcagctcccagtgtataattatcaggcatttccagcctacccgaactccgcagttcaggtaaccacaggttatcagtttcacgtttacaactatcagatgccaccccaatgtccggtgggggagcaaaggcggaacctgtggactgaggcatataagtggtggtacctggtgtgcctgatacagcggcgtgactag

SEQ ID NO: 220536 - DNA, 1317 bp, Artificial Sequence
  Description of Artificial Sequence: Synthetic coding sequence
atgtcagctgcaaatcctgaaaccccaaacagcacaatatcgagagaggctagcactcaaagttcttctgccgctgcttctcagggctgggtgctgccagaagggaagatcgtccctaacacagtctttgtgggcggtatagacgccagaatggatgaaaccgaaatcggcagctgtttcggaagatatggatcagtcaaagaagtaaagatcatcaccaaccgcactggcgtgagtaaagggtacggatttgtctccttcgtcaatgacgtcgatgtgcagaagatagttggcagccaaatccatttccacggaaagaaactgaagctgggtcctgctattcgcaaacagaaactgtgcgctaggcacgtccagccgaggccactggtggttaatcctcccccacctccacagtttcagaacgtttggcggaaccccaacaccgaaacctatctgcagccccaaatcacccctaatcctgtgacacagcatgtgcaagcctactcagcttacccacattcgccgggacaggtcataacggggtgtcagctgctggtgtataattaccaggaataccctacctaccccgattccgccttccaggttacgaccggttaccagctgccagtgtacaactaccaaccatttccggcatacccaagatctccctttcaggttacagccggataccagctgcccgtgtataactatcaggctttccctgcctatccaaacagcccctttcaggtcgctaccggatatcagtttcctgtgtacaattatcaggccttcccagcatatccaaatagcccggtgcaggtgaccaccgggtaccaactgccagtctacaactaccaggcctttcctgcataccctaatagcccgtttcaagttgccacgggttatcagtttcctgtatataattatcaggctttccccgcataccccaattccccagtgcaagtgaccacaggataccagctgcctgtgtataactatcaagcttttccagcttacccaaatagtcccttccaggtggccacaggatatcagtttcctgtgtacaattaccaggcctttccagcctaccccaattcccccgtgcaggtcacaacaggctatcagttgcccgtctacaattaccaggccttccccgcttatcctaactctgccgtgcaggtgactactggctatcagtttcatgtttataactaccagatgcctccacagtgtcccgttggggaacaaaggcgcaatctgtggactgaggcttataagtggtggtacctggtatgtctcatccaacgcagggattag

SEQ ID NO: 220537 - DNA, 1086 bp, Artificial Sequence
  Description of Artificial Sequence: Synthetic coding sequence
atgtcggctgcaaacccagagacgcctaatagcaccataagccgggaagccagcacccagagcagctccgctgccgcatcacagggttgggtactgcctgaaggcaaaattgtccccaatacggtgtttgttggcggtatcgatgcacggatggacgagacggagatagggagttgcttcggtagatatggctccgtgaaggaagtcaaaatcattaccaataggacaggagtctccaagggatatggcttcgtttcattcgtcaacgacgtggacgtccagaaaattgtgggcagtcagattcattttcatggcaaaaaattgaaattgggaccagctattcgaaaacagaagctctgcgccagacacgtgcagccccgaccccttgtggtgaacccacctcccccaccacagttccagaacgtttggcggaatcctaacacagaaacgtatctccagcctcaaatcactcccaacccggtcacccagcatgtccaggcctattctgcttatccacatagtcccggacaggtgatcacgggctgccagctgttagtttataattaccaggagtatccaacttatccagattccgctttccaagtgacaaccgggtatcagctgccagtgtacaattaccagccattccccgcttaccccagaagcccattccaagttacggcaggataccaacttcccgtttacaactaccaagctttccctgcatacccgaattccccgttccaggtggcaacagggtaccagttccccgtttataactatcaagcatttcctgcttaccccaacagtcccgtacaagtgaccacgggataccagctgccggtctacaactatcaagcattccctgcgtatccaaacagcccattccaggttgccaccggctaccagttcccagtatataattatcaggccttccctgcctaccccaattcaccggtccaagtgacaacaggataccaactgcccgtgtacaattaccaagccttccccgcttacccaaattcccccgtgcaggtcacaaccgggtatcaactgcctgtgtacaactaccagatgcccccttag

SEQ ID NO: 220538 - DNA, 1173 bp, Artificial Sequence
  Description of Artificial Sequence: Synthetic coding sequence
atgtcggctgccaaccccgagacaccaaatagtaccatatccagagaagccagcacccagtccagttccgccgcagcttctcagggttgggtgctgccagaaggcaagattgtccccaacacggttttcgtcgggggaatagacgctcgtatggacgagacagagattggttcatgcttcggaaggtatggttctgttaaggaagtgaagatcattactaatcgcactggagtcagcaagggttatggcttcgtctccttcgtgaatgacgtagatgttcagaagattgtgggctctcagatacacttccacgggaagaaactgaagctcggtccagctatcaggaagcagaagctgtgcgcacggcacgtgcagcctagacctttagtggtcaacccccctccaccaccgcagtttcaaaatgtgtggagaaatcccaataccgagacgtatctacaaccccagattacccccaatcccgtcacccagcacgtccaggcgtactcagcctacccccattctccgggacaggttattacaggctgccagctgctggtctacaactaccaggaatatccaacatatcccgactcggcgtttcaggtgacaaccggatatcagctgcccgtatataactaccaaccatttccggcttacccgaggagtccgttccaggtaaccgccggatatcaactccctgtatacaattaccaagcctttcctgcctatcccaacagccccttccaagtggctaccggctatcagttccctgtgtacaactaccaggcatttccggcttacccaaacagtccagtacaggtgaccactggatatcagctgcccgtatataactaccaggccttcccggcttaccccaacagccctttccaggtcgccaccggataccagtttcctgtgtacaactaccaggcgtttcccgcatacccaaattctccggttcaggtgacgaccggttatcagctcccagtgtataactaccaggccttccctgcatacccaaacagcgctgtgcaagtgacaaccggttaccagttccatgtatataactaccagatgccaccacagtgcccagtaggtgagcagagacgcaacctgtggactgaggcgtataagtggtggtacctagtttgtttgattcaacgacgcgattag

SEQ ID NO: 220539 - DNA, 948 bp, Artificial Sequence
  Description of Artificial Sequence: Synthetic coding sequence
atggcagcaccctcctgtgggggtgatagaaaggccaggctgacaccttccctcccccacgagtcgactgctaatcccgagacacccaatagcacgatttctagggaggcaagcactcagtcttcctcagctgccacaagtcagggttacattctgcccgaggggaaaattatgccgaatactgttttcgttggtggcattgacgtgcgaatggacgaaacagagatccgttcttttttcgcccgatacggatcagtcaaggaggtgaaaatcatcaccgatagaacaggagtgagtaaaggctacggatttgtgtctttcttcaatgatgttgatgtccagaagattgtagagagccaaatcaactttcatggcaaaaaactaaagctgggtcccgctattcgcaagcagaacctgtgcgcctatcatgtccaaccgaggccattagtgttcaatcaccccccacctccccagttccagaacgtgtggacgaatcctaacactgagacctacatgcagcccactacaaccatgaatcccattactcagtatgttcaggcataccctacttatcctaactccccagttcaggtcatcaccgggtatcagctaccagtgtataactaccagatgccgccacaatggcccgtgggagaacagaggtcttatgtcgtgcctccagcgtacagcgctgtcaactatcattgcaatgaagtggacccgggtgctgaagtggtgcccaacgagtgctcagtgcacgaggctacccctccatccgggaacggaccacagaaaaagtcagttgataggtctattcagaccgtcgtctcctgcttgtttaaccccgaaaacaggctgcggaactctgtcgtgactcaggatgattattttaaagacaagcgcgtgcaccacttccgaagaagccgagctatgctgaaatccgtgtag

SEQ ID NO: 220540 - DNA, 888 bp, Artificial Sequence
  Description of Artificial Sequence: Synthetic coding sequence
atgagtacagcaaatccagagactcctaactctactatctcccgagaggcctcaacccagagcagcagcgccgcaacgtctcaaggttacattctgccagaaggtaaaatcatgcctaatacagtgtttgtcgggggaattgacgttagaatggacgagacggaaattaggagcttttttgcacgctacggctctgttaaggaagtgaaaatcattaccgatcgtactggagtctctaagggctatggttttgtctcttttttcaacgatgtggatgtgcagaaaattgtagaatcacagattaattttcatggtaagaaacttaaattaggaccggcaatcagaaaacagaacttatgtgcctatcacgtgcagccccgaccccttgttttcaaccacccaccgccaccacagttccaaaatgtttggaccaaccctaacaccgaaacttacatgcagcccaccaccaccatgaatccaattactcaatacgttcaggcttatcccacgtaccctaatagtccagtccaggtgatcacaggttaccagctgcctgtgtataattatcagatgccgccacagtggcccgtgggagagcagcgttcctacgtcgtgccgcctgcctatagtgctgtcaattaccattgtaatgaggtagatcccggagcggaagtagtacctaatgaatgcagtgtccatgaagcgaccccgcctagcggtaatggtccccagaagaaaagcgtggaccgcagcattcagacagttgttagctgcttgtttaatccggaaaacagacttaggaattcagtggtaacccaagatgattactttaaggataaaagagtccaccactttcgccgttcccgcgcaatgttgaagtccgtgtag

SEQ ID NO: 220541 - DNA, 2286 bp, Artificial Sequence
  Description of Artificial Sequence: Synthetic coding sequence
atgaattggcgctttgtggagctcttatatttcctgttcatttggggacgtatctctgtccagccaagtcaccaggaacctgctggaactgaccagcacgtttccaaagagttcgactggttaatctctgatagaggcccttttcaccacagtcggagctacctgtcattcgttgagaggcacagacagggttttaccacacgctataaaatttatagagagttcgcccgttggaaggtgagaaatacggccatcgagagaagggacctggtgcgccacccagtcccgctgatgcccgaatttcagcgaagcatccgcttattggggagacgcccaacaacccagcagttcatcgacaccattatcaaaaaatatggaacccatctgctgatctctgccaccctggggggagaagaagccttaaccatgtatatggataaatctcgactcgataggaagagtggaaacgcaacacagtctgtggaggctttacatcaactcgcctccagttactttgtggacagagatgggaccatgaggagattacacgaaattcaaatctcaactggtgccattaaggtgacagagacgcggacaggcccactggggtgcaactcctatgacaacttagacagtgtgagctcagtactcctgcagtccacggaaagcaagctgcacctccagggcctacagatcatctttcctcagtatctgcaagaaaagttcgtgcaatccgcactgtcctacattatgtgtaacggggagggggagtatttgtgtcagaattctcaatgtcgttgccagtgcgcagaggagttcccccaatgcaactgccctatcaccgacatccaaattatggaatatacgttggccaatatggcaaaaagctgggctgaagcttacaaggacctggaaaatagcgatgagtttaaatcgtttatgaaacgactcccctctaatcatttcctgacaataggatccatccatcagcactggggaaatgactgggatctgcagaaccgctacaaactcctgcaaagcgcaactgaagcacaacgacagaaaatacagcgcaccgccaggaagctctttggcctcagcgtacgatgccgccacaatcccaatcaccagttgccaagagagaggacaatccagcaatggctcgcaagggtacagtcacttctgtactgcaacgagaacggattctggggcactttcttggagagccagcgatcctgtgtgtgccacggcagtacaacactgtgtcagcgtcccattccttgcgtaattgggggaaacaattcatgcgctatgtgctctttggcgaatatctctctgtgtggttcctgcaacaaaggatacaagctctacaggggaagatgtgaaccacagaacgtggatagcgagaggtcggagcagtttatcagttttgagactgatctggactttcaagacctcgaacttaagtacctgctacaaaagatggactctcggttgtacgtgcatacaacttttattagcaatgaaattagactggacacctttttcgacccacgctggcgcaaacgtatgtccctgacccttaagtctaataagaacagaatggacttcatccacatggtcatcggtatgtcaatgagaatctgccagatgaggaattccagcctggatccaatgtttttcgtgtacgtcaacccttttagtggtagccatagcgaaggttggaacatgccctttggggaattcggctaccctcggtgggaaaagattaggctccagaattcccagtgttacaactggactctgctattgggcaaccgctggaaaacctttttcgaaaccgtccacatctacctgcggagccgcacccgcctgccaacgttacttcggaatgaaacaggacaaggacccgtggatctgtctgatcctagtaagaggcaattctacattaagattagcgatgttcaggtcttcggatatagtctgagattcaacgccgacttgcttcgcagcgcggttcagcaagtcaaccagtcttacactcagggtggtcagttttatagtagctcctctgtgatgcttttactgctggacatccgggatcgaattaaccggttagccccaccagtggcacctggaaagcctcagctggaccttttctcctgcatgttgaaacataggctgaaactgaccaactccgagataattagggtaaaccatgcactcgatctgtataacaccgagatcctaaagcagtcagaccaaatgacagcaaagctatgctag

SEQ ID NO: 220542 - DNA, 963 bp, Artificial Sequence
  Description of Artificial Sequence: Synthetic coding sequence
atgaattggaggtttgtcgagctactgtacttcctatttatttggggtcgcatcagtgtgcagccctcccatcaggagccagccggtaccgaccagcacgtcagtaaggaattcgactggcttatctccgataggggccctttccaccacagtcgatcttacctcagtttcgtggaacgccaccgccagggatttaccactcgatacaagatctatagggagttcgcaaggtggaaggtgaggaatacagctatcgaacggcgagacttggtaaggcatcccgtccccctgatgccagagttccagcgctcaattaggcttctgggcaggagaccaacgacacagcaatttatcgataccataataaaaaagtatggcacacatctactgatatctgccacactgggtggcgaggaagccctgactatgtacatggataaaagtaggctggaccgaaagagtggtaacgccacccagtccgtcgaagcactgcaccagctcgcgtcttcctactttgtcgatagagacggcactatgcgcaggcttcacgagatacagatatccacaggggctatcaaggtaacagaaacgcggacaggcccactcggctgcaacagttacgacaaccttgacagcgttagctccgtgctgttgcaaagcactgagtctaagctgcacctgcaaggcctccaaattattttcccacaatatcttcaagagaagttcgtgcagagcgccctgagttatatcatgtgcaacggcgagggtgagtacctttgccaaaactcacagtgtaggtgtcagtgcgccgaagagtttcctcagtgtaactgtccaattactgatatccagattatggagtacactctggccaacatggcaaaatcctgggcagaggcctataaagacctcgagaactccggtagagagtcccattcagttcctctccacgagtggccatag

SEQ ID NO: 220543 - DNA, 2286 bp, Artificial Sequence
  Description of Artificial Sequence: Synthetic coding sequence
atgaattggagattcgtggagctgctttatttcctgttcatatggggaagaatcagtgtccagccttcccaccaagaacctgccggaacagatcaacatgtgtctaaagagtttgattggctcatttccgaccgcggacccttccatcactctcggagctatctctccttcgtggaacgccatagacagggctttaccactcggtataagatctatagggaattcgccagatggaaagtacgcaatacagcaatagagaggcgggatttggtacggcaccctgtccctctgatgcctgaattccagagatcaattcggttattgggcagacgacccaccacccagcagttcatcgacaccattatcaaaaagtacggaacgcacctgctgattagcgctacccttggcggtgaagaggctctgacgatgtatatggacaaaagccggctagataggaaatctgggaatgccactcagagcgtggaagctctgcaccagctggcttcgtcttatttcgtagaccgggacggtaccatgaggcggttacatgagatccagatctcgacgggagccataaaggttactgagaccagaacaggaccacttggctgtaactcctatgataatctcgactccgtgtcctccgtgttgctccagtcaaccgaaagcaaactccacctgcaggggttgcagattatttttccccaatatttgcaggagaagttcgttcaaagcgccttatcctacattatgtgcaacggcgagggagaatacctctgccaaaactcccagtgccggtgccagtgtgcggaagaattccctcaatgcaactgccccattaccgatattcagatcatggagtacactctcgccaacatggctaaatcttgggccgaagcttacaaggatctggagaatagcgacgaattcaagagctttatgaagcgcttgccaagcaatcatttcttaactatcggctcaatccaccagcattggggcaatgattgggatctccagaatcggtataagctgttacagagcgccactgaggcccagcgccaaaagattcagcgaaccgccaggaagctcttcggactatcagtccggtgccgccataacccaaatcaccagctccccagggagcggacaatccagcagtggctcgcccgagttcagagcctgctttactgcaatgagaacgggttctggggcaccttccttgaatctcagcgaagctgtgtgtgtcatggatctaccacgctgtgccagagaccgataccatgtgtgatcggcggtaacaacagttgtgcaatgtgttccctggccaatatctccctctgtggatcctgtaataaagggtacaaactgtatcggggtcgttgtgaaccgcagaacgtggacagtgaaaggagtgaacagtttatatctttcgagaccgatttggattttcaggatcttgaactgaagtatctccttcaaaaaatggattcccgactgtatgtccatactactttcattagtaacgaaatccgacttgacaccttttttgatcccagatggcgtaaaaggatgagtctgaccctgaaatctaacaaaaaccgaatggatttcatccatatggttattggcatgagtatgcggatctgccagatgcgtaactcttccctcgacccaatgttcttcgtgtatgtgaaccctttcagcggcagtcattccgagggttggaatatgccattcggtgagtttggctacccccgatgggagaaaatccgccttcagaatagccaatgctacaactggactctgcttctgggcaataggtggaagacattttttgagaccgtccacatttacttaagaagccgcacccgcttaccaaccctcttgcgcaatgaaacaggccagggccctgttgacctgtctgatcccagcaaaagacagttctatataaagatctccgacgtacaagtgttcggatatagtctgcggttcaacgccgacttgttgagatcagccgtgcaacaagttaatcagtcctatactcagggtggacagttctatagcagcagcagcgtgatgcttttactcctggacatccgtgaccggatcaataggctggcccctcctgtggccccaggtaagccacagctggatctgttctcttgtatgctgaaacatcgcctaaaactgaccaattctgagattatcagggtgaaccacgcgcttgatctgtacaacacagaaattctgaagcaaagcgaccaaatgacagccaagctttgctag

SEQ ID NO: 220544 - DNA, 1404 bp, Artificial Sequence
  Description of Artificial Sequence: Synthetic coding sequence
atgaaacgtatcaaagtcccagattacaaagacagaagtgtgtttggagttccccttacggtcaacgtgcagcggactggacagcctttgccccaatccattcaacaagcaatgagataccttcgaaaccactgcctggaccaggtcggcctgttccgcaagagcggggtgaaatcacggatacaggctttgaggcagatgaacgagggcgctatagactgcgtgaactatgagggccaatctgcctatgatgtggccgatatgctgaagcaatactttagggacctcccagaacctttgatgaccaataaactctcagaaacatttctgcagatctatcagtatgtcccgaaggaccaacgcctacaagctatcaaagccgctataatgcttctccccgacgagaacagggaagtgctccagaccctcctatacttcctgtcagacgttactgccgctgtcaaagagaatcaaatgacccctactaacttggcggtgtgcctggcaccttcactattccatttgaacaccttgaaaagagagaactcaagcccacgggtgatgcaaaggaagcaatccctggggaagccagatcagaaggatcttaatgaaaacttggcggcaacccaaggcctggcacatatgatagcagagtgtaaaaagctgttccaggttccagaggaaatgtccagatgcaggaattcctacacagaacaggaacttaaacctttaactctggaagctttgggtcacctgggcaatgatgatagtgctgattaccaacactttctacaggactgcgttgacggcctgtttaaggaagtgaaagagaaattcaaagggtgggtgtcatacagcacctctgaacaggccgaattgtcgtataagaaggtgtccgaggggccacccctgagattgtggagatctgtcatcgaagtacccgctgtgcccgaagagattctgaagaggctgctcaaggagcaacatctgtgggacgtggatttgctggatagtaaggtgatcgagattctcgattctcagaccgaaatttaccagtacgtgcagaacagcatggcaccacaccctgccagggactatgtggtattaagaacctggcgaactaacttaccaaagggagcttgtgctttgctgctgacctccgtggatcacgaccgtgctcctgtcgtgggcgtgagggtgaacgtgcttctgtcgcgctaccttattgaaccatgcggccctggcaagagcaaattaacttacatgtgtcgggttgatctaaggggacatatgcctgaatggtacaccaagagttttggacacctgtgcgccgcagaagtggtgaaaatacgggacagcttcagtaaccagaatacggagacaaaagataccaagagccggtag

SEQ ID NO: 220545 - DNA, 3378 bp, Artificial Sequence
  Description of Artificial Sequence: Synthetic coding sequence
atgggggacccaaaggcgcatgtgatggcccgtcctctgagagcacctctccgcagaagttttagcgaccatatccgggatagtaccgcacgggcactcgacgtgatttggaaaaatacacgggacaggagactggccgagatagaggcaaaggaggcgtgtgactggctccgagccaccggatttccacaatacgcccagctgtacgaagattttctgttccccatcgacatttccctggtcaaaagagagcacgactttctggatcgcgacgccattgaggcactgtgccgcagattaaatacccttaataagtgtgccgtgatgaagctcgagatttctccacataggaaacgctcagatgattccgatgaggatgagccttgtgccatctccggtaagtggacttttcagcgggattcgaagcgttggtctcgactggaggaatttgacgtgttctcacccaagcaggacctagtccccggtagtcccgatgactcccacccaaaagatggacccagtccaggtggtactctaatggatctgtcagagcgtcaggaagtttccagcgtccgttctctaagttctactgggtcccttcctagccacgcccctcccagcgaagatgccgctactcccaggactaactcagtgatcagcgtctgcagctccagtaacctggccggaaacgatgatagctttggctctctgccctcgcccaaggaactgtcctcattctcctttagcatgaaagggcacgaaaagaccgccaagtctaagacccgttcacttctaaaacggatggaaagtctgaaactcaagagcagccaccattcaaaacataaggcacctagtaagcttggcctcatcatcagtgggccaatcctccaggaaggaatggatgaagaaaagctcaagcagctcaactgcgtggagattagcgcacttaatgggaacagaatcaatgtacctatggttaggaaacgcagtgtgtctaattccacgcagaccagcagcagctcctctcagtccgagacttcctccgccgttagcacaccatcacctgtcacgcgcactcgctctcttagcgcatgtaacaagagggtcggtatgtatctggagggattcgatccatttaatcagtctacctttaacaatgtggtcgaacagaacttcaagaacagagagtcttaccccgaggacaccgtcttttacatacctgaggatcacaaacccggtacttttcctaaagccttaacaaacggatcctttagccctagcggtaataacggcagtgtcaactggagaacagggagctttcatggtcctggtcacataagcttgcgccgtgaaaatagttctgacagcccaaaagaattaaaacggcgaaattccagtagctccatgagctcacgtctgtcgatttatgataacgtgcccggaagcatcttgtattcgagcagcggagacctcgctgatcttgagaatgaagatatctttcctgagctggacgacattctgtaccacgtgaagggaatgcaacgtatcgttaatcaatggagcgagaaattctcagacgaaggagacagcgactccgctttagactcagtcagtccatgccctagctcccctaagcagatccacctggacgtcgacaacgatagaactacacctagcgatttggactcaactggaaatagcctgaacgagccggaggaaccatccgagattccggagcgcagagactctggggtaggcgcatctctcactcggtcgaatcggcaccggctccggtggcattctttccagagttctcatagacctagtctgaatagtgtttcactccaaataaactgccagagcgtggctcaaatgaatctcttgcagaagtactccctattgaaactgacggctctgttagagaagtatacgccttctaacaaacacggcttcagttgggccgtgcccaagttcatgaagcggattaaggtcccggactacaaggataggtctgtgtttggggtcccactaacagtaaacgtccagcggacaggccaacctctgccgcaatccattcaacaggcgatgaggtacctgcgaaatcactgcttggaccaagtgggactgtttcggaagagtggagtcaagtcgaggatccaggctcttcgacaaatgaatgaaggcgctatcgactgcgtgaattatgaggggcagagtgcatatgacgtcgcggacatgctgaaacaatattttagggatctgcccgagccactgatgacaaacaagctttccgaaacttttctccaaatctaccaatatgtgccaaaggaccaacgtcttcaggccattaaggctgccatcatgctcctccctgacgagaacagagaagtcctgcagactctgttgtacttcttgtcagatgtgaccgctgcggtgaaagagaatcaaatgactccgactaacctagccgtgtgtttggccccttctctgttccatctgaatactctgaagagagagaatagctctcccagggttatgcagaggaagcagtcacttgggaagcccgaccaaaaggatctgaacgaaaacctggcagccacccaagggctggcacatatgatagcagagtgcaagaaactctttcaggtgcctgaggaaatgtcacgatgcagaaactcctataccgaacaggagctgaaacctctgactctggaggcccttggccacctcggtaacgacgactcggcagactaccaacatttcttacaggactgcgtcgatggactgttcaaagaggtgaaggaaaaatttaagggctgggtctcttattctaccagcgaacaagctgaactgagctacaaaaaagtctctgaagggccaccactgaggctgtggcggtctgtgattgaggtgccagcagtccctgaagaaattctaaaacggttgctgaaagaacagcatctttgggatgttgacctccttgactctaaggtaatcgagatcctggacagccaaactgaaatctatcagtatgttcagaattccatggcccctcatccagcgcgagactatgtggtgctcagaacctggcggacaaacctgcccaaaggcgcttgcgccttacttcttacatccgttgatcatgatcgcgcaccagtggtgggagtacgcgtgaatgtcctgctgagccgatacttgatcgaaccttgtggtcctggcaaatcaaaattaacttacatgtgtagggtggaccttcggggacatatgccagagtggtacactaagtcattcggacacctatgcgcagccgaggtcgtcaagatacgtgattcctttagcaatcaaaatacggagaccaaagatactaagtctcgatag

SEQ ID NO: 220546 - DNA, 3054 bp, Artificial Sequence
  Description of Artificial Sequence: Synthetic coding sequence
atgaaattagaaataagtcctcatagaaaaagaagcgatgactccgacgaggatgaaccgtgtgccataagcgggaaatggacctttcagcgggatagtaaacgctggtctcgcttggaggaatttgatgtgtttagcccaaagcaggacctggtgccgggtagtcccgatgatagccaccctaaggatggcccatcccccggagggaccttgatggacttgagcgagcggcaggaggtatcctcagtgcgttctttgagctctacaggatccctcccttctcacgccccaccatctgaggacgcggcaacccccaggactaactctgtgatctctgtttgcagcagcagtaatcttgctggcaatgatgacagtttcggttcactcccatccccaaaggagttgagctcattctctttttcgatgaagggtcatgagaaaaccgctaaatcaaagaccaggtctctgttgaagaggatggagtctctcaagctcaaatcctctcaccacagcaaacataaggcaccgtcaaagctgggcctgatcattagtggacccattctgcaggagggaatggacgaggagaaactgaagcagctcaactgcgtagagatatccgcactgaatggtaataggattaatgtgcctatggtcaggaaaaggtcagtgtccaactctacacagacatctagttcgagttcacaaagcgaaacaagtagtgctgtgtccaccccctctccggtgacccggacgcggtcgctgagcgcctgcaacaagcgcgtgggaatgtatctagagggcttcgaccctttcaaccagagtacttttaataatgtggtggaacagaactttaaaaaccgtgagtcttacccggaggacactgtgttttacatccctgaagatcacaagccaggaactttcccgaaagctcttactaacggaagcttcagcccgagcggcaataacgggagtgttaattggaggaccggatcgttccacggacctggacatatcagtttgcggagagaaaatagctcagactcccctaaggagctgaagcgcagaaactcctccagttctatgtctagccggttatctatctatgacaatgtgcctggatctatcctgtattcgtcatccggcgacctggccgatctggagaacgaagatatcttccccgagcttgacgatatcctgtaccatgtcaagggcatgcagcgtatcgttaaccagtggtcagaaaaattttccgacgaaggagatagcgactctgcactggacagcgtgagtccttgtccgtcctctcctaaacagattcatctggacgtcgataacgaccggacaacaccctctgaccttgattcaaccggaaactcattgaatgaaccagaagagccatcagaaatcccggagcgcagggattcgggggtgggagcttccttaactcgcagcaaccggcatcgcctccgctggcatagcttccagagttcacatagaccttctcttaacagtgtgtccctgcagatcaactgccaaagcgtcgcacaaatgaatctgctgcagaaatatagtctgttgaagctcacagccctgctggagaagtacacacccagtaataaacacggcttttcatgggctgtacccaaatttatgaaacggattaaggtgccggactacaaagaccgttcagtatttggtgttcccctgacggtcaacgtgcagcggacaggacagcctctgccccaatctattcagcaagccatgcgttacctgcgcaatcactgtcttgaccaggtgggcttgtttagaaagtccggcgtgaaaagtcgaattcaggccctgcgtcaaatgaacgaaggagcgatagattgtgttaactatgagggccagtcagcgtatgatgtagccgatatgctcaagcagtacttcagagatctgcccgagcctttaatgacaaacaagctatccgaaacgtttctgcagatctatcagtacgttccaaaagaccagcgactgcaggcgatcaaagcggcaatcatgctcctgccagacgaaaaccgggaggttttgcagacactcctttatttcctctccgacgtcaccgctgcggttaaggaaaaccagatgacaccaactaacctggccgtgtgccttgccccatccctgttccacttgaacactctgaaaagagagaattcctctccccgagtaatgcaaagaaaacagtcccttggaaagccggaccagaaggatctcaacgaaaacttggccgctacgcaaggtctcgctcatatgatcgctgagtgtaagaaactttttcaggttcctgaggagatgagccgatgtagaaacagctatacagagcaagaactgaagcctctcactctcgaggccttaggccatctcggtaatgacgacagtgctgactaccagcactttttgcaggactgcgtagacgggttgtttaaggaagtaaaggagaagtttaagggttgggtgagttactccacatctgagcaggccgaactgagttacaaaaaagtttccgaaggaccaccactgcggctgtggcgcagcgtgattgaagtgcctgctgtcccagaggaaattctgaaacgcctgctgaaggagcagcacctgtgggatgtagacctgctggattccaaagttatcgagattctggattctcagacggagatatatcaatacgtccagaactcaatggcgcctcatcccgctcgggattacgtcgtgttaagaacctggaggaccaacctgcccaaaggcgcttgcgccctgcttctgacgagcgtcgatcacgatagagcccctgttgtaggtgtgcgggtaaacgtcctcctaagtcggtacctcatcgaaccctgcgggccaggtaagtcaaaattgacctacatgtgtcgggtggacctgagaggacacatgccggaatggtacacaaagagtttcgggcacttgtgcgctgctgaagtcgtaaaaattagggacagtttcagcaatcagaacactgagacaaaagataccaagtccagatag

SEQ ID NO: 220547 - DNA, 972 bp, Artificial Sequence
  Description of Artificial Sequence: Synthetic coding sequence
atgggcaactccgctagccggagtgattttgagtgggtctacaccgaccagccccacacccagagacgcaaagagatcttggccaaatacccagctataaaagccttgatgcgtccagacccacgtctaaaatgggcggtgctcgtgttagtgttggtgcaaatgctagcatgctggctcgtgcggggtctagcctggcgctggctgctgttttgggcgtatgcctttgggggttgcgtgaaccactctcttacattagcaatacacgacattagccataatgcagcatttgggactgggcgagcggctcggaaccggtggctggctgtgtttgcaaacctgccagttggcgtgccctatgctgctagctttaagaaatatcatgtggaccaccatcggtatctgggcggagatggtctcgatgtggatgtgcccacccgcctcgaagggtggttcttttgtaccccagccaggaagcttttgtggctagtgctacagccctttttctactctttgcgcccactgtgtgtgcacccaaaagcagttacaagaatggaagtgctgaacacactggtccagttagccgcagacctggctatattcgccctgtgggggctgaaacctgtggtgtatctcttagcttcatcatttcttggcctgggcctccatcccatttccggccatttcgtcgccgagcattatatgttccttaaggggcatgaaacttattcgtattacgggcctttgaattggattaccttcaatgtcgggtaccacgtagagcaccatgatttcccaagcatccctggctataatctgccgctggttcgcaaaatcgcccctgagtattacgaccatctgccacagcaccatagctgggtgaaggttctatgggactttgtgtttgaagacagccttggcccatatgctagagttaagcgcgtctacagattagcaaaagatggcctgtag

SEQ ID NO: 220548 - DNA, 2214 bp, Artificial Sequence
  Description of Artificial Sequence: Synthetic coding sequence
atgcagccgagacgggcacaagctcccggagcccagctgctacccgcactggctctcctgctgctgttactgggggcagggcctagagggtcttcacttgcaaaccctgtgccagcggcaccactgtctgcccctgggccttgcgcagctcagccctgcaggaacggcggtgtgtgcaccagccggccagagcctgatccgcagcaccccgctccggctggggaacctgggtactcatgtacatgtcccgctggaattagcggggctaactgtcaactcgttgccgatccatgcgcctctaacccatgccaccacggtaactgtagctccagcagttcttccagctcagacggatatctttgtatttgtaatgaagggtacgagggccctaactgcgagcaggcgctcccaagtttgccagcaactgggtggacggagagcatggccccaaggcaattgcagcctgtcccagcaacccaagaaccagacaaaatactgcccaggagtcaggccacagtcaccctgcctacatggcagccgaaaaccggtcagaaggttgtagaaatgaaatgggatcaggttgaagtgattcctgatatcgcctgcggaaacgcctccagcaattcctccgcgggagggaggctggtgtcttttgaggtgccccagaatacgtccgtgaaaattaggcaagatgccacggctagtctgattttgctatggaaggtgacagccactgggttccagcagtgctcattaattgacggcagatccgtgacacccctccaagcgagtggagggctggtgctcttggaggaaatgctggccctaggtaataaccacttcatcggattcgtgaacgactccgttaccaagtctatcgtggctctgcgtctgactctcgtggtgaaagtttctacatgcgtgccaggggagagccacgcgaacgatctagaatgtagtggtaaagggaagtgcacgacaaagccctccgaggctaccttttcctgtacatgcgaagagcagtacgtggggacattctgcgaggaatacgatgcatgtcaaaggaaaccctgccagaataatgccagctgtattgacgcgaacgagaagcaagacggctcaaacttcacatgtgtttgtctgcccggttatacaggagaactctgtcagtccaagattgactactgcatcctagatccatgcagaaacggcgcaacctgcattagttcattatccggatttacctgtcaatgccccgagggctattttggctccgcatgcgaggagaaagttgatccgtgcgccagtagcccctgccagaataatggaacttgctacgtggatggggtccatttcacttgtaactgttctcctggattcacagggcctacttgcgcccaactgatcgacttctgcgccctgtccccctgtgcccatggcacctgcagaagcgttggaacttcatacaaatgcctctgcgatccaggataccacggcctgtactgcgaggaagagtacaatgaatgtctttcagccccatgcctgaacgcagcaacctgccgagatctggtgaatggatacgagtgcgtatgcttggcagaatacaagggcacacactgcgagctgtacaaagatccttgcgctaacgtgtcttgcctcaatggtgcaacctgcgactcagacggccttaacggaacctgtatctgcgcccctggctttacgggagaagagtgcgacatcgatatcaatgagtgcgacagcaacccttgtcaccacggagggagctgtctggaccaaccgaatggctataactgccattgcccccacggctgggtgggtgctaattgcgagatacacttgcaatggaaaagcgggcacatggctgagtccctcacaaacatgcctcgccactccctgtatattattatcggcgctttgtgcgtggcattcatcctgatgctgataatcctcatcgtggggatttgcaggatatccaggattgagtaccaaggttccagtcggcctgcctatgaggagttctataactgcaggtcgattgactctgagttttctaatgctatcgcttcaatccgtcatgccagatttggtaagaagtctcgtcctgcaatgtacgatgtgagcccaatcgcctacgaggattactcccctgacgacaagccattggtgacactgattaagactaaagatttatag

SEQ ID NO: 220549 - DNA, 1368 bp, Artificial Sequence
  Description of Artificial Sequence: Synthetic coding sequence
atgcttgctctgggcaacaaccacttcatcgggttcgtgaacgactcagtgactaagtctatagtcgcactgaggctgacgctcgtggtaaaagtcagcacctgcgttccaggagaatcccacgccaatgacttagagtgcagcgggaagggaaagtgcaccacaaagccaagtgaagctactttcagctgcacttgcgaagagcagtacgttggtaccttctgcgaggaatacgatgcgtgccaacgtaagccatgtcagaataacgcctcatgtattgacgccaacgaaaaacaggatgggtccaattttacttgcgtgtgcctacccggatatacaggagaattatgccagagcaaaattgactattgtatcttggacccctgtagaaacggcgcaacttgtatcagctccctgtccggtttcacttgtcagtgtcccgagggctacttcgggtccgcgtgcgaagagaaggtggatccatgcgcaagttcgccgtgccaaaacaatggaacctgttgctcgcctggctttactggtccaacctgcgcacagcttatagatttctgtgccctgagcccatgtgcccacggcacctgcaggtctgtcggcacaagctataaatgcctgtgtgacccaggctatcacgggctttactgcgaggaggaatacaacgaatgcctttctgcaccctgtctcaacgctgcaacttgcagagacctggtcaacggatacgagtgcgtttgtttggccgagtacaagggcacccattgcgaattatataaggatccttgtgccaacgtctcttgcctcaacggggctacatgcgactctgatgggttgaacggaacgtgcatctgtgcacctggtttcaccggggaagagtgcgacattgacattaacgagtgtgatagcaatccttgtcatcacggtggctcgtgtctagaccaaccgaatggatataattgccattgcccgcatggttgggtgggggcaaattgtgaaatccacctgcaatggaagtcagggcacatggcagaaagcttgactaatatgccccgtcactccctgtatattattatcggagctctttgcgtggccttcatcctgatgctgataattctgattgtcggaatatgtagaatctctagaattgagtatcaaggatcctctcggcctgcctacgaagagttctacaattgtcgctcaattgatagcgagtttagcaacgcaatcgcctccattcgccatgcacggttcgggaagaagagcagaccggctatgtacgacgtgtcacctattgcgtatgaggactattctccggacgataagccactcgtgacacttattaagacaaaagacctgtag

SEQ ID NO: 220550 - DNA, 933 bp, Artificial Sequence
  Description of Artificial Sequence: Synthetic coding sequence
atgacagctacagaggctttgctgagagtgcttctgctgttgctggccttcggacattctacctacggcgctgagtgtttcccggcttgcaatccacagaatgggttttgtgaggacgacaatgtctgtcgatgtcaaccaggatggcaaggtccactttgcgatcaatgtgtgacctctcctgggtgtcttcacggcctgtgcggcgagccaggtcagtgtatttgcacagatggctgggacggggagctgtgtgatcgtgatgtccgtgcgtgctctagtgcaccatgcgctaataacagaacatgcgtcagccttgatgatggtctctacgaatgttcctgtgcacctggctacagcggaaaggactgtcagaagaaggacgggccttgtgtgataaacggatccccctgtcagcacggcggaacatgtgtcgacgatgaggggagagcctctcacgcttcctgtttatgtcccccaggctttagcggtaatttctgtgagattgtcgccaatagctgtacgcccaatccttgcgagaacgatggggtatgtactgacattgggggagattttagatgtcgatgccccgcaggattcatcgacaagacatgcagcaggccagtcaccaactgcgcctcatctccctgtcagaacgggggaacatgcctccagcacacccagggccaggcaatttgctttacgatcctcggagttcttactagcctcgtggtcctggggactgtgggtattgtcttcttgaataagtgtgaaacttgggtgtctaatctccgttataaccacatgctacggaagaagaagaacctgctcctgcagtacaattccggcgaggacctggctgtaaacattatcttccccgaaaaaatcgacatgaccaccttcagcaaggaagcaggagacgaggagatatag

SEQ ID NO: 220551 - DNA, 1152 bp, Artificial Sequence
  Description of Artificial Sequence: Synthetic coding sequence
atgactgcgaccgaagccctgttacgcgtgctgttgcttctgctggcctttgggcattctacatatggtgccgaatgttttcccgcatgcaacccccaaaatggattttgtgaggacgacaacgtttgtcggtgtcagcccggttggcagggacccctctgtgaccagtgtgtaactagtcccggttgcctgcatggattatgcggcgagcccggacagtgtatttgcactgacggatgggacggcgagctctgtgacagggacgtgagagcttgtagctctgcgccttgtgcgaataatcgaacctgcgtgtctctagatgatggtctgtacgagtgcagctgcgcccctgggtattctggaaaagattgccagaaaaaagacggaccttgcgtaattaacggatccccatgccagcacggtgggacttgcgtggacgacgagggtagggctagccatgcctcttgcctctgcccgccaggtttcagcggtaatttttgtgagatcgtggccaatagctgtactcctaacccttgcgagaacgatggtgtgtgcaccgatatcggcggagactttcggtgcagatgccccgcaggatttattgacaagacttgctctaggcccgtgactaattgcgctagctctccatgccagaacgggggtacgtgcctgcagcatacccaggtgtcgtacgagtgtctatgcaagccggagttcacagggcttacgtgcgttaagaagagagccctttccccccagcaagtgacaagactgccgtcgggctatggattagcctaccggttgacgcctggtgtgcacgagcttcctgttcagcaaccagagcaccgaatactgaaagtctccatgaaagaacttaacaaaaaaacgccactgctgactgagggtcaggccatatgcttcacaatcttgggtgttcttacctctctggtggtactggggactgtgggcatcgtattcctaaacaagtgtgagacgtgggtgagtaacctgagatacaaccacatgttgagaaagaaaaaaaacctgttgttgcaatacaatagtggagaagatctcgcagtaaacatcatctttcccgagaagatcgacatgacaaccttttccaaagaagctggggatgaggagatctag

SEQ ID NO: 220552 - DNA, 294 bp, Artificial Sequence
  Description of Artificial Sequence: Synthetic coding sequence
atgaccgccaccgaggcactcttgagggtgctgctccttctcctggcattcggccattccacttacggggctgaatgtttccctgcctgtaaccctcagaatggtttctgtgaggatgacaacgtgtgccggtgccaaccaggctggcaaggcccattgtgcgaccagtgtgtcacttctcctggctgtttgcatggtctgtgcggagaacctggacaatgcatctgcactgatggctgggatggtgaactatgcgatagagacgtacgagcctgttcgtcagctccatgttag

SEQ ID NO: 220553 - DNA, 3612 bp, Artificial Sequence
  Description of Artificial Sequence: Synthetic coding sequence
atggcagcgtgcggacgggtccgaagaatgttcaggctgtccgccgctctccacttgctgttgctgtttgctgccggtgccgagaaactgcctggacaaggggtgcactctcaagggcaggggccaggcgctaattttgtctcattcgtcggccaggccggtgggggtgggcctgctggacagcaacttccacaattgccccaatcttctcagctgcagcagcagcagcagcagcagcagcagcagcaacagcctcagcctccacagcctcccttccctgcaggtggcccacccgcacgcaggggcggagcaggcgctggcggaggctggaagctggccgaagaggagtcttgcagggaggacgtgactcgcgtttgccctaagcatacttggagcaacaacctggccgtgctggagtgcctgcaggacgtaagggagcctgagaacgaaatctcttcagattgcaatcacctgctctggaactataagcttaatctgacaacggatccaaagttcgagtccgttgccagggaagtgtgcaaatctacgataactgaaataaaggagtgcgcagatgaaccagttggcaaggggtacatggtctcatgtctcgtcgatcatagaggcaatatcaccgaatatcagtgtcatcagtatatcacaaaaatgactgcaattatcttttcggattatcgattgatctgcggtttcatggacgactgtaagaatgacatcaacattttgaagtgtggaagcatacgattaggagagaaagatgctcattctcagggggaggtggtatcatgcctagagaaggggctagtaaaggaagcggaagaaagagagcctaagattcaggtaagtgaactgtgcaaaaaggctattcttcgggtggctgagcttagctcagacgatttccatctagaccggcatctttactttgcttgcagagacgatagggaaaggttctgcgagaatacccaagccggtgagggtcgagtttataagtgcctattcaaccataaatttgaagagtctatgagcgagaaatgcagagaagctctgacaactcgtcagaaactgatagcccaggactataaagtgtcctattccctggcaaaatcgtgtaaaagcgatttgaagaagtaccggtgtaacgttgaaaatctgccaaggtcccgggaagcgagacttagttacttgttaatgtgtttagagtccgccgtgcaccgtggacgtcaggtcagctcagaatgccaaggcgaaatgctggactacagaagaatgctcatggaagacttcagcctgagccctgagatcatactgtcctgcagaggggagatcgagcaccactgcagcggactccaccggaaaggacgaactctgcactgcttaatgaaggtagttcggggtgagaaaggcaaccttggaatgaattgccagcaggccctccagaccttaattcaggagaccgacccaggtgcagattacagaatcgatcgggctctgaacgaggcatgcgagagcgtcattcagacagcctgcaagcacattcgatcgggcgacccaatgatactgtcatgcttgatggagcacttatacactgagaaaatggtggaggattgcgagcacaggctgttagagttgcagtattttatcagtcgcgattggaagctcgatccggttttgtataggaagtgtcagggggatgcaagcaggctgtgtcacactcacgggtggaacgagacctcggaattcatgccccagggagcagtgttcagctgcctctatagacatgcataccgtactgaggagcaagggagaagactgtcaagggagtgccgcgcagaagttcaacggattctacaccaaagagcaatggatgtgaaactggaccctgccctgcaagacaagtgtctgattgacctggggaagtggtgttccgagaaaactgagaccgggcaagaactggaatgcctacaagatcatctggatgacttggtggtggagtgccgagatattgtgggtaaccttacagaactcgagtcagaagacattcaaatcgaggctctgctaatgcgtgcttgtgagccgatcattcagaacttttgtcacgatgtagccgataaccagatcgacagtggggacctgatggagtgtctgattcagaacaaacaccagaaggacatgaacgaaaagtgtgctatcggagtgacccacttccagttagtgcagatgaaggattttcgcttttcctacaaattcaaaatggcctgcaaagaagatgtgctgaaactctgtcccaatataaagaagaaggttgatgttgtcatatgtctgtccaccacagtccggaatgacactctgcaggaagccaaggagcatagggtcagccttaaatgtaggcgacagctgcgcgtcgaagagctggagatgaccgaagatatccgtctagaacccgacctctacgaagcctgtaagtcagatatcaaaaacttctgctcagccgtgcagtatggaaatgcccagataatcgagtgcctcaaagaaaacaagaaacaactgtcaacacgatgccatcagaaggtatttaagctgcaggaaacagagatgatggacccagagcttgactatacactaatgagagtgtgcaagcagatgatcaaacggttctgtccggaggccgactccaaaactatgttgcaatgcttgaaacaaaataaaaactcagaattgatggatccaaagtgcaaacagatgatcacgaagcgccagatcacgcagaataccgattataggcttaaccccatgctccgaaaggcttgcaaggccgacattcctaagttttgccacggtatactcacaaaggccaaagacgatagtgagctggagggccaggttattagctgcctaaagctccggtatgccgaccagaggctatcatcagattgtgaggatcagatcaggattattattcaagaaagtgccctggactacagactggatccacagctgcagctccattgttccgacgaaatttcctctctgtgtgctgaggaagctgctgctcaagagcagactggccaggtagaagagtgcctgaaggtgaacctattaaaaattaagacagaactctgcaaaaaggaggtacttaacatgctcaaggaatccaaggcagacatttttgttgatccggtgctccacacagcatgcgccctggacataaagcatcattgtgcagccataacgccaggtcgcggtcgccagatgagttgtctcatggaagccctggaagataaacgcgtacggctacaaccggaatgtaaaaagcggttgaacgaccgtatcgaaatgtggtcttacgccgcaaaggtggcaccagccgatggtttttctgatttggcaatgcaagtgatgacctccccttctaagaactacattctgagcgtgatatctggaagtatctgtatccttttcctgattggactcatgtgcggtcgtatcactaaaagggttacccgcgagttgaaagatcgattgcaatacaggagcgaaactatggcttacaaagggcttgtgtggagccaagatgtgacaggttcccctgcttag

SEQ ID NO: 220554 - DNA, 1764 bp, Artificial Sequence
  Description of Artificial Sequence: Synthetic coding sequence
atggtctccccacggatgagcggactgttatcccagacagtgattctcgcacttatctttcttccccagacgcgccctgctggggtgttcgagctgcaaatacactctttcggccctgggcctggccctggtgcacctcgctctccgtgttccgctagactcccttgcaggctcttcttccgagtttgcttgaaacccggactgagcgaagaggctgcagagagcccatgtgcccttggtgcggctctgtccgcaaggggcccagtctatactgaacagcccggagcacctgcccctgatctcccactcccagacgggctgctgcaagtgccattccgtgatgcctggcctggcactttctcgttcatcatcgagacgtggagagaggaactgggagaccaaattggcggtcctgcatggtctctactggctcgggtcgctggaagacggcgtttggcagctgggggaccatgggcgcgtgacatccagagagccggagcctgggaactacgattctcataccgtgcccgatgcgaaccgcctgccgttggaaccgcttgtacgagactctgcagaccaagatcagctccttccagatgcggtccgggactgcgcccatgtgctccgctggaggacgagtgtgaagcccctctcgtctgccgggcaggttgcagcccggaacacgggttctgtgagcagccaggtgaatgtcgatgtctggagggctggaccggccctctgtgcaccgtgcccgttagcactagtagttgccttagcccacgagggccaagttctgctacaacaggatgtctggtacccggtcctgggccatgtgacgggaacccgtgcgccaacgggggaagttgcagtgagactccgcgatccttcgaatgcacttgtcctcggggattctacggtctgagatgcgaagtgtcgggcgtcacttgtgccgacggaccatgtttcaacggcggactatgtgtcggtggcgcagacccagactctgcctacatttgtcattgtccccctggttttcagggaagcaactgtgagaagcgagttgaccgatgctcactgcagccttgccgcaatggcggattgtgtttggaccttggacacgccctccgatgtaggtgccgcgctggctttgccggaccacgatgtgaacatgatctggacgattgtgctgggagagcctgcgcaaacggaggaacatgcgtggaaggaggcggagcccacagatgctcatgtgctttggggtttgggggacgagactgcagagagagggccgacccttgtgcagcacgcccatgtgcgcatggcggtcgctgttatgcacatttctcaggtctcgtgtgtgcctgcgcccctggctacatgggagcgaggtgtgagttccccgttcaccctgacggagcaagcgcactgcctgcagcccctcccggattaaggcctggagacccgcagcggtatctgctacccccagcactgggcctgttggtggctgcgggagtggctggtgcagcgctgctgttggtgcatgtgcgacggcgtggacactctcaggatgcgggatcccgtttgctggccggtacccctgaaccttctgtgcacgcgctgccagacgcccttaacaacctgcgaacccaagaaggctctggagatggaccttccagctcggtagactggaatcgtcccgaagacgtggacccacaaggaatatatgtgattagcgcccctagcatctatgctagagaagcttag

SEQ ID NO: 220555 - DNA, 2058 bp, Artificial Sequence
  Description of Artificial Sequence: Synthetic coding sequence
atggcggctgctagcagaagcgctagtgggtgggctctgcttctgctagttgccctgtggcaacagcgcgcagccggaagtggcgtgtttcagttacagctgcaagagttcataaatgagcgcggtgtattggcctctggtagaccttgcgaacccggttgccgcacattcttcagagtgtgcctgaagcattttcaggctgtggtctcccccggtccatgtacattcggaactgtttcaaccccagtgctggggactaattcttttgctgtgagagacgattcctccgggggtggtcgcaatcccctgcagttaccttttaacttcacgtggcctggaactttttcgctgatcattgaggcctggcatgctcctggcgacgatcttcgtcccgaagcgttgccaccagacgcactgatcagtaaaattgcaattcagggcagcctcgctgtcggccagaactggctactggacgagcaaacaagtacactgacacgtttacggtactcatatcgtgtgatctgtagtgataactactatggagacaactgcagccgcctttgtaaaaagaggaacgatcattttggccactacgtgtgtcagcctgacggtaatttgtcttgtctacccggttggactggggagtactgtcaacagccaatctgtcttagcgggtgtcatgagcagaacggctactgcagcaagcccgctgaatgcctgtgtcgcccaggctggcagggtagactgtgcaatgaatgcatcccacataacggctgtaggcatgggacttgttcgactccatggcaatgcacatgtgacgaaggatggggcggacttttctgcgaccaggaccttaattattgcacgcatcacagcccttgtaaaaacggagctacctgtagcaatagcggtcagcggtcctatacatgcacttgcaggcctggatacacgggagtagattgtgagctggaactgtctgagtgcgactcaaacccatgccgcaacggaggctcttgtaaggatcaagaagatgggtatcattgtttgtgccctccaggctattatggcctgcattgtgagcactccacccttagttgtgccgactcaccctgcttcaatggaggctcgtgtcgcgaacgcaaccagggcgctaactacgcctgtgagtgccctcctaatttcactggttcaaattgtgaaaagaaggttgacaggtgcacatctaatccgtgtgcgaatggagggcaatgtcttaacaggggcccatctcggatgtgtcgatgccgccctggattcactggaacatactgtgaactacacgtgtccgattgcgcccgaaacccttgcgctcatggtggaacctgccatgatctggagaatggtctgatgtgcacctgtcccgctggcttcagtggacggcgatgcgaggtcaggacttctattgacgcttgcgccagctccccctgcttcaatagagctacatgttataccgacctgagtaccgatacattcgtgtgtaattgcccatatggtttcgtgggatccagatgtgaattcccagtcggactaccccctagctttccatgggtggccgttagccttggggtcggccttgcggtgctgctggtgcttctgggcatggtggcagttgccgtgcgccagctgcgcttgcgcaggcccgatgacggtagccgtgaggccatgaataacttgagtgactttcagaaggacaatcttattccagctgcccaacttaaaaatacgaaccaaaagaaagagctcgaggtcgactgtggcttagacaagtctaattgcgggaagcagcagaatcacaccttagattacaacctggccccaggcccactgggacgcggtaccatgcccggtaaatttccccactccgataagtcattgggtgaaaaagctccactgagacttcactcggaaaaaccagaatgcagaattagcgctatttgttcccccagagatagcatgtaccaaagcgtttgcctgatcagcgaggaaaggaatgaatgtgtgatagccactgaggtttag

SEQ ID NO: 220556 - DNA, 2223 bp, Artificial Sequence
  Description of Artificial Sequence: Synthetic coding sequence
atggcctctcatctgaggccgccatcgccgctgctggttagagtctataaaagtggtccacgcgttcgcagaaagctggagagctatttccaatctagcaagagttccggaggaggcgaatgtactgtctccactcaggaacacgaggcacccggtacctttagagtggagttctcggaaagggctgccaaggagagagtcctcaaaaagggcgaacatcaaatcctcgtcgatgagaagcctgtgccaatttttctggtgcccactgagaattcaatcaagaagaatacacgccctcaaatttccagcctaacacagagtcaagccgagaccccctcaggggacatgcaccaacatgaggggcacatccccaatgccgtcgattcatgcctccagaagattttccttaccgtcacagcagatctgaactgtaatcttttctctaaggaacagagggcctatattacaaccctgtgtccctctatccggaagatggagggccacgacggtatcgaaaaagtgtgtggagacttccaggatatcgagcgaattcatcagttcttgtcagagcagtttcttgaatccgaacagaaacagcaattcagtcctagcatgacagagcgcaaacctctttcccagcaggagcgagatagttgtatctcacctagcgagcctgagaccaaagctgagcagaagagcaattatttcgaagtaccccttccttattttgagtatttcaaatatatttgccccgataaaattaactcgattgagaaacgatttggggtgaatatcgaaatacaggaatcaagtccaaatatggtctgtcttgactttacatctagtaggtcaggcgacttggaggcagccagagaatccttcgcgagcgaattccagaagaataccgagccccttaagcaggaatgcgtcagcctcgcagattccaagcaggcaaataagttcaagcaggaacttaatcaccaattcaccaagcttctcatcaaggagaaggggggtgagctgactctactgggaacgcaagacgacatcagtgcggcaaaacaaaaaatttcagaagctttcgttaagattcccgtgaaactgtttgccgctaattacatgatgaatgtgattgaagtggactcggcccactataaactgctggagacagaactcctgcaggaaatctccgagattgaaaaaaggtacgatatctgctctaaagtcagtgagaagggccagaagacatgtattctgtttgagagcaaggatcgccaggtggatctgagcgtgcatgcctatgcttcttttatcgacgcttttcagcatgctagttgtcagttgatgcgggaagtgctcctattgaagagcctggggaaagaacgcaaacatctgcaccagaccaaatttgcagacgatttcaggaagaggcaccccaacgttcacttcgtgctcaatcaagaaagtatgaccctcactgggcttcctaaccacctagcgaaagccaagcaatacgtgctgaaggggggaggcatgagcagtttagcagggaagaaactgaaggagggacacgagacacctatggacattgactctgatgacagcaaggcggcatcaccgccactcaaggggagcgtcagctcagaagcttctgagttggacaaaaaagaaaaaggcatctgtgtgatttgtatggacactataagcaacaaaaaggttcttccgaagtgtaaacacgaattctgtgcgccttgtatcaacaaggctatgagctacaagcccatctgtcccacctgccaaactagctacggcattcagaagggaaatcagcccgaggggtccatggtattcactgtcagtcgggactcattgcccggttacgagagttttggcaccatcgttatcacctacagcatgaaggccggaatccaaactgaagagcatccaaatccaggtaagcgatatcccggtatccagaggacagcctacttacccgataataaagagggacggaaagtcctgaagctactctatcgggctttcgatcagaaacttatatttacagtcgggtactctcgcgtcctaggggtgtcggacgtcatcacgtggaacgacattcatcataagacttctagattcggcggacccgagatgtacggttatcctgacccgtcatacctgaagcgggttaaggaagagcttaaggctaagggaattgagtag

SEQ ID NO: 220557 - DNA, 1863 bp, Artificial Sequence
  Description of Artificial Sequence: Synthetic coding sequence
atgtcacgccctgggcacggaggcctgatgcctgtcaacggcctgggatttccccctcagaacgtggctagggtcgtggtgtgggaatggctgaatgagcatagccgatggagaccatataccgccaccgtttgccatcatatcgaaaacgtgctcaaagaagacgctagggggtctgttgtcctgggccaagtcgacgcgcagctagtgccatatattatcgatctccagagcatgcaccagtttcggcaggacactggtaccatgcgccctgttcgtagaaacttctacgacccgagcagtgctccaggcaaaggcattgtctgggaatgggagaatgacgggggtgcgtggaccgcctatgatatggatatctgtatcacaatccagaacgcatatgagaagcagcatccctggctagatctcagctccttggggttctgctaccttatttatttcaatagtatgagccagatgaatagacagaccaggaggaggcgacggttaagaaggcgcttagacctagcttatccccttaccgtcgggagcatccccaagagccaatcttggcccgtgggcgctagctcaggccagccctgttcttgccaacagtgcctcttggtcaattctaccagggccgcttcaaacgcaatcttagccagccaaagaagaaaggcccctccagccccaccccttcctccccctcctccgcctggcggaccaccgggagctctggctgtcaggccctccgccacctttacaggcgcagccctgtgggctgccccagcagcagggccagccgagccagcccctcccccaggcgctccaccaaggtctccaggagcccctggaggggcacgaacaccaggccagaataacttgaatcggccaggtccccagagaacaacttcagtgtccgcgcgagcctctatccctcctggggtgcccgcacttcctgtaaagaacctaaacggaacgggcccagtccaccctgccttggcaggaatgaccgggatcctgctctgcgcagcagggctcccagtctgtctgacaagggccccaaaacctatcctgcaccctccacccgtctctaagagtgatgttaagcctgtccctggtgtaccgggagtttgtagaaagacgaagaaaaaacacctgaaaaaatctaaaaacccagaagacgtggttcgcaggtacatgcagaaggtcaagaatccacccgatgaagactgcacgatttgcatggaaaggctggtgactgcctccggttatgagggtgtgttgcgtcataagggggtgcggccagaattggtgggtcggctcgggagatgcgggcacatgtaccatcttctgtgcctggtagcgatgtattctaacggaaacaaagatgggtctctgcagtgtcctacttgtaaggcaatttatggcgaaaaaacaggcacccagccccctgggaaaatggaattccaccttattcctcacagcctgcccggttttcctgatacccagactatcaggatcgtttacgacattcctacaggcatccaaggacccgaacacccgaaccccggaaaaaaattcaccgccagaggctttcctcgtcactgctacctgccaaataatgagaagggaagaaaagtactccgcttgctgatcacagcctgggagcggagacttatttttaccatcggaaccagtaatactacaggagagtcagatacagtggtgtggaacgaaattcaccacaaaaccgaatttggctctaacctgaccgggcacggataccctgacgcgtcatacctagataatgtacttgccgaactcacggcacagggcgtgtcggaagctgctgccaaagcttag

SEQ ID NO: 220558 - DNA, 1044 bp, Artificial Sequence
  Description of Artificial Sequence: Synthetic coding sequence
atgtccttcgttttgtctagaatggctgcttgcgggggaacctgcaaaaacaaagtgactgtgagcaaaccggtgtgggattttctatcaaaggaaacccccgcaagactggcaaggctgcgcgaagaacaccgggtgagtattctgatcgacggggaaacctctgacatctatgtcctgcagcttagtccacaagggccaccgcctgccccacccaatggactgtatctggccaggaaggctctgaagggcctgttaaaagaggcagaaaaggaactaaagaaagcccaaaggcagggagagcttatgggttgcctggctttgggtgggggaggcgagcaccccgaaatgcatagagcgggacctcctcccctgagggccgctccactgttacctcctggtgctcggggactgccccctccaccacctcccttgcctcctccattgcctccaagactgagagaggaggccgaggagcaggagtccacatgccccatatgtttaggtgaaattcagaatgcaaaaactctggaaaaatgcagacactccttttgcgaggggtgtattactcgggcactccaggtcaagaaggcttgtccaatgtgcggtcgcttctatggccagttggtcggaaaccaaccacagaacgggaggatgctcgtgagtaaggacgccactttgctgttgccctcgtatgaaaagtacggcactatcgtcatccaatacgtattcccacccggagtacaaggggctgagcatcccaatccaggggtccgctatcctggcaccacgcgcgtagcctacctccccgactgtcccgagggtaataaggtcctcacactgtttcgtaaagcctttgaccaaaggttgacattcactattggtacatctatgacaactggacggcctaacgtgatcacgtggaacgacatccaccacaagacatcatgcaccggaggcccacagctcttcggatatcccgatccgacctacctgaccagagtccaggaggagctgcgggcaaaagggattaccgatgattag

SEQ ID NO: 220559 - DNA, 1044 bp, Artificial Sequence
  Description of Artificial Sequence: Synthetic coding sequence
atgtcttttgttttgtcacggatggcagcctgtggaggtacatgcaaaaataaggtgactgtctctaagcccgtttgggacttcctgagcaaggagactcccgctagattggcaagattgagagaggagcaccgcgtaagcattttaattgacggcgaaacctccgacatctacgtcctccaactgtcccctcaaggcccaccgcctgcaccccctaatggtctgtacctagctaggaaggctcttaagggactcctaaaagaggcagagaaggagttgaaaaaggcccagcggcagggtgagctgatgggctgcttggctctgggaggcggtggcgaacatcctgagatgcaccgggcaggcccacccccactgcgagcagctcctctgctcccccctggagccagaggtctcccaccgcctccccctcctttgccgccacccctgccacctagactccgggaggaggcagaagagcaggagtcgacgtgccccatatgtctgggtgaaatacagaacgccaagacactggaaaagtgtcggcacagtttttgcgagggctgcattacacgcgctcttcaggtcaagaaggcatgccccatgtgtggacggttctatggccagctggtcggaaaccagccccagaacggcagaatgctggtgtccaaggacgccactctgttactcccttcttatgaaaagtatggaaccattgtgatccagtacgtatttcctccaggcgttcagggcgcagaacaccctaaccctggggtgcgctaccctggcacaacgcgcgtggcttacctgcccgattgcccggagggcaacaaagtgttaaccctgttccgcaaggccttcgaccagaggctgacctttacaatcgggacctcaatgacaaccggccgacctaacgtgatcacttggaatgatattcatcacaagactagctgtacagggggaccccaacttttcgggtatcctgaccccacgtatctgaccagagtccaggaagagttgcgagccaagggcataacggacgattag

SEQ ID NO: 220560 - DNA, 1044 bp, Artificial Sequence
  Description of Artificial Sequence: Synthetic coding sequence
atgtcattcgtgctctctaggatggcagcatgcggcggaacatgcaaaaataaggtaacagtgagtaagcctgtgtgggatttcctgagtaaagaaactcctgcccgtctggcgcgactccgggaagagcatcgtgtaagtatcctgatcgacggagaaaccagtgacatttatgtcttacagctcagcccccagggccctccaccggcaccgcctaatggcctctatctagcacgcaaggctcttaaaggccttctgaaagaggccgagaaagagttgaagaaggctcaaagacagggagaactcatgggttgcctggctcttgggggtggcggtgaacatcccgagatgcaccgggctgggcctccacctctaagggcagcgcctctgttaccccctggcgcaaggggccttccgccacccccaccaccgttgcccccacctcttcctccaaggcttcgcgaagaagcagaagagcaggaaagcacatgccctatctgcctgggagagatccagaatgctaagactcttgagaaatgtcgtcactctttctgcgaaggctgcatcacccgagcactccaggtgaaaaaagcatgccctatgtgtggcaggttctacgggcaactggtgggaaatcagccccaaaacggaagaatgctggtgagtaaagatgccaccttacttttgccatcgtatgagaagtatggcactatcgtaattcaatatgtatttcccccaggggttcagggagccgagcatcccaacccaggcgtgcggtaccctggaaccactcgcgtggcatacctcccagactgtccagagggtaacaaagttctcaccctgtttcggaaggcctttgatcagcgtttaaccttcacgatcggcaccagtatgaccaccggtcggcctaacgttattacatggaacgacatacatcataagacatcttgtaccggcggtccgcagctgttcggctacccagatccaacgtacctcaccagggtgcaggaggagctgcgcgctaaggggatcacggacgattag

SEQ ID NO: 220561 - DNA, 615 bp, Artificial Sequence
  Description of Artificial Sequence: Synthetic coding sequence
atgcctattttatcttcatccgggtccaagatggccgcatgcggaggcacgtgtaagaataaagtgactgtttccaagcccgtgtgggattttctaagcaaggaaacgccagccagacttgcaagactgcgcgaagagcacagagtgagcattctgattgacggcgagacgtctgatatttacgttctgcagctatctccgcagggccctccccctgcccctccaaatggtctgtatctggctcgcaaagccctgaaagggctgttgaaagaggcagagaaagagctgaagaaggcgcaacgacagggtgaacttatgggttgccttgccctgggcggagggggagagcatcccgagatgcaccgagcaggacccccacctctgagggcagcccctctgctgccaccaggggcacgcggtctgcctcccccaccacctcctctccccccacctttgcctcccagattgcgcgaggaagcagaagagcaggagtccacctgtcccatctgccttggcgaaatccagaacgcgaagaccttggaaaagtgccggcatagtttctgtgaagggtgcattactagggccctacaagtcaagaaagcctgccccatgtag

SEQ ID NO: 220562 - DNA, 24 bp, Artificial Sequence
  Description of Artificial Sequence: Synthetic coding sequence
atgccaatcctgagcagctcctag

SEQ ID NO: 220563 - DNA, 1053 bp, Artificial Sequence
  Description of Artificial Sequence: Synthetic coding sequence
atgccgattctgtcttcatcgggttccaagatggccgcttgcgggggaacatgcaagaataaagttacagtgtcgaaacccgtgtgggactttctgtccaaagagacccccgctcggctggctcgcctgagggaggagcaccgcgtctcaatattaatagatggagagaccagcgatatctacgtgctgcagctgtccccccaggggccacctccagcacctccaaatggcctctacctcgcccgtaaggctctcaagggcttgttgaaggaagcagaaaaggagttgaaaaaagcacaacgacagggcgagctgatgggttgcctggctctgggcggaggtggcgagcacccagagatgcacagggccggtcctcccccactgcgagcggcacctctgctcccaccaggagccagaggattacctccgcctccccctcccttgcccccacccttacccccacgcctccgagaggaagccgaggaacaggagtcaacctgccccatctgtttaggcgagatccagaacgccaaaacactagaaaagtgcaggcactccttctgtgagggctgcattacccgcgcactccaggtgaaaaaggcctgccctatgtgtgggaggttctatgggcagctggtgggaaaccagcctcagaatggcagaatgctggtcagtaaggacgccactctgcttctgcctagttacgaaaaatatggcactatcgtgattcagtacgtattcccaccaggagtccaaggagcagaacatccgaatcctggcgtgcggtatccaggaaccacacgagtggcctatcttccagattgtcccgaggggaacaaagtgctcacattatttaggaaggccttcgaccagaggctgacgtttaccataggcaccagtatgaccactggtcggccaaacgtgattacctggaatgatatccaccacaaaacctcttgcacgggcggaccccagctgttcggttaccccgacccgacttatcttaccagggtgcaggaggaacttagagccaagggaattacggatgactag

SEQ ID NO: 220564 - DNA, 150 bp, Artificial Sequence
  Description of Artificial Sequence: Synthetic coding sequence
atgtcattcgtgctgtcccgtatggccgcatgcggtggaacttgcaagaacaaggtcactgtctcaaaacctgtatgggacttcttaagtaaggaaacccccgcaagattggcacgactgcgtgaagagcacagggtctctattctgtag

SEQ ID NO: 220565 - DNA, 2136 bp, Artificial Sequence
  Description of Artificial Sequence: Synthetic coding sequence
atgctggatggtccactgtttagcgaggggcctgactccccacgcgagctgcaagatgaggagagcggttcatgcctgtgggtccaaaaatccaaattgcttgtgattgaggtgaagactatctcatgtcactatagcagacgggcaccatccaggcagcccatggatttccaggccagtcattgggcacgaggttttcagaataggacctgtggcccaagacccggatccccccagcctccacccagaaggccatgggcgtcgagggttctgcaggaggcgaccaattggcgggctggtcccttagctgaagtacgggctcgtgaacaggaaaagaggaaggccgctagccaggagcgcgaggcaaaggagacagagagaaagcggaggaaggccggtggagccagacggtcaccaccaggtcgacctaggcctgagcccaggaatgcacctcgagtggcacagttggcagggctgcctgctcccctgcgtccagagaggctggcccctgttgggagggcacccaggccctccgcccaacctcagtctgacccaggttccgcatgggccggaccttgggggggtcggaggcctgggccaccgtcctacgaagcccaccttttgctgcgcggatcggcagggacagccccacggcgaaggtgggaccggccacctccctatgtggcccctcccagctacgaggggcctcatagaactctggggacaaaacgcggacctggcaatagccaggttcccacctcctcagcccctgccgcaacaccggctcggaccgacggtgggagaaccaaaaaaagactcgaccctaggatctacagggacgttttgggggcttgggggctgcgccaaggccaggggcttctgggcggttctccgggatgcggggctgcgagagcaagacccgaacctgggaagggagttgtcgagaagagcctgggacttgccgctgcagacctgaatagcggcagcgattcccacccacaggctaaagccactggatcagcgggtaccgaaatcgccccagctggatccgcaactgccgcaccatgtgcaccacaccctgctccgcgttccaggcatcatctcaagggctcaagggagggtaaggaaggtgagcagatttggttccccaaatgctggataccatcccccaagaagcagcctccgaggcatagtcaaacccttccgcgaccatgggcgcctggtggaactggatggcgcgagtctctggggcttggagagggggctggtcctgaaactctggaagggtggaaagcaacaagacgggcacacactcttccacgatcctctcagggtctcagccgcggtgagggggtttttgtgatcgatgccacatgcgtcgttattagatcacagtatgtgccgaccccgaggacccagcaggtgcaattgctgccaagcggggtcacacgggtggtgggagactctccctctcaatcaaaacccggtaaagaggagggagaaggggcaacagtgttcccatccccctgccaaaaacggttatcttcatctaggctattgcatcagcccggagggggacgagggggagaggcagagggtggacggccaggagattctacattggaggaaaggactttccgaatattggggctgccagcacccgaagtcaatttgcgggacgctcctactcagcctggatcgccggagcatcaagcactgggtcccgcagcttccggtgctcaggggagggccgaagggtccgaagtggccgtggtccagcgcagggccggtcgcggatgggcgaggacccccggaccctatgccggagccctgcgcgaggctgtgtcccggattcgcaggcacacggcaccagatagtgacaccgatgaagccgaggaactctcggtgcattccggttcttctgatggctctgacacagaggccccaggcgcatcctggagaaacgagcggactttgcccgaagtcgggaacagttctccagaagaagatggtaagacggccgagctgtcagattccgtgggagagatccttgatgtcatctctcaaaccgaggaggtgctgtttggggtgagagacatcagagggacccagcaaggaaacaggaaacgacagtag

SEQ ID NO: 220566 - DNA, 852 bp, Artificial Sequence
  Description of Artificial Sequence: Synthetic coding sequence
atgggtatttggacgtccggaactgacatttttctgtcactgtgggagatctatgtgtccccaagaagtccgggatggatggatttcattcagcacctcggagtgtgttgtttagtggccctgatctcagtaggcctactgtctgtggctgcctgttggttccttccttcaatcattgccgctgcagcttcttggatcataacttgtgtccttctttgctgttccaagcacgcgagatgttttattctgctggtgttcctgtcatgcggtctaagagagggaagaaacgccctgatcgccgctgggacagggatcgtcattctaggtcatgtcgagaatatctttcacaattttaagggactacttgacggtatgacctgcaacctccgcgctaagagttttagtattcacttccccctgctgaagaagtatatcgaggcaattcagtggatttacggacttgcaacaccattatctgtgtttgacgatctggtgagttggaaccaaacactggccgtctcactgttctctccctcccatgtcttggaggctcagcttaatgatagcaagggtgaagtcttatcagtattgtatcagatggccactacgaccgaggtgctatcttctctcggacaaaagttgctggcctttgcaggactgtccctggtgttgctggggaccgggctgttcatgaagagattcctaggtccatgcggttggaagtatgaaaatatctatatcacccgtcaatttgtgcagttcgatgaacgcgaacgccatcagcagagaccttgtgtgctgccacttaataaggaagaaaggcgcaagttcatctctggtttccaatcatag

SEQ ID NO: 220567 - DNA, 1401 bp, Artificial Sequence
  Description of Artificial Sequence: Synthetic coding sequence
atgctcaaatggcccattcccggacaggtcgccttgtttcagattctccgctgccggggtaattctcgtcggacaacggtaacctctctgactgtgtcccaagtgggacagaacttcaccttcgtgctcaccgacatcgattccaaacagaggttcggtttttgccgcctcagcagtggcgctaagagctgcttttgtatactttcttacctgccatggttcgaggtgttttacaagctgctgaatatcctcgcagactacacaactaagaggcaggagaaccagtggaatgagttattggaaacactgcacaaactgccaatccccgacccgggtgtgagtgtacacctgtcagtgcactcctacttcactgtgccagataccagggagcttcccagtattcctgaaaacagaaatttaactgagtattttgtcgccgtggatgtgaataatatgctgcacctatacgctagcatgctatacgagaggaggattctgattatttgctctaaactgtcaacactgactgcctgtattcatggctcagctgccatgttgtacccgatgtattggcagcacgtgtatatccccgtcctgccaccgcatctgttagattactgttgcgcaccgatgccctacctgattggaatacacctgtccctgatggagaaggtacgaaatatggcgctcgatgatgtggtcatcctgaacgttgacacgaacacactggagactccgttcgatgacttgcagagcctcccaaacgacgtcatctcttctttaaagaacagactgaagaaagtctccacaactacgggcgatggggtcgctagagcattccttaaggcacaggccgcatttttcggctcctacagaaatgcacttaaaatcgagccagaagagcccatcactttttgtgaggaggcctttgtgagccattatcgttcaggtgcaatgcgccagttcctccaaaatgcaacacagctccaattgtttaagcaatttatcgacggaaggctcgacctgctgaactcaggcgaggggttctctgacgttttcgaagaggaaatcaatatgggtgaatacgccggatctgacaaactttatcatcagtggctcagtaccgtacgcaagggcagcggcgcaatcctcaatacagtcaagactaaggctaatcctgctatgaaaaccgtgtacaaattcgctaaggaccatgctaagatgggtatcaaggaagtgaagaaccgccttaagcaaaaagatatcgcggagaatggatgcgcacccactcctgaggaacagctcccaaagactgctcccagcccgctcgtggaagcaaaggatcctaagttgagagaagaccgccgacctatcacagtgcattttggacaggccctgtag

SEQ ID NO: 220568 - DNA, 1680 bp, Artificial Sequence
  Description of Artificial Sequence: Synthetic coding sequence
atgggaagccgcattaagcaaaatcctgagacaacttttgaggtttatgtcgaagtcgcatacccccgtaccggcggaacactatcagaccccgaggtccagcgccagtttccagaggattattctgatcaggaagtgctccagacgttgaccaaattttgttttcccttctatgtcgattcacttactgtcagtcaggtcggtcaaaactttaccttcgttctcacggacatcgacagcaagcagcgttttgggttctgtcgactatcatctggcgctaaaagctgcttttgtatattgtcctatttgccgtggttcgaggtattttacaaacttctgaacatcctggcagattacactaccaagaggcaagagaaccagtggaacgaactgctggagaccctccataaattacccatccctgatcccggagtgtccgtgcacttgtccgtccatagttactttaccgttcctgacactcgcgagcttccctcaattcccgagaatcgaaacctgaccgaatatttcgtagcggtagacgtcaacaatatgttacacctttatgctagtatgctgtacgaacgaagaatcctcatcatttgctcgaaactctcaactttgactgcctgcatccacggttcagcagcaatgttgtatcctatgtactggcagcacgtgtacattccggtgctaccaccacatctgctggattactgctgtgcgcctatgccgtacctgatcggcatccacttgagccttatggaaaaagtaagaaacatggcgctggatgacgttgttattctcaatgtcgatactaacacgctggaaacccctttcgatgatctgcagtccctgccgaacgacgttatatcatctttgaagaatcgactgaaaaaggttagtacaacaactggcgacggggtggcccgtgcatttttgaaggcacaggctgccttctttggcagctatcggaacgcactgaagattgagcctgaggagcctattactttttgtgaggaagcatttgtatcccactacaggagtggggcaatgagacaatttctgcagaacgccacacaactccaactcttcaagcagtttatcgatggacgcctggacctcctgaacagcggagagggctttagtgatgtgtttgaagaggagatcaacatgggggaatacgcgggttctgacaaactttaccatcagtggctctccaccgtgcgtaagggtagcggggctattcttaatacagtcaagactaaggctaatcccgcaatgaagactgtttataagtttgctaaagatcatgctaagatgggtatcaaggaagtcaagaacagactgaagcagaaggacatcgcagaaaatggctgtgcccctacgcccgaagagcagttgcccaagaccgcgccttccccccttgtcgaagcaaaagaccccaaactgcgagaggacagaagacctatcacagttcactttggccaagttcgccctccacgcccacatgtcgtgaagaggcctaaatcaaacatagctgtcgaaggaaggcggaccagcgtacccagcccagagcaaaacaccatcgcaacacccgctacacttcacatcctgcaaaaaagcataacgcacttcgccgctaaatttcctacaagaggatggactagcagttcccattag

SEQ ID NO: 220569 - DNA, 3030 bp, Artificial Sequence
  Description of Artificial Sequence: Synthetic coding sequence
atgggaagtcgtataaaacagaaccctgaaacaacttttgaagtttacgtcgaggtggcctaccctcgcacgggtgggacgttatcggatcctgaggtccaacgacagtttcctgaagactacagtgaccaagaggtgttgcagaccctaactaagttttgctttcctttctatgtcgattcccttaccgtcagccaggttggacagaacttcacgtttgtgctgacagatatcgacagcaagcagaggttcgggttttgtcgattgtcatctggagcaaaatcgtgcttttgtatcttatcttacctcccttggttcgaggttttctataaactcctgaatatcttagccgactacactactaagcggcaagaaaaccaatggaatgaactcctggagaccctccacaagctaccaatcccggaccccggagtgagcgtgcacctgagcgtccactcatattttactgtccctgataccagggagttaccttctatccccgagaatagaaacctgaccgagtatttcgttgctgtcgacgtgaataacatgctgcacctctacgcctcaatgctctatgaacggaggattttgattatctgcagcaagctgagcacgctgaccgcttgtattcacgggagtgccgctatgctttatcccatgtactggcagcatgtgtacatacccgtccttccaccacatctccttgactactgctgcgcccctatgccatacctgattggtattcacctcagcctgatggaaaaggtgaggaatatggccttggatgacgtggttattctgaatgtggacactaatacccttgaaaccccctttgacgatctccaaagcctgccgaatgatgtgataagctctttgaaaaacagattgaagaaggtctcgactacgactggagacggagtggcgagggcttttctgaaggcccaggccgctttcttcggctcttataggaacgccctcaagattgagcccgaagagcctattaccttctgcgaagaggcttttgtatcccactataggagcggagccatgaggcaatttctgcagaacgctacccaactccagctctttaagcagttcatcgacggacggttggacctattgaattcaggtgaaggattttcagatgtgtttgaggaagagatcaacatgggggagtatgcgggatccgacaagctttaccatcaatggttgtctaccgttaggaagggatcgggagcaattctcaacacagtgaaaactaaagccaacccagcgatgaagaccgtatataagtttgccaaagaccacgcaaaaatgggcattaaagaagtgaagaacaggctcaaacagaaggacattgcagagaatgggtgcgctcccacacctgaagaacagctgcccaaaaccgctccctcgccgctggtggaggccaaagatccgaaactgcgagaggacagacgccctatcactgtccactttggccaggtgcgtcccccacggccacacgtggtgaaacggcctaaaagtaatatagcagtggaagggcgacgcacatcagtcccttccccagagcagccccagccgtataggactttgcgggagtcagacagtgctgagggtgacgaagcggagtcacccgaacaacaggtgagaaaaagtaccgggcctgtcccagctccacctgatagagcggcttctatcgaccttctcgaggacgttttctcgaatctggacatggaagctgcgctgcagccactggggcaggccaagagtctagaggacctgcgtgcccctaaggacctgcgagaacaacctgggaccttcgattatcagcgattggatctcggaggatccgaacgctccagaggagttacagttgcactcaagctcacccacccttataataaactgtggtctctgggacaggacgatatggcaattccatccaagccacccgctgcgtcacctgagaaaccttccgcactcctaggaaattccctcgctctaccgcgacggccacaaaacagagattcaatccttaatccgtctgataaagaagaggtaccgacgccaacgctgggctcaatcaccatcccgcgaccacagggacgaaagactcccgagctggggattgtgccccctcccccaattccccgtcctgccaaactgcaggcagcaggcgctgcacttggcgatgtctcagaaagattacagaccgatagagaccgcagggccgcactgagtcccggactgctgccaggcgtggtcccccaggggccaacggaactactgcagccactgtccccaggccctggagcagccggaacctcatctgacgccctgttggcactgctggatcctttaagcactgcgtggtctgggtcgacactgccttctagaccagccacccctaatgttgcaacaccattcactcctcaattctcattccctccggctggaacgcccactcctttcccacagcccccactcaatccttttgttccttcaatgccagcagctcctcccacactgcctcttgtgtccactcccgcagggccattcggtgcacctcccgcaagcctcggtcctgcattcgcctccgggcttctgttatcctccgccggattttgcgcacctcatcggtcccaacctaatctgtcggctttgtcaatgcctaacctgtttggacagatgccaatgggcactcacacatcccctttgcagcccctgggacctccggctgtggctccatccaggatacgaaccctgccactggcgaggtcatccgcgagggccgcagagaccaaacagggtctggcactgaggcctggtgatcccccactgctacctcccaggccacctcagggtctggaaccgactctgcagcccagtgccccacagcaggccagggatcctttcgaagacttacttcagaaaacgaagcaggatgtatcaccatctccagcactcgccccagctccggacagtgtggagcagctgcggaaacagtgggagaccttcgaatag

SEQ ID NO: 220570 - DNA, 1590 bp, Artificial Sequence
  Description of Artificial Sequence: Synthetic coding sequence
atgctaaaatggcctattccaggccaggtcgccctatttcaagaagtactgcaaaccctaacgaagttttgtttccctttttatgtggatagccttacggtttcccaagtgggccagaactttacattcgtcctcaccgacatcgacagtaaacagcgcttcgggttttgccgcctatcctctggagcgaaaagttgcttttgcatcctctcatacctgccatggttcgaggttttctacaagcttttgaacatccttgccgactacactactaaacggcaggagaaccagtggaatgagttgctcgagaccttacacaagctacccatccccgatccgggtgtgtccgtgcacctatctgtacattcttacttcacagtgccagacacgagagagcttcctagcattcccgaaaaccgcaacctcactgaatattttgtcgctgtggatgtcaataatatgctgcacctctacgcatctatgttgtatgaacgaagaatactcatcatctgcagtaagctgagtacgctgactgcctgtattcatggaagcgccgcaatgttatatccaatgtactggcaacatgtttacatcccagttttgcccccacacctgcttgactactgctgtgccccaatgccctacctcattggcatacacttgtctctgatggagaaagtgcggaacatggcccttgacgacgtggtgatactcaatgtcgacacaaataccctcgagacgcctttcgacgacctacaatctctgcctaatgatgttatttctagccttaagaataggctgaaaaaggtgtccactacaaccggtgatggagtggctagggccttcctgaaagcacaggctgctttctttggttcataccgcaatgctcttaaaattgagcctgaagaacctattacgttctgtgaagaagcattcgtgtcccactacaggtctggcgctatgagacagtttctgcagaatgccacccagctgcagctgttcaagcaatttattgacggtaggttagaccttctgaactctggcgaaggattttctgatgtgttcgaagaggaaattaacatgggtgaatacgccggatcagacaagctgtatcatcagtggttgtctacagtgcgcaaaggcagcggggctatccttaataccgttaaaaccaaagccaacccagctatgaaaacggtatacaaattcgcgaaagaccacgccaaaatgggtattaaagaagtaaaaaaccgcttgaagcagaaagatattgccgaaaatgggtgtgcgcctacgccggaggaacaattgcccaagaccgctccttcaccactcgtcgaggccaaggatccaaagctcagagaagataggagacctatcacggtgcacttcggacaggtcagaccccctcggccacatgtggtcaagaggccgaagtcgaatatcgccgtagaaggcaggcgcacttctgtcccgtcgccagagcagaataccatcgccaccccagcaacacttcatatactgcagaagtccatcactcattttgcggcaaaattccccacacgaggatggacgagcagttcacattag

SEQ ID NO: 220571 - DNA, 3063 bp, Artificial Sequence
  Description of Artificial Sequence: Synthetic coding sequence
atgcgtagaccaggcgaccatggcctgcaggaccaagaagtgctccaaactctcaccaagttttgttttcccttctatgtggacagcctcaccgtgagccaggttggccagaatttcacttttgtactgacagacatagattcaaaacagaggttcggattctgcaggctgagttcaggagctaaaagttgcttctgtatcctgagttatctaccatggttcgaggtgttttataagttattgaatattcttgctgattataccaccaagaggcaggaaaaccagtggaacgagcttttagagacgctgcacaagctgcctatccccgaccctggggtttctgtccacttaagcgtacattcctattttactgtaccagataccagagaactccccagcatcccagaaaaccggaaccttactgagtactttgttgccgtggacgtgaacaatatgctgcacctgtacgcctccatgctgtatgagagacgtatcctgatcatctgtagtaagttgtcaacattgaccgcgtgtatccacggctctgctgccatgctgtacccaatgtattggcagcatgtttacataccggttctcccgccacacctgctggactattgctgcgcccctatgccctacttgatcggaatccatcttagtctgatggaaaaagtgcgtaacatggctctggacgatgtcgtgatcctgaacgtggacacaaatacactggaaaccccttttgatgaccttcagtcactgccgaatgatgtaatcagcagtctgaagaatcgccttaaaaaagtgagcaccaccacaggtgatggagtggctagagcattcctcaaggctcaggccgctttctttggcagttaccgcaacgcattaaaaatagagccagaggaacccatcacattctgtgaagaagcctttgtgtctcactaccggtccggcgcaatgagacagttcctgcagaacgctacccagctgcagttgttcaagcagttcatcgatgggaggctagaccttttgaattcaggggagggattttctgatgtctttgaggaggagatcaacatgggggagtacgccggatccgacaagctctatcaccagtggctgagcactgtacgtaaggggtctggagcaattttaaatacggtcaagactaaagctaacccagccatgaaaaccgtgtataagttcgctaaagatcatgccaaaatgggtatcaaagaggtgaaaaacaggctgaagcagaaagatatagcagaaaatggatgcgctcccactcctgaagagcagttgcctaagacggcaccttcaccactggttgaggcaaaggatcccaaacttcgggaagacaggcgtcccatcacagtccatttcggtcaggtcagaccgcctagacctcacgttgtgaaacgccctaagtctaatatcgccgtagagggtaggagaacctcagtgccctcacccgaacatctggtgaaaccactcaggcattacgcagtgttcttgagcgaggactctagcgacgacgaatgccagagagaagagggtcccagtagcggttttaccgaaagctttttcttctccgctccgttcgaatggcctcagccctacaggacactgcgtgaatcagacagcgccgaaggcgatgaggcggagtctccagagcagcaggtcagaaagtctaccggcccagtaccggcacctccagatagagcagcttctatcgatctgctggaggatgtgttctcaaacctggacatggaagctgctctgcagccgctcggacaggccaaaagcttagaggatctgcgcgctccaaaagatttgagggagcagcccggaactttcgactatcaacggctggatctggggggtagtgagaggtctcgcggagtgacagtggctttgaagctaacacacccttataataagctatggtcccttggccaggacgatatggcaataccatctaagccacccgcagcgagccctgaaaaacctagcgcccttctagggaacagtctggcgttacctaggcgcccacaaaaccgggactccatcctgaaccccagcgacaaggaggaggttccgacccctaccctcggatctatcacaattcctcgtcctcagggaagaaagaccccggagcttggcatcgtgcccccacccccaatccccaggccagccaagctgcaggcagctggggctgcccttggcgacgtgtccgagcgcttgcagactgaccgggatcggagagctgccttgtctcctggcctgcttcccggtgtcgtgccccagggccctacggagttgcttcaacccttgagtcccggtccaggtgcggcaggcacatcctctgacgcactgctggctctgcttgaccctctgagcactgcgtggagtgggagcacactaccgagtcgaccggctactcccaacgtagcaacgccattcacacctcagttctctttccccccagccggtactcccaccccattcccgcagcccccactcaacccctttgtgcctagcatgcccgcagctccacctacactgccacttgtcagtacccccgctggtccttttggggcacccccagcaagcctcggcccagcatttgcatcaggcctgttactctctagcgcaggcttctgcgcccctcaccgatcccagccaaacctgtcagctctgtctatgccaaatctgtttgggcagatgccgatgggaacacacacatcccctctacagcccctcgggccacctgctgtggctccttcccgaattagaaccctccccctcgccagatcttcagctagagctgccgagacaaaacaggggctggcgctgcgtccaggcgacccaccactgctcccgccaagaccccctcaaggtctcgagccgacactgcagccatcagcccctcagcaggccagggatccatttgaagatctactccaaaaaactaaacaggacgtgtctcccagccctgcgctggctcccgctcctgactctgtggagcagctgagaaagcaatgggagacttttgagtag

SEQ ID NO: 220572 - DNA, 2385 bp, Artificial Sequence
  Description of Artificial Sequence: Synthetic coding sequence
atgctttatcctatgtattggcagcacgtctatattccagtcttgcctccccatttgctggactactgctgtgccccaatgccatatctgattggaatccatctttccttgatggagaaggtgcgcaatatggctctggatgacgttgttatccttaacgttgacaccaacacccttgaaaccccgtttgatgatttgcaaagtttacccaacgatgtggaagaacccattacattctgcgaggaagcctttgtgtcgcactaccggtcaggtgcaatgcggcagtttttacagaacgcaacacagctgcaactctttaagcaatttattgatggccgactggacctacttaattctggcgaaggcttcagcgacgtgttcgaggaagagattaacatgggagagtatgctggctccgataagctataccatcagtggctgtcaaccgtgcgaaagggatcaggcgcaatactgaataccgtgaaaaccaaagcgaatccggcaatgaagactgtatataaattcgcaaaagaccacgcaaaaatgggaattaaggaggtcaaaaacagattaaaacagaaagacatagctgagaacggctgcgcccctacgcccgaggagcagctgccaaagactgcaccatcccccctcgtggaagccaaagaccctaaactgagagaagacaggcgccctattactgtgcactttggccaagtgagaccaccgaggccacatgtggtgaaacgtccaaagagcaacatcgcagtcgagggaaggagaacctccgtgccttccccagagcatctggtgaagccactgaggcactatgctgttttcctatccgaggattcttctgacgacgagtgtcagagggaagaggggcctagcagtggattcaccgagagtttttttttctctgccccatttgagtggccccaaccctacagaacacttagagagtctgattctgctgagggcgatgaagcagaatcccctgaacagcaggtcaggaaatctaccggccctgtgccagcaccacccgatcgtgctgcttcaattgaccttctggaagacgttttttctaatcttgacatggaggcggctctgcagcccttgggacaagcaaaaagccttgaggacctacgcgcacctaaagacctgcgcgagcaaccaggaaccttcgactaccaacggctagaccttggaggttcggagcgttccaggggagtcactgtcgcactcaaactaacacacccctacaacaagttgtggtcccttggacaggatgatatggcaattcctagcaagccgccagctgcgtctcctgagaaaccttccgcattgttgggaaactcattagcactgccaaggaggcctcaaaaccgggacagtatcttgaacccctcagacaaagaggaagttccaacaccaacactgggatctataacgattcctaggcctcagggtaggaagactcccgaactgggtatagtcccccctccccctatccccagacctgccaagctgcaggctgctggggctgccctcggtgatgtctctgagcgactgcaaactgacagggatagacgggctgcactttccccagggctactgccaggagtggtaccacagggcccaacggaactgctgcagccgcttagccctgggccaggagcggctggcacatcctcagatgctctcctcgctcttttagacccattgagtaccgcttggagtggctctaccttacccagcagaccagcgacaccaaacgtcgccacaccattcacgccacagttctcattccctccagccggaacaccaacgccctttccccagccccctttgaatcccttcgtgccttcaatgcccgcagcaccgcctaccctgccattagtctcaacacccgctggtccgtttggggcacctccggctagcctggggcctgccttcgcctcaggcctgctgttgagcagtgccggtttctgcgctcctcataggtcccagcctaatttgtctgctctgagtatgccaaatctgtttgggcagatgcctatggggactcacacatcaccacttcagcccctcggtcctcctgccgtggccccttcgcgtatacggacgctgcctctcgcgaggagttctgccagggctgctgagacaaaacaggggttggcactgcgaccaggagatcccccactcctgcccccacgccctccccaaggccttgagccaaccttgcagcccagtgccccacagcaggcacgggatccatttgaggacttactgcagaaaactaaacaggatgtgagtcccagcccagcccttgcacctgccccagatagcgtggaacagttgcggaagcagtgggaaaccttcgagtag

SEQ ID NO: 220573 - DNA, 1191 bp, Artificial Sequence
  Description of Artificial Sequence: Synthetic coding sequence
atggccgcagccccaagggaggagaagcgctggccccagcccgtctttagcaaccctgtggtgctttggaaattccctgaagactttggggaccaggaaatcctccagtccgtccccaagttctgtttcccatttgacgtggagagagtgtcccagaatcaagtgggacagcatttcactttcgtgcttacagacattgaaagtaaacagaggttcggtttctgcaggcttacatcgggaggcactatctgcctctgtattctctcctacctcccctggtttgaggtctactacaagcttctgaacactctcgccgattacctggctaaggaactcgaaaacgacttaaacgagacactgagaagcctgtacaaccacccagtgcccaaggccaacacccctgtaaatctgagtgtgcactcctatttcattgcacccgacgtgaccggcttgcctacaatccccgaatcccgcaatctaaccgagtactttgtggcggtggacgtcaacaatatgttgcaactatacgcctccatgttgcacgaacgacgcatagtgatcatctcatccaaactgagcactctgacagcttgcatacatggaagcgccgctcttctgtatcccatgtactggcagcacatatacatcccggtcctgcctcctcatctgctcgattattgttgcgctccaatgccctatctgatcggcatccacagtagtctgatagagagagtgaaaaacaagtccttggaagatgttgtgatgctcaatgtagacaccaacacgctggagagcccatttagcgacctgaacaatctgccaagcgacgttgtttctgcattgaagaacaagctcaaaaaacagtccacagcaactggagacggcgttgcaagggctttcctgcgcgctcaggccgctctgttcggttcttatcgcgatgcattacgatacaaacctggcgagccaattaccttttgtgaggagtccttcgtaaagcatcggagcagcgtgatgaaacaattccttgagacagccattaacctccaactgtttaagcagtttatagacggacgtctggcaaagctgaacgcgggacgcggattttctgatgtgttcgaagaagaaatcacatctgggggtttctgtgggggaaaggacaaactccaatatgactatccttttagccagtag

SEQ ID NO: 220574 - DNA, 1281 bp, Artificial Sequence
  Description of Artificial Sequence: Synthetic coding sequence
atggattgtagaacaaaggccaaccctgatagaacattcgacctggtcctcaaggtgaaatgtcacgcgtcagaaaacgaagatccagtggttctgtggaagttccctgaggatttcggggatcaggagattctgcagtctgtgcccaaattctgctttccctttgacgtcgagagagtgtcccagaaccaggtggggcagcattttacgttcgtactgactgatatcgaatctaagcaacggttcggtttctgccgccttacatcaggcggtacaatatgtctctgtattctctcttatttgccatggttcgaggtatactacaagttgctgaacactctggcagactacttggctaaggaactcgaaaatgacctgaacgaaacattgcgatccctttataaccaccctgtcccaaaagctaacactccggtaaatttatctgttaatcaggagatattcatcgcctgtgaacaggtgctgaaggatcagcctgccctggtcccccattcctattttatcgcccctgatgtgactggccttcccactatccccgagagccggaacctgacagaatacttcgtggcagtagacgtgaacaacatgttgcagctatatgcctctatgcttcacgaacgcaggatcgtgatcatctcatctaagctttctactcttacagcatgtatccacgggtcagccgcactcctctaccctatgtactggcaacatatatacataccggtgctgccaccgcacttgctggattattgctgtgcgcctatgccttatctgattggaattcatagctccttaatagaaagagtgaagaacaaatccctggaggatgtggttatgctgaacgtcgacactaatacactagaaagccctttctcagatctgaataacctaccatccgacgtggtaagcgcgctcaaaaataagctcaaaaaacagtcaaccgccaccggagatggggtggctcgagcttttttgcgggcacaggccgcactgttcgggagctaccgggatgctctgcgctacaaacccggagaaccaataacattctgcgaggagtcattcgtgaaacatcggagcagcgtaatgaagcagttccttgagaccgccattaatcttcagctgtttaaacaatttattgacgggagactcgccaagcttaacgcaggacggggtttctcagatgtgtttgaggaggagatcactagcgggggattttgtgggggaaaggataagctccagtacgactacccatttagccagtag

SEQ ID NO: 220575 - DNA, 1191 bp, Artificial Sequence
  Description of Artificial Sequence: Synthetic coding sequence
atggctgccgctccacgagaagaaaagcgctggccccagccagtgttctccaacccagtggttttgtggaaatttcctgaggactttggagaccaggagattctgcagtctgtgcccaaattctgcttcccctttgatgtggagagagtgtctcagaatcaggttggacagcatttcaccttcgtactaacagatatagaatctaagcagagatttggcttctgtagacttacttctggcggaactatttgtctatgcatcttatcttacctaccttggttcgaggtgtactacaagttgttgaacacattggctgattatttggcaaaggaactggagaacgatctgaacgagacactgcgtagcctctataatcacccagtccccaaggcgaacactcccgtgaacttaagcgttcatagctacttcattgccccagatgtaacaggactcccgaccatccctgagagtcggaacctcacggagtactttgtggcagtcgacgtgaacaatatgctgcagctgtatgccagcatgcttcacgaaagaaggatcgttataatttcgtccaagctttctacgctaactgcctgcatccacggaagcgcggctcttctataccctatgtactggcaacacatctatatcccggtcttaccccctcacttgcttgactactgttgcgcgcctatgccatatttgatcggaatacactcctccctgattgagcgagttaaaaacaagagcctggaagatgtggtgatgctgaacgtggacacaaatacactggaatcccctttcagcgaccttaacaatctgccatccgatgtggtgtcagcgctgaagaacaagctcaagaaacagagcactgccactggcgatggtgtcgcaagggccttcctgagagcgcaggccgctttattcggcagctacagagacgctcttaggtacaaacctggcgaacccatcactttctgtgaagagagttttgtgaagcaccggtcatccgtcatgaaacagtttttggagacagctattaacctgcagctgttcaaacagtttattgacggcaggttagccaaacttaacgcaggcagagggttctctgatgtatttgaagaggaaattacctcagggggattttgtggaggaaaagacaagctacagtatgactatcctttctcccagtag

SEQ ID NO: 220576 - DNA, 2268 bp, Artificial Sequence
  Description of Artificial Sequence: Synthetic coding sequence
atcgaaaccaagacacgcgcaaacccagatcgaaccttcgacctcgtactgaaagtgaagtgccacgcttccgaaaacgaggatcccgttgtgctgtggaagtttcctgaggacttcggggatcaagagatcctgcagtctgttcctaaattctgttttccatttgatgttgagcgtgtgtcccaaaaccaggtcggacagcattttacttttgtgcttaccgatattgagtccaaacagcgattcggcttctgtcgactgacctctgggggtacaatatgcctctgcattctgtcctatttgccctggttcgaggtctactacaaactgcttaatacgctggcggattatttggcaaaggaactcgaaaacgatcttaatgagactctgaggagtttgtacaatcaccctgttccaaaggccaatacccccgtcaacctatctgtgcacagctacttcatcgcacccgatgtgactggcctccccacgattcccgaatcacgtaacttgactgagtactttgtcgccgtcgacgtgaacaacatgctccaattgtacgcgagcatgctgcatgagcggagaatcgtgatcataagtagcaagctgtcaaccctgaccgcctgtattcatggcagtgccgctctcctctatccaatgtactggcagcacatctacataccggtcctaccgcctcacttgctggactactgctgcgcccctatgccctatttgataggaatacacagcagcctgatagagagggtcaaaaacaaaagccttgaagacgtggttatgctcaacgtagatactaacacccttgaatcaccctttagtgacctgaacaatctgcccagtgatgtagtgagcgccctcaaaaacaaattgaaaaagcagagcacagccaccggcgatggggtagcacgcgcttttctccgcgctcaggccgctctgttcggctcttaccgagacgctctccgctacaagccgggagagcccatcacattctgtgaggaatcctttgttaagcacaggagtagcgttatgaaacaattcctggagactgcaattaacctccagctgttcaaacagttcatcgacggtaggctggccaagctcaacgcaggacggggatttagtgacgtctttgaagaggagataacctcgggaggattctgtggtggcaaccctcggtcctatcagcagtgggttcacaccgtgaaaaaaggcggagctctgttcaataccgctatgactaaggctactcccgctgtaaggacagcctataagttcgcaaagaaccacgccaaactcgggttgaaagaagtcaagagtaaactgaaacacaaggagaacgaagaggattacggaacttgttcttctagcgtccagtatactcctgtgtataaactgcacaacgagaaaggagggaactccgaaaagaggaaactggctcaagccaggttgaagcgtcccttgaagagtcttgacggcgcactctatgacgatgaggatgatgacgacattgagcgtgcatcgaaactcagtagtgaggatggtgaggaagcctctgcctatctgtacgagtctgacgatagtgtcgaaaccagggtgaaaaccccgtattctggcgagatggatttgttaggggaaatcctggatacattatccacacactcctctgatcagggcaagctggcagccgctaagtccctcgatttcttccgtagcatggatgatatcgattacaaaccaaccaataaatccaacgcgccatcagagaacaatctggcgtttctgtgcggaggaagcggcgatcaggcagagtggaacctgggtcaagatgacagcgcactacacggaaagcacctcccaccatccccgagaaaacgcgtgtcttcttctggacttaccgattcactattcattctgaaagaggaaaatagtaacaagcatcttggcgcagacaacgttagtgacccgacaagtggcctagatttccagctcacatcaccagaggtctcacagacagataaggggaaaaccgaaaagcgggaaactctgagtcagatctccgacgacctactgataccaggactaggaagacacagtagtacattcgtaccatgggaaaaagaaggcaaagaggctaaggagactagcgaggatattgggctgctgcacgaggtagtgtccctgtgccacatgacttctgatttccagcagagcctgaacatcagcgacaaaaacacaaacggcaaccagacttag

SEQ ID NO: 220577 - DNA, 2328 bp, Artificial Sequence
  Description of Artificial Sequence: Synthetic coding sequence
atcgagacaaagactagggcaaatcccgacagaacatttgacttggtactgaaggtcaagtgtcacgcctcagagaatgaggaccccgttgtcctttggaagtttccagaagacttcggagatcaagagattttacagtctgtgccgaagttctgctttccatttgacgtggagcgggtatctcagaatcaggtaggccaacacttcaccttcgtactcaccgacatcgagagcaaacaacgctttggattttgtagactgacgtctggcggtacgatttgcctgtgcatactgtcatacttgccctggttcgaggtgtattacaagctgctgaataccctggccgactacctcgccaaagaactcgagaatgacctgaacgagacactccgttcgctttacaaccaccccgtccctaaggccaacacgcctgtgaatttatcagtaaatcaggagatctttatagcttgcgagcaggtactgaaggatcagccagccctggtgccacattcttactttatagctccagacgtgaccggcctgccaactatccccgagagcaggaatctgaccgagtactttgtggccgtcgacgtcaacaacatgctccagctttacgcgagcatgctgcacgagagaaggatcgtgatcatttcttccaaactttctaccctgactgcttgtatccacggcagtgccgcactcctgtaccccatgtactggcagcacatctatatcccggttctgccgccacatttgctagactactgctgcgcacctatgccttacttgatcggaatacactcttccctgattgaaagagtcaaaaataaaagtttggaggacgtggtgatgcttaatgtggatactaataccctggaatcaccattctccgatcttaacaatctgccttccgacgtggtgagcgctctgaagaacaaactgaagaaacagtctaccgctaccggcgacggcgttgccagggcctttctgagagcacaggccgctctctttggcagctatcgagatgcattgcggtacaagcccggtgagcctatcaccttttgcgaggagtctttcgtgaagcatcgatcctcagtgatgaagcagtttttggagaccgcaattaacctccaactcttcaaacagttcatcgacggcagattggctaaactgaatgccggaaggggcttcagcgatgtctttgaggaagaaatcacgtcaggagggttttgcggaggtaacccccgttcataccagcagtgggtccataccgtaaagaaaggtggcgctttgtttaacaccgcaatgaccaaggccacaccagcggtacggaccgcctacaagttcgcgaagaaccatgctaaactggggctgaaggaggtgaaatcaaagctgaaacacaaggaaaatgaagaggattacggcacttgttctagttctgttcaatacacccctgtgtataagctacacaatgagaagggcggaaacagcgagaagagaaagctcgcacaggccagactgaaacgacctctcaaatctctggatggggctctatacgatgatgaggatgatgatgatattgaacgagcttctaagttgtcatcggaggacggggaggaggcctcggcatatctgtatgagagcgatgacagtgttgaaacgagagtgaaaaccccttactctggcgagatggatttgctcggtgagattttggatacactgtccacccactcctctgaccagggtaaactggcggctgcaaaatcactcgatttctttaggtcgatggatgatatcgactacaaacccacaaataaatctaatgcgcctagcgaaaacaaccttgcattcttatgcggagggtcaggggatcaagctgaatggaatctgggtcaagatgatagcgctttgcatgggaagcatctccctccctctccgaggaaacgggtctcttcatctggactcacagactcgttgttcatcttgaaagaagaaaactctaataagcatctgggcgcagataatgttagtgaccccacgtcaggcctggacttccagctcaccagtcccgaagtaagtcagacagataagggaaaaactgaaaagcgcgagactctgtctcagatctccgatgatctgttgatcccagggctcggacgtcatagtagcacgtttgtgccctgggaaaaggaaggaaaagaagccaaagagactagcgaggatattggccttctgcacgaagttgtcagcctgtgccatatgacctcggattttcagcaatctctcaacatctctgataaaaacaccaacgggaatcagacatag

SEQ ID NO: 220578 - DNA, 1248 bp, Artificial Sequence
  Description of Artificial Sequence: Synthetic coding sequence
gtgaagcacaggagctcagtaatgaagcagttcctggaaaccgcgattaatttgcagttgttcaaacaattcatcgatggacgactggctaagctcaacgctgggagagggttcagcgatgtgtttgaagaggagattacatccgggggtttttgcggcggaaaccccagatcgtaccagcagtgggtacacaccgtgaagaaggggggagcactgttcaacaccgctatgaccaaggctacaccagctgtgaggactgcctacaaatttgctaagaatcatgcaaagctaggacttaaagaggttaagagcaaattgaaacacaaagaaaacgaggaagactacgggacatgttcttcttccgtgcagtacactcctgtttacaagctgcataatgagaagggcggaaacagcgaaaaacgaaaactagctcaagctcggcttaaacgtcccctgaaaagcctggatggagccctttacgacgatgaggacgacgatgatattgaaagagccagtaagctgtcttccgaggatggagaagaggcctctgcttatctgtacgagtctgatgactctgtcgagacccgggtcaaaacaccatactccggtgaaatggacctgctgggtgagattctggatacccttagtacgcactcatctgaccagggcaaattggctgccgcaaaatccttggatttcttccggagcatggacgatattgactacaagcccaccaataaaagtaatgcccctagcgagaacaatcttgcttttctctgtgggggatccggtgaccaagcggagtggaatctcggacaggacgacagcgcactgcatggcaagcatctccccccatccccgaggaaaagagtgtcatccagcggactgactgattctctgttcatattaaaagaagagaattccaacaagcatctgggcgctgacaatgtctccgaccctacctctggactggactttcaacttacctccccagaggtgagccagactgacaagggcaaaaccgaaaaaagagaaaccctgtcgcaaatctccgacgacttgctgatccccggacttgggcgacacagcagcacctttgtcccatgggaaaaggaagggaaggaggccaaggagacaagtgaggacataggcctactgcatgaagtggtgtcactatgtcacatgacaagtgattttcagcagtccctgaacatttcagataagaacaccaacggaaaccagacctag

SEQ ID NO: 220579 - DNA, 2406 bp, Artificial Sequence
  Description of Artificial Sequence: Synthetic coding sequence
atggagtcacgggcagaaggcggaagccccgcagtgttcgactggttctttgaagccgcatgtcctgctagtcttcaagaggacccaccaatcttgcggcagtttccaccagattttagagaccaggaggcaatgcagatggtgcctaagttctgctttccattcgatgtagaacgagaaccaccaagccctgcagtacaacatttcaccttcgccttaacggacctagcagggaacagaagatttggcttctgtcggctgagggccggaacccagagctgtctttgcattctgtcccacctgccatggttcgaagttttttacaaattactaaataccgtaggcgatctgctggcacaagaccaggttacagaggccgaggagctactccagaacctgtttcagcagtccctgagtggtccccaggcgtctgtgggtctggagttgggatcaggagtgactgtttcaagcggacagggaattcccccacccactcgaggaaacagcaaaccgctgagctgtttcgtggccccagattccgggaggttgcccagcattcccgaaaaccggaacctcacagaactcgtggtggcagtgacggatgaaaatatcgttggcttgtttgccgcacttctggcagagagaagagtcctcctgacagcctcgaagttgtccacactgacatcctgtgtacacgctagttgcgccctactgtaccccatgcgctgggagcacgtgctgattccgactctgcctcctcatttattagactattgctgtgccccaatgccctacttaattggcgttcacgcctctctagctgagcgggtgcgcgaaaaggcgttggaggatgttgtggttctgaacgtcgacgctaacactctggagactactttcaatgatgttcaggcccttccccctgatgtagtcagcttactgcgcctaagattgcgaaaagtcgcgctggccccaggagagggtgtcagccgtctgttcctgaaagcccaagctcttctattcggcggttatcgagacgcccttgtttgctctccagggcagcctgtgaccttctctgaagaagtatttctagcccagaagcctggcgctccactgcaagcattccaccggcgtgccgtgcacttacaacttttcaaacagttcattgaggccagactggagaagctgaataagggcgaaggtttttcggaccaattcgagcaggagattactggatgtggagcgtccagcggagctctgcgctcttatcagctttgggccgacaacttaaagaaggggggtggggctctgctacattctgtgaaggccaagacacagcctgccgtgaaaaatatgtaccggagtgccaagtctggactaaagggcgtgcaatcactgcttatgtacaaggatggcgatagcgtgctgcaaagggggggaagtctgcgcgcacccgctttgccttctcgctccgaccgactgcaacagcgactgcccattactcaacatttcggaaagaacagacctctgagaccatcccgtcgtaggcaactcgaagagggcacaagtgagccgccaggcgctggtacccccccacttagcccagaggatgaaggctgcccttgggccgaggaggctttagatagctctttcctaggcagcggggaggagctggacctgctgagtgaaatcctagattccctaagcatgggcgcaaaaagcgccggaagcctgcggccatctcagagtcttgactgttgtcaccgcggagacctcgattcatgtttttctctgccaaacatccccaggtggcaacccgatgataagaagctgccagaacctgagccacagccgctctcgctgccctcactccaaaacgcttcctccttagacgccactagtagctccaaggatagtagaagccaactcatacctagcgagagcgaccaggaagttacctcaccttctcagtcttctaccgccagcgccgatccaagcatatggggggaccccaagcccagccccctgaccgaaccgttaatcttacatcttaccccatcccacaaagcggcagaggattcgactgcccaggaaaatcccactccctggctcagcaccgctccaactgaacccagcccaccagagtccccgcagattttagctccgactaagcccaattttgatattgcgtggacaagtcagccgctggatccctcttcggacccctcctccttagaagacccccgagccagacccccaaaagccctcctggcggagcgggctcacctgcagccacgggaagagccaggggctttaaattcccccgcaacacctacatctaactgtcagaaaagccagccaagtagtagaccacgtgtcgctgacctgaaaaaatgtttcgagggatag

SEQ ID NO: 220580 - DNA, 2274 bp, Artificial Sequence
  Description of Artificial Sequence: Synthetic coding sequence
atgcagatggtgcccaagttctgtttccccttcgatgtggaacgggaaccgccaagtcccgctgtgcagcatttcaccttcgccctgactgacttagcaggcaatcgacgttttggcttttgccgcttgcgtgccggaactcagagttgcctgtgcattttatctcatcttccctggttcgaggtattctataagctgcttaacacagtgggcgatttgcttgcgcaagaccaggtcacagaagctgaagaactactacagaacctctttcaacagtctctttctggcccacaggcaagtgtgggactagagttgggatctggcgtgaccgtcagtagcggacagggtattccgccacctactcggggaaacagcaagcccctctcatgttttgtcgcaccggacagcggcagactcccaagtatccccgagaaccgaaatctcacggagttggtggtcgccgtgaccgacgagaatatcgtgggactattcgccgctctgctggccgaacggagagtcctgctcactgccagtaaactttcaactctgacgagctgtgtacatgcttcatgcgcactgctgtaccctatgaggtgggagcatgtgctgatccctactcttcccccacaccttttagactattgttgtgcccctatgccatacttgataggcgttcacgcttcactggccgaacgggtccgagaaaaagcgctcgaagatgtggtagtgctcaacgtggatgccaacacacttgagaccacattcaatgacgttcaagctctgcctcccgacgttgtctcacttctgcgcctcagattgcgcaaggtggcgctcgctcccggtgaaggggtgtcgaggcttttcctcaaggcacaggcactgctttttggcggataccgggacgctctggtctgttccccgggtcagccagtcacctttagcgaggaggtatttctcgcgcagaaaccaggcgcaccactgcaggcgttccacagacgggctgttcatcttcagctgtttaagcagtttattgaagctcgcctggagaaactgaataaaggtgaagggttcagcgaccagttcgagcaagagattaccggatgcggcgcatcttcaggggctctgagatcatatcagctttgggccgataacctaaagaaaggcggaggagccttactccatagtgtgaaagcgaagacccaacccgcagttaaaaatatgtaccgaagcgccaaatccggcctgaaaggcgtacagtctctgttaatgtacaaagacggcgactcagtgctgcagcggggagggagcctgcgagcaccagcactccccagcaggtctgatcgtcttcagcaaaggctgcccattacccaacacttcggaaaaaataggccattacgaccatcacggaggagacagctcgaggagggtacctccgagccacctggcgctggcactcccccattaagccccgaggatgaggggtgcccatgggcagaagaagcactcgacagctcctttctcggaagtggggaggagttagatctgttaagcgaaattctggatagcttatctatgggggcaaaatctgcaggtagcctgaggcccagccagagccttgactgctgtcatcggggagacctggactcatgcttctcactgcccaacatccccagatggcagccagatgataagaagcttcctgagccagagccgcagcccttgagtctgccatccttacagaacgcatcttcactggacgcaacctcatcctccaaggattcacgaagtcagttaatacctagcgaatccgatcaagaggtaacctccccgagtcagtctagcacagcctctgccgatccaagtatttggggtgatcccaagccgtctccgctcacagaacctctcatcctccacctgaccccgtcccataaagccgctgaagattctaccgctcaggagaatcccacaccctggctgtccaccgcccctacagaaccaagccccccagaatccccccaaatcttggcccctactaagcctaattttgatatagcgtggacttcccagcccttagacccttcctcggatccctcatccctagaggatccgagagcgcgtccccctaaagcccttttagccgagagggcccacctccaaccacgcgaggagcccggtgctctgaactctcccgcaacccccacttcaaactgccagaaaagccagccgtcaagtcgaccacgcgtggccgatttgaagaagtgctttgaaggctag

SEQ ID NO: 220581 - DNA, 2193 bp, Artificial Sequence
  Description of Artificial Sequence: Synthetic coding sequence
atgctgttcaatagcgtccttcggcagccccagctcggcgtgctgagaaacggttggtcaagccagtaccccctacagtcactgctcacgggatatcagtgctccggaaatgatgagcacacatcatacggggaaacaggggtccctgtgccgccttttggttgtacattttctagcgcgccaaacatggagcacgtgctggccgtggccaacgaagaaggttttgtgcgcctttacaacactgagtcacagtcttttaggaagaaatgcttcaaggaatggatggcgcattggaacgcggtcttcgaccttgcttgggtgccaggggaactgaaactggttaccgcagctggtgaccagacagccaaattctgggatgtgaaggcgggagaattgatcggcacttgcaaaggacatcagtgctctctcaagagcgtagcatttagcaaatttgagaaagcagtgttctgcacgggaggccgtgatggcaatataatggtttgggatacgcggtgcaataagaaagatggattttataggcaagtcaaccagatctctggagcacacaacacatcagataagcagactccctccaagcccaagaaaaagcagaacagtaagggcctggccccttctgtcgatttccagcagagcgtcactgtggtgctattccaagacgaaaatacgcttgtcagcgccggagctgttgatggtatcatcaaggtctgggatctccgcaaaaactataccgcgtaccgacaagagccaatagcgagtaagtccttcttatacccgggatccagtactagaaaattgggatactcttccctcattctcgatagtactggtagcactttgtttgccaattgtacagatgataatatttatatgttcaatatgaccggcctgaaaacttcacccgtcgccattttcaacggacaccagaatagcactttttacgtgaaaagctctctttctcctgacgaccaatttttggtatcaggtagctcggatgaggcagcctacatctggaaggtctccacaccatggcagcctcctactgtgcttttggggcactctcaggaagttacatccgtctgttggtgccctagcgatttcacaaagattgccacgtgctcagacgataatactctgaagatttggagactgaaccggggtttagaagagaagcctgggggtgataagctttcaacagtgggctgggcgtcacagaagaagaaggaaagccgccctggactagtcaccgtgacgagctcccagtccacaccagccaaggcccctagggcaaagtgcaatcccagtaacagctccccatcaagtgctgcttgcgccccttcctgcgccggtgatcttccattgccaagtaacacgccaacgttttcaatcaaaacatctcccgcaaaggctcggtcccctattaacaggcgcggatccgtgtctagcgtcagtcccaagcctccttctagcttcaagatgagtatcaggaactgggttaccagaaccccttcatcatcccctccaatcactccacccgctagtgagaccaagatcatgtcccctcggaaggcattgatccctgtctctcagaagtcatctcaagcagaggcttgctctgagagcagaaacagagtgaagcggagactggatagtagctgcctggagtccgtgaagcaaaaatgcgtcaagagttgtaactgtgtaacagagcttgacgggcaagtggagaacctacacttagacctatgctgccttgccggaaatcaggaagatctatctaaagactccctaggaccgacgaaaagcagcaagatcgagggcgcaggcacaagcattagcgagccaccctcccctataagtccatacgcttcagagtcttgcggtaccttacctctgccgcttaggccatgtggagaggggtcagagatggtggggaaggaaaacagttcacccgaaaacaaaaactggcttctcgccatggccgctaaacggaaggctgaaaatccctcccccagatctccatcctcacagaccccgaatagcaggcgccaaagtggcaagaagctgccttctcccgtcactataaccccatcctccatgcgtaagatttgcacttactttcatcgaaagagccaggaggacttttgtggtcctgaacattccactgaactgtag

SEQ ID NO: 220582 - DNA, 1230 bp, Artificial Sequence
  Description of Artificial Sequence: Synthetic coding sequence
atgttgttcaactccgtcctaagacagcctcagctgggcgtcttgcgcaacggatggtcctcccagtaccccctgcagtctctgctgaccggctatcaatgcagcggtaacgatgagcacacttcatacggagagactggtgtgccggttcccccattcgggtgcacgttctcatccgatgataacaccctcaagatctggaggctgaataggggcctggaggagaagccgggaggtgataagctgagcacagtcggatgggcatctcagaaaaaaaaggagtcccgtcccggattggtcaccgtgactagctcacagagtacgcccgctaaagcccctcgcgctaagtgcaatccttccaactcttctccttcatctgccgcttgtgcaccatcatgcgctggcgatctccctttgccatctaacactccaactttctccataaagacaagcccagcgaaggctcggagtcctatcaacaggcgagggtcagtgtctagcgtcagcccaaaaccaccatcctcgttcaagatgtcaatccgtaactgggtgacgaggacacctagctcaagtcccccaataactccaccggcttcagaaaccaagattatgtcgcccaggaaggccctgatccccgtctcacaaaaatcctcccaggccgaggcctgctccgagagcagaaacagggtgaaacggaggctggactcatcctgtcttgaatccgtcaagcagaagtgtgttaaaagttgcaattgtgtgactgagctggacggccaggttgaaaatcttcacttggacctgtgctgccttgctggcaatcaggaggatttgtccaaggactctttgggacctaccaaatcaagcaaaatcgagggcgcagggaccagcatttctgagcccccttctccaatctcaccctatgctagcgagagctgtggaactctccctctgccactgcggccatgtggggaagggagtgaaatggttgggaaggaaaacagtagcccagaaaataaaaactggctgctagccatggcagccaagcggaaggccgagaacccaagtcctcgatccccctcctcacagacccccaatagccgcagacagtccggaaaaaagctcccgtcacctgtgacaattaccccttccagtatgcggaagatatgcacatactttcacaggaaatctcaggaagacttttgcggtccagagcactcgactgaactgtag

SEQ ID NO: 220583 - DNA, 2067 bp, Artificial Sequence
  Description of Artificial Sequence: Synthetic coding sequence
atgctgttcaattcggtgctgagacagcctcagctcggggtgctcagaaatgctcctaacatggagcacgtgctggccgtggccaacgaagaggggtttgtgcggttgtacaacaccgagagtcaaagcttcaggaagaaatgcttcaaggagtggatggcgcattggaatgctgttttcgaccttgcatgggtgcctggtgaactaaaactcgtgaccgctgcaggtgaccagactgctaagttttgggacgtgaaggctggagaactgatcgggacttgcaaaggccatcagtgcagcttaaaaagcgttgcctttagtaaattcgagaaagcagttttctgcaccggcggacgcgacggtaacattatggtgtgggacacaaggtgcaacaaaaaagatggattttataggcaagttaaccaaatcagcggagctcacaacacttccgataagcagacgccaagcaagcctaaaaaaaaacagaactccaagggacttgccccaagcgtcgacttccagcagtccgtaacggtggtgctctttcaggacgagaatacactcgtatctgctggtgctgtggacggcataataaaggtttgggacctgcgaaaaaactacacagcctacagacaggaaccaattgcttccaaatctttcctctatcccggaagtagcacaagaaagctgggctactcatcccttattctggactcgacaggcagcactctgttcgctaactgtacagatgataacatctacatgttcaatatgacagggctcaagacatcgcctgtcgctatcttcaacgggcatcagaattccacattttatgtgaagtcttctctgagtcctgatgaccaattcctagtcagcggatcttctgacgaggcagcctatatctggaaggtgagtactccttggcagcctcccaccgtccttctcggccatagccaggaggtgacatccgtctgctggtgcccatccgactttactaaaatcgccacttgttctgatgacaataccctaaagatatggagactgaacaggggcctggaagagaagccaggcggagataaactctcaactgtgggatgggccagtcagaagaagaaggaatcacgacctggactggtgacagtgacctcttcccaatctaccccagcaaaggcacctcgggctaagtgtaacccctcaaactcatccccttcctcagctgcgtgtgcacccagttgcgccggtgatctgccactgcctagcaacacacccaccttctcaatcaaaacctcacccgcaaaagcccgtagcccaataaaccgcagggggtctgtatccagtgttagtccaaaaccaccatcctcctttaagatgtctatccggaattgggttacccgtaccccgtccagcagcccccctattactccacctgcgagtgagaccaaaattatgagccctcggaaagccctcatccccgtgagtcagaaatctagccaggccgaagcatgctctgaatcgcggaaccgggtgaagcgacgcttagactccagctgcttagagagcgttaaacagaaatgcgtcaaaagctgtaattgcgtcaccgagctggacggccaagtggaaaatctgcatttagacctctgttgtctcgccggaaaccaagaggacttatcaaaagactctctgggcccaactaaatccagtaaaatcgagggagcgggaacatccatatcggaacccccatcaccaatctcgccatacgctagtgagtcttgcggcactcttccacttccactgcggccatgtggggaagggagtgagatggtcggaaaggaaaattcatccccagagaacaaaaactggctcttagccatggctgccaaaaggaaagccgagaaccccagtcccaggagcccctcaagccagacacctaacagccgcaggcaatctggcaaaaagctccctagccccgtcaccattactcccagctccatgagaaagatttgtacttacttccaccgaaaaagccaagaagacttttgtggcccagaacatagcactgaactttag

SEQ ID NO: 220584 - DNA, 1494 bp, Artificial Sequence
  Description of Artificial Sequence: Synthetic coding sequence
atgaagattagtatccttttgatgttcctgtggggtctgtcttgcgcattgccagtaactcgctaccagaataatgagagtgaggatagcgaggaatggaaagggcacctcgcccaagcacctactcctcctctggcaaacgaggaccccagcgacagcacacaatctgaggaaggtttggggagcgatgaccaccagtatatttatagactggctggaggattttcgagatctaccgggaaggggggagacgataaagacgatgacgaggatgactcaggcgacgacaccttcggagatgacgactcaggacctggccctaaggatcgccaggaaggcggtaacagcaggctgggatctgatgaagacagcgatgatacgattcaggcttctgaggagtcagcaccacagggccaagactctgcccaagacaccacttctgaatcccgggagctggataatgaagaccgtgtggatagcaaaccagagggaggggattcaacacaggagtctgagtctgaggagcattgggtaggagggggtagtgacggcgagagtagccatggcgacggatctgaacttgatgacgaggggatgcagagcgacgacccagaatccatacgttctgaacggggaaacagccggatgaattctgcaggcatgaagtccaaggagtcaggagaaaactccgagcaagcaaatacccaggactccggcggatcccaactcctggagcatcccagccgcaaaatcttccggaagtcccggatctctgaggaggatgatcggtcagaacttgacgacaataataccatggaggaagtgaaatcagatagtactgaaaattcaaatagcagggataccggcctctcgcagcctcgacgcgattccaagggggacagtcaggaggactccaaagagaatctttctcaggaagagagccagaatgttgatggccctagttcagagtcaagccaggaagcaaacctgagtagtcaggagaactcctctgaaagccaggaggaagtggtatcggagagtagaggcgacaacccagatcctacgacctcttacgtggaagatcaggaggattctgactctagcgaggaggattcctctcacactttgtcccacagcaagtccgagtccagagaggaacaggcagactcagaatcctcagagagtctgaacttctccgaagaatctccagagagccccgaagacgaaaattcctcctctcaggaagggctccaaagtcacagttcctccgctgaatcccagagcgaagagagccactccgaagaggatgacagcgacagtcaagatagctctcggagtaaggaagattcaaattctaccgaatcaaagtctagttccgaagaggatgggcagctgaagaacatcgagatcgaaagtcgcaagcttaccgtggatgcttaccacaataagcctattggcgaccaggacgacaatgactgtcaagatgggtactag

SEQ ID NO: 220585 - DNA, 1542 bp, Artificial Sequence
  Description of Artificial Sequence: Synthetic coding sequence
atgaaaattagcatcctgctcatgtttctgtggggtctcagttgtgcccttccggttactaggtaccagaataatgaatctgaggacagcgaagagtggaagggccatttagctcaagctccgacacctccactggagtcctctgagtcctctgaaggctcaaaagtaagttccgaagagcaagctaatgaagatccaagtgactccacacagtctgaagagggcctaggatctgatgaccaccagtatatctacagattggcgggtggattttctaggagtacaggaaaagggggtgatgacaaagacgacgacgaggacgactctggagatgacacctttggggatgacgatagcggcccaggcccaaaagatagacaggagggaggcaacagccgtttgggttccgacgaagacagtgatgatacgattcaggcatccgaagagagtgcgcctcagggccaggacagcgctcaggacacgacctccgagtctagagagctggataacgaagatcgggtggactccaagccagaggggggagattcaacgcaagagtccgaatccgaggaacactgggttggcggaggctctgacggggaatctagccacggggacggttctgaactagatgatgagggaatgcagagtgacgaccctgaaagcatccgctccgagcgcggtaatagtcgcatgaattcagctggaatgaaaagtaaagagagcggagagaactccgaacaggcgaatacccaggattctggtggatcacagcttcttgagcacccctcccggaagatatttcgcaaatcgagaatttctgaggaggatgatcggtcagagctcgacgataacaacacaatggaggaagtcaagtctgacagcaccgagaacagtaactccagggacaccggattgtcgcaaccgagaagggattccaagggtgactcacaagaggacagcaaggaaaacctttcccaagaggagagtcagaacgttgatgggccttcgagcgagtcctcccaggaagcaaacctgtcttcccaggaaaatagctcagagtcccaggaggaagttgtctccgaaagtagaggggacaatcccgatcccacgactagctatgtcgaggaccaggaggattccgatagcagtgaggaggactcgtcccacactctgtcccactctaagagcgagtctcgtgaggagcaagccgactctgagagttctgagagcctgaacttttctgaggaatcccctgaaagtcccgaggacgaaaacagcagcagccaggagggcctgcagtcacatagcagcagtgccgaatctcagagtgaagaatcgcactctgaagaggacgatagcgatagtcaggattcgagtagaagcaaggaggacagcaacagtacagagagcaaaagcagtagcgaggaggatggacagctgaagaatattgagatcgagtcccggaaactcacggtggatgcataccacaacaagccgatcggcgaccaagatgacaatgattgccaggacggctattag

SEQ ID NO: 220586 - DNA, 3906 bp, Artificial Sequence
  Description of Artificial Sequence: Synthetic coding sequence
atgaagataattacatatttttgcatctgggcagtggcatgggcaataccggttcctcaaagtaagcctctggaacgacacgtggaaaagagcatgaacttacatctgttggccaggtcaaatgtgtcagtacaggatgagctcaatgccagtggaacgattaaggaatctggagtgctggtgcacgagggagaccgcggaagacaggaaaatacccaagacgggcacaaaggagagggcaacgggagcaaatgggcagaggtggggggtaagagtttcagcacttatagcacccttgcaaacgaagaaggcaacattgagggatggaacggcgataccgggaaggccgagacctacggtcacgacggtattcatgggaaggaagaaaacatcactgcaaacggcatccagggtcaggtgagcatcatcgataatgcgggagcgactaaccgcagcaacactaacggtaatacggataaaaatacgcagaatggagacgtcggcgacgcaggtcataatgaggatgttgccgtggttcaggaggacgggcctcaggtcgccggatcaaataattctactgacaatgaggacgaaatcatcgaaaattcttgcaggaacgaaggcaatacatctgaaatcacaccacagataaacagcaagaggaacgggacgaaagaggccgaggtcacgcctggcactggggaagatgccggactggacaactcagacggctcccccagcgggaacggggctgacgaggacgaagatgaaggcagcggagatgatgaggacgaggaggccggtaacggcaaagacagttcaaacaattccaagggacaagaagggcaggatcacggcaaggaagacgaccatgactcctccatcggacagaattctgacagtaaggagtactacgatccagaggggaaggaagatcctcacaatgaggttgatggagataaaacctcaaaatccgaggagaatagcgcaggtattcctgaagataatggatctcagcggatagaagatacccagaagctgaatcaccgggagtctaaacgcgtcgagaatcgcatcaccaaggagagcgaaacccacgcagtcggtaagagccaagacaagggcattgagatcaaaggaccctcaagtggcaaccgaaatatcaccaaggaagtgggaaaagggaacgagggtaaagaggataaaggtcagcacggaatgatactgggcaaaggcaacgtgaagactcagggagaagtggtgaatatcgagggcccaggccagaagagcgaaccaggaaataaggttgggcattccaacactgggagcgactcaaattctgacggttacgacagttacgacttcgacgataagtcgatgcaaggagacgatcccaactcctccgacgagtctaacggtaacgacgacgcaaactcagagtctgataacaactcaagcagcaggggtgatgcgagctataatagcgatgaaagcaaggacaacggcaacgggtctgactccaaaggggcagaggatgatgatagcgatagtacgtcagataccaacaattcagacagcaacggtaacgggaacaacgggaatgacgataatgataaatctgactctgggaagggaaagtcggatagttcagacagtgatagctccgacagttctaacagctccgattctagtgactcatctgattcagactcgtctgacagtaacagctcctcggactcagattcgagtgactccgactcgagcgatagcagcgattctgatagctctgatagctctaattcctcagattcaagcgactcctcagattcttcggattctagtgatagcagcgattccagtgactccaaaagcgactccagtaaatcagaatctgattctagtgacagcgattctaagagcgatagctcagacagtaactcttccgacagttcagacaactcagatagcagcgattcgagcaactcaagcaattcctccgattcctctgacagctccgatagctccgactcatcatccagctcggactcctcaaattcttccgatagcagtgacagctccgattcatcgaattctagcgaaagctccgattcgagtgatagtagtgattctgactctagcgattcttccgatagtagcaatagtaatagcagtgattctgactcctcaaatagctccgacagctccgacagctctaattcctctgactctagtgattcatccgattcatccaactctagcgacagttctgattcttccgacagcagcaactcttccgattcaagcgatagttccgactcttccgacagttccgactcttccaatagctctgatagcaacgactcatctaattccagtgacagctctgatagcagcaactcttcagattctagcaactcatctgatagttcggacagcagcgattccagcgactcggattccagcaacagcagcgatagtagcaacagtagcgactcatctgactcatccaactcatcagatagtagcgattctagtgatagctccgatggatctgattctgattcttccaacagatcagactctagcaactcctcagattcatcagattcctctgacagttccaactcaagcgactcaagcgatagttctgacagcaacgagtcgtccaacagcagcgactctagcgatagctctaattctagcgactccgattcttcagattcaagtaactcctcggattcgtccgatagtagcaacagctccgattcttctgaatcctcaaactctagtgataactccaactcaagcgattcttcaaattcgtctgattccagtgattcttccgatagtagtaatagcagtgattcctctaactccagcgactccagcaattctagcgactcctcggactccaatagctctgatagctccgatagcagtaatagttcagattcttccgacagcagcgattccagtgacagtagcgattcgagcgactcttctaactccagcgacagcagcgactcttctgattcatcagattccagcaacagctctgacagctccaacagctccgactcatctaatagtagtgattcttcagactcatccgatagctctgactcctccgactcgtcagattccagcgactcaagtgactcaagcaacagctccgattccagcgactcatctgattcaagcgactcctctgatagctctgactcaagcgactcttcagacagctccgagtcctcagattcatcagacagctctaattcttctgattcttccgactcctccgactcctctgattcgtctgactcgtctgattcatctgacagcagcgactcatcagacagctctaatagttcggactcctcggactcctccgacagctctgatagctcggattcttccaactccagcgattcgtctgacagcagtgagtcctcagattcttccgacagttccgacagcagcgactcttctgattcctccgacagctcggactctagcgattcctcagacagtagcaactccagtgattccagcgactcctctgattcttctgacagctcagattccagtgatagctctgactcttcagattcctctgactccagcgatagctcagacagctcagactctagtgactcttctgattccagtgatagttcggatagttctgatagtaacgaatcatcggatagctcagattcgtccgatagtagtgactcttctaattctagcgattcaagcgattcctccgattcctctgactctacaagtgattcaaacgatgaatcggacagtcagtccaaaagcggcaatggaaataataacgggtcggacagcgacagcgatagtgaaggctcagattcaaatcactctactagtgacgactag

SEQ ID NO: 220587 - DNA, 3906 bp, Artificial Sequence
  Description of Artificial Sequence: Synthetic coding sequence
atgaaaataatcacgtatttctgtatctgggccgtggcctgggcaatacctgtgccacagagcaagcctcttgagcgccacgtggagaagagtatgaaccttcatttgttagctcggagcaatgtatccgtccaagatgagctcaacgcgtccggaacaattaaggagtccggtgtgttagtacacgagggcgatcgtggtaggcaggagaacactcaggacggccacaagggggaggggaatgggtccaaatgggcagaagtgggaggtaagtcattttcaacctatagtactctggccaacgaagagggaaacatagaggggtggaacggggacacagggaaggctgagacttatggccacgacggcattcatgggaaagaggaaaacataaccgcaaatgggattcaaggacaggtatctatcatcgataacgccggagccaccaatcggtcaaatacgaacgggaacaccgacaaaaatacccagaacggagacgtgggagacgctgggcataatgaagatgtcgccgtggtgcaagaggacggacctcaggtggcaggatctaacaattccacagataacgaagacgagattatagagaactcttgcagaaacgagggaaacactagcgaaattactccccaaattaatagcaagcggaacggcacgaaagaagccgaggtgacgcccggaacgggcgaggatgcaggcctcgataacagtgatggaagtccgtccggcaatggtgccgatgaagatgaggacgaaggctccggagatgacgaggatgaggaagccggaaatggcaaggatagctctaataacagcaagggacaggagggccaagaccatgggaaggaggatgatcacgactcgagcattggacagaactcggacagcaaggagtattacgatcccgaaggtaaggaagacccacataacgaggtcgatggcgacaaaacctccaaaagcgaagagaactccgccggtataccagaggacaacgggagccagcgcatcgaggatacacagaagttaaaccaccgtgagagtaaacgagtcgaaaacagaattaccaaggaaagcgaaacccatgctgtgggcaaatctcaagacaaaggaatagagattaaggggcctagcagcggcaacaggaatattactaaagaggtgggaaaggggaacgagggaaaggaagacaagggtcaacacggcatgatcctcggcaagggtaacgttaagacccaaggggaggtggttaatatagaaggaccgggtcaaaagtctgagcctggcaataaggtcggacactccaacacggggtctgacagcaactccgacggctacgattcctatgattttgatgacaaatcaatgcagggggacgaccctaatagctccgacgagtctaatggtaatgacgacgctaacagtgagagtgacaataacagttcctcccgcggtgatgcttcttacaacagcgacgagagtaaggataacggcaacggatctgattctaagggagcagaggacgacgactccgattccacaagcgacacgaacaatagcgattccaacggaaacggcaataacggaaatgatgacaatgataagtccgactccggaaagggcaagtcagatagttccgactctgattcctctgactcgtccaattcttccgattcctctgattcatctgattctgacagctcagactctaatagttctagcgatagcgatagcagcgattctgacagctccgactctagtgatagcgatagcagtgattcttctaattcctccgatagctccgactcttctgactcttctgatagcagtgactcctccgactcaagtgacagtaaatccgatagtagcaagagtgaatccgatagctccgatagcgattcgaagtcagactcttccgatagcaattcctccgattctagcgacaattcggactcttctgattcaagcaactccagcaatagtagcgacagttcagactcctccgactcatcagactccagttcttcttccgactcgtccaattcttccgatagttccgacagctccgatagttcaaactcatcagaatcaagcgattcatccgactcttcagactccgattccagtgatagtagtgactcttcgaattccaacagctctgattctgacagctctaactcatccgacagttctgacagctccaactcaagcgacagttctgattcttccgactcatccaacagcagtgactctagcgattcaagtgattcatccaatagctcagactcctcagattcctcagactcctccgattcatcagacagcagcaattcaagcgacagtaacgattcgtccaactcgtcagactcgagtgatagttccaactcctctgattccagcaattcttctgactcttcagattcgagcgacagttctgattccgactcatctaattcttccgactcctcgaactcaagcgatagcagcgacagcagtaactccagcgactctagcgattcctcggactctagtgatgggtcagattcagacagttctaaccgcagcgactccagtaacagtagcgactcatcagacagtagcgactcgtccaactcctcagattctagcgacagctctgactcaaatgagtcctctaactcttccgacagctctgactctagtaacagctctgactctgattcatctgacagttctaattcttccgattcctcagactcctctaatagctccgacagttctgagtcaagcaactcctcagataactcaaattcaagtgatagctcaaacagctcagactcaagtgatagctccgattcgagtaacagtagcgatagcagcaactcttccgattcctctaacagtagcgattctagcgatagcaattctagcgactcgtccgattcgtccaatagtagcgacagcagcgatagttccgattcctccgattcttccgattccagcgactccagtaacagtagcgattcttctgactctagcgactcctccgattcttcaaacagtagcgattcatccaacagctccgacagctctaattccagcgactcttccgattcctccgattccagcgattcttcagacagcagtgattcttctgattcgtccgactcctctaactcttccgactcatctgattccagcgatagcagtgacagtagtgactcctcagacagctcagattctagcgactctagcgaaagttccgactcttcggatagcagcaattcctccgatagttccgatagctccgacagcagcgatagctcagacagctctgacagctccgacagctcagatagctcagatagcagtaacagttctgactcatcggatagttccgacagcagcgattctagcgacagctctaacagttctgacagtagcgattccagcgagtcctctgactcctcggactcaagcgactcttccgattcctccgatagttccgacagcagcgactccagtgatagttctgatagctccaattcctctgattcgagcgatagctccgactcaagcgattcctccgacagcagtgactcgagcgactcgtcagactcctctgatagcagcgatagcagcgattctagcgattcgagtgatagcagtgattcttccgactccagtgactcatccgatagtaacgagagttccgatagtagtgattcgtcagactccagtgattcttcaaactcttccgacagcagcgatagttcagattcaagcgattctacctccgactctaacgatgagagcgactctcagtctaagtccggcaatggcaacaataacgggtcagactctgatagtgactccgaaggctccgatagcaaccacagtacctccgatgactag

SEQ ID NO: 220588 - DNA, 783 bp, Artificial Sequence
  Description of Artificial Sequence: Synthetic coding sequence
atggcaacccccccaaagagatcatgtccatcgttctctgcttcctcagaaggaacacgtatcaaaaaaataagcatcgagggaaatatcgctgctggtaaaagcaccttcgtgaacatcctaaagcagctgtgtgaggactgggaggtagtacccgagccagtggcacgttggtgcaatgtgcagtcaacccaagacgaatttgaggagctgactatgtcccagaagaacggcggaaacgtgttgcagatgatgtatgagaaacctgagcggtggagctttacttttcagacctatgcatgcctgagccggatccgcgctcagctggcttcactcaatggtaagctgaaggacgctgagaagcctgtgctatttttcgaacggtctgtgtacagtgaccggtacattttcgcaagcaatctctacgaatctgagtgtatgaatgagactgaatggaccatctaccaagactggcatgactggatgaacaatcagttcggacagtctctcgaattggacggaattatctacctgcaagccacacctgaaacctgtctccacaggatctatctgaggggacgcaatgaggaacagggcattccgcttgagtacctggagaagctacattataaacatgagtcttggctcttgcacaggacactgaaaaccaactttgactaccttcaggaggtaccaattttgactctggatgtgaacgaggactttaaggataagtatgagagtctggtcgagaaggtgaaggaattcctgtccaccctctag

SEQ ID NO: 220589 - DNA, 48 bp, Artificial Sequence
  Description of Artificial Sequence: Synthetic coding sequence
atggctacaccacccaaacggagctgtcccagtttctccgccagctag

SEQ ID NO: 220590 - DNA, 834 bp, Artificial Sequence
  Description of Artificial Sequence: Synthetic coding sequence
atggctgccggacggttgttcctgtccagactgagagctcccttttcttcgatggccaaatcccctcttgagggcgtgtcatcttctcgaggcctgcatgctggccgtggcccacgtcggcttagcatcgagggcaacatagctgtgggaaagtccactttcgtcaaactcctgaccaagacatatcccgaatggcacgttgctaccgaacctgtcgcaacgtggcagaacattcaggcggcaggcactcagaaggcttgtacagcccaatctctgggcaatctgctggatatgatgtaccgagagccagctcgatggtcttatacattccagacgttctccttccttagtcgcctgaaggtccagctggaaccattccctgagaagctgttacaggccagaaaaccagtgcagatcttcgagagaagtgtgtactcggataggtacatcttcgcaaaaaatttgttcgaaaatgggagcctgtcagacatcgagtggcatatctaccaagactggcattctttcctcttgtgggagttcgcaagtagaattaccctgcatggattcatttatcttcaggcgtccccacaggtgtgtctgaagcgtttgtatcagagggctagggaagaagaaaagggcatcgagctcgcatacctggagcagcttcatggccagcacgaggcctggctgatccataagacaaccaaattgcatttcgaggctctgatgaacattcctgtcctcgtgctcgacgtcaacgacgacttctccgaggaagtcacaaagcaagaagacctgatgcgcgaagtgaatacattcgttaaaaatttatag

SEQ ID NO: 220591 - DNA, 720 bp, Artificial Sequence
  Description of Artificial Sequence: Synthetic coding sequence
atggcagccggaaggctgtttttatccagactgcgcgcaccctttagcagcatggcgaaaagccctcttgagggggttagctctagccgaggcctgcatgcaggcaggggccctagacgcttatccattgagggcaatatagcatgtaccgcgcagtctctaggaaaccttcttgatatgatgtaccgcgaacctgctaggtggagctacacattccagactttctcttttttgagtcgcctgaaagtgcagcttgagcccttccccgagaagcttttgcaagctcgcaaacctgtgcagattttcgagcgctcggtgtattccgatcgatatatctttgccaaaaacctgttcgagaatggcagcctgtctgacatcgaatggcatatctatcaagactggcattcattcctcctgtgggaatttgcctctcggatcaccttgcatggcttcatttatctgcaggcttcaccccaggtgtgtctgaaacgactttatcagagggcccgagaagaagagaaaggcatagagctggcttacctggaacaattgcatggacagcatgaggcatggctcatccataagaccacaaagcttcactttgaggccctgatgaatatccccgtgctggtattagacgtgaacgatgacttctccgaagaggtgacaaagcaggaagaccttatgagagaagtgaatacattcgtcaagaacctctag

SEQ ID NO: 220592 - DNA, 570 bp, Artificial Sequence
  Description of Artificial Sequence: Synthetic coding sequence
atggcagcaggccgtctctttctgtccaggcttagagcccctttcagcagtatggcaaaaagccccttggaaggggtgagctctagcagaggtctgcatgccggtaggggcccacgtcgcctcagtatcgagggcaacatcgctgtcgggaaatcaaccttcgtgaagctactgactaagacctaccctgaatggcacgtcgcaacagagcctgtggcaacatggcagaacatccaggccgctgggactcagaaagcctgtactgcacagtcactgggtaacctgttagacatgatgtacagagaacccgctagatggagttacacgtttcagacatttagctttctgagtcgtctgaaggtgcagttggagccgtttcccgaaaagctcttgcaggcccgaaagccagttcagattttcgagcggtcagtgtacagcgaccgcctccactttgaggccttgatgaacatcccagtgttggtcctggacgtgaacgacgatttctccgaggaagttaccaaacaggaagatcttatgagagaggtaaatacattcgtgaaaaacctgtag

SEQ ID NO: 220593 - DNA, 768 bp, Artificial Sequence
  Description of Artificial Sequence: Synthetic coding sequence
atggctgccggacggctctttttaagccgcctgagggcccctttctccagtatggccaaaagcccattggaaggcgtgagttcctcccgcggattacatgcaggaaggggcccacggagactctctatcgaaggcaacatcgggaatatacttaagcagattcgcatgagagcccctattcaggagaccgcatgcacagcccagtcacttggaaacttactggatatgatgtatagagagccggctcgctggagttacacttttcaaaccttctcattcttgtctcgactcaaagtccagctggaaccgtttcctgagaaactgttgcaggcaagaaaaccagtccagatttttgagcgctcagtatactcggatagatatatattcgcaaaaaatctctttgagaacggctcactatctgatattgagtggcatatctaccaggattggcatagctttctcctgtgggagtttgccagtcgtataaccctacatgggttcatttacctgcaggctagtccccaagtgtgcctaaaacgcctgtaccagcgggcacgggaagaggaaaagggaatcgagctggcctacctggagcagctccatggccagcacgaagcttggctcattcacaagacaactaagcttcatttcgaagccttaatgaacatccctgtactggtgctagacgtgaacgacgacttcagcgaggaggtgactaaacaggaggatctaatgcgagaggtgaatacattcgtgaagaacctgtag

SEQ ID NO: 220594 - DNA, 1416 bp, Artificial Sequence
  Description of Artificial Sequence: Synthetic coding sequence
atggccaaaaaggtggccgtcattggggcaggagtgtccggactgatttcattgaaatgctgtgttgacgagggcctggagccaacatgttttgagagaacagaggatatcggaggtgtgtggagatttaaggaaaatgtcgaagatggaagagctagtatctatcagagcgtggttacaaacacttccaaggagatgtcttgtttttccgattttcccatgcctgaggattttcccaacttcctgcacaacagtaaacttctggaatatttccgaatctttgccaagaagttcgacctgttgaaatatatccaattccagaccaccgtgttatctgttcggaagtgtcctgatttctcttcctctggacagtggaaagtcgtgacgcagagtaatggaaaggaacaaagtgcggtattcgatgccgtcatggtctgcagcggccaccacatcctacctcacatacccctcaagtccttccccggtatggaacgattcaaaggacaatattttcacagccgacagtataagcatcctgatgggttcgaaggcaaaagaattttggtcattggcatgggcaactccggctcagacatcgccgtggagctctcaaaaaacgccgctcaggttttcatatcaacacgacacggcacttgggtgatgtctcgcatttctgaggacggctacccatgggattccgtgtttcacacacgttttagaagtatgctgagaaacgtgttacctaggaccgccgttaagtggatgatcgaacagcagatgaaccggtggttcaatcacgaaaattacgggctggaaccgcagaacaagtacatcatgaaggagccggttctaaacgatgatgtgccatcccggttattatgtggcgcaattaaagtgaagtcaacggtaaaggaattgactgagacatccgctatctttgaggatggaactgtcgaggaaaatatcgatgtgattatcttcgctacgggatactcctttagcttcccgtttctcgaggacagcctggttaaagtggagaacaacatggtgtcactgtacaaatatattttcccagcgcatctggataagagcaccctcgcatgcataggactgattcagccgctggggtccatcttccccactgctgaactccaggcgagatgggtgacaagggtcttcaagggtctatgttcactgccgagcgagcgcacgatgatgatggacatcatcaaaaggaacgaaaagaggatcgacctcttcggcgagtcacaaagccagacgctccaaactaattacgtcgactacttggacgaactcgctctggagattggggctaaacctgatttctgtagcctattgtttaaggatccgaaactggcagttaggctgtattttgggccatgcaactcatactag

SEQ ID NO: 220595 - DNA, 969 bp, Artificial Sequence
  Description of Artificial Sequence: Synthetic coding sequence
atggaggggagtcttgagagggaagcgccagctggcgcacttgccgcagtgcttaagcacagcagcaccctgccccctgagtccacacaggtgaggggttacgacttcaacagaggtgtgaactaccgcgctctgctcgaggcttttgggaccactggattccaggccacaaatttcggcagggcagtgcagcaggtgaatgcgatgattgaaaagaagctcgaaccattgtcacaggacgaagaccagcacgcagatttaacacagtctcgcaggcctcttacgagctgcactatcttcctgggttatacatctaatttgataagcagcggaatcagggaaaccatccgatatttggtgcaacacaatatggtcgacgtgctcgtcacaactgccggaggcgtagaagaagatctcatcaaatgtctggctcccacttacctgggcgagttctcactgcgcggtaaagagctgcgggagaatgggataaaccggattggcaacctgctggtgccaaacgaaaattactgcaagttcgaagattggctaatgcctatcttagaccaaatggttatggagcagaacaccgagggcgtgaagtggacacctagtaaaatgatcgccagactcggaaaggagatcaacaatcccgaaagcgtgtactactgggctcagaagaatcacattcccgtcttttcgcctgctcttacagacggttctctcggggacatgattttttttcacagctataaaaaccctgggctggtgctggatatcgttgaggcccaggagttcgatggctccgactcaggcgcacgccctgatgaggccgtgtcttgggggaagatcagggtggacgcgcagccggtgaaagtctacgcagacgcctccttagttttcccacttctcgtggcggagacatttgcccagaaaatggacgcattcatgcacgaaaaaaacgaggactag

SEQ ID NO: 220596 - DNA, 984 bp, Artificial Sequence
  Description of Artificial Sequence: Synthetic coding sequence
atgcccataattccagccttttgggaagccgaggccggtggatctcgggaggaggaatttgagacctcccttgctaatatgatcgagaagaagctggagccactgtctcaagatgaagatcagcatgccgacctgacacagtccagaagacccttaaccagctgtaccatatttttaggctacacctccaatctgatttctagcggaatccgcgaaacaatacgatacctagtgcagcataacatggtggacgtcctcgtgaccaccgctggaggggtagaagaggacctgatcaaatgcctggctcccacctatctgggcgagttcagccttaggggtaaggagctccgggagaacggaattaatcgtattggcaatctgctcgtgcccaacgaaaattactgtaagtttgaggattggttgatgccaatactagatcagatggtcatggaacagaacactgagggcgtcaagtggacaccctctaaaatgatcgccaggctgggaaaagagattaacaatcctgagtccgtttactattgggcccaaaagaatcatatcccagtgttttcacccgctttgaccgacgggtcactaggagacatgatcttttttcactcgtataagaaccccggtttagtcctggacattgtagaagacttgcgactgatcaatacccaagcaattttcgcgaaatgcactggtatgattatcctcgggggaggggttgtaaagcaccatatcgctaacgccaacctgatgaggaacggcgcagattacgccgtatacatcaacacggcccaggaattcgatggttctgattcaggggctagaccggatgaggctgtgtcatggggcaaaattagggtggacgctcagcccgttaaggtctatgcagatgccagcttagtctttccgctgctggttgctgaaacattcgcccaaaagatggacgcattcatgcatgagaagaatgaggactag

SEQ ID NO: 220597 - DNA, 462 bp, Artificial Sequence
  Description of Artificial Sequence: Synthetic coding sequence
atgccccagctgtgtacccgcgcttccagcagtgagatccctggaagacttttaactactctccaaagcgcacagggacagaagttccttcatttcgccaagtccgactcattcctcgatgatatatttgccgcttggatggctcagagactaaaaactcacctcttgactgagacctggcagcgcaaacgacaagagctcccttctaactgctctctgccgtaccacgtctataatatcaaagccatcaagctgagtcggcatagctatttcagctcttaccaggaccacgctaagtggtgcatctcacagaagggtaccaaaaacagatggacttgcatcggagacctgaaccggtctccgcaccaggccttccgatctggagggttcatatgtactcagaactggcagatctatcaggcctttcagggactagtgctttattatgaatcctgtaagtag

SEQ ID NO: 220598 - DNA, 1086 bp, Artificial Sequence
  Description of Artificial Sequence: Synthetic coding sequence
atgaagcagaaaatgatggcccgactgctgcgtaccagtttcgccctcttgttcctggggctcttcggggttcttggggctgcgaccatctcctgtaggaacgaggaggggaaagccgtggactggtttaccttctataagctgcccaaaaggcagaacaaggagtcgggagaaacagggctggaatacctctatcttgatagtacaactcgctcctggcggaagagtgaacagttaatgaatgacacaaaatccgttttgggacgaaccttgcagcagctgtatgaggcatatgcctcaaagtcaaacaatactgcctatttgatttacaatgacggcgttcctaaacccgtgaattatagccggaagtatgggcacaccaaggggctgctgctgtggaatcgggtccaggggttctggcttatacatagcataccacagttcccgccaatccccgaagaagggtatgactacccacccactggcagacgcaacgggcaatccggcatatgtattacattcaagtataatcagtatgaggccattgattctcaattattagtgtgtaacccaaacgtgtattcttgctcaattccagccactttccaccaggagctaatacatatgccacagctgtgtactcgggctagtagctcggaaatccccggtcggctactgactacactccagtcagcccaaggacagaaattcctgcattttgctaagagcgactcatttctggatgacatattcgctgcttggatggcacagcggttaaagacgcacttactcactgagacatggcagaggaagcgccaagaacttccctcaaactgtagcttgccctaccatgtgtacaatatcaaagcaatcaaactgtcaaggcatagctatttttccagctatcaagatcatgccaaatggtgtataagtcagaaaggaaccaaaaacagatggacttgtatcggcgatctgaaccgcagtccacatcaggcttttagaagcgggggattcatttgcactcaaaattggcagatatatcaggcctttcagggtctggttctgtactacgagagttgcaaatag

SEQ ID NO: 220599 - DNA, 1317 bp, Artificial Sequence
  Description of Artificial Sequence: Synthetic coding sequence
atggctcttagaggggtgtcagtcaggctgctgtctcgaggcccagggctgcatgttctcagaacttgggtcagctccgctgctcagactgaaaaaggcggtcgcacgcagagccagctcgccaaatcttcaagaccagagtttgactggcaagacccgctggtcctggaggaacagctgaccactgacgagatcctgatccgggatacatttcggacttattgccaagagagattgatgccccgaatcctgctggcaaatcgaaatgaagttttccaccgggagatcattagcgaaatgggtgaattgggagtgcttggccctacaattaaagggtatggatgcgccggagtctcttctgtagcttacggtctgctggccagggagctcgagagggtcgacagcggctatcggtcagctatgtctgtgcagagctctctggtcatgcacccaatttatgcctatggctctgaagaacagaggcagaagtacttgccccaactcgccaaaggggagctgctcggttgttttggcctaacagaacccaactctggcagtgatccgtcttcaatggagactcgcgctcactacaacagttccaataaatcctataccctgaatggcaccaaaacatggatcaccaacagccctatggctgatttatttgtggtgtgggctcggtgcgaggatgggtgcatccgtggattcctcctggagaagggaatgagaggactgagtgctcctaggatccaaggcaaattttctttgagagcttctgctaccggcatgataatcatggacggtgtcgaagttccagaagagaatgttttgccaggtgcttccagcctgggcggaccattcggctgcctgaacaatgcacgctatggtattgcctggggcgtcttgggagcatccgagttttgtctccacacggctcgacaatacgctctggaccgcatgcagttcggagtccccctcgctaggaaccagctcatccagaaaaagctggcggatatgctgaccgagattaccctgggcctgcacgcgtgcctccaactgggaagattaaaagaccaggataaggcggctcctgaaatggtctcactgttgaaaaggaataattgcggaaaggcccttgacatcgccaggcaagcaagggatatgctgggaggcaatggaatttctgacgagtaccatgtgattcgccacgctatgaatctcgaagcagtcaacacctatgaaggaacccatgacatccacgcccttatactggggagggccataactgggatacaggcattcaccgcctccaaatag

SEQ ID NO: 220600 - DNA, 918 bp, Artificial Sequence
  Description of Artificial Sequence: Synthetic coding sequence
atgatacctcttctgctggcagccctgctatgtgttcccgcaggtgctctgacgtgttacggagactctggacaacctgttgactggtttgtggtgtacaagctacccgcacttaggggatctggcgaggctgctcagcggggtctgcagtataagtacctggacgagtccagcggaggatggcgtgacggcagagcattgattaattctccagagggagcggtgggcaggagtctccagccactttaccggagcaacacttcacagctcgccttcctgctctacaatgatcagccccctcagccttccaaggctcaggacagttcaatgcggggacacacaaaagggaaacagctcacctatacgtatccctgggtttacaactaccaattagagggaatctttgcgcaggaatttcctgacctggagaacgttgtgaagggccatcatgtgtcgcaggagccatggaacagctcaattaccctgacttctcaggcaggggcagttttccagtctttcgccaaattctcaaaattcggagacgatttatatagcgggtggctggccgcagccctgggcacaaatcttcaggttcagttttggcataagacggtagggatcctgccctctaattgttccgatatctggcaggtgttaaatgtaaaccagattgcattcccaggtccggcagggccttcattcaattcaacggaagatcactccaagtggtgcgtcagtccaaagggaccatggacttgtgttggcgacatgaacagaaatcagggagaggagcaacgaggcggaggcaccttatgtgctcaactgcctgctctgtggaaggcatttcagcccctcgttaagaactaccagccttgcaacggcatggccagaaagcctagtagggcttacaaaatttag

SEQ ID NO: 220601 - DNA, 909 bp, Artificial Sequence
  Description of Artificial Sequence: Synthetic coding sequence
atgcactacccaaccgctctactgtttttgattctggcaaatggtgcacaggcttttcgcatatgcgcatttaacgcgcagagactcacgctcgctaaggtggccagagaacaggtgatggatacactggtcaggatactggcgagatgtgatataatggtcttgcaggaagttgtggattcatcaggctccgcgattcccctgctgctgagggagctgaatcggttcgacgggtccggtccctattccactctctcgtcccctcagctcggacgctctacctatatggagacctatgtgtatttctaccgctcccacaagacacaggtcctctcctcctatgtttacaatgatgaggatgacgtgttcgctagggaaccatttgttgcccagtttagtctgcctagtaatgtacttcctagtctggtgctggtaccactgcacacgacacccaaggccgttgaaaaggagttaaatgccctgtatgacgttttccttgaagtctcgcaacattggcaaagcaaggacgttattctgctgggggattttaacgcagattgtgcttctctgactaagaagcgcctagataaacttgaactgcgcaccgaacccggtttccactgggtgatcgctgacggcgaggatactacagtgagggccagtacacactgtacatacgaccgagtggtcctccacggagaacggtgtcgctccttgctccataccgcagccgcattcgacttccctacttctttccagctgactgaggaggaagccctgaatatctcagaccattatccagttgaagttgaactgaaactcagccaagcccacagcgtgcagcccttgtccctcacggtcctgctgctgctgagcctcctaagtccgcagctgtgccccgctgcctag

SEQ ID NO: 220602 - DNA, 909 bp, Artificial Sequence
  Description of Artificial Sequence: Synthetic coding sequence
atgcattatccaaccgcccttctgttcctaatcctggcaaacggagctcaagcgtttaggatctgtgccttcaatgcccagcggctgactttagcaaaggtagcccgtgaacaagtcatggacactctcgttagaattcttgcacggtgtgacattatggtcctgcaagaagtcgtagattcctccggttccgccattccactgctcctgcgcgagcttaaccgtttcgatggttccggcccttatagtaccctgagcagcccgcagttaggtcgaagtacttacatggagacatatgtttatttctataggagtcacaagactcaagttctgtcaagttacgtgtataacgacgaggatgacgtttttgccagagagccctttgtggcccaattttcactgccgtctaacgttctccctagtctggttctcgtccctctgcacacaacccccaaggccgtcgaaaaggagctgaacgcactttatgatgtgtttctcgaggtgagccagcattggcaatccaaggacgtaatcctgctgggtgacttcaatgccgactgcgccagcctaaccaagaagagactggataagctggaattgaggaccgaacccggtttccactgggtgatcgctgatggagaagataccacagtccgcgcttctacccattgtacctacgatcgggtggttctgcatggcgaaaggtgtagatctctgctccatacagctgcggcttttgattttccgacgtccttccagttgactgaggaggaggctttgaatatctccgaccactaccccgtggaggttgaactgaaactttcccaggctcactccgtgcagccgctgtcactgaccgtgctcctgctattgtctctgctctcgcctcagttgtgccctgccgcatag

SEQ ID NO: 220603 - DNA, 909 bp, Artificial Sequence
  Description of Artificial Sequence: Synthetic coding sequence
atgcactacccgacagctctcctcttcttgatcctcgctaacggagcccaggcgttccggatatgtgctttcaatgcccagagattaacacttgccaaggtagccagggaacaggttatggacaccctcgtgcggattctcgcaagatgcgacatcatggtgctgcaggaagtagttgactcaagtggcagcgctataccactgttactccgggaacttaaccgctttgatggcagtggcccttacagcaccctcagctcccctcagctgggaaggtccacatacatggaaacctatgtttatttctacaggtcccataagacccaagtgctgtcaagttacgtttataacgacgaagatgacgtgttcgcacgggagccttttgtggcccagttttctctcccttccaatgtgctgccttccctggtccttgtacctcttcatacgacacctaaagccgtagaaaaggaactgaatgccctctatgatgtgtttctcgaagtcagccagcattggcagtccaaggacgtcatcctgttgggagactttaatgcagattgcgccagcctgacaaaaaagcgactcgataagttagagctccgtacagagcctggttttcactgggtaatagcggacggagaagataccactgtgcgagcatctacacattgtacttacgaccgcgtagtgctccatggggaacggtgccgaagcctattgcacaccgctgcagcatttgactttcctacaagctttcagctcacagaggaagaagccttgaacattagtgatcactaccctgtggaagtagagttgaagcttagccaggctcactcagtccagccactgagcctgactgtgctgctcttgctctccttactgagccctcagttatgccctgctgcatag

SEQ ID NO: 220604 - DNA, 909 bp, Artificial Sequence
  Description of Artificial Sequence: Synthetic coding sequence
atgcactatccaacagctcttttgttcctcatcctggctaacggcgctcaggcctttcgcatctgtgcatttaatgcccagcggttaaccctggccaaagtggcccgagagcaggttatggacaccctggtcagaatcctggcccgatgtgatattatggtgctgcaagaggtagtcgactcatcaggaagtgcaatccctctgctgctccgggagctcaatcgttttgatgggtccgggccatactctacattgtcgtctccgcagctcgggagatccacgtatatggagacttacgtttacttttatcgatcacataagacgcaggtgcttagttcctacgtgtacaacgatgaagacgatgtgttcgcgagggagcccttcgtggcacaattttctttaccctctaatgtgctgccctccctggtgctggtgccactgcatacaacacctaaggctgttgaaaaggagcttaatgccctgtacgacgtctttctcgaagtaagtcaacattggcaatccaaagacgtgattctactaggagacttcaacgccgactgcgccagcctgacgaagaaaaggttagacaagctagaactacgcaccgagcccggattccattgggtaatagcggacggtgaagacactactgtacgtgctagcacacactgcacgtacgaccgggttgttctccatggagagcggtgtaggtccctgttacacaccgcggcagcttttgacttcccaacctcatttcaactgaccgaggaggaagccctgaacattagcgatcattaccctgtcgaagtggagttgaaactgagccaggcacattctgtgcaaccactgtcattaaccgtgctcctgctgctatccctgttgagcccccagctctgtcccgctgcgtag

SEQ ID NO: 220605 - DNA, 909 bp, Artificial Sequence
  Description of Artificial Sequence: Synthetic coding sequence
atgcattacccaactgctttactgttcctgatcttagccaatggcgctcaagcctttcgcatttgcgcttttaacgcacagagattgactctggccaaagtggcacgcgaacaagtgatggacaccctggttcgtatactcgctagatgcgacatcatggttctccaggaagttgtggattccagcgggagtgccattcccttactcctgcgggaactgaacaggttcgacggctctggaccctactccacactaagcagcccccagcttggcagaagcacctacatggaaacgtatgtctacttctataggagccataaaactcaagtgctgagcagttatgtttacaatgatgaggacgacgtgttcgcccgtgagccattcgttgcacagttctcactccccagcaacgttttgcctagtctggttctggtccctctgcacacaacccccaaagctgtggaaaaagagttgaacgcgctctacgatgtgttcctcgaagtttcccagcactggcagtccaaggatgtcatattactcggtgacttcaacgctgattgcgcgtccctgacaaagaagcggctggacaagctcgagctgcgcactgagccgggttttcattgggttatcgctgatggggaagacaccacggtcagagcttcaacgcattgtacctatgatcgcgttgtgctccatggggaaagatgcaggagcctattacacaccgcagccgctttcgatttccctacgagcttccagttgaccgaagaagaggcactaaatatttccgaccattatccagtggaagtggagctgaaactgtcccaggctcattctgttcaaccactgtcactaacagtactgctattgctgtcactgctcagcccccagttatgtccggctgcctag

SEQ ID NO: 220606 - DNA, 909 bp, Artificial Sequence
  Description of Artificial Sequence: Synthetic coding sequence
atgcattatcccaccgcgctgctgttcctgatcctagccaacggcgcacaagcgtttcggatttgtgcctttaacgcccaaaggctcacccttgcgaaggttgccagagaacaggtaatggataccctagtcaggattctcgctcgatgcgatatcatggttctccaagaggttgtcgacagcagcggaagcgcaatcccgcttctgctcagggaactgaaccgcttcgacgggagtgggccttacagtaccctctccagcccacagttgggcagaagcacttacatggagacctacgtctacttctaccgctctcacaaaactcaggtgctgtcttcgtatgtatacaatgatgaagatgacgtattcgcaagggagccgtttgtggcccagttcagcctcccctctaacgtgttgccatcgctggtgctggtgcctttgcacacaacccctaaagcagtggagaaggagcttaacgccctgtacgacgtgttcctggaggttagccagcactggcagagtaaggacgtgattctgttaggcgactttaatgctgactgtgcatccctcaccaagaagcgactggacaagctggagttgcgtacagaacccggtttccactgggtgattgccgatggcgaagacacaacagtgcgagcttcaactcactgtacatatgacagagtcgtgctgcatggggagcgctgtaggtctctgcttcatacagccgctgcttttgacttccccactagttttcagctgactgaagaagaagccctcaacatcagcgaccactacccagtagaagttgaactgaagctaagtcaggcccattccgtgcagcctctttccctgacagtactcctgctgctgagcctcttgtctccccagctttgtccggctgcgtag

SEQ ID NO: 220607 - DNA, 315 bp, Artificial Sequence
  Description of Artificial Sequence: Synthetic coding sequence
atgcactaccctacggcactgttatttctgatcttagccaacggcgctcaggccttcagaatatgtgcctttaacgcgcagcggctcacccttgcaaaagttgccagggagcaggtcatggacacacttgttaggattttagccagatgtgacattatggtgttgcaagaggtggtggactctagcggatccgccatccccctgctgcttagggagctgaaccgatttgatggaagcgggccttacagcacactgtcttctccgcagttgggcagaagcacatatatggaaacctacgtttacttctataggtag

SEQ ID NO: 220608 - DNA, 81 bp, Artificial Sequence
  Description of Artificial Sequence: Synthetic coding sequence
atgcactaccctactgctctgctgttcctgatccttgcgaacggcgctcaagccttccgcatatgcgcctttaatgcatag

SEQ ID NO: 220609 - DNA, 627 bp, Artificial Sequence
  Description of Artificial Sequence: Synthetic coding sequence
atgcattacccaaccgcactattatttctgatactggctaacggagcacaggcatttagaatctgcgcgtttaacgcgcaacgacttacactggctaaagttgccagggaacaggtaatggacacactcgtgcggatattagcacggtgcgatatcatggtcctgcaggaagtcgtggactcttcgggtagcgctatccctttattgctgcgagaactaaaccgttttgatggctccggaccctattctactctaagttccccccaacttggaaggagtacctacatggagacttacgtgtatttttacaggtcccacaagacacaggtcctgagcagctacgtgtacaacgacgaggacgacgtgtttgcacgtgagccattcgtagctcagtttagcctcccctccaatgtactgccctccttagtgctagtgccgctgcacaccacccctaaggcagtggaaaaggaactaaacgccctttatgatgtgttccttgaggtatcccagcactggcagtcaaaagacgttattttacttggagacttcaacgcggattgtgctagcttaactaagaaaaggttggacaaactcgagctccgtactgagcccggatttcactggtag

SEQ ID NO: 220610 - DNA, 918 bp, Artificial Sequence
  Description of Artificial Sequence: Synthetic coding sequence
atgagccgcgaactggcccctctcctattgctgctgctttccattcacagtgctctcgctatgcgaatctgttccttcaatgtgcggagcttcggggagtccaagcaagaagataagaatgctatggatgttatagtcaaagtcattaagcgatgcgacattatcctcgttatggaaataaaggacagtaataatagaatctgcccaatactgatggagaaactaaaccgaaattctcgacggggtataacatacaactacgtgattagctccagactcggcaggaacacttacaaggaacagtacgcctttctgtacaaggaaaagcttgtgagtgtgaagcgctcgtaccactaccacgactatcaagacggagatgccgacgtgttctccagggagccctttgtcgtatggttccagtcaccccacaccgcggtcaaggactttgtgatcatccctctgcacaccactcccgagacctctgtcaaggagatcgatgaactggtggaggtatacacagacgtgaaacaccgctggaaggcagagaacttcattttcatgggcgactttaacgcgggatgtagttatgtgcccaagaaggcctggaaaaatatccgactgaggaccgacccaagatttgtctggctgataggagaccaggaagataccacagttaagaagtctactaactgtgcctacgaccgcatagtgttgagagggcaggaaattgtgtccagcgtggtccctaagtccaactctgtgtttgattttcagaaagcctacaaactcacggaggaagaggcccttgatgtgtctgaccattttccagtagagtttaaattgcagtcgagcagagcctttacaaattcaaagaagagcgtcaccctccgaaagaagaccaagtctaagcgcagctag

SEQ ID NO: 220611 - DNA, 918 bp, Artificial Sequence
  Description of Artificial Sequence: Synthetic coding sequence
atgagtagagagctcgccccactgttactgctgctcctgtccatccacagcgccctggcgatgagaatttgttcctttaatgtgcgcagcttcggtgagtccaaacaggaggacaaaaacgccatggatgttatcgttaaagtcatcaagcgctgcgacattattctggtcatggaaattaaggacagcaataatcggatatgtcctatcctaatggaaaaactgaacaggaactctcgccgagggatcacctataactacgtgatttcatcacggctgggcagaaatacgtataaggaacaatacgccttcctttacaaagaaaaactagtttctgtcaagaggtcttaccattatcacgattaccaggatggtgatgcagatgtgttcagccgcgagcctttcgtggtttggttccagtccccacacactgcggttaaagacttcgtcattattccgttgcataccacccctgagacctccgtcaaggagatcgacgagctggttgaagtgtataccgacgttaagcacagatggaaagccgagaatttcatcttcatgggcgacttcaacgcaggttgttcttatgtgccaaagaaggcatggaaaaatattcggcttcggactgatcccaggtttgtctggctgattggtgatcaagaggatactactgtgaaaaagagtaccaattgcgcctatgatcggatcgtcctgagagggcaggagatagtctcctctgtagtgccaaaatcaaatagcgttttcgacttccagaaagcctacaagctaaccgaggaggaggcactggacgtcagtgatcatttccccgtggaattcaagctgcagagttcccgtgccttcaccaattccaagaagagcgtgactctgagaaaaaagacaaagtcaaaaaggtcctag

SEQ ID NO: 220612 - DNA, 867 bp, Artificial Sequence
  Description of Artificial Sequence: Synthetic coding sequence
atgtctagggagctggctccactcctcctgctcctgctgagtatccacagtgccttagcaatgcgcatttgcagtttcaacgttagaagtttcggggagagtaaacaggaggacaagaacgcaatggacgtcatcgttaaggtcattaagagatgtgatattatcttggtcatggagataaaagattccaacaatagaatttgtcctatactgatggagaagctcaaccggaattctagaaggggaattacatacaactatgtaatttcaagcaggttgggacggaacacctacaaagagcaatatgcatttctttacaaggaaaaactggtgtctgttaaacggtcctaccactaccatgactaccaggacggcgatgctgacgtgttcagcagggagccatttgtagtgtggttccaaagtccacacacagccgtaaaagattttgtgattatccccttacacacaacaccggaaacatcagtgaaagagatcgacgagctggttgaagtgtataccgacgtgaaacatcgctggaaagcggaaaacttcatctttatgggggatttcaacgccggttgttcctacgtccctaagaaggcttggaaaaacataagattgcggaccgaccctcgctttgtttggctgatcggtgaccaagaagacaccactgtcaaaaagtccaccaactgtgcctacgatagaatagtgctcagggggcaggaaatcgtgagcagcgttgtccctaagagtaacagcgtgttcgattttcagaaggcttacaagctcacggaggaggaagtccgactgccttcttgcctgagcatgcctctgagttggaaggacgaacttgcttgggcaacctag

SEQ ID NO: 220613 - DNA, 303 bp, Artificial Sequence
  Description of Artificial Sequence: Synthetic coding sequence
atgtctcgcgaactcgctccactcctgctacttttactcagcatccattctgctctggccatgaggatttgtagctttaatgtgagatctttcggagagtctaaacaggaagacaagaatgcaatggacgtgatcgtcaaggtgatcaaaaggtgtgacattattctggtgatggagattaaggactctaacaatcgaatttgccctatcctgatggagaagctgaatcggaacagtcgcagggggattacatacaactatgtcatcagcagccgcctgggaagaaatacctacaaggaatag

SEQ ID NO: 220614 - DNA, 828 bp, Artificial Sequence
  Description of Artificial Sequence: Synthetic coding sequence
atgtctagggagctggccccactgttgctgctactgctcagtatccactccgcactggccatgcggatttgttcgttcaacgtgaggagcttcggggaaagtaagcaggaagacaaaaatgcaatggatgtcattgtgaaggtgataaagcgatgcgatatcatccttgtaatggagatcaaggactccaacaatcgtatatgcccaatcctgatggagaagctgaatcgtgaaaagctggttagtgtgaagagatcgtatcactatcacgattaccaggacggagatgccgatgtgttctcacgggagccttttgtggtttggttccaaagtccccatacagccgtcaaggatttcgtgatcatccctttgcatacgaccccggagaccagcgtaaaagaaattgatgagctggtggaggtgtacacagacgtaaagcataggtggaaggccgaaaattttattttcatgggggacttcaacgccggttgtagttatgtgccgaaaaaagcctggaaaaatattcggctgagaacagacccccgtttcgtgtggctgatcggagaccaggaggacaccaccgtcaagaagtccaccaactgcgcttatgataggattgtgctgagggggcaggagattgtgtcatctgtagtgccgaagtctaattcagtgtttgattttcaaaaagcctacaagctcactgaggaggaggccctagatgtcagcgaccactttccagtggagttcaaactgcaaagcagtagagcctttacaaacagtaagaagtccgtaacgttgcggaaaaagaccaaatccaagcgctcttag

SEQ ID NO: 220615 - DNA, 753 bp, Artificial Sequence
  Description of Artificial Sequence: Synthetic coding sequence
atgacaccgctctgtcccagaccagccctctgctatcactttttaaccagcttactgaggtctgcgatgcagaatgctaggaccgccgaaggcaggagtcgtggcacgttgcgagccaggcctgctccgcgacctgccgctcagcacggcattccacgtcctctaagtagcgccggaaggctgtcgcaggggtgccgaggcgcatcaacagtgggtgctgccggatggaagggcgaactccctaaagcaggcggatcacctgcccctggccctgagactcccgctattagcccctccaaacgggctcgtcctgcggaagtgggcggtatgcagttacgcttcgcacgtcttagcgagcatgctaccgctccgacccggggtagcgctagagccgctgggtatgacctgtatagcgcttatgactatacaatcccgcctatggagaaggctgttgtcaaaacagatatccagattgcactcccctcgggctgctacggccgtgtggctcccaggagtggcctggctgccaagcatttcattgatgtgggcgctggcgtcatcgatgaggactaccggggaaacgtgggcgtggtgttgtttaacttcggaaaggagaagtttgaggtgaagaagggagacaggatcgcccagcttatttgtgaacgtattttttatcctgagatagaagaagttcaagccctggatgatacagagcgcggatcaggcggttttggcagcacgggcaaaaattag

SEQ ID NO: 220616 - DNA, 759 bp, Artificial Sequence
  Description of Artificial Sequence: Synthetic coding sequence
atgacccctctgtgccctcgaccggctctgtgctaccatttcttgacgagcctcctgagaagcgcgatgcaaaatgccaggggcgcacggcagcgggctgaagcagccgtccttagcggaccaggacctcccctgggacgggctgcccagcacggcatccccagacctctgagttccgcaggcaggctttctcaaggttgcaggggcgctagcacagtcggtgctgccggttggaaaggggagctacctaaggccggaggctcgccggctcccggtcctgagacacctgccatctctccttccaagcgcgctaggccagctgaagtcggcggaatgcagcttcgcttcgctcgattgtctgaacacgccacagcacccacgaggggcagcgcgagagcagccggttacgacctgtattcagcttacgactatacaattcccccaatggagaaagctgtggtgaagaccgatatccaaattgcacttccaagcggctgctatgggcgtgtagcacctaggtccggtctggcagcaaagcacttcattgatgtgggcgctggcgtgatcgatgaggattacagaggcaacgtgggtgtggtgctgtttaactttggtaaggagaaatttgaggtcaaaaagggagacaggattgcccagctcatctgcgagcgcatattctaccccgaaatcgaggaagtgcaggctctggacgacactgagaggggctcggggggtttcggcagtaccggcaaaaattag

SEQ ID NO: 220617 - DNA, 495 bp, Artificial Sequence
  Description of Artificial Sequence: Synthetic coding sequence
atgccctgcagcgaggaaacccccgctatctccccatccaagagagctcggccagccgaggtgggcggtatgcagctaaggtttgccagactaagtgaacatgctacggcccctacacggggatcagcacgtgccgctggctacgacctgtattctgcgtatgactacaccatcccccctatggagaaagcagtggtcaagaccgacattcagattgcgttgccatcaggctgttacgggagggttgcccctaggtcaggacttgctgcaaagcactttatcgatgttggggcaggtgtcattgacgaggattataggggcaatgttggcgtggtactgtttaattttggcaaggagaaattcgaggtcaagaagggagaccggatcgcccaactgatttgtgaacggatattctatccagagatcgaagaggtccaagccctggatgatacggagcgagggtctgggggattcggttccactggtaagaattag

SEQ ID NO: 220618 - DNA, 426 bp, Artificial Sequence
  Description of Artificial Sequence: Synthetic coding sequence
atgcagctgcggtttgctaggctctccgagcacgcaaccgcccctacacggggttctgccagggcagcaggctacgatctctactccgcttacgattataccatacctccgatggagaaagccgtcgtcaaaactgacatccagattgcacttccaagcggctgttacgggcgtgttgcccctagatcagggctggccgcaaaacactttatcgatgttggagccggagtcatcgacgaggactatagggggaacgttggcgtggtactgttcaatttcggtaaggaaaagttcgaggtgaagaagggcgatcgaatcgcacagctgatttgtgagaggattttctacccagaaattgaagaggtgcaagcactggatgatacggagcgcggttctggagggttcgggtcgacagggaagaattag

SEQ ID NO: 220619 - DNA, 1056 bp, Artificial Sequence
  Description of Artificial Sequence: Synthetic coding sequence
atgcccctaaggaaacacagacagcattttaaaaaatatggcaactgttttaccgctggtgaagccgttgattggctgtacgatttgctcagaaacaattctaacttcggacctgaggtgacgaggcagcagacaattcagttgctccggaagttcctgaagaaccacgttatagaagatattaagggtcggtggggatctgaaaatgtggatgataacaaccaactcttcagatttcctgctacgagtcctttgaaaaccctcccaaggagaacccctaagagacacggcctgcatttgagccaggagaatggcgaaaaaataaagcatgagattattaacgaggatcaggaaaatgctatagacaacagggaactgagtcaggaggacgttgaagaggtttggcgctacgtgattctgatctacctgcaaaccattctgggggtcccctctctggaagaagtgattaaccccaaacaggttatcccacagtatattatgtataacatggcaaacactagcaaaaggggagtagtgattttacagaacaagtctgacgacttaccacactgggtacttagcgccatgaagtgtctggctaactggcctcgctccaatgacatgaataaccccacctatgtgggtttcgaaagagatgtctttcggaccatcgctgattatttcctggacctgccagaaccgctactgacattcgagtactacgagctgttcgtaaacatacttggcaattttaaggattttagatcctctataccagttgtttgtggatacattacagtttctgatcgctctagtggaatacacaagattcaggacgaccctcagagctcgaaattcctgcacctcaataatctgaactccttcaagtctacggagtgtctcttgctctctcttctgcatcgtgagaagaataaagaggagtccgacagtaccgagaggctccagatctcaaatccaggattccaggaaagatgtgctaaaaaaatgcagctcgtgaacctccgcaacagacgcgcttgctgcaatttgatctag

SEQ ID NO: 220620 - DNA, 1584 bp, Artificial Sequence
  Description of Artificial Sequence: Synthetic coding sequence
atggagtcacagggggtaccccctggcccttacagggccacaaagctgtggaatgaggtcactacttcgttccgcgctggtatgcctcttcgcaaacacagacagcattttaagaagtatggcaattgcttcaccgccggagaggcggtagattggttgtacgatctactgcgcaataactcaaactttggcccagaggtgaccaggcagcagaccatccaactcctacggaagttcctaaagaaccacgtgatcgaggatattaaggggaggtggggctctgaaaacgtggacgacaacaatcaactgttccgcttccccgcaaccagtccactgaaaacacttcctagacgctaccctgaactgcggaaaaacaatatcgagaacttcagtaaagacaaagactcaatcttcaagctgagaaacttgagtcgcaggaccccaaagaggcacggactgcacctgagtcaggaaaacggcgaaaagatcaaacacgaaataattaacgaggaccaggagaacgcgattgacaatcgggagctgagccaggaagatgtagaggaggtctggcgctacgtgattctgatctatctgcagacaatcctgggggtccccagtctggaggaggtgataaaccccaagcaggtgatacctcagtatataatgtacaacatggcgaatacgtcaaaaagaggagtcgttattctacagaataaaagcgatgatctgccccactgggtgttatccgccatgaagtgtctcgctaactggcctagaagcaacgacatgaacaatcccacttacgtcggctttgagagggatgtgttccggaccatcgctgactactttctggacttaccggagccactgctgacattcgaatactatgagttgttcgttaatattttaggcctcctccaacctcatctggaacgggtggccattgacgcactgcagctctgctgtctcctgctgcccccaccgaatagacggaaattgcagctgcttatgcgaatgatctctcggatgtcccagaatgtagacatgcccaagttgcatgatgccatgggcacaagaagcctgatgatacacactttttcaagatgtgtgctttgttgtgcggaggaggtggacctcgacgagctcctggccggtcgtctggtatcctttctgatggaccaccaccaggagatcctccaagttccatcgtacctgcaaacagccgtggaaaagcacctggattatctcaagaaaggccacattgaaaatccaggtgacggattatttgctcctctgcctacctactcctattgtaaacagatatccgctcaggagtttgacgaacagaaggtttcaacaagccaggcagctattgctgaacttctcgaaaatatcatcaagaataggtccctgccattaaaggaaaagcgcaagaagctgaagcagtttcagaaggagtaccctttaatttaccagaagaggttccctactacagagtcagaagccgctctgttcggggataagccaacaataaaacagcctatgctaatactgcgcaaacctaagtttagaagcctgagatag

SEQ ID NO: 220621 - DNA, 2436 bp, Artificial Sequence
  Description of Artificial Sequence: Synthetic coding sequence
atggagagccagggggtgcctccgggtccgtacagagccactaagctgtggaatgaagtgactacctcctttcgagctggtatgcccctccggaaacaccgccaacacttcaagaagtacggtaattgctttaccgccggtgaggctgtcgactggctctatgatctgcttagaaataactcaaacttcggccctgaggtgacgcggcaacagacaatccagctgcttaggaaatttctcaagaatcacgttatcgaagatattaaggggaggtggggttcggaaaacgtagatgataataaccaattgtttcgcttcccagccacgtctcctctcaaaaccctgcctcgcaggtatcccgagctccggaagaacaacatcgagaacttctccaaggacaaagacagcatcttcaaattgcgcaatttgagcaggcgcacacctaagcgtcacggcctgcacctgtcacaagagaatggcgaaaagataaagcatgagatcattaatgaggaccaggagaatgccatcgataacagagagctgtcccaggaggatgtcgaggaggtgtggagatatgtaatactcatttacctccagactatattgggggtgccctctttggaggaagtcataaatccaaagcaggtcatccctcagtacattatgtacaacatggctaacacttccaaacggggagtggtaatccttcagaataagagtgacgacttgcctcactgggttctgagcgctatgaaatgcctggccaattggccaagaagcaatgacatgaataatcccacatatgttggctttgagcgggacgtttttaggaccatcgccgattactttttagacttacctgagcccttactgacattcgagtactacgaactgttcgttaacattttggtagtctgcggttatatcactgtgagcgatcgcagctccgggatccataaaatccaagatgatccccagtcatcaaaattcctgcatctgaacaatttgaacagtttcaagtcaactgagtgcctgttgctcagcctgctccatagagagaagaataaagaggagagcgacagtactgagcgtttacaaatcagtaatcctgggttccaagaacggtgtgccaaaaaaatgcagctggttaaccttagaaatcgcagagtgtctgcaaatgacattatgggaggcagttgtcacaacttgataggactcagtaatatgcacgacctgtctagtaactccaaaccgcgttgttgctccctcgagggaatcgttgacgttcctggcaattcctcaaaagaggcgagttcagtgttccatcagtcatttcctaatatcgagggacaaaacaacaagttgtttctcgagtctaagcccaagcaggagtttttgctgaaccttcactcggaggaaaacatccaaaaaccattcagcgcgggtttcaaaaggaccagtacactgacagtccaggatcaagaagagctttgtaacggaaagtgtaagagtaagcagctctgtaggtctcagtctttgctgctcagaagtagtacccgcaggaatagctacatcaacactcctgtggccgaaatcattatgaagccaaatgtcgggcagggctccacctcagtacagacggctatggaatccgaactaggagaaagttctgctactatcaacaaacggctgtgcaagtccacaattgagctcagcgaaaatagtctcctgccggcttcttcaatgctgacgggcacacagtcattactgcagccccatctggaacgcgtggctatcgacgccctgcagctctgttgtcttctgctccctccgcctaatcgcagaaagctgcaactactgatgaggatgatcagcaggatgtcccagaacgtcgacatgccaaagttacacgatgcaatgggcacacgcagcctgatgatccacacgttctctagatgcgttctttgttgtgccgaggaggtcgacttggacgagctgttggcgggaaggctggtgtcttttctgatggaccaccatcaggagatactccaagtgccctcctaccttcaaacagcagtggagaaacacctcgactatctgaagaaaggccatattgaaaatcctggggacgggctgttcgcaccactccctacatactcgtactgcaaacaaatttccgcccaggagtttgacgagcagaaggttagcacttctcaggctgcgatagctgagctcctggaaaatatcatcaaaaacaggtccctgcccttgaaggagaagcgtaaaaaactgaagcagttccagaaagagtaccccctgatctaccagaagaggttcccaaccactgagtctgaggccgcactgtttggagataaaccaacaatcaagcagccaatgctcatcctcagaaagcccaaattccggtctttgcgctag

SEQ ID NO: 220622 - DNA, 1590 bp, Artificial Sequence
  Description of Artificial Sequence: Synthetic coding sequence
atggagcatcgtattgtcggacctggaccttacagagctacaagactttggaacgagactgtggagctgtttagagcaaagatgccactcaggaagcaccggtgtcgatttaagtcctacgagcactgttttaccgccgctgaggctgtcgactggttgcatgagttactgaggtgcagtcagaattttggtcccgaggtcacacgtaagcagacagtccaactgctcaagaaatttcttaagaaccatgtgattgaagatatcaaaggcaagtggggtgaagaagattttgaggataacaggcacctatacagatttcccccttctagccccttaaaaccttatcctaaaaagcctcccaaccaaaaagatgtcataaaattccccgagtggaatgatcttccgccaggcacaagtcaggagaacatacctgtgcggccagttgtgatgaacagcgaaatgtggtacaagcggcatagtatagcaatcggcgaagtgcctgcatgccggctggtccaccgcaggcagctgaccgaagcaaatgtggaggagatctggaaaagcatgacactgtcatatctccagaagatcctgggactggatagtctggaggaggttctggacgtaaaactggtgaattctaagttcatcatccacaatgtatactccgtcagcaagcagggagttgttattctggacgataagagcaaagaacttcctcactgggtgctgtctgccatgaagtgccttgcaaattggccgaattgttctgacctcaagcagcctatgtatcttggtttcgaaaaggacgtgttcaaaacgatagccgactattatggacaccttaaggagccacttctcacattccatctatttgatgcctttgtctctgtgctggggctgcttcagaaggagaaggtggctgtggaagccttccaaatttgttgcctgctcctgccgccagagaacaggagaaagctgcagctgttgatgcggatgatggcccgaatttgtttgaacaaggagatgccaccgctctgtgatggattcggaaccaggacacttatggttcaaactttttcccggtgcatcctctgcagcaaggatgaagtcgatttagacgaactgcttgctgcaagactggtgacttttcttatggataactaccaggaaatcctgaaagtgccactggccctgcaaacatcaattgaggagagggtggcacacctgaggcgcgtacagatcaaatatcccggtgcagatatggatatcaccctgtccgccccttcattttgccggcagatctctccagaggagtttgagtaccagagatcatatgggagtcaggaacctctggcggctctcctggaagaggtgattactgacgcaaagctgagcaacaaggagaagaagaaaaagctgaagcagttccaaaaatcctaccctgaggtataccaggagcgattccccacgcctgagtccgccgcacttttattccctgaaaaaccaaaacccaagccccagctcctgatgtgggcgctgaagaaaccgtttcagcccttccagaggacccgtagcttccgcatgtag

SEQ ID NO: 220623 - DNA, 1404 bp, Artificial Sequence
  Description of Artificial Sequence: Synthetic coding sequence
atggaacaccgcattgtagggcctgggccataccgcgctacccggttgtggaatgagacagtggagctgtttagggccaagatgccacttcgcaagcatcgatgtcgctttaaatcttacgagcattgttttactgcagctgaagcagtcgactggcttcatgaactcttaaggtgcagccagaatttcggccctgaggtgacccggaagcagaccgtccagctcttgaagaaatttttaaagaatcacgtcattgaagacattaaggggaagtggggagaggaagactttgaagacaatcggcacctgtaccggttccctccctcctcaccgcttaaaccgtatcctaagaaacccccaaaccaaaaagatgttattaagtttcccgagtggaacgacctgccccctggtacaagtcaggagaatatccccgtgaggcctgtcgtgatgaactcggagatgtggtacaagcgtcactccattgctatcggggaggtgccggcttgccgcttggtccatcgcaggcagcttaccgaagccaatgtcgaagagatatggaagtcaatgactctctcgtacctccagaaaattcttgggctggatagcttagaagaggtgctcgatgtcaagcttgttaacagcaagtttatcattcacaatgtatattcagtcagtaagcagggtgtggtgatcctggatgataagtccaaggaactgccacattgggttttgtcagcgatgaagtgtctggccaattggcccaactgctcggacctgaagcagccaatgtacctggggtttgagaaagacgtattcaagactatcgcagattactatggtcacctgaaggagcccctgctgaccttccacctatttgacgcatttgtgtccgtactgggcttgctgcagaaagaaaaagtggccgttgaagcttttcagatctgttgtttgctcctccctccagagaaccgaagaaaactgcaactgctgatgcgcatgatggctaggatatgtctgaataaagaaatgccgccattatgcgacggctttggcacacggactcttatggtgcagacttttagtaggtgtatcctgtgttccaaggacgaggtggacctggacgagttgttggctgcccgtctggtcacctttcttatggacaattaccaggagatcctgaaggtgcccctcgctttacagacaagcattgaagaacgcgtcgctcaccttaggcgcgtgcagttccagaagtcctatccagaggtgtaccaggagaggttccccacacccgagtcagccgcactcctttttcccgaaaagcccaagcctaaacctcagctgctaatgtgggcactcaagaagccattccagccattccagagaacccgctcgtttcgcatgtag

SEQ ID NO: 220624 - DNA, 1323 bp, Artificial Sequence
  Description of Artificial Sequence: Synthetic coding sequence
atgcctctgcgaaaacaccggtgccggttcaagtcctatgagcattgtttcacggctgcagaagcagttgactggctccatgaattgctgcgctgctcacaaaacttcggccctgaagttactaggaaacaaaccgtccagctgctgaaaaagtttctcaaaaaccacgtgattgaggatatcaaaggcaagtggggggaggaagacttcgaagataaccgacacctgtacagatttcctccctccagcccattgaaaccttatccgaagaaaccccctaaccagaaggacgtcataaaattcccagagtggaacgacctaccgcctgggacgagccaggaaaacattccggtccgtccagtggtgatgaatagcgagatgtggtacaagcgccattcgattgccattggagaagtacccgcatgccgattggtgcacaggagacagctgactgaggctaatgtggaggagatatggaagagcatgaccctcagttatctgcaaaaaatcctcggtttagattcacttgaggaagtgttggacgttaagttagtgaacagtaagttcattatccacaacgtttacagcgtgtccaaacagggggttgtgatactagatgacaaatctaaggagttaccccactgggttttgtcagccatgaaatgccttgccaactggccgaactgtagcgacctcaagcagcctatgtatctgggctttgagaaagacgttttcaagacaatagccgactactacggccacctgaaagagcccctgctgactttccatttgttcgatgcttttgtgtctgtgcttggacttctgcagaaggaaaaagtggcagtagaggcctttcaaatttgctgcttgttgcttccgccagaaaatcgacggaaattacagctccttatgaggatgatggccaggatttgcctaaataaggagatgccccctctgtgtgacggattcgggactcggactctgatggtccagacgttctcccgctgtatcttatgttcaaaggacgaagtcgatctggacgagttattggcagcgagactggtcacgttcctgatggataattaccaagagattctcaaagtcccgctcgctctgcagacatccatcgaggagcgcgtggcgcatttacggagggtgcagttccaaaagtcctatcccgaggtgtaccaggaacgctttccaacaccagagtcggcagcgctccttttcccagaaaagccaaaaccaaaaccgcagcttctgatgtgggccctgaaaaagccctttcagccattccagcgcacccggtctttcagaatgtag

SEQ ID NO: 220625 - DNA, 4746 bp, Artificial Sequence
  Description of Artificial Sequence: Synthetic coding sequence
atgcggacgaccaaagtttataagctggtgattcacaaaaagggcttcggcggttcagacgatgagcttgttgttaacccaaaagtatttccccacatcaagctgggggacatagtcgagatcgcacaccccaacgatgagtactcccccttactgctccaggtgaagtcactcaaagaggacctccaaaaagagaccatctcagtggatcagactgtaacacaggtcttcagactgcggccttaccaagatgtgtatgtgaatgtcgtggatcctaaagatgtgacattagacctggtggagttaacattcaaggatcagtatatcggcagaggcgatatgtggcgacttaagaaaagcctcgtgtccacatgtgcctatattactcagaaggtcgagttcgccggtatccgggctcaagccggagagctgtgggtaaagaatgagaaggtaatgtgtggatatatttccgaggataccagagtggtgttccgatctacatccgctatggtgtatatctttatccagatgtcttgtgaaatgtgggacttcgatatctacggcgacctgtattttgagaaagccgtcaatgggttcctggccgatctctttacaaaatggaaagagaaaaattgttctcatgaagtgactgtggtccttttcagccgcacattctatgatgccaagtctgttgatgagttcccggagattaatcgcgcttcaattagacaggaccacaaaggcaggttttatgaggatttctacaaggttgtagtgcagaatgagagacgggaagagtggaccagtctgctcgtcacaatcaaaaaactcttcatccagtacccggttttggtgagactggaacaggcagagggcttccctcagggtgacaattctacaagcgctcagggtaattatctcgaggcgatcaatctttccttcaacgtatttgataagcattatattaatcggaatttcgatagaaccgggcaaatgtcagtcgtcatcacacccggtgtgggggtctttgaggtggaccgcctattaatgatactcaccaaacaaagaatgatagataacggcattggcgtggatttggtgtgtatgggtgaacagcctctccatgcggtgccactgtttaagctccataacagatcagcccctagggactctaggctcggagatgactacaacatcccacactggattaaccattctttttataccagcaagagtcaactgttctgtaattctttcacgcctagaatcaaactggctggcaaaaaacctgcaagcgaaaaggcaaagaacggcagagatacaagcctcggctcccctaaggaatccgagaacgctctgcccattcaggtggattatgatgcttacgacgcgcaagtgtttcgcttgcctggacctagccgggctcaatgccttaccacgtgccggtctgtgagggagagagagagtcatagccgaaagtccgcatcctcatgtgatgtgtcctctagtcctagcctcccctcaaggacattgcctaccgaagaggtgcgatcacaggcgtctgacgactccagcctgggaaaaagcgcgaacatcttgatgattccccacccacacctccatcagtacgaggtcagcagctccctgggttataccagcacacgtgatgttctggagaatatgatggagcctccccagcgtgacagcagtgctcctggcagatttcatgtcggcagtgcagagtcaatgttacacgtccgcccaggcggatataccccacagagagcattgattaacccttttgctcctagtcggatgcccatgaaacttacaagcaacaggcgcaggtggatgcacacatttccagtaggaccctctggcgaggctatccaaatccatcaccaaaccagacagaatatggccgagctacagggcagcggacagcgggaccccacacactccagcgcagagttgctggaacttgcctaccacgaagcggctggacgccattctaatagtagacagcccggagacgggatgtcattcttaaacttctcaggcaccgaggagttatccgtcggcctactgtccaacagtggcgcaggcatgaatccacgtacccaaaataaagactctctggaggattccgtctcaacttcaccagatcctatactcaccctttcagcacccccagttgtgccagggttctgctgtactgtcggcgtggactggaaatcactgaccacccccgcttgtctgcctcttaccacagactacttccctgatcggcagggattacagaatgactacactgaaggatgctatgatttacttccggaggcggacatagacagacgcgatgaggatggcgtgcaaatgactgcccagcaagtttttgaggagttcatctgtcagcgtctgatgcaggggtaccagatcatcgttcagccaaagacccagaaacccaacccagccgtccctccgcctctgagtagctcaccgctttactctcgcggtcttgtgagtcgtaataggcctgaagaggaggaccagtactggctctccatgggcagaacatttcacaaagttaccttaaaggacaagatgatcaccgttactcggtaccttcctaagtacccttatgagagcgcacagattcactatacatattctctctgtccgtctcacagcgactccgagttcgtgtcttgttgggtggagttctcccacgagcgacttgaggaatacaagtggaattacctggaccagtacatctgttctgccggaagtgaagatttcagtttgatcgagagtctgaagttttggcgtacgagattccttctgctgcccgcatgcgttacagcgactaagcgcatcaccgagggtgaggctcattgtgacatttacggggacagaccacgtgccgacgaagatgaatggcagttactggacggcttcgtgcgattcgtggagggccttaatcggatcagacggcgtcataggagtgatagaatgatgagaaaggggaccgcaatgaagggactgcagatgacaggcccaatcagcacccactctcttgagtcaaccgctccacctgtcggaaaaaagggaactagcgccctgtccgccttactggagatggaagctagtcaaaagtgtctgggagagcagcaagcagcagttcatgggggaaaatcgagcgctcaatcagcggagtccagtagcgtggccatgacacctacatatatggactcaccacgcaaggtctccgtcgaccaaacagcaactccaatgctggatggtacctctcttggaatttgcactggacagtctatggacagaggaaattcgcagacattcggcaatagccaaaatattggggaacagggctattcttctaccaattcctcagattcttcatctcagcagctcgtggcgtccagtcttacatcctcctccacactaactgaaattctggaggcgatgaagcacccaagcactggagttcagctgctcagcgagcagaaaggcctttcaccttattgcttcatcagtgctgaggtggttcactggttagtcaaccatgtggaggggatccagacccaggcgatggccatcgacattatgcagaagatgctcgaagagcagctcattactcacgcttctggcgaggcttggcgtacttttatctacggattttacttttacaaaatcgtgaccgacaaagagcctgatagggtggccatgcaacagccagcgactacttggcacacagctggcgtagatgactttgcgagtttccaaagaaagtggttcgaggtggccttcgtggctgaggaactggtccactctgagataccggcatttctcttgccatggctcccaagccggcctgcctcatacgcctcccggcatagttcatttagtcggtcattcggaggccgaagtcaagccgctgcgctgctggcagcgaccgtgcccgaacaaagaaccgtgaccctggacgtcgatgtgaacaaccggactgaccgcctggaatggtgttcctgttactatcacggtaatttcagtttgaatgctgcattcgaaatcaaactgcactggatggccgtgaccgcagcagtgcttttcgaaatggtccagggatggcatcgtaaggccacctcgtgcggctttctcctcgtgcctgttctggagggaccatttgccttaccctcttatctatacggcgaccccctgagagctcaactgttcatccccctgaacatctcgtgtctgctgaaggaaggatcggagcatctcttcgattcctttgagcctgagacatactgggaccggatgcatctcttccaggaggcaattgctcatcgattcggttttgtgcaggataagtattctgccagcgcgttcaatttcccagcggagaataagccccaatacatccacgtgactggcaccgtatttttacaactgccctacagcaaaaggaaattctcgggccagcagaggagaaggcgaaattcaacctcttccaccaatcaaaacatgttttgtgaagagcgggtgggatataattgggcctataatacgatgctgacaaagacatggcgctcctcagcaacaggagatgagaagttcgctgacaggctccttaaggactttactgatttctgcattaacagagacaataggctcgtgaccttctggacaagttgcctcgagaagatgcatgcttctgccccatag

SEQ ID NO: 220626 - DNA, 3690 bp, Artificial Sequence
  Description of Artificial Sequence: Synthetic coding sequence
atgaggacgaccaaggtctataagctggttatccataaaaagggcttcggaggcagcgacgatgaacttgtagtgaatcccaaggtattccctcacatcaaacttggcgacatcgttgaaattgcacatccaaacgacgaatactcccctctgcttttgcaggtcaagtcactgaaagaagatttacagaaagaaactattagtgtcgaccagaccgtgacgcaagtcttccggttgaggccctatcaggatgtgtacgttaacgtcgtggatccaaaagatgtgaccctggacctcgtcgagttaacatttaaggatcagtatatcggacggggtgacatgtggcggctcaagaaaagtctcgttagtacatgtgcttatatcacgcagaaggtggagttcgccggaattcgcgctcaggcaggcgagctctgggtcaagaatgaaaaggttatgtgcggatacatctctgaggacactagagtcgtatttcgaagtacttccgcaatggtatatatatttattcagatgagttgtgaaatgtgggactttgacatttatggcgatctttacttcgagaaagccgttaatggattcttggccgacctgtttactaagtggaaagaaaagaactgctcacatgaggttaccgttgtgctgttcagtaggacgttctacgatgctaaaagcgtggatgaatttcccgagattaaccgggcaagtatacggcaagatcacaagggacgcttctacgaggatttctacaaggtggtggtgcaaaatgaacggcgagaggagtggacctcattgttggtcacgatcaagaaactgttcattcagtacccggtgctcgtccgtctggaacaggcggaggggtttccacagggcgacaatagcacatccgcccaaggcaattacctggaggcaatcaacctgtcatttaacgttttcgacaaacactacataaacaggaatttcgatcgaaccggccagatgagcgtggttatcactcccggagtcggggtgttcgaggtggatagactgctgatgatcttgacaaagcagcggatgattgataacgggatcggagtggacctcgtctgcatgggagaacagccgctccacgccgtcccattattcaagcttcataaccgtagcgcgccaagggattccaggttaggcgatgactataatataccccactggattaatcattctttctacacttccaaaagtcaactgttttgcaattcattcacgccacgaatcaaattagccggtaagaagcccgcttctgagaaggccaagaacgggagggacacttcgttggggtcacccaaggaaagtgagaacgccctgcctatccaggtggattacgacgcgtatgacgcccaagtgttccgcttgccaggcccttctcgtgcccaatgtctgactacttgtcggagcgtacgcgaaagggagagccacagcaggaaatccgccagttcatgtgacgtctcctccagcccaagccttcccagtagaaccctgcctactgaggaagtacgtagccaggccagtgatgactcaagcctaggaaagtccgcgaatatcctgatgatcccccacccacacctgcaccagtacgaggtatccagctcactcggctacacctcaacaagagatgttcttgaaaacatgatggagccgcctcagagggacagctccgctcccggaagatttcacgtaggatccgccgagtccatgcttcacgtgcgccctggcggatacaccccccagcgagccctgatcaatccgtttgccccaagccgaatgcctatgaaattgactagcaataggcgccgatggatgcacaccttcccagtgggaatgaacccaagaacccagaataaggacagcttagaagatagtgtatcaacgtccccggaccctatcctgacgttatcggccccaccagtggtgcctggtttctgttgcaccgttggggtagactggaaatccctgacaactccggcatgccttccacttacaactgattattttcccgatagacagggcttacaaaacgattatacggaaggctgttatgatcttttgccagaggctgacatcgatcggagggacgaagacggggtgcagatgacagcacagcaggtcttcgaagagttcatttgtcagcggttgatgcagggctatcagatcattgtccaacctaagactcagaagcccaatccagcggtccctcccccactcagctccagcccactgtacagtagaggactagtatcccggaacagacccgaggaggaagatcagtactggctgtcaatgggcagaactttccacaaggtgaccttgaaagacaagatgataaccgttacaaggtatttacccaagtatccatatgaatctgcccagatccactatacgtactcactctgtccctctcatagcgactcagagttcgtgtcttgttgggtggaattctcccacgagaggctggaggaatataagtggaattacctcgaccagtacatctgctctgctgggagcgaagatttcagtctgatcgagagtctgaaattctggcgcacaaggtttctactcttacccgcttgtgttacagccacaaagcggatcactgagggagaagcacattgtgatatatacggcgatcgccctcgggctgatgaggatgagtggcagctgctagatggtttcgttaggtttgttgagggcctgaacagaatccgacggcgacacaggtcggaccgcatgatgaggaaaggaaccgcaatgaaagggttgcagatgactggccctattagcacacactcactggaatctacagcccctccagtgggcaaaaaagggacctccgccctctccgcacttttggagatggaggcctctcagaagtgtctgggggaacagcaggccgcagtccacgggggtaaaagctcagcgcagtctgctgagtcctcctctgtcgcgatgactccaacatacatggacagcccccgtaaagatggggcattcttcatggagtttgtaaggtcccccaggactgcatccagtgcattctatccccaagtgtccgtcgaccagaccgcaactcctatgctcgatgggacttcccttggtatttgcaccggccagtctatggaccgcggaaattcacagactttcggtaattcacaaaatattggggaacagggctactcatcaaccaactcctctgacagctcctcacaacaactggtggccagctcattgacaagtagtagcacgctgacggagattctcgaagcaatgaaacacccctctaccggcgtccagcttctttctgagcagaaaggattgtctccctactgcttcatcagcgcagaggtggtgcattggctagtgaatcacgtggaggggattcagacacaggccatggcaatcgatatcatgcagtggccatgctcgtcccccccaccacccggaactcagcaggagtggacgacctcacccgcttctagcgcttctggcctgcggtggccgttatggcagaaatcgtcttgcaccctgcgcttccttcctttcagctgtcctggatgtctcgccggacaacccccaatgcaggtaggaaccgctccactcgcagaggtccttgaagatggggcaagacgccaacatttttag

SEQ ID NO: 220627 - DNA, 4512 bp, Artificial Sequence
  Description of Artificial Sequence: Synthetic coding sequence
atgagaaccacgaaggtatataaactggtgattcacaagaagggtttcgggggatcagatgacgaactcgtcgtcaatcccaaggttttccctcacataaaacttggcgacatcgtagaaatcgcgcaccccaatgacgagtatagtcctcttctactccaggtgaagagtcttaaggaggacctacagaaagagactatatccgtagaccagacagtcacccaggtgttccggctacggccataccaggacgtctatgtgaacgtcgtcgaccctaaagacgttactctagatttggtcgaactcaccttcaaggaccagtatattggacgcggagatatgtggagactgaagaaaagtttggtttcaacatgcgcatacatcactcaaaaggtcgaatttgccggaattagagcccaggctggagagttatgggttaagaacgaaaaggtgatgtgcggttatatttcagaggacacaagagtggtctttagatcaactagcgccatggtatatatctttatccaaatgagctgcgagatgtgggacttcgatatttatggtgacctgtatttcgagaaggccgtcaatgggttcctagcagacctgttcacaaaatggaaagaaaagaattgcagccacgaagtgacggttgtcctcttttcaagaactttttacgatgcaaagtccgtcgatgaatttccggagataaatcgagcctctattcgacaggatcacaagggaagattttatgaggacttctataaagtggtcgtccagaatgaaagacgcgaggaatggacttccctgctcgtgaccataaaaaagctgtttatccagtaccctgtactggtacgcttagaacaggcagaaggtttcccccagggggacaattcaacgtccgctcaggggaactacctcgaggcaatcaaccttagcttcaacgtcttcgacaaacactacattaaccggaacttcgatagaacgggacaaatgagcgtggtaatcacgccaggagtcggcgtgtttgaggtggacagattgctgatgattctgacgaagcagcggatgattgataacggtatcggagtggatctggtgtgcatgggggaacagccattgcacgccgtacctctgttcaagttacacaataggagtgctcccagggactctcgcctgggtgatgactataacatcccacactggattaaccactcattctatacttcaaaaagccaattattttgtaatagcttcactcctagaattaagctcgcgggaaaaaagcctgccagcgaaaaagccaagaacggtcgagacacgtctttaggctcgcccaaagaaagtgagaacgccttgccaatccaggttgactacgatgcctacgatgcccaggtattccgccttcctgggccatcccgagctcagtgccttacaacttgtcgatcagtgcgggagcgagaatctcatagccgaaaatctgcttcttcctgcgatgtgagcagctcaccatcactgccatctcgcaccttgcctaccgaagaggtaaggtcacaggcctccgacgattcaagccttggtaaaagcgctaatattcttatgattccacacccacatttacatcagtacgaggtatctagctctcttgggtatacctctacccgcgatgttctggagaacatgatggagccacctcaaagggattcctctgcgcctggccgatttcatgtggggtcggctgagagtatgttgcacgtgaggccaggaggctacacaccacagcgcgcattgatcaatccctttgcgccttcgcgtatgcccatgaagttgacaagcaatcgtcggagatggatgcacacctttcctgtcgagacctcttgcttttatcttagcatcggtatgaaccccagaacgcagaataaagacagtctggaggactcagtctccacttctccagatcctatgcccggattctgttgcacggtgggagtggactggaagagcctgaccacccctgcatgtttaccacttacgactgattatttcccagaccgccagggcttgcagaatgactacacagagggctgctacgatcttctcccggaagcagacatcgatcggagggacgaagacggagtgcagatgactgcgcaacaagtgttcgaagaattcatatgtcagagactcatgcaggggtaccaaatcatcgtgcagccgaagacacagaagccgaatcccgctgtcccccctcccctgagtagcagtccgctttattcacggggtctcgtatcccgcaacaggccagaggaagaagaccaatattggctgtctatggggagaaccttccataaggtgaccctgaaagataagatgatcaccgtcactaggtaccttcccaagtacccctatgagtctgcccagatccactatacgtacagcttgtgtccatcccactctgacagcgagtttgtgagctgttgggtggagtttagtcacgagcggcttgaagagtacaaatggaactatctggatcagtacatttgctccgcgggatctgaggacttctcacttatcgagagtttgaagttttggcggacccggttcttacttctccccgcatgcgtcacagctactaagcgaattactgagggcgaagcacactgcgatatatacggggaccgaccccgagccgatgaggacgagtggcagctcttggacggattcgttagattcgtggaagggctcaataggatccgcaggcggcacaggagcgaccgaatgatgcgtaaaggtaccgctatgaagggcctccagatgaccgggcctatttccacccacagtctggaaagcaccgcccctccggttggcaagaaaggcacttccgcgctgagtgcgctgctggagatggaggctagccaaaaatgcctgggtgaacagcaggcggctgtacacgggggaaaaagctctgcccagtcagccgagtcttcaagtgtggcgatgactccaacctacatggacagcccaagaaaggtgagtgtcgaccaaactgcgactcccatgttggacggcacgagtctgggaatttgcactggtcaaagtatggataggggcaattcgcagacctttgggaactctcagaacataggtgagcagggctacagttcaaccaattcctctgattctagttcccaacagctggtggccagcagtctcacctcctctagcaccctgacagaaatcttagaagccatgaagcatcctagcaccggtgtgcagctgcttagcgagcagaaaggcctgtctccttactgttttattagtgccgaagttgtgcactggctcgttaaccacgtggaggggatccagacccaagcaatggcgatcgatatcatgcaaaagatgttagaagaacagctgatcactcatgcaagtggtgaggcgtggcgaactttcatctacggattctacttctataaaatagtgaccgataaggagcctgacagagtggctatgcagcagcctgccaccacttggcatactgccggagtcgacgattttgcaagcttccagcgcaagtggtttgaggtggccttcgttgctgaagagttagtgcactccgagattcctgcgtttttactcccctggctcccgtcccggccagcttcttacgcctcccgtcactcgagctttagcaggagttttggaggccgatctcaagccgcagctctcctggcagccacagtgcctgaacagagaactgtcactctggatgtcgacgtcaacaaccggacagaccgactcgagtggtgtagttgctattaccacgggaactttagcctcaacgcagccttcgagatcaaacttcactggatggccgtgacagctgctgttttatttgagatggtgcaggggtggcaccggaaagcaacgtcttgcggattccttctggtgcccgtgctcgaagggccattcgcgctcccatcttatttgtacggcgatcctcttagagctcaactctttatccctctgaacatttcctgccttctcaaggagggctccgagcatctgttcgactcttttgagcccgagacctattgggatcgaatgcatttattccaggaagccattgcccaccggtttggctttgtccaggataagtattcagcaagtgcgttcaacttcccagccgagaataaaccacagtacatccacgtgacgggaacagtattcctccagctgccctactctaaacggaagttctccgggcaacagcgacgaagaagaaattccaccagtagtacaaatcaaaatatgttttgtgaggaacgggtagggtacaactgggcttataatactatgctcaccaaaacatggagatcatctgcaactggcgatgagaaattcgccgaccgcctgctgaaggatttcacagatttctgtatcaatcgcgataacaggttagtgaccttctggacttcgtgcctcgaaaagatgcacgctagcgcaccttag

SEQ ID NO: 220628 - DNA, 1680 bp, Artificial Sequence
  Description of Artificial Sequence: Synthetic coding sequence
atgcgaaccacgaaagtgtacaagcttgtgattcacaagaagggttttggaggaagcgatgacgaactggttgtcaatccaaaagtttttccccacatcaaattaggcgatattgttgagatcgcccatccaaatgacgagtactcgccccttcttttgcaggttaagagccttaaagaggatctgcaaaaagaaaccatctctgtggaccagaccgtgacgcaggttttcagactgaggccataccaagatgtctacgttaatgtggtggatcccaaagatgtcactctagacctggtcgaacttacgttcaaggaccagtatatcggtcggggagatatgtggcggctgaagaagagcctcgtctcaacctgtgcttatattacgcagaaggtggaattcgctgggattcgggcacaggctggggaactttgggtaaagaacgaaaaggtgatgtgtggctatatatcagaggatacacgagttgtcttcagatccacttctgcgatggtgtacatcttcattcaaatgagctgcgaaatgtgggacttcgacatctatggggatctttattttgagaaagccgtaaacggtttcctggcggatctttttaccaagtggaaagaaaagaactgcagccacgaggttactgtagtcctcttcagcaggactttttatgatgcaaaatccgtggatgagtttccagagataaacagagccagcatccgccaagatcacaagggaagattctatgaggacttctacaaggtagttgtacagaacgaacgtagagaggagtggacaagcctgctggtcacaattaagaagctctttatccagtatccagttctcgtgagattggagcaggcggaggggttcccacaaggcgacaactcaacctcagcccaggggaactacttggaggccatcaatctcagtttcaatgtttttgacaagcactatattaacagaaactttgaccgaacggggcagatgtccgtcgttattactccaggggtaggtgtgtttgaggttgaccgcctgttgatgatcttgaccaaacaaaggatgatcgataatggcatcggtgtggacctggtttgcatgggggaacagcctctgcacgcagtgccactgtttaaactccacaaccggtccgcaccacgcgacagtagattaggcgacgactacaatattcctcactggattaaccatagtttttacacttcgaagagccagctattttgcaattcatttacacccaggataaagctcgcaggaaagaagccagcgtccgagaaggccaagaacgggagagacaccagtctcggctccccgaaggagtccgagaatgccttacccatacaggtcgattatgatgcctacgatgcacaggtattccgactgcctggtccctcgagagcccagtgcctcactacctgccgatctgtgagagagcgcgaatctcactccagaaaaagcgcgagcagttgcgacgtctcgtctagtccatctctgccctcgcgaaccctccctacagaggaggtgaggtcacaagcgtcggacgattccagcctcggcaagtcagccaacatattaatgataccacacccccatctgcaccaatatgaagtctctagcagcctgggttatacaagtacacgggagcatctgggttag

SEQ ID NO: 220629 - DNA, 4659 bp, Artificial Sequence
  Description of Artificial Sequence: Synthetic coding sequence
atgcggacaaccaaagtttacaagttggtaatccacaagaaaggttttgggggaagcgatgacgagctggtggtcaaccctaaggtatttcctcatataaagctgggtgatatcgtagagatcgcacatccaaacgacgagtactcccccctgctgctgcaggtgaagagcctgaaggaagacctgcagaaggagacaatctccgtggaccagaccgtgacccaggtctttcgcctgaggccttatcaggacgtgtatgtcaatgttgtcgacccgaaagacgtgacactcgatttggttgaattgacatttaaggaccagtatattgggaggggagatatgtggaggctgaaaaagagtctggtgagtacttgtgcctacattacccagaaagttgaattcgcaggcattagagctcaggccggtgagttgtgggtgaagaacgagaaagttatgtgtggctacatctctgaagacaccagagtggtattccgtagcacatccgcaatggtttacatatttatccagatgtcatgtgaaatgtgggattttgatatctatggtgatctttattttgaaaaagctgtaaacggtttcctggctgatttatttaccaaatggaaagaaaagaattgcagtcacgaggtaaccgtagttctgttttcaaggaccttctacgatgcgaagtctgttgacgaattccctgagattaatagggctagcatccgccaggaccacaaggggaggttttacgaggatttttacaaggtagtggttcagaatgaaaggcgcgaagagtggactagcctgctcgtgactatcaagaagctgtttatccagtatcctgtactggttcgcttggagcaggccgaggggttcccgcagggcgacaatagtacctcagctcaaggcaactacctggaggctattaacctgtcctttaatgtgttcgacaaacattacataaatcgtaactttgataggaccggccagatgagtgtggttattactccaggagtaggggtgttcgaggtggataggctcctgatgatactcacaaagcagcggatgattgacaacggcatcggcgtggaccttgtctgtatgggcgaacagccgctgcatgccgttccgctgttcaagctgcataacaggagcgccccacgggacagtagactgggagacgactataacattccacattggatcaaccacagcttctacactagtaagagccagctgttctgcaactcattcacaccacggatcaaattggctggcaagaagcctgcctctgagaaggctaagaacggccgtgacacctctcttggatcgcctaaggaaagcgagaacgctctgccaatacaggtagactatgacgcttatgatgcacaagtgttccgtcttccagggccaagccgggcacagtgcttaaccacctgtcgctcagtcagggagcgcgagtcccacagccgtaaatctgcttcaagctgcgacgtctcctcgagccccagcttgcccagccgcactttacccactgaagaagtgcgaagtcaggcttccgatgattcttcgctcggcaaatctgctaatatcctaatgataccccatcctcatttacaccagtacgaggtgagcagtagcctaggatacacttctacgcgggacgtgctcgaaaatatgatggaacctccgcaaagggactcgtccgccccaggaaggttccacgtgggctctgccgaatcaatgctgcatgttcggccaggtggctacacgccccagcgcgctctgatcaatccatttgcaccctcgcgaatgcctatgaagctaacttcaaacagacgcaggtggatgcacaccttccccgtgggtccctccggcgaggcaattcaaatccatcaccagacacgccagaatatggccgagctccaggggtccgggcagcgcgatcctacacattccagcgccgagctgttggagctcgcctatcatgaggctgcaggcagacattctaatagcagacagcctggtgacgggatgtcttttctgaattttagtggaaccgaagaattgtccgtggggctgctgtccaactcaggtgcaggaatgaacccacggacacaaaataaggactcactggaagattcagtatctacgagtcctgaccctattttgacattatccgctcctcctgtggtacctgggttttgctgtaccgtgggcgtagactggaagtcactaaccacaccagcctgcttgccactgactacagattatttcccagaccgccaggggctccagaacgattacacagaaggatgctatgatctactgccggaggcagatatcgacagaagagacgaagatggggtccagatgaccgctcagcaagtctttgaggagtttatttgtcagcgcctgatgcaaggctatcagatcatcgtgcaacccaagacccagaaaccgaaccccgcagtgccaccccctctctccagcagtcccctgtactcacgtggactggtgtcccggaatcggcctgaagaagaagaccagtactggctctcgatgggcagaactttccacaaggttactctaaaggataaaatgataacagtgactagatacctgcctaagtacccatacgaatctgcacaaatccattacacatattctctctgcccatctcattctgattctgagtttgtgtcatgttgggtggagttcagccacgagcggcttgaggaatacaagtggaactacctcgaccagtatatctgttctgccggttccgaggatttttccctgatcgagtcattgaaattctggcggacaaggttcctactactccccgcttgtgtcacagctacaaaaagaatcactgaaggggaagcccattgcgacatttatggcgaccgccctagagcggatgaagacgaatggcagctactcgacggctttgtgcgtttcgtggagggtctgaaccgaattcgacgtaggcataggtcagaccgtatgatgcgcaaaggcactgcgatgaagggactgcaaatgacaggtccaattagtacccacagccttgagtctactgccccacctgttgggaagaagggaacgtccgctctttctgcccttctggaaatggaggcatcacagaagtgtctaggggagcagcaagccgctgtgcatggagggaagtcctccgctcagtcagctgagagttcaagtgtggccatgacacctacttacatggatagtccccgtaaagacggagccttcttcatggagtttgtgcgatcccccaggaccgccagcagtgccttctaccctcaggttagtgtggatcagaccgcgacgccaatgctggatggaacctcgctcgggatttgcaccgggcaaagtatggaccggggaaattcccagacatttgggaacagtcagaatataggggagcaggggtattccagcacgaattcatcggactcttcaagtcagcagctggttgccagttctcttacctccagcagtacgttaacagagatactcgaggctatgaagcatccctcgacgggggtgcagctgctgagtgagcagaagggattgtccccctattgtttcatcagcgccgaagtcgtccactggctggtaaaccatgtcgaggggatccaaacgcaggctatggctatagatatcatgcagaagatgctggaggagcagctgatcactcacgcctcaggagaggcctggcgcacctttatctatggattttacttttataaaatcgtaacagacaaagaaccagaccgagtggcaatgcagcagcccgcaactacctggcacactgcgggtgtggacgactttgcatcgttccagagaaaatggttcgaggtcgcctttgtggcggaggagttggtgcactcagagatccccgcattccttttgccatggttacctagccggccagcttcatatgcgtcacgccattcctcattcagccgcagtttcggtgggaggtcacaagcggcagctttgttagcagccacagtgcctgaacaacggaccgtgacgttggatgtggatgtgaacaacaggactgacaggctggagtggtgtagctgttactaccacggcaacttcagcctcaatgctgcctttgagataaaattacactggatggcggtcactgccgctgtgctctttgaaatggtgcagggttggcaccgtaaggctacaagttgcggctttctgctggtaccagtgctggaaggcccattcgccctgccaagttatctgtacggggacccactcagggctcagttgtttattcccctcaacatctcatgcctcctaaaagaagggtccgaacacctgtttgacagcctaggtctgtacaagattaacatcctacccctgctcctcacatccctgctgagaacatcactgtcgatttcaaccttacaagagcagtgcttttgtagttgtccaacaccgtcagcaagcagccagggaagctcggggggagggggaacgccgcctgcccctcccactcgcacatgctcagccagaagcggctccgcaaccacgggccctaccaccccctgtagccccaagcatggagctccggcaccccagggaatgaagagtctcctgataggatgttag

SEQ ID NO: 220630 - DNA, 4719 bp, Artificial Sequence
  Description of Artificial Sequence: Synthetic coding sequence
atgcgaaccacaaaagtgtataagttggtcatccacaagaaggggttcggaggatcagacgacgaactggtcgttaaccctaaggtctttccccacattaagctaggcgatatcgtggagatagcgcatccaaacgatgaatattctcctttactgctgcaggttaaatccttgaaggaggacctccaaaaggagacgatatccgtcgaccagacagtcactcaggtgttccggctcagaccgtaccaggacgtctacgtgaacgttgtggatcctaaggatgtgacccttgacctggtggagctcacattcaaagatcaatacataggtaggggggacatgtggcgactaaagaaatctctcgtgtcgacgtgtgcctatattacacagaaagttgagttcgcaggcatccgggcacaagccggtgagctgtgggttaaaaatgagaaagttatgtgtgggtacatttctgaggacactcgggtggtgtttcgctcaacatctgcaatggtatacatcttcatacagatgagctgcgagatgtgggactttgatatttacggagatttatactttgaaaaggcggttaatggctttcttgcagacttgttcactaagtggaaggagaagaactgtagccatgaagtaaccgtcgtcttgttctcccgaaccttctatgatgccaaatccgtagacgagtttcctgaaataaacagggcgagcatccgtcaagaccacaaaggtcggttctatgaggatttctataaggtcgtcgtgcagaacgaaaggcgagaagaatggacatccctgcttgtgacaatcaagaagctttttattcagtatccggttcttgtgcgcctggaacaggctgaaggattcccccagggcgacaattccactagcgcacaaggaaactacctggaggcaattaacttgtcgtttaatgtgttcgacaagcactacatcaaccggaattttgacaggacagggcagatgagtgtggtaataacccccggagtgggggtgtttgaggtagatagactactgatgattctgacaaaacaaaggatgattgataacggcattggcgtggacctggtgtgcatgggggaacagccactccacgctgttcctttatttaagctccataatcggagtgctccaagggattctcgtctcggagatgattacaacatcccacactggatcaatcattccttttacaccagcaaaagtcagctgttctgtaacagcttcaccccccgaattaaactggcgggtaaaaaacccgcttccgaaaaagccaagaacggaagagatacgtcactgggctcccccaaggagtcagagaatgcgctcccaatacaggtggattatgacgcctatgacgcgcaggtttttaggcttccgggaccatcccgggctcagtgcctcacaacttgcaggtctgtgcgcgaaagagaatcccactcaaggaaatccgccagtagctgcgatgtatcatctagtcccagccttccttccaggacattgcccacggaagaggttaggagccaggcgtccgatgactcgagtttggggaagtcagctaatatactcatgatacctcatccacacctccaccagtatgaggtctcatcctctctggggtacaccagcacaagggacgtattggagaacatgatggagcccccacagagagactcatcagctccgggtagattccacgtgggctcagccgagtctatgctgcacgtaaggcctggcggttacacgccgcagagggccttgattaatccgttcgccccttctcggatgccaatgaagttgacgtctaaccgcagaaggtggatgcacacattccccgtgggaccttcgggcgaggctatccaaattcatcaccagactcgtcagaacatggcagagttgcaggggagcggccagcgggatcccactcactcctcagccgaactcctggagctcgcatatcacgaggctgcagggcgacactcaaactcaaggcaaccgggagacggcatgtcttttttaaacttcagcggaactgaagaactttccgtcggactccttagcaactcgggagccggaatgaaccctcggacccagaacaaggattccctggaggattccgtgagcacaagccccgaccccatgcccggattttgctgtacggtcggcgtcgattggaagtccctcaccactccagcctgtctgcctctgaccacagactatttccccgatcggcagggattgcagaacgattataccgagggatgctatgacctgcttcccgaagctgacatagaccgcagagatgaggatggcgtgcagatgacagcccagcaagtttttgaagagtttatctgtcagcgtctgatgcaaggttaccaaatcattgtgcagccaaagacccagaagcccaaccctgcggttcccccacctctgtcgtcatctcccctctatagtcgaggactggtcagcaggaacagacccgaagaggaagaccagtactggttgagcatggggagaaccttccacaaagtgacccttaaggacaagatgatcaccgtaactaggtatctaccaaaatacccttacgagagcgctcagatccactacacctattctttgtgcccctcccattcagactcagagtttgtatcctgctgggttgaattcagtcatgagcgcctggaagagtacaagtggaattatttagaccagtatatctgttctgctgggagtgaggactttagcctcattgagtcactgaaattctggagaacacgcttcctgctcctgccagcctgcgttactgctaccaaacggataaccgagggggaagcccattgcgatatctatggtgacaggcctcgggcagacgaggacgagtggcagctcttagatggcttcgtgcggtttgtggagggtcttaacaggattaggcgtagacaccgctctgaccggatgatgcggaaaggcacggcaatgaaaggtttgcaaatgacaggacccatatcaactcattcactcgagtctaccgctccccctgtgggaaagaagggcacatccgctctgagcgcgttgctggagatggaagcaagtcagaagtgcctaggtgagcagcaggccgctgtacatggtggaaaaagttcagcccagtcagccgagagcagtagtgttgccatgactcccacatatatggacagtccaagaaaggtcagcgtagatcagacggccacaccaatgctcgatgggacctcactcggcatctgcacgggccaaagcatggacagggggaattcccagaccttcggtaacagtcagaatattggggaacaagggtactcttctactaattcctctgattcctcctcacagcagctggttgcttcatccctcacttccagctcaacgttgactgaaatattggaagccatgaaacaccctagtacaggggtccaactgctgtccgaacagaagggcctgtctccgtactgcttcatcagcgccgaggttgtgcactggttggtgaaccatgtggagggtatacagacccaagcgatggctatcgatattatgcaaaagatgttagaagaacaactgatcacacatgcctcgggagaggcctggaggaccttcatctacggcttctacttttataaaattgttaccgataaggaacctgatcgagtcgctatgcagcagccagccacgacatggcacaccgcaggcgtggacgatttcgcaagttttcagcgcaaatggtttgaagtagcctttgtggcggaggaattggtacattccgaaattccagccttcctccttccctggctgccatcgcggcctgcctcttatgcctcccgccactcttcattctcacgcagcttcggcggaagatcgcaggccgcagccctgcttgccgctacggtgcccgagcagagaacagtcaccctcgatgtggacgtcaacaatcggacagatcggctggagtggtgctcctgctattaccacggaaacttcagtttgaatgccgcttttgagatcaagctgcactggatggcggtgacggctgccgtactgttcgaaatggttcagggatggcacaggaaagctacgagttgcggattcctcctggtccctgtgcttgagggccctttcgcattaccaagctacctttatggggaccccctgcgcgcacagctgtttatacccctgaacatttcttgtctcctgaaggaaggatccgaacacctcttcgatagctttgaacccgaaacatactgggaccggatgcacctgtttcaagaggccattgcacaccggtttggctttgttcaggataaatattccgcgtccgctttcaatttccctgccgagaataagcctcagtatatccacgttactggcaccgtgtttttgcagctcccctattcaaagcggaagtttagtggacaacagaggcgaaggagaaattccacttcatctaccaatcagaacatgttctgcgaggagcgcgtgggttacaattgggcatacaacaccatgttgactaagacctggaggtcctctgccacaggtgatgaaaaattcgccgatcggctgctgaaagatttcactgacttttgcattaatcgcgataatcggcttgtgacgttctggacctcttgtttggaaaaaatgcatgcgtccgcaccatag

SEQ ID NO: 220631 - DNA, 4719 bp, Artificial Sequence
  Description of Artificial Sequence: Synthetic coding sequence
atgagaaccacgaaggtgtataaattggtgattcataagaaaggctttggcggtagtgatgacgagctggtggtcaacccgaaagtgtttcctcacatcaagctcggtgacatcgtagaaattgcacatcctaatgatgaatattctcctctccttttgcaggtgaaatctctaaaagaggatttgcagaaagaaactatatctgtggatcagaccgtaacacaggtgttccgcttgcgtccatatcaagatgtgtatgtgaacgtggtcgaccctaaagatgtgactctagacctcgtggaacttaccttcaaagatcagtacatcgggaggggagatatgtggaggcttaagaagtcgttagtgtctacttgcgcgtatatcactcagaaggttgagtttgctgggatcagggctcaggccggtgagctgtgggtgaaaaatgagaaggtgatgtgcggctacatctcggaagacactagagttgttttccggtcaacatccgctatggtgtatatattcattcagatgtcctgcgagatgtgggactttgatatctatggcgacctgtatttcgaaaaagctgttaatgggtttctcgctgacttgttcacaaagtggaaagagaaaaattgctcccatgaagtgacagttgtcctattctccaggactttttatgacgccaagtctgtggatgagtttcctgagataaacagggctagtatcagacaagatcacaagggccgtttctacgaagatttctacaaggttgtggttcagaatgaacgtcgcgaagagtggaccagcttgcttgtgacgataaagaagcttttcattcagtacccagtactggtgcgtttggagcaggccgaaggctttcctcaaggtgataatagcacatcggcccagggcaactacctggaggctatcaatctgagttttaacgtatttgacaaacattatatcaatcggaatttcgacaggaccgggcaaatgagcgttgtcattacccccggagtaggagtcttcgaggttgacaggctgttgatgattctcacgaaacagcgaatgattgacaacgggattggcgtagacttggtttgcatgggggaacagccgctgcacgcagtcccattgttcaaattgcataaccgctccgccccaagggactcgcggctgggcgatgactataatatccctcactggatcaaccactccttttacacctcaaaaagccaattgttttgtaatagctttaccccaagaattaagctcgccggaaagaaacctgcttcagaaaaggccaagaatggccgagatactagcctgggctctcctaaggagagtgaaaacgccttacccattcaggttgactatgacgcctacgacgcccaggtttttcgtttaccgggaccatccagagcacagtgccttaccacctgtcgtagcgtgagggagagagaatctcacagcagaaaatccgcgagttcctgtgacgtgagcagtagcccttcgttaccctccaggacactaccaacagaggaggtacgaagccaggctagcgacgattcctctctgggaaaatcagctaatatcctaatgatcccacacccccatctccatcagtacgaggtctccagttccttaggttatacctccaccagagatgtccttgaaaacatgatggaaccaccccagagagattcgagcgcacccggaagatttcatgtcggctcagccgaatctatgctgcatgtgcgaccgggaggctacacaccccagagagcactgattaatccctttgctccatcccgcatgccaatgaagctgacgagcaatcgccgtcgctggatgcatacttttcccgtgggaccatctggagaggcaattcagatccatcaccaaacacggcagaatatggccgaactgcaagggtccgggcagcgggatcctactcattcttcggccgaattattggagttggcttatcatgaggctgcgggtcgccattccaactcacgacagcccggagacggcatgtccttcctgaacttctctggcacagaagaactgagcgttggactactttcaaattctggtgctggtatgaatcctagaactcagaacaaggactccctcgaggacagcgtgagcacttctcctgatccaatgccagggttctgttgcacagtcggggttgactggaagagcctgacaacacctgcctgtttgccacttactaccgattacttccccgatagacaagggctccaaaacgactacacagagggatgctacgacctgctgccagaagcggacatcgaccggagggacgaggatggcgtccaaatgacagcgcaacaggtgtttgaggagttcatatgccagaggttgatgcagggctaccagatcattgttcagccaaaaacacaaaaaccaaacccagccgtacccccacctctgagttcaagccctctttattctcgtggactagtaagtcggaaccgcccagaagaagaggaccagtattggctcagtatggggcgtactttccataaagtcaccctgaaggataaaatgattaccgttacaaggtacctgcccaaatacccatacgagtcagcccagatccactacacttactctctctgtccatcacatagtgattcagagtttgtctcttgttgggtggagttcagccacgagagactcgaggaatacaaatggaattatcttgatcagtatatttgttccgccggttccgaggatttttctctcattgagtcattaaaattctggagaactaggtttttgttgttacccgcttgcgtcactgcgacaaagaggattaccgaaggggaggcccactgcgatatctatggtgaccggccacgcgcagacgaggatgaatggcagctgctcgacggattcgtacgctttgttgagggcctgaaccgtattagacggaggcacagatcagaccgtatgatgcgtaaagggaccgcaatgaaaggccttcagatgaccggtccgataagcacacactctctcgaaagtacagcgccacctgtcggcaaaaaagggacttctgccctgtctgccctcctcgagatggaggcatcccaaaaatgtttgggcgaacagcaagccgctgtgcatggaggaaagtccagtgcacagtccgctgagagttctagtgtcgctatgacacctacgtacatggactcacccagaaaggtgtcagtagatcagaccgccacacctatgttggatggtacttcactcgggatttgtaccggacagagcatggacaggggtaattcgcaaacgttcggcaatagtcaaaacataggagaacaggggtatagttccacgaactcctctgatagctccagccagcagttggtggcatctagcttgacctcatccagtacactgacagaaatcttggaagccatgaagcaccccagtactggcgttcagctgctatcagagcagaaaggcctctcaccctactgcttcatttctgccgaggttgtacactggctggtcaaccacgtggaggggattcaaacacaggcaatggcaatcgatatcatgcaaaaaatgctcgaagagcagctgatcactcacgccagcggcgaggcctggaggacattcatctatggattttatttctacaagatcgttacagacaaagaacccgaccgagtcgcaatgcagcagcccgcaaccacgtggcataccgcaggagtggatgactttgcaagttttcagcgcaaatggtttgaggtggcctttgtggcggaagagttggtgcacagcgagatacctgcattcttgttgccatggctgccgtcaaggccagcctcctacgcttctcggcatagctccttcagtagatctttcggaggacgcagtcaagcagccgcacttctggctgctacagtgccggaacagagaaccgtaactctagacgttgatgtcaataaccgcaccgaccgactcgagtggtgtagctgctattatcatgggaacttttcgcttaatgctgcgttcgaaatcaagcttcattggatggccgtgaccgccgctgtcctattcgaaatggtacaaggatggcaccgcaaggcaacttcctgcgggtttcttctggtgcccgttctcgaaggaccattcgccttaccaagctatctatacggagatcctctccgcgctcagctgtttatcccattgaacatatcatgcctcctgaaggaaggatccgaacacctcttcgactcatttgaaccagaaacatactgggacagaatgcacctgttccaagaggccatcgcacacagattcggcttcgttcaggataagtatagcgccagtgcattcaattttcccgcagaaaacaaaccacagtacatccacgtcacaggcaccgtgttcctgcagctgccatatagcaagaggaagttttcagggcagcagcgccgtcgacgaaattccacatccagtactaaccagaacatgttctgcgaagaacgagtcggatacaattgggcgtacaacaccatgctaactaagacgtggcgctcaagcgctacaggcgatgaaaagtttgcagataggttgctgaaggattttaccgatttctgcattaaccgagataatcggctcgtgaccttttggacatcatgtttggaaaaaatgcacgcctctgccccttag

SEQ ID NO: 220632 - DNA, 138 bp, Artificial Sequence
  Description of Artificial Sequence: Synthetic coding sequence
atgcggacaacaaaggtttacaagctggtgattcacaaaaaaggcttcggcggatctgatgacgagttggtcgtgaaccctaaagttttccctcacatcaagctgggcgacatcgtcgaaatcgcccacccaaactag

SEQ ID NO: 220633 - DNA, 4512 bp, Artificial Sequence
  Description of Artificial Sequence: Synthetic coding sequence
atgcgcactactaaagtgtacaagctcgtgattcataaaaaaggttttggtggcagcgatgatgagttagtggtcaatcctaaggtctttcctcatatcaagttaggtgacatcgttgaaatcgcacaccccaacgacgaatacagcccattgttgctgcaagtgaaaagcctcaaggaagatctgcagaaggaaaccatcagcgtagatcagaccgtcactcaggtctttagattacgcccttaccaggacgtgtacgtcaacgtggtggacccaaaggacgtgacactcgatcttgtagagctgacattcaaggaccagtacattggcaggggcgacatgtggagactcaaaaaatccctggtcagtacttgtgcgtacatcactcagaaagtcgagtttgctggaatccgtgctcaggccggagaattgtgggttaaaaacgagaaggttatgtgtgggtacattagcgaggatacgcgcgtcgttttccggtccacttcagccatggtttacattttcatacagatgtcatgtgagatgtgggacttcgacatctacggagacctatacttcgagaaagccgtaaacggatttctggctgacttattcactaagtggaaggaaaagaattgttcccatgaagttacagtggtgctgttttctcgtaccttctatgacgcaaagtcagtggacgaattcccagaaatcaaccgcgcttcgatcagacaggaccataaaggaagattttacgaagacttttataaagtcgtcgtgcagaacgagaggcgggaggagtggacttctcttttggtgactattaagaagctgttcatccaatacccggtgctagtgcgcctcgagcaggcggaggggtttccacaaggagacaattcaacatcagcacaaggcaattatctcgaggctatcaacctaagctttaacgtattcgataagcactatattaacaggaacttcgacagaacaggccagatgtcagtcgtgatcactcctggtgtgggggtattcgaggtcgatcggctactgatgatcctgacaaagcagagaatgattgataatggtattggcgttgatctcgtgtgcatgggcgagcagccactccacgctgtgccactgtttaagttacacaataggtcggccccaagggattcaagactaggcgacgattacaatatcccccattggattaaccactccttttacacctcaaagagccagctgttctgcaactcattcacaccaaggatcaagctggcaggcaagaagcctgcatccgaaaaggctaagaacggaagggacacatcactggggtcccccaaggaaagcgaaaatgctctacctattcaagttgattatgatgcctatgatgctcaggtttttcggctcccaggcccatccagggcccagtgcctgacaacttgtagatccgtaagagagcgcgaaagccactcacgtaagagtgctagttcctgtgatgtaagcagttccccttcattgcctagcaggactttacccacggaagaggtacggtcacaggcttccgatgactctagccttggcaagtccgccaatattttgatgatcccccacccccaccttcatcagtacgaggtcagcagttccctgggctacactagcacacgtgacgtgctggaaaatatgatggagccccctcagagagacagtagtgctcctggtcggttccacgttggatccgccgaatcaatgcttcacgtgagaccagggggatacacgcctcagcgagcacttatcaacccctttgctcctagtagaatgccgatgaaactcaccagcaaccggaggcggtggatgcacactttccctgtgggcatgaaccctcgtactcagaacaaggactccctggaagactccgtaagtacatctcccgaccccatcctcaccctctcggcccctcccgtggtcccaggcttctgctgtacagtcggtgtggactggaagtctcttactaccccggcatgcctgcctctgaccactgactacttcccggataggcagggtctccagaatgactatactgagggctgttacgaccttctgccagaggccgacatagatcggagagacgaagacggggtccagatgactgcacagcaggttttcgaagagttcatttgccagaggctgatgcaggggtaccagataattgtgcagcctaagacccagaagcccaacccagccgtgccaccacccttgtccagttcacccctctactctagagggcttgtttcacgtaaccggccagaagaagaggaccaatattggcttagtatgggacgaaccttccataaagttactctgaaagataaaatgataaccgtgactagatatctgcccaaatatccatacgaatccgcacagattcattatacttacagcctttgtccgtctcattcagattccgagtttgtgagctgctgggtagagttctctcacgaacgcctggaagagtataaatggaattacctggaccaatatatctgctctgcaggctccgaagatttttccttgatcgagagcctgaaattctggagaacacgcttcctcctgctcccagcctgtgtgactgccacaaaacgcattacagaaggcgaagcacactgtgacatctatggtgatcggcctagggcggatgaagacgagtggcagctgctcgacggcttcgtcagattcgtggaaggccttaacaggattcgacgtagacataggtctgataggatgatgcggaaggggacagcgatgaaggggctccaaatgaccggcccaatttccacccatagtctcgagtctacagcccctcccgtgggtaagaaagggacgtctgctctcagcgccctcctggagatggaagcaagtcaaaagtgtctaggcgaacaacaggctgccgtacacggagggaagagcagtgcacagtccgcagaatcctcttctgtcgcgatgactcccacctacatggattcgcccaggaaggtatctgtggaccagacggccacgcccatgcttgacgggacctctctggggatctgcaccggccagagcatggaccggggtaacagccagacttttggcaattctcagaacataggggagcaggggtattcgagcactaatagtagcgactcgtcttctcagcaactcgtggccagcagtttgacaagctcatcaacactgacagaaattctggaagctatgaaacacccttctacaggcgtacaactcctgagcgaacagaagggcctctctccatattgcttcatttccgcagaagttgtacattggctggtcaaccacgtcgaaggtattcagactcaggcgatggcaatcgatatcatgcagaagatgctcgaagagcagctgataacgcatgcttcaggagaggcctggcgtacatttatctatgggttctacttctacaagattgtgaccgacaaagaacctgatagagtggctatgcagcagcctgcaaccacctggcataccgccggagtggacgatttcgcgtctttccaacgcaagtggttcgaagtggcgttcgtggcggaggaacttgtgcattcagaaattcctgcctttctgttaccttggctgccgagccggcctgcctcctatgcaagtcgccactcgtccttttcacgaagcttcgggggaaggtcacaggccgctgcccttttagccgctactgtccctgaacagcggacagttaccctggacgtggatgtgaacaatcgaacagaccggcttgaatggtgttcatgctactaccacggtaacttcagcttgaatgctgcattcgagattaagcttcactggatggccgtgacagcagcagtcctgtttgaaatggttcaggggtggcacaggaaggccacaagctgtggatttttgctcgtgccggtcctggaggggcctttcgccttgcctagctacctgtatggggatcccctgcgtgcccagctgttcatcccactcaacataagttgtctgctgaaggaggggtccgagcacctcttcgactcatttgagcctgaaacgtattgggatcggatgcacctgtttcaggaggctatcgctcatagattcgggtttgtgcaggataagtacagtgcttcggctttcaatttcccagcggagaacaaacctcagtacattcacgtaacaggaacggtctttctgcagctcccttacagcaagcggaagtttagtgggcagcagaggcgcagacgaaattcaactagttccactaaccaaaacatgttttgcgaagaaagggtcggctataactgggcctacaacacaatgttaacgaagacttggcggagctccgccactggggatgagaagtttgcggatcggctgcttaaagacttcactgacttctgcatcaatcgagacaaccggctagtcaccttctggacctcctgcctggaaaagatgcacgccagcgccccttag

SEQ ID NO: 220634 - DNA, 1995 bp, Artificial Sequence
  Description of Artificial Sequence: Synthetic coding sequence
atgcggacaaccaaagtgtataaactggtgattcacaagaagggcttcggcggttctgacgatgagctagtggtaaatccgaaggtttttccccacatcaagcttggcgatatcgttgagatagcccaccctaatgatgagtatagtccgttgctattgcaggtaaagtctttaaaggaggatctgcaaaaagagacaatcagtgtcgaccaaactgtaacccaggtgttccgactgaggccgtaccaggatgtgtatgtcaacgtagtggaccccaaagtgagcacttgtgcatacattacccagaaagtggaatttgctggcatccgcgcacaagccggagaattatgggtgaagaatgaaaaggttatgtgcggctacatttctgaagatactagagtggtgttccggagtacctctgccatggtgtacatatttatccagatgagttgtgagatgtgggacttcgacatttacggcgacctctattttgagaaggcagtcaatggattcctggccgatctgtttaccaaatggaaggaaaaaaattgtagccacgaagtgaccgtggttctttttagcagaactttttatgatgcaaaaagcgtggatgagttcccggagatcaaccgcgcatccattagacaggaccacaaagggagattctacgaggacttctacaaggtagttgttcagaatgaacgccgagaggagtggacatcattgttagtgacaattaaaaaactgttcattcaatatccagttctggtgaggctcgagcaggccgaagggtttccgcagggggataacagcaccagtgcccaagggaattatctggaagcgattaacctgtcctttaacgttttcgataagcactacataaataggaattttgatcggaccggacaaatgtcggtggttattacccccggtgtgggcgttttcgaggtcgaccgactcctaatgattctcaccaagcagagaatgattgataacggaatcggggtggatctggtgtgcatgggagagcaacccctgcatgccgtaccactctttaagctccacaaccgctccgctcccagagactcccggttgggggacgactacaacatcccgcattggattaaccattcattctacacatctaagtcccagctcttctgtaactctttcactccgcgaatcaagttggctggcaaaaagccagcttctgaaaaggccaagaacggtcgtgacacatcactggggtcgcccaaggaatcagagaatgccctgccaatccaggtggactacgacgcgtacgacgcgcaggtgtttaggcttccaggcccttccagggcacagtgcctgaccacatgtcgctcggttagggaaagagagagtcacagcagaaagtccgctagtagctgcgacgttagctcttcaccatcactgccctcccgtacgctcccaacagaagaggtacggtcccaggccagcgatgacagctccctcggcaagtcagcgaacattctgatgatcccccacccacatttgcatcaatacgaggttagttcctcgctgggttacacatcgaccagagacgttttagagaacatgatggaacccccacagcgggactcctccgcacccggtcgattccacgtcggctccgccgagagcatgctgcatgtgcgccctggaggctatactcctcagcgcgctttgattaatcctttcgctcccagccgcatgcctatgaagctcacctctaacagacggcgttggatgcatactttcccagtaggaatgaatccgaggacgcagaataaggatagcctagaagattccgtctctacgtcaccagacccatccaagcggggtcaacttactggagagcgcggacgccagggcgtgtggggaggacagtccatgcgcaaacaggaagaagctctgtgggaagtcagcggacccgaggtgcacatccctttaggatatggcaaagcaatgtggtag

SEQ ID NO: 220635 - DNA, 1263 bp, Artificial Sequence
  Description of Artificial Sequence: Synthetic coding sequence
atgaaacacccctccacgggcgtccagctactgtccgagcagaagggcctgtccccctactgctttatcagcgctgaagtggtccactggctcgttaaccacgtcgagggcatccagacccaagcaatggcaattgacatcatgcagaaaatgctagaagagcagcttataacacacgcttccggcgaagcttggcgcaccttcatctatggattttatttctataagattgtcacagacaaagagcccgaccgcgtcgcgatgcagcagcccgcaacaacatggcatacagctggggtagacgattttgcgtccttccaacgcaagtggttcgaggtagcattcgtggcagaggaactggtgcactctgagatccctgcctttctgctgccttggctgcctagtcggccagcctcttacgcttcgcggcactcaagtttttctcggtcttttgggggacgctctcaggccgctgccctccttgctgccacagtgcctgagcagcggacagtgactctcgacgtagacgtaaacaacaggacagaccgcctcgagtggtgcagctgttactatcacgggaatttctccctaaatgccgcatttgagatcaaattgcactggatggctgtaactgctgctgttttgttcgaaatggtgcagggatggcatcgaaaggcaacatcttgcggctttttgctcgtccccgtgctggagggtcccttcgctctgcctagctacttatacggggacccattgcgcgcacagctcttcatccctctgaatattagctgcttgttgaaagaaggctcggagcacctcttcgatagtttcgagccagagacatactgggatagaatgcatctgttccaggaagcaatagcgcaccgctttgggttcgtccaggataagtacagcgcctcagcattcaactttcccgcagagaacaaacctcagtatattcacgtaacaggcacagtctttctgcagcttccctactccaagcggaagttcagtggacagcaacgcaggcggaggaatagcacgagctccaccaatcagaatatgttttgcgaagagagagtgggttacaactgggcctacaacacaatgctgactaaaacctggaggtcttctgcaactggcgacgagaaatttgcggaccggctcttgaaggacttcaccgacttctgcattaacagagataacaggctggtaacgttttggacgtcttgcctggagaaaatgcacgcctctgcaccgtag

SEQ ID NO: 220636 - DNA, 4785 bp, Artificial Sequence
  Description of Artificial Sequence: Synthetic coding sequence
atgcgcaccactaaggtttataagcttgtgattcacaagaaaggctttggcggaagtgatgatgagctggtcgtgaatcctaaggtattcccacatataaaactcggggatatcgtggagatcgctcatcccaatgatgaatattcacccttactgctgcaggtaaaatctcttaaagaggacctgcagaaagagaccatatccgtggatcaaacagttacacaagtcttccgcctgcggccttaccaggacgtgtacgtgaacgttgtggatccaaaggatgtgactcttgacctggttgagcttactttcaaggaccagtacataggtaggggcgatatgtggcggttgaaaaaatccctggtgtcaacctgcgcctacattacccagaaggtggaatttgctggtatcagagctcaggctggtgagctctgggtgaaaaatgaaaaggtcatgtgcgggtatatctcagaagacactcgggtagttttcaggtcaacatcagctatggtgtatatttttatccaaatgagttgtgagatgtgggacttcgacatctacggagatctgtacttcgagaaggcagtgaacggcttcctggcggacctgttcaccaaatggaaggagaagaattgctctcatgaagtcaccgttgttctcttttcacgcactttttatgatgccaaaagcgtggatgagttcccagagattaatagggcgtcgattcgacaagaccacaaaggcaggttctatgaggatttctacaaggtcgtggtccagaatgaacgcagggaggagtggacatcacttctggtcacgatcaaaaaactttttattcaatatcctgtgctggtgagactcgagcaggccgaggggttcccgcagggcgacaattctaccagtgcccagggtaactacctcgaggcgataaatctgtcatttaatgtttttgataagcactacattaataggaattttgatagaaccggacaaatgagcgtcgttattactcccggtgtcggagtgttcgaggtcgaccgtctgctgatgatcttaaccaagcagaggatgatcgacaacgggattggagtagacttagtatgcatgggagagcagccgctgcatgccgtgcccctgttcaagctgcacaaccgcagcgcacctcgcgattcaaggttaggagacgactacaatatccctcactggatcaaccactccttctacacctctaagagccagctattttgcaatagctttaccccacggatcaagttggcaggcaaaaagcctgccagcgagaaagcaaaaaatggaagagatacaagcctgggttcccccaaagaatcagaaaacgcgctgccaatacaggtggattacgacgcttatgatgcgcaggtctttcggctgccaggaccaagcagagcacaatgtctgactacctgcaggagcgtgcgcgagcgtgaatcccacagcaggaaaagcgccagctcgtgcgatgtcagctcaagcccaagtctcccttcccggactctgccgacagaagaagttcgaagccaagcatccgatgactcctctttgggaaaatcagccaatattctgatgatcccccacccacacttacaccagtacgaagtttcctccagcctgggttatacatcaacccgagatgtgttggagaacatgatggagccccctcagagagattcttctgcccctggtcgattccacgtaggctctgctgagtccatgctgcacgtgaggcctggaggttacactcctcagcgagctttgatcaacccctttgcaccctccagaatgccaatgaaacttactagtaaccggcgaagatggatgcacacctttcccgtgggtccctccggcgaagccatccagattcaccaccaaactcggcagaatatggctgaattgcaggggagcgggcagagagacccaacacacagctccgctgaattactcgagctcgcctatcacgaggctgctggtcggcactcgaattctagacagcctggagatggaatgtcgttcctgaatttcagcggcactgaagagctgtccgtcggactcctttccaattctggtgcaggaatgaaccccaggacacaaaataaggacagcctggaggacagcgtgtccacctcaccagacccgatgcccggtttctgttgtacggtgggcgtggattggaagagcttaacaacacctgcatgcctgcccctgaccaccgattactttcccgacagacagggcctgcagaatgactataccgagggctgttatgatctgttacccgaggccgatatcgaccgtagagacgaagatggagtgcagatgacagcacagcaggtttttgaggagttcatatgccaacgtttgatgcaggggtatcaaatcattgttcagccaaagactcagaagcctaatcccgctgtacctccgccactgagctcaagcccactgtactccagagggctagtatcacgcaacagacctgaagaagaagaccagtattggttgtccatgggcaggacgtttcataaagttacgttgaaggataagatgatcactgtaacaaggtatctcccaaaatatccttatgaaagtgcccaaatccactacacatattcactctgcccctcacattccgactcggagtttgtgagctgctgggttgaattctcccacgagaggctcgaggagtacaaatggaattatttggaccagtatatctgctctgcgggttccgaagacttcagcctaatcgagtctttgaagttttggagaactcgttttctgcttctgcctgcttgcgtgacagccaccaagcgcatcacggaaggcgaggcccattgtgacatatacggagatcgccctagagccgacgaggatgagtggcagttgctggacgggttcgtgaggttcgtggaaggcctaaacaggatccgtcggaggcataggagtgatcggatgatgcggaaaggcactgccatgaaaggcctgcagatgacggggcctatttctacccactctcttgaaagcaccgctcctcctgtcggaaagaaaggaacctccgccctgtccgccctcctggagatggaggcatctcaaaaatgcctcggcgaacaacaagcggcagtgcatggcggtaagtcttccgctcagagcgccgaatccagctcagtagccatgacgccaacatacatggactccccacgaaaagatggagccttctttatggaatttgtgcggtccccacgtaccgcctcctctgccttctacccacaggttagtgtggatcagaccgcaactccaatgctggacgggacatcacttgggatctgcaccggtcagtctatggacaggggcaactcccaaaccttcggtaatagccaaaatatcggggaacaagggtactccagcactaacagtagcgattcatcttcccagcaattagtagcatctagcttgacgtccagctccacccttacagagattctcgaagcaatgaaacacccctccacaggagttcaacttctctctgaacagaagggcctgtctccatactgttttatttctgcagaagtggtccactggctggtcaatcatgttgaaggcatccagactcaggctatggccatagacatcatgcagaagatgctcgaggaacagctcattacccacgcgtctggcgaggcctggcggacgttcatctatggattctacttttacaagattgtgactgacaaggaaccagatcgagtggccatgcagcaaccagcaactacctggcataccgccggagttgacgattttgcgtcgttccagcggaaatggttcgaagtggccttcgttgcagaagagttggttcactccgagattcccgctttcctcctcccctggctgccatcaaggccagcttcctatgcgagcagacactcgtctttctcgcggagtttcggtgggcgaagtcaagcagctgcactgttggcagccactgtacccgaacagcgtactgtgactttagatgtggacgtgaacaacaggaccgacaggcttgaatggtgctcttgttattaccacggaaatttttctctgaatgcagcgttcgagattaaattgcactggatggcagtgaccgccgctgtcctgttcgagatggtgcaggggtggcaccggaaggccacctcatgcgggtttctgctggtccctgtgctggagggcccattcgccttaccctcttacctctacggcgacccactgcgtgcccaactgtttattcccctcaatatatcctgtctgctgaaggaagggtctgagcacctcttcgactcttttgagccagagacatattgggacagaatgcatctttttcaagaggctatagcacaccgctttgggtttgtacaggataagtactcagcttctgccttcaattttcctgccgaaaataaaccacagtatatacatgtgactgggacagtgtttcttcagctgccctatagcaaaagaaagttttcaggccagcagcggaggagacggaacagtacttcttctaccaaccaaaacatgttttgcgaggagcgggttggatacaattgggcttacaacacaatgctaaccaaaacatggcggagcagtgccacaggcgacgagaagttcgccgataggctgcttaaggattttactgatttttgcatcaatcgtgacaatcgcctcgtgacattttggacgagttgccttgaaaagatgcatgcatctgcaccatag

SEQ ID NO: 220637 - DNA, 1536 bp, Artificial Sequence
  Description of Artificial Sequence: Synthetic coding sequence
atggctaccgtacaggagaaggccgctgccctgaacctcagcgccctgcactcaccggcacatagaccacccggattcagcgtggctcagaagccgttcggagccacctatgtttggtcaagcattattaatacactccaaactcaggtggaggtgaaaaagagacggcacaggctgaaacgacataacgactgcttcgttgggtccgaggctgtagacgtgattttctcacatctgatccagaacaagtactttggtgacgtggatattcccagagccaaggtcgtaagagtctgtcaggcattgatggattacaaagtgtttgaggccgtgcccaccaaagtgttcggtaaggacaagaagccaacctttgaggactcatcatgctcgctctacagatttacaaccatccctaaccaggattcccaactgggcaaggagaataaattgtactctcccgctagatatgcggacgccctcttcaagtcctcagatatacgttctgcaagcctggaggatttgtgggaaaacttaagcctaaaacccgctaactcgccgcacgtgaatatttctgcaacactcagcccccaggtcattaatgaggtctggcaggaggagaccattggaaggttgctacaactcgtggatcttcccctgctggatagcttactgaagcaacaagaagctgttccaaaaatccctcagccaaagagacagtccactatggtgaattccagtaattacctagatcgtgggatccttaaggcatattccgattcccaagaggacgagtggctgagtgctgcaattgattgcctggaatatctccctgaccagatggttgttgagatttcccgcagtttccctgagcagccagacagaacggaccttgtcaaagaactgctttttgacgccattggtcgctactactcatcacgcgagccccttctgaatcatctaagcgatgtgcacaacggaatagcagagttgctggtgaatggcaagactgaaatagcactggaggccacacagctcctgctgaaattacttgacttccagaacagggaggagtttcgcaggctgctctatttcatggcagtggccgctaatccctctgagtttaagctgcagaaggaatctgataatcgaatggtggtgaaaagaatctttagcaaggccatcgtggacaacaagaatctatccaagggtaagaccgatctgcttgtcctgtttctgatggatcaccagaaggatgtattcaaaattcccggaacactccataagatcgtctctgttaaactcatggccattcagaatgggagggacccaaacagggatgcagggtacatctattgtcagcggattgaccagcgggactacagtaataatacggagaagaccaccaaagatgagttactaaacttgctcaagaccttggacgaagacagcaaattgagtgccaaggagaagaagaagctgctgggccaattttataagtgccatcccgacatttttattgagcacttcggagactag

SEQ ID NO: 220638 - DNA, 1509 bp, Artificial Sequence
  Description of Artificial Sequence: Synthetic coding sequence
atgcggggtctgtgtgagttctactggcaggaatttggtatcaaaggttttagcgtggcccaaaagccgtttggcgctacgtacgtttggtcctccatcattaacacactgcagacacaggttgaagtcaaaaaaagaaggcatcgcctgaagcgccacaatgattgttttgtcggctcagaagccgtggacgtgatcttttcacaccttatccagaacaagtacttcggggacgtggatatcccacgggcaaaggtggtgagagtttgccaggcgctaatggattacaaggtgtttgaagctgtacctacaaaggtgttcggcaaggacaagaaaccaacatttgaagattcatcttgttcactctatcgctttactacgatccctaaccaggactctcaattgggtaaggagaataaactctacagccctgccagatatgcagacgccctgtttaaatccagtgatataaggtccgcctcgctcgaggacctatgggaaaatcttagcctgaagccagccaattccccacatgtgaacattagtgccacactgagtccacaagtgataaacgaggtatggcaggaggaaaccattggcaggctgctgcaactggtggacctgccattgctagacagcctgctgaaacaacaggaagccgttccaaaaatccctcaaccaaaacgacaaagtaccatggtgaattcttccaactaccttgaccgaggaatcttgaaagcctatagtgacagccaggaagacgaatggttaagcgccgctatcgactgcctggaatacctacctgaccaaatggtcgtggagatcagtagatcttttcctgaacagcccgatcgcaccgatcttgtgaaggaactgcttttcgatgccatcggcagatactactcatctagagagcccctcctcaaccatttatctgacgtgcataatggaattgccgaattgttggtgaatggaaagacggaaattgccctagaagcaacacagttattgttgaagctgctggatttccagaatagggaagagtttagaagattactttatttcatggccgtggctgcaaacccatccgagttcaaacttcagaaagagagcgacaatcgcatggtcgtgaagcggatattcagcaaggcaatcgtagataacaagaatctgtcgaaagggaaaactgacctgctggtgctgttcctcatggatcatcagaaggacgtctttaaaattcccggtacactccataagatcgtatctgtcaaactcatggcaattcagaacgggcgtgacccaaaccgtgatgccggatatatctattgccagcgtatagatcagagagattacagcaacaacaccgagaaaaccactaaagatgagctactaaatttgctcaaaacccttgacgaagactctaagctgtcagccaaggagaagaagaaactcctcggtcaattctataagtgtcacccggatatttttattgaacactttggtgattag

SEQ ID NO: 220639 - DNA, 1230 bp, Artificial Sequence
  Description of Artificial Sequence: Synthetic coding sequence
atggaagagggtggatctacgggatccgccggatcagattcttccacttctgggtctgggggtgctcaacagcgtgagctcgaaagaatggctgaggtcttggtgaccggtgaacagctgaggctgcgcctgcacgaggagaaggttataaaggatcggcgacaccacctcaaaacatatccaaactgcttcgtagccaaagagcttattgactggttaatcgagcataaagaggcaagcgatcgggagaccgctattaagttgatgcagaagcttgcagatagagggattattcatcacgtttgtgatgagcataaagaatttaaggacgtcaagctgttttaccgcttcagaaaagacgatggaaccttcccactggataatgaggtgaaggccttcatgagggggcagagactgtacgagaaactcatgtccccagaaaatacgctgctccagcctagggaggaagagggagtgaagtatgaaagaacatttatggcctcagagtttctcgattggctggtgcaggaaggggaggctacgacacgtaaagaagcggaacagctctgccaccgcctcatggagcatggtattatccagcacgtgagcaacaaacacccgttcgtggactccaacctgctgtaccaatttcgtatgaactttagaagaaggcgccgtctgatggagctgttaaacgagaagtccccttcctcccaggagactcacgacagccccttttgtctaaggaagcaatctcacgacaaccgaaagtccacctcgttcatgtctgttagtccaagtaaggaaatcaagatcgtgagcgcggtcagaaggagcagtatgtcctcttgcggcagttccggttacttttcctcgtcaccaacactgagcagctcacccccagtcctatgcaacccaaaatccgtgcttaaaagacctgtaacttctgaagagctccttactccaggggctccatatgcccgaaagactttcaccattgtcggagatgccgtgggttgggggtttgtggtgaggggttccaagccctgccatatccaggccgtggatccctcaggtcccgcagccgcagccggaatgaaagtgtgtcaatttgtcgtgtcagtcaatggtctcaatgtgctgcacgtcgactatcgcacagtgagtaacctgatactgactggacccagaaccatcgtgatggaggtcatggaagagctcgagtgctag

SEQ ID NO: 220640 - DNA, 2877 bp, Artificial Sequence
  Description of Artificial Sequence: Synthetic coding sequence
atgaggacacacactaggggcgcacctagcgtgttctttatctacctcctgtgctttgttagcgcctacatcactgatgagaatcccgaagtgatgattccttttaccaatgctaattacgattcacacccgatgctctacttcagtcgcgctgaggttgcggagttgcaactacgtgctgctagttcccatgaacatattgccgctcgtttgactgaagctgtgcacaccatgttgtcctcccctctggagtatctgccgccatgggatccaaaagattatagtgcaagatggaatgagatttttggcaacaatttaggagcactcgctatgttctgtgtactgtatcccgaaaatattgaagcacgcgatatggccaaggactacatggagcggatggcagcccagccaagttggctggtgaaagatgcaccttgggatgaagtgccgctagcgcacagtcttgtcgggtttgcgaccgcatacgatttcctgtataactacttgtccaaaacccaacaggagaagttcttggaagtaatcgctaatgcttctgggtacatgtacgaaacgagttacaggcgcggatgggggtttcagtacctgcacaaccaccagcccactaattgcatggctttacttactgggtcattggtgctaatgaatcaggggtacctccaggaagcttacctgtggactaagcaggtgctgacaataatggagaagtcgctggtcctgttacgcgaagttacagacggtagtctgtacgagggcgttgcttatggctcttatactactagaagtcttttccagtacatgtttctggtgcagcgacactttaacatcaatcacttcgggcacccatggctgaaacagcatttcgccttcatgtacaggaccattctgccaggttttcaaagaacggtcgcgattgctgactccaactataactggttctacgggccagagtcccagctggtgttcctggataagttcgtcatgcgcaacgggtctggcaactggctagcggaccaaatcaggagaaatcgggtggtggaaggtcccggtactcccagcaaggggcagagatggtgtacgctgcacaccgagtttctatggtatgacgggtcattaaagagtgtgccccctccagacttcggcacacccacactacattattttgaagactggggcgttgttacctatggtagcgccctcccagccgaaatcaatcgctcttttctcagcttcaaatccggcaagttaggaggtagggccatttacgatatagtacaccggaacaagtacaaggattggatcaaagggtggaggaatttcaacgctggccacgagcatcctgatcagaacagctttacctttgcccctaatggagttccattcattactgaggctctttatgggcctaagtacacattctttaacaacgtcctcatgttcagtcccgcagtgtccaagtcttgtttctccccttgggttggacaggtcaccgaagactgctcaagtaagtggtcaaaatacaagcacgatctcgctgcctcctgtcagggaagagtagttgcggcagaggagaaaaacggcgtcgttttcatcaggggtgagggcgtcggagcttacaacccccaactgaacctcaagaacgttcagaggaacctgatcctgctccatccgcagctgctacttctagttgaccagatccatctcggagaagaatctcctctcgaaaccgccgcttcgttttttcacaacgttgacgttcctttcgaagagactgtcgtggatggcgtccacggcgctttcatccgacagcgagatggactgtataagatgtactggatggatgatactggttacagtgagaaagccacctttgcgagtgtgacgtatcccagaggctatccctacaacggcactaattatgtgaatgtcacaatgcatctgagatctcccattacaagggcggcatacctctttatcggcccaagcattgacgttcaaagtttcacggtgcacggtgatagccagcaactcgacgtgttcattgcaaccagtaagcacgcttacgccacttatctgtggaccggagaagctactggacagtccgccttcgcacaggtgattgcagacaggcacaaaatcctgtttgaccggaattccgctatcaaaagcagcattgtacctgaggtcaaggactatgccgcaatcgtagaacaaaaccttcagcactttaaacccgtttttcagctcctggagaaacagatcctttcaagggtgcggaacaccgcgagctttaggaagacagcggagcgcctgttacggttttccgataagagacagactgaggaggccattgaccggatttttgcaatctctcagcagcaacagcagcagtctaaaagcaaaaagaaccggagagccggaaagaggtacaagttcgttgatgctgttcccgacatctttgcgcagatagaagtgaatgaaaaaaagatccggcagaaggctcaaatactggctcaaaaagagcttccaattgacgaggacgaggagatgaaagatctcttagattttgctgatgtcacctacgagaaacacaagaatggaggcctgattaagggccgttttggccaggcccgtatggtgacaaccacccacagccgcgctccaagtttaagcgctagctatactaggctgtttcttatcctaaacattgccatcttcttcgtgatgctggccatgcaacttacgtatttccagcgggcacagagtctccatggtcagcgatgtctttatgccgtccttttgattgactcttgtattctgttatggttgtattcatcctgttcccagagccagtgctag

SEQ ID NO: 220641 - DNA, 2877 bp, Artificial Sequence
  Description of Artificial Sequence: Synthetic coding sequence
atgagaactcatacacgcggagcgcctagcgtgttctttatatatctgctgtgcttcgtgtccgcatacataaccgatgaaaaccctgaagtgatgatcccatttactaatgcgaattacgactctcatcccatgttgtacttcagccgagccgaagtcgccgagctgcagctgcgcgcagcctcctcccacgagcatatcgcggctcgcctgaccgaagccgtgcataccatgctttccagtcccttagaatacctgccaccgtgggaccccaaagactactccgctcggtggaacgagatctttgggaataacttgggcgcactcgcaatgttctgtgttctgtaccctgagaatatagaagctcgcgatatggccaaggattacatggagcggatggccgctcaaccatcctggcttgtgaaagatgccccatgggacgaggtgccattggcccacagtctggtggggttcgcaactgcttatgatttcctgtacaattacttgtccaagacccagcaggagaagtttctggaagtgattgcaaacgcaagcggatatatgtatgaaacgtcttatcgccgagggtggggattccagtacctccacaaccaccagcctaccaattgtatggccctgctcacaggctcgttagtgctgatgaatcagggttatctgcaggaggcctatctgtggacaaaacaggtcctgacgattatggaaaaaagcctggtgctcttgagggaagttacggacggcagtttgtacgagggagtcgcatacggaagctatacaactcgctctctattccagtatatgtttctcgtccagaggcacttcaacatcaaccacttcggccatccctggttgaagcagcacttcgctttcatgtatcgaacaatactgcctggctttcaaaggacagtggctatcgccgactcgaactataattggttctatggcccagagagccagctcgtgtttctggacaagtttgtcatgcgcaacggaagcggaaattggctcgctgaccaaattcggaggaaccgggtggtggaaggcccaggcacgcccagcaaaggacaacgatggtgcacgctgcacaccgaattcctctggtatgacggttcactgaagtccgtacccccaccagattttggaactccgacactccattattttgaggattggggagtggttacgtatggttccgccctgcccgctgagataaaccgcagcttcttgagcttcaagtccgggaaactgggcggaagggccatttatgacattgtgcatcgtaacaaatacaaagattggatcaaagggtggaggaactttaatgcaggccatgaacacccagatcagaattcttttacctttgcaccaaacggagtgccctttattactgaggccttgtacggcccaaagtataccttcttcaacaatgtcctgatgtttagcccagccgtcagcaagtcttgcttcagcccatgggtaggccaggtgactgaagactgtagctcaaagtggtccaaatataaacacgatctcgccgctagttgccagggtcgggtagtggctgcagaggaaaaaaacggggttgtgttcatccgcggagagggggtgggagcatataatccccaactaaacctgaagaacgtgcagaggaacctcattttacttcatccacagctgttgttgctggtcgaccagatccacctcggggaggaaagccccctggaaaccgccgcaagttttttccataacgtcgatgtgcccttcgaggagactgttgtcgatggggtccacggggcatttatccggcagcgcgatggcctgtacaagatgtactggatggacgacaccggctatagcgagaaggccacttttgcttccgtaacatatcccagggggtacccctataatgggacaaattatgtgaatgtgaccatgcatctgagaagtcctattacgcgtgccgcttacctatttatcgggccatctatcgacgtgcagtcctttactgttcacggggactcacagcaactcgacgtgttcatcgccacaagcaagcacgcttacgccacttatctgtggacaggggaagccacaggccagtccgcattcgcacaggttattgccgaccgccacaagatcttgtttgacagaaactctgccattaagagtagtattgtcccggaagttaaagattacgctgcaatcgtcgagcagaatctccaacacttcaagccagtgttccagctccttgaaaagcagatactgagccgagtacgtaatactgctagcttcagaaagacagctgaacgactcctcagattctccgacaagagacaaaccgaggaggccatagatcgaatttttgccattagccagcagcagcaacagcaaagcaagagcaagaaaaataggcgggctggcaagaggtataaattcgtggatgccgttccggatatattcgctcagatcgaggtcaacgagaaaaaaattcggcagaaagctcaaatattggcccagaaggaattgcctatcgatgaagatgaggagatgaaggatctgctggacttcgcagacgttacatacgagaagcataagaacgggggactcattaaggggaggtttggccaggccagaatggttactaccacccattcaagggccccaagtttatcggcctcatatacacggctgttcctgattctgaatattgctatctttttcgtcatgctggctatgcagttgacatacttccagagagcccaatctctgcacggacagcggtgcctgtatgcagtgctgctaatagattcctgcatccttctgtggctgtatagttcttgcagccagagccagtgctag

SEQ ID NO: 220642 - DNA, 501 bp, Artificial Sequence
  Description of Artificial Sequence: Synthetic coding sequence
atgagaacccacacccgcggagctccatcggtctttttcatatatctgctctgtttcgtatcggcctatataacagatgagaaccccgaagtgatgatcccattcaccaacgccaattacgacagtcatcctatgctctacttcagccgggctgaggttgccgaactgcagctgagggctgcttctagccacgagcacattgcagccaggctgaccgaagctgtgcatactatgctatccagcccacttgaatacctgcccccatgggacccaaaggattattctgcacgatggaacgaaatcttcggaaataatttgggtgcactggcaatgttctgtgtgctttaccccgaaaacattgaggcccgagacatggctaaggattatatggagcgcatggcagcccaacctagttggttggtgaaggatgctccctgggatgaggtacctcttgcacatagtttagtagggttcgcgacagcatacgactttttatactag

SEQ ID NO: 220643 - DNA, 2877 bp, Artificial Sequence
  Description of Artificial Sequence: Synthetic coding sequence
atgcgtacgcatactaggggagctccctctgtcttttttatttacctgttgtgtttcgtctcagcatatattactgacgagaaccctgaagttatgattcctttcactaatgccaactacgacagtcatccaatgttgtactttagtcgtgctgaggtggctgaattgcagctgagggccgcatcctcccacgagcacatcgccgctcggctcacggaagccgttcacacaatgctgagttcaccattggaataccttcccccttgggacccaaaagattactctgcccgttggaacgagattttcggaaacaacctaggtgccttagccatgttctgtgttttatatcctgaaaacattgaggcaagggacatggcaaaagactacatggagcgcatggcagcccaaccaagctggctggtgaaggatgctccatgggacgaagtgccgctggctcacagcctggtgggctttgctactgcctatgactttctgtataactatcttagtaaaacccagcaggaaaagttcttagaggtcatagccaacgcctccggctatatgtatgaaacttcatatcggagggggtgggggtttcagtatctgcacaatcatcagccaaccaactgcatggcactcctgaccgggtcccttgtcctgatgaaccagggatatctgcaggaggcgtatctctggacaaagcaggtgttgacgattatggagaaatccctggttctactgcgagaggtgactgatggctccttatatgaaggggtggcctatggctcttacacaactcggtctctcttccagtatatgtttcttgtgcaacgccatttcaacatcaaccacttcggacacccatggctgaagcagcattttgcctttatgtacagaactatattaccgggatttcagcgtaccgtagcaattgccgattcaaactataattggttttacgggcctgagtcccaactggtctttttggataaattcgtgatgcgcaatggttccggaaattggctcgccgatcagatccgacgtaaccgagtcgtagagggcccaggtacgccaagtaaggggcagagatggtgcacattgcatacagagtttctgtggtacgatggtagcttgaagtccgtcccccctcccgattttggcacacctacattgcactactttgaggactggggggtggttacctatggatccgctctgcctgctgaaataaatcgtagttttctgtcctttaaatccggtaaactcggtggccgtgcaatatatgatatagtacatagaaacaaatacaaagactggataaagggttggagaaacttcaacgcagggcacgagcaccccgatcagaattcatttacatttgctccaaacggcgtcccctttattacagaagccctttacggacctaagtacacgttttttaataacgtactgatgttctctcccgctgtttcaaaaagttgctttagcccctgggtaggccaagtaaccgaggattgcagttctaagtggtctaaatacaaacacgatctcgccgcatcctgtcagggtcgggtcgttgcagccgaggagaagaacggggtggtatttattagaggcgagggagtaggtgcttataacccgcagctgaacctcaagaatgtgcagaggaatcttattttgctgcacccacaactcctgctgcttgttgaccagatccacctgggcgaagagagtcctctcgaaacggcagcctctttctttcataacgtcgacgtcccttttgaagaaaccgttgtggatggcgtgcacggtgcctttatccggcagcgggacggtttgtacaagatgtattggatggacgataccggttacagcgagaaagccaccttcgcatccgtgacatatccacgcggatacccttacaatggcacaaactatgtgaacgtgaccatgcacctccgatctcccattacacgggctgcctacttattcattggcccatccatcgacgtacagagctttacggtccatggtgatagtcagcagcttgatgtattcatcgccacaagcaagcacgcatatgccacttacctctggactggggaagctaccggacagtctgccttcgctcaggtcattgctgatcgccataagatactattcgaccgaaatagcgcaataaagagctccatcgttcctgaagtgaaggactacgccgcaatcgttgaacagaatctgcagcacttcaagcctgtgtttcagctgttggaaaagcagatccttagccgcgtgcgaaataccgcctctttccgcaaaaccgccgaacgattgctgcgcttcagcgataagaggcagactgaagaagctattgacagaatctttgcaatatctcaacagcagcagcagcaaagcaagtcgaagaagaatcgtcgcgcaggtaagagatacaaatttgtcgatgcggttccagatatattcgcacagatcgaggtgaatgagaagaaaatacggcaaaaagctcagatactggctcagaaagagttgcctatcgatgaagacgaagaaatgaaagatttgcttgatttcgcagacgtcacctatgagaaacataagaacggcggacttatcaaggggagattcgggcaagctagaatggtgacaactacccacagccgggctccctccctgagcgcaagctatacaaggttgttcctgattcttaatattgcaatatttttcgtgatgcttgcaatgcagctcacttactttcagcgcgcacagtccctgcatggacaaagatgtctgtatgctgtcctgctcatcgacagttgcattcttctgtggttatacagctcttgctctcagagccaatgctag

SEQ ID NO: 220644 - DNA, 2934 bp, Artificial Sequence
  Description of Artificial Sequence: Synthetic coding sequence
atgggaagctttgaagatggactcgccgctctggagatctggagatccgatgccacgatgagaacacatactcggggagcgccaagtgttttcttcatttatctcctttgcttcgtgagcgcatatattacagatgaaaatccagaggtcatgatccctttcacaaacgcgaattatgactcccaccctatgttatactttagccgggcagaggttgccgaactgcagttacgcgctgcctcctcgcatgaacacatagccgcacgtttaaccgaggctgtgcacacaatgttgtcatctccgctagagtacctgccgccatgggatcctaaggattacagcgctaggtggaacgagatttttggcaacaatctgggggctctggccatgttttgcgtcttgtatccagaaaacatcgaggcgagagacatggcaaaggactacatggaacggatggccgcacagcccagctggctagtcaaagacgcaccttgggatgaggtgccacttgctcacagcctcgtgggtttcgctactgcctatgacttcctctataactatctatcgaagacccagcaggagaaatttctcgaagtcattgccaacgccagtggatacatgtacgagactagttacagacgaggctggggattccagtatttacacaatcaccagcccaccaactgtatggcgctcctgactggtagtctcgtcctgatgaatcagggctacttacaggaggcctatctctggacaaagcaagttctcactattatggagaagtctctggttcttttacgtgaagtgactgacggatccctgtacgaaggcgtggcatatggctcgtacactaccagatccctgttccagtacatgttcctcgtgcagcgccactttaatattaatcattttggtcacccatggctgaagcagcattttgcatttatgtacaggaccatactaccgggattccagcgcaccgttgctatcgctgactccaactataactggttctatggcccagagtcgcaactcgtctttttggataagttcgtaatgcgcaacgggtcaggaaactggctggccgatcaaatacgccgaaaccgggttgttgaaggacctggcacccctagcaagggtcagcggtggtgtactctccatactgaatttctatggtacgacgggagcctgaagtcagtgccaccccctgactttgggaccccaacattgcactatttcgaggattggggcgtggtgacctacggctctgccctacctgctgagattaaccgctctttcctgagcttcaagagtgggaaactcgggggacgagctatctacgatatcgtacacaggaataaatataaggactggataaaggggtggcgaaactttaatgccggacatgagcatcccgatcaaaacagctttacctttgctcccaacggtgtgccattcatcacagaggcactttatggcccaaaatatacattttttaataatgtgttgatgttcagtcccgctgttagtaagagttgcttctctccctgggtggggcaggtcactgaggactgtagtagcaagtggtcgaagtataaacacgatctggctgcgtcctgccaggggagggtggttgcagcggaagagaagaacggggtcgtctttattagaggcgaaggagtgggtgcttataacccgcagctcaatctcaagaacgttcagcgtaaccttatcctattgcatccccagttactgttgcttgtcgatcagattcatcttggtgaagagagcccactggagaccgcggcatcctttttccacaacgtagatgtgccttttgaggagaccgtcgtggacggagtgcatggggcatttatcaggcagcgtgacgggctctacaagatgtattggatggatgatacaggatatagcgaaaaggccacctttgcttcggtgacttatcccagaggctatccttacaatggaacaaactacgtcaatgtgacaatgcacctgcgctcacccatcactcgcgctgcatacttattcattggcccttcgattgatgtgcagagttttaccgtccacggagactctcaacagctggatgtgttcattgcgacttcgaagcacgcttacgcaacttacctgtggacaggcgaggccaccggtcagagtgcgttcgcccaggtcatcgcagatcgccacaaaatcctatttgatagaaatagcgccattaagtcttccattgtgcctgaggtgaaggactatgccgctatcgtggagcaaaatttacagcacttcaaacctgtatttcaactgctggagaagcagattctgtcaagggtccgcaacaccgcctcctttcgcaagaccgccgaacggttgttgcgtttctctgacaaacggcagaccgaggaggccatcgaccggatttttgccatctctcaacagcagcaacaacaaagcaaaagcaaaaagaatcgtcgggcaggcaagagatacaagtttgtggacgccgtcccggatatttttgcccagatcgaagtgaatgagaagaagatcaggcagaaagcgcaaatactggctcagaaagagctacctattgacgaggacgaggagatgaaggacctcctggatttcgctgatgtcacatacgaaaagcataagaacggcggacttattaagggacgctttggtcaggcacgcatggtgaccacaacccatagccgcgcaccttcgctgagtgccagctacactaggctgttcctgattcttaacattgctatattcttcgtcatgctagctatgcagctgacatatttccagagggctcagtccctgcacggacagcgctgtttgtacgcggtactgctcatcgattcttgtatactattgtggctttattcctcctgctcgcagagccaatgctag

SEQ ID NO: 220645 - DNA, 570 bp, Artificial Sequence
  Description of Artificial Sequence: Synthetic coding sequence
atggctgcactaaaagggaggcaggtctattgggccaccgctggcaagatttccgggtggacttggccccacgcgcctcggaggcctcacgtcctgttgctgaatgggattggcgtcgggggagctctgggttccatcgacgaactgctgtgccaggctctgagcaacggactgaatgtgccagaaggaagcttgaccagcacctgcgcccaacaacctgacggtctcatacacactgccaagtggggccatgtgcacagccttagctcccattcgccaggagctccaaatgcatgcggtgtattacctggaactacagtggacgatggcgtgcaccaggacctgcaacgagtcttagcatgtgagcaggtttacgatctggagggcatgcttgacgacgcccattcccacgagttgctggcggtcgtcgccgcagtgcatcaccatggcgtgtctaaagccctacacaacggtacgttgtcatttgtggaggccttcggagggattccaccgtgtaccgtgcggatcttccgcaggtggtttgggtgcttgggagacctggagatttag

SEQ ID NO: 220646 - DNA, 3669 bp, Artificial Sequence
  Description of Artificial Sequence: Synthetic coding sequence
atgccaaaaggtggtgcaccaccgtggattatggccttgatgttcaccgggcacctgttgtttctagcgctgctgatgtttgccttttcaaccttcgaagagagtgtgagtaactactctgagtgggctgtattcactgacgacatcgatcagtttaaaacccaaaaggtgcaggattttcggcctaatcagaagttgaaaaagtctatgctgcatcccagcctgtattttgacgcgggtgagatccaggcgatgagacagaagagtagggcatcccatctgcacttgttcagggccattcgctccgcagtgacagtgatgctgagcaaccctacctactatttgccccctcctaaacacgcagattttgccgctaagtggaatgagatctatggcaacaacctgccaccgctggccctgtactgtctcctatgccccgaagataaagtggcgttcgagtttgtgctggagtatatggaccggatggtgggctataaggactggctggtcgaaaatgcacctggtgatgaggtacctataggccacagcctgacaggattcgctacagcgtttgactttctatacaatctactggataatcatcgccgtcagaaatatcttgaaaaaatctgggtgataacggaggagatgtacgagtacagcaaggtgcgctcatggggaaaacagctactgcacaaccatcaagctacgaacatgatagcactgctcacaggtgctctggtcacaggggttgataaaggttctaaggctaatatatggaaacaggcagtcgtggatgtgatggaaaagacgatgtttctgctgaatcacatcgtggacggatccctcgacgaaggggtggcttatggtagctataccgcaaagagtgtgacgcagtacgtattcctcgcgcagagacatttcaatattaacaatctggacaacaattggcttaagatgcacttctggttttattatgcaactttacttcccggtttccagcgaacagtgggcattgccgactcgaattacaattggttctacggacccgagtctcagctcgtcttcctcgataagttcatcctgaagaatggagctgggaattggttggcacagcaaattcgcaagcataggcctaaggatggtcccatggtcccttctacagcccaaaggtggagtacactgcatactgaatacatatggtacgaccctcaactgacccctcaaccacccgcagactacgggaccgctaaaatccatactttcccaaattggggtgtcgtgacatatggggcaggcttgccaaatacccaaactaacaccttcgtgtcgttcaagagtggcaaactgggaggaagagctgtctacgacattgtacattttcagccttattcctggatcgatggatggcgctccttcaatcctggccacgaacatccagaccagaacagctttacattcgctcctaatgggcaggttttcgtgtctgaggctctgtatggaccgaagctctcgcatctcaataatgtcctggtgtttgcgccaagcccatcttcccaatgcaacaagccctgggaaggacagcttggagaatgcgcccagtggctgaagtggactggcgaggaagttggagacgccgctggcgagataattaccgccagccaacatggcgagatggtatttgtgagtggtgaggccgtgtccgcatactcatctgcaatgcggctgaagagtgtttatcgcgcattgttgctcttaaactcccagactctgctggtggtggatcacattgaacgccaagaagatagtccaattaactcggtaagcgctttcttccacaacctggatattgattttaagtatattccctataaattcatgaatcggtataatggggcaatgatggatgtgtgggatgcccattataaaatgttctggtttgatcaccacggaaattcccctatggcctcaatacaggaggcagaacaggctgcagagtttaagaagcgatggacccagtttgtgaatgtgacgttccagatggagccaaccattacaagaattgcctacgtgttctacggtccttacataaacgtgtcatcatgtcgattcattgactcaagtaatccagggctgcagatttcattaaacgtgaataataccgagcatgtggtgagtattgtaactgactaccacaacttgaaaacacggtttaattatctcgggtttgggggtttcgcaagcgtggcagatcagggccagatcaccagattcgggctgggaactcaggctattgtgaaacctgtcaggcacgataggataattttccccttcgggttcaagttcaatattgccgttggtcttattctgtgtattagcctggtgatcctaacattccagtggcgtttttacctgtcgttcaggaaacttatgagatggattctgatccttgtgatcgcgctctggttcattgagctgctcgatgtttggagcacgtgttcccagcctatctgcgctaagtggacgcgcactgaggcagagggaagcaaaaagtctttgagcagtgaagggcatcatatggacctgcccgacgtggtaattaccagtctcccgggatcgggcgctgagattctaaagcagctcttctttaacagttctgatttcctctacatcagagtgcccactgcctatatcgacattccggaaactgagctggagattgattcgttcgtggacgcctgcgagtggaaagtttccgacatcagaagcggacacttccgtctcctccgaggctggttacagtcactcgtccaagatacaaaactccacttacagaatatccacctccacgaaccaaatcggggaaaacttgctcaatactttgcgatgaacaaggataaaaagcgaaagtttaagcggagagagtccctgcccgaacagcgctcccagatgaaaggggcattcgacagagatgcagaatatattagggcgctgcggagacacctggtatactatcctagcgccaggcccgtgctctcactgtccagtgggagctggaccctcaaactgcacttctttcaagaagtgctgggagcaagcatgagagcgctttacattgtacgggaccccagggcctggatttattccatgctgtacaatagcaagcctagcctctacagcttaaaaaacgtgcccgagcatctagcgaagctgtttaaaattgaaggaggcaaaggcaagtgcaatctgaattctggctatgcctttgaatacgagcccttgaggaaagagctgagcaagtctaaaagtaatgctgtgtctctcctgagccatctgtggctggcaaatacagcagccgcacttcgaatcaacactgacctgttgccaaccagttatcagctggtaaagtttgaagatatcgtccactttcctcagaagacaactgaacggatcttcgccttccttggtataccattgagcccagcttccctaaatcaaatcctgtttgccaccagcacaaacctcttttatttgccttacgagggagaaatttctcccaccaacacaaatgtatggaagcagaatttgccccgtgatgaaatcaaactgattgagaacatctgttggacacttatggacaggttgggataccccaaatttatggactag

SEQ ID NO: 220647 - DNA, 3639 bp, Artificial Sequence
  Description of Artificial Sequence: Synthetic coding sequence
atggcccttatgttcactggtcatcttctttttctagccttactaatgttcgccttctctactttcgaggagtccgtatcaaactattcagaatgggctgtttttactgacgatatagatcagtttaaaactcagaaagtgcaggatttcagacctaaccagaaactgaagaagagtatgctccacccaagtctgtacttcgacgcaggtgagatccaggccatgaggcagaaatccagggcatcacaccttcacttatttcgggcaatccgttctgcagtgactgtgatgctgagcaaccccacatactacttgccgccacctaaacatgccgattttgccgctaagtggaacgagatttacggaaataacctccctcctctcgctctttactgcttgctctgtccggaggataaggtagcgtttgagttcgtgctcgagtacatggatagaatggtgggatataaggactggctggtcgagaatgccccaggggacgaagtgcccattggccacagcctaaccggattcgccaccgcttttgactttctgtacaatctgctggataaccatcgccgacaaaaatatttggagaaaatctgggtaatcactgaagagatgtacgaatacagcaaggttcgatcatggggcaagcagctcctccataaccaccaggctacgaacatgatagcgcttctcaccggagcgctggttaccggcgtggataagggatctaaagcaaacatctggaaacaggccgtggtggatgtgatggaaaaaaccatgtttctcttgaatcatattgtggatggtagcctagatgaaggggtggcttatggatcttatactgccaaaagcgtgactcaatacgtattcctggcccagaggcactttaatatcaataacttagacaataactggctgaagatgcacttctggttctattacgctaccctgctgcctggatttcagcgcactgttggcatcgctgattccaactataattggttttatggccctgaatcacaactggtgttcctagacaaattcatcttaaaaaacggcgcaggtaactggttagcacaacagatccgcaaacaccgtcccaaagatgggccaatggtgccgtcgactgcccagaggtggtcaacactgcacaccgagtatatctggtatgatccacagctaactccccaaccccctgccgattatggtaccgcaaaaatccacactttccctaactggggggtggtgacctatggggcaggcttgccgaacacccagactaatacttttgtcagctttaaatccggcaagttgggtggcagagctgtttacgacatcgtgcacttccagccctactcatggattgatggctggcgcagcttcaaccctggtcatgaacaccctgaccagaactcatttactttcgccccaaacggccaggtgtttgtgagtgaagctttatacgggccaaaactttcccacctgaacaacgtcctcgtgttcgctccgtccccctctagccagtgcaacaaaccatgggaaggccagctcggggagtgcgcccaatggcttaaatggactggagaagaggttggtgacgccgctggcgaaattatcacagccagccagcacggagagatggtgttcgtttctggggaggccgtctcagcttacagctctgcaatgcggttgaagtctgtgtacagggccctgcttttactgaattctcagacactgctggtggtggaccacatagagaggcaggaggacagcccaataaatagcgtgagcgccttttttcacaacctggacattgactttaaatacatcccttacaaatttatgaacagatataacggtgccatgatggatgtgtgggatgcccactataagatgttctggttcgaccaccacggtaactctcccatggcttcgattcaggaggccgagcaggctgcggagttcaaaaaaagatggacacagttcgtaaatgtgaccttccagatggagccaactattacgcgtatcgcttacgtgttctacggaccctatattaacgtcagcagctgccgatttattgattcctcaaaccccggactgcagatttctctgaacgtcaacaacacagagcacgtggtgtcaatcgtcaccgactaccacaacttgaaaactcggttcaactatctgggcttcggcggattcgcttctgttgcagaccagggccagatcaccagattcggactcgggacccaggccatcgttaagccggtcaggcatgatagaatcatatttccttttggatttaagttcaatatcgccgtgggactgatcctctgtatctccctcgtgatcctcacatttcagtggagattttatctatcttttaggaaactgatgaggtggatactaattttggtgattgcactgtggtttatcgagctgcttgacgtgtggagcacttgctcacaacctatctgcgccaaatggaccaggaccgaggccgaagggtccaaaaagtcactgagcagtgaaggtcatcacatggacctgcccgatgtggttattacatctctgcccggatccggagctgagattcttaagcagctcttcttcaactctagcgacttcttgtatatcagggttcccactgcgtatattgacatccccgaaacagaactggagatcgacagttttgttgacgcctgcgagtggaaggtttccgatattaggtccgggcacttccggctactccggggatggttacagtctctagtacaggataccaagctccacctgcagaacatacacctgcatgagcctaacaggggcaagttggcccagtacttcgcaatgaacaaggataaaaagaggaaattcaagcgtcgtgagtccctgccggaacagagatcccaaatgaagggcgctttcgatagggatgccgaatatatccgcgcactacgcaggcacctggtgtattacccttcggcgagacccgttttgtccttaagctcgggttcttggactctcaaacttcatttcttccaggaagtcttgggagccagcatgagggccctgtacattgtgagggacccaagagcttggatctactcgatgctgtataattcaaagcccagcttatattcgcttaaaaacgtgcctgagcaccttgccaaactgtttaagatcgaaggcggaaaggggaaatgtaacctgaattcaggatacgcgtttgaatacgagcccctgcgcaaggagctaagtaaaagcaagtcgaatgcagtgagcctactgagccatctctggttggctaatactgctgctgctctgaggatcaacaccgacctgctgccgaccagctaccagctcgtcaagttcgaggacatcgtccactttccgcaaaagaccacagagcgaatctttgcttttctagggatccctctgtcaccagccagcctcaaccagatcctcttcgctaccagtactaatttattctatttgccatatgagggagaaattagccccactaataccaacgtctggaaacaaaatcttccaagagatgaaattaaattgatagagaatatttgctggaccctcatggatagactcggctatccgaagtttatggactag

SEQ ID NO: 220648 - DNA, 606 bp, Artificial Sequence
  Description of Artificial Sequence: Synthetic coding sequence
atggacctgtctctcttgtgggtcctcctccccctcgttactatggcttgggggcagtacggagactacggctatccctaccaacaatatcatgactatagtgacgacggctgggttaacctgaataggcagggcttctcttaccagtgtccccagggccaggtgattgtagccgtgaggagtattttcagcaagaaggagggttctgacaggcagtggaactatgcttgcatgcccactccacaatcgttgggggaacccaccgaatgctggtgggaagagattaaccgtgccggaatggaatggtatcagacatgttccaataacggtctggtggccggatttcagtctcgatactttgagtccgtgctagatcgtgaatggcagttctactgttgccggtatagcaagcgctgcccatactcatgttggctgacaaccgagtaccctggccattacggggaagagatggatatgatctcatacaactacgactattatattcgtggcgcaaccacaaccttctcagcagtggagcgggaccgccagtggaaatttatcatgtgtcgcatgactgagtacgactgtgagttcgctaacgtttag

SEQ ID NO: 220649 - DNA, 333 bp, Artificial Sequence
  Description of Artificial Sequence: Synthetic coding sequence
atgagattcatgacccttctattcctgacagctcttgccggtgccctggtctgtgcctatgatcctgaggccgctagcgcgccagggtccggaaacccgtgtcacgaggcatcagcggctcagaaggagaatgccggagaagacccagggctggcaaggcaagcacctaaaccacgaaagcagcgctccagtttactggaaaaaggactggatggcgcaaagaaggccgtggggggattagggaagctgggcaaagacgccgtggaagacctagagtccgtaggcaaaggagccgtgcacgatgtgaaagacgtccttgactccgttctctag

SEQ ID NO: 220650 - DNA, 1191 bp, Artificial Sequence
  Description of Artificial Sequence: Synthetic coding sequence
atggcactgctaacaaacttacttccactatgttgcctggcgctgttggcactaccagcccagtcgtgcggtcctgggagaggacctgtgggccgaaggcgctacgctcgcaaacagctagtcccactgctttataaacagttcgtgccgggtgttccagagcgcactcttggggcttctggccctgctgaaggtagggtggcccgtggatccgaacggttccgggatttggttccgaactacaatcctgacatcatcttcaaggatgaggagaattccggagccgaccgcctgatgacagaacggtgcaaggagcgcgtgaatgcactggccattgccgtgatgaacatgtggcctggcgttcggctgcgggtaaccgaggggtgggatgaggatgggcaccacgcccaagattctttacactacgagggaagggcactggatatcactacatcagaccgcgatcgaaacaagtacggcctactggcgaggcttgccgtcgaggccggattcgactgggtttactacgagtctcgaaatcacgtgcatgtctccgtcaaggccgacaatagtctggctgtgagagcgggtggctgttttccagggaacgctaccgtccgtctgtggtctggcgagcggaagggcctccgagaacttcaccgtggcgactgggtgctcgcagctgacgcaagcgggagagtagtgcccacaccagttctgctgttcctggacagagaccttcagaggcgcgcatcgttcgtagctgtagaaacggaatggccaccgcgaaagttgctgctgaccccctggcacctggtctttgctgccagggggccagcgccagctccgggagattttgcgccagtttttgctaggcggcttcgcgctggcgattccgtactggcacctggcggtgatgccctgcggcctgcacgggtcgctcgggtggcccgagaagaggccgtcggggtttttgccccactgactgcacacggaacactcttggtaaatgatgtgctcgcttcttgttacgccgtgctggaatctcatcagtgggcccaccgggcatttgctcccctgaggctgctccacgctctgggggctctgttaccgggaggcgcagtgcagccgaccggaatgcattggtactcccgtcttctgtatcgactcgcagaggagctcctgggatag

SEQ ID NO: 220651 - DNA, 1413 bp, Artificial Sequence
  Description of Artificial Sequence: Synthetic coding sequence
atgtctcaagcgtactctagcagccagcgcgtctcctcttataggcgaacctttggcggagccccagggtttcctcttggatcccctctgtcctctcctgtgtttccgagggcaggctttggtagtaaaggtagttcctccagcgtcacctcacgcgtgtatcaggtctctaggacttcaggaggtgcagggggactcggcagcctccgcgcatctcgcctagggactacaaggacaccctctagttatggagcaggcgaacttctggatttcagtcttgctgacgccgtcaaccaggagttcctgaccacacggacgaatgagaaggtggagctccaggaacttaatgatcggtttgcgaattatatcgaaaaggtgaggtttcttgagcagcagaacgccgcactggctgccgaggtgaatagactgaaaggaagggagccaacacgggttgctgagctctatgaggaagagctgcgtgaactgcgcaggcaagttgaggtcctgacaaaccaacgagccagggttgatgttgaaagagataacctgctagacgatctgcagcggctgaaagccaagctccaggaagaaatccaactgaaggaggaggccgaaaataacctggccgctttcagggccgacgtggatgcagctactctcgcacgtatcgacctggagcgcagaattgagtcactgaacgaagagattgcctttctaaagaaagtgcacgaggaagagatccgcgaactgcaggctcagctgcaggaacagcaggttcaggtagaaatggatatgtcaaagcccgacctcacagctgcgctgagggacatcagagctcagtacgagactatcgccgcaaagaacattagcgaggcagaggaatggtacaagagcaaggtatccgacctgactcaagctgctaacaagaacaacgacgcccttcgccaagcgaagcaagagatgatggagtaccggcaccagatacagtcgtacacgtgcgaaatcgacgccctgaaaggaacaaacgatagcctgatgagacagatgcgcgaattggaagatcgttttgcatcagaagcgagcggataccaggacaatatcgctagactcgaggaggagatcaggcacctgaaagacgaaatggcacggcatctacgagagtatcaggacctgcttaatgtaaagatggctctagatgtcgagattgcgacataccgaaagctcttagaaggcgaggaatcacggatcaacctgcccatccagacatattcagctctgaattttagagaaacctctccagaacagcgagggtctgaggtacatacgaagaagacggtgatgataaaaaccatcgagacacgcgatggagaagtagtgtccgaggctacacagcagcaacatgaagtcctgtag

SEQ ID NO: 220652 - DNA, 2523 bp, Artificial Sequence
  Description of Artificial Sequence: Synthetic coding sequence
atggcgctggcctcggctgcccctggctctatattttgtaagcagctgcttttttcattgctggtattgacccttctatgtgacgcctgccagaaagtataccttagggtgcccagtcacctgcaggctgagactctggtcgggaaggtcaatttagaggagtgcctgaaaagcgcaagcttgattagaagctctgaccctgccttccgcattcttgaagatggatccatctatacgacccacgacttgattctgtcgtcagagcgcaagagcttcagcatttttctgagtgatggccagagaagggaacagcaggaaatcaaggtcgtactgagcgccagagagaataaatccccgaaaaagcgccatacaaaagatacagccctgaaacgaagcaagcggagatgggcaccaattcccgcaagcctcatggaaaactcactaggtccctttcctcagcacgtgcagcagatccagagcgatgccgctcaaaactataccatcttctactccatctccgggcctggagtggataaggaaccgttcaacctgttttacatagaaaaagataccggtgatatcttttgtacgaggagcatcgaccgagaaaagtatgagcagtttgccctctacggttatgcaactaccgcagacggttatgcgcctgaatatcccttaccgctaatcatcaagatcgaagatgataacgataatgctccctattttgaacatagggtgacaatttttacagtaccagaaaactgccgctccggtaccagcgtcggcaaggtcaccgctaccgatttagatgagcctgacactctgcatacccggctaaagtataaaattctgcaacagatcccagatcatcctaagcatttctccatccatcccgatacgggagtcatcactacaactacgccgtttttagaccgcgaaaagtgtgacacttaccagctgatcatggaggttcgcgacatgggagggcagccctttgggctgttcaatacgggaacaattacaattagtttggaggacgagaatgataaccctccttccttcaccgagacctcctatgtgactgaggtggaggaaaacaggatcgatgtggaaatattgcggatgaaggtgcaggatcaggatctgccaaacacacctcacagcaaagctgtatataaaattttacagggaaacgaaaacggtaatttcatcattagtaccgatcccaacaccaatgagggggtcctttgtgttgtaaagcctctcaactacgaggtcaataggcaggtgattctgcaagtaggtgtgattaacgaagcacagttctctaaagctgccagtagtcaaacaccaaccatgtgcacaacgactgtgactgtaaagattattgactctgacgagggccctgaatgtcacccacccgtgaaggtgattcaatcccaagacggcttccctgctggccaagaacttttagggtataaagctctcgaccccgagattagttcaggtgagggtctgaggtatcagaagctgggagacgaagataactggttcgagatcaatcagcataccggagatttgcgcacccttaaagttcttgaccgagagtctaagtttgtgaaaaacaaccaatataatatttcagtggtggctgtggatgctgttggtagatcctgtaccggcactctggtcgttcacctggatgattacaatgatcacgcccctcagattgacaaggaagtaaccatctgccaaaacaacgaggattttgccgtgctcaagcctgtcgatcccgatggccctgagaacgggcctccgttccaatttttcttggacaatagtgcctctaagaactggaatatagaggagaaggatggaaagactgctatcctgagacagaggcagaatttggattataattattacagtgtgccgatccagatcaaagatcgccacgggctcgttgccacacacatgcttactgtccgcgtctgcgactgtagcacgccatccgagtgtagaatgaaggataaatccacccgagatgtacggcctaatgtcattcttggaaggtgggccatattggctatggtcttagggtcggttctcctcctgtgtatcctgttcacgtgtttttgcgtcacagcaaagcgcacagtcaaaaaatgctttcctgaggacatcgctcaacagaacctgatcgtgagcaatactgaaggacccggagaggaagtcactgaggccaatataagactcccaatgcagactagtaacatatgtgatacctcgatgagcgttggcaccgttggcggtcagggcattaagactcaacaatccttcgagatggtgaagggcggttacacgctggactcaaacaagggagggggacatcagaccttggaatccgtgaagggtgtcgggcagggagataccggaagatatgcctatacggattggcagtcatttacccagcctcggttgggcgaggagtccattaggggccacacacttataaagaactag

SEQ ID NO: 220653 - DNA, 2685 bp, Artificial Sequence
  Description of Artificial Sequence: Synthetic coding sequence
atggctctggccagcgctgccccaggttccatattttgcaagcagttgttattttccctgctcgtcctgaccttattatgcgatgcttgccaaaaagtctaccttcgggtgccaagccatctgcaagctgaaaccctcgtgggaaaggtgaacctggaagagtgtcttaaatccgcgtcactgatccggtccagtgatcctgcatttcggatactggaggatggctcaatatataccactcatgacctaattctgtcctctgagcgcaagtccttcagcatttttctctccgatggacagaggagggagcagcaggaaattaaagttgtcttgagtgccagggaaaacaaaagcccaaagaaaaggcacactaaagatacggctctgaagcgtagcaaacgacgatgggcccctatcccagccagtttgatggaaaactctctaggcccattcccccagcatgttcagcagatccagagtgacgccgcacagaattacaccatcttctactcaatctctggccctggcgtcgataaggaacctttcaatttgttctatatcgagaaagacacaggcgacattttctgtaccaggagtattgacagagagaaatatgaacagttcgccctgtacggatacgctaccaccgctgacggctatgccccagaataccccctgcctcttatcataaagatcgaagacgataatgacaatgccccttattttgaacatcgggtgactatattcaccgtgccagaaaattgcaggagcgggacgtctgtcgggaaggtcacggccacggatcttgatgaaccagacaccctccatacgagattaaagtataagatcctccagcagatcccagatcaccccaaacacttttcaatacaccctgataccggcgttatcaccacgacaactccctttctggatcgtgagaagtgtgatacttaccagcttatcatggaagtccgggatatgggcggacagcctttcgggctcttcaatacaggcaccattactatcagccttgaggacgagaacgataatcctccgagcttcactgagacttcatatgtcaccgaggtcgaggaaaatcgcattgatgttgagatactcagaatgaaagtacaggatcaagacttacccaataccccgcattctaaggcagtgtacaaaatcctgcagggtaacgagaatggaaattttatcatctccaccgaccccaacacaaatgagggagtgctctgtgtggtaaagcctctgaattacgaagtgaacagacaggttattctgcaagtcggtgtaattaacgaagcacagttttcgaaggctgctagctctcagacacctactatgtgtacaacaacagtcaccgtcaaaatcatcgactctgacgaagggcctgagtgccaccccccagtgaaagtgattcagtcccaggacggtttccctgctggacaagagctgctaggttataaggccctcgatccagaaatcagctccggggagggcctacgctaccaaaagctgggtgacgaggacaattggttcgagataaatcaacacaccggggacttgcgaactctcaaagtcctggatcgagaaagtaaatttgttaagaacaatcagtataatattagcgtggttgctgtagacgctgtcggacgaagttgcacaggcaccctagtggtgcacctcgacgactacaatgatcacgcacctcagatcgataaggaagtgaccatttgccagaacaacgaggactttgcagtgcttaagcccgtggaccccgatgggccagaaaatggccctccttttcagttttttctggacaattccgcttctaaaaattggaatattgaggagaaggacgggaagacggctatcctcagacaacgccagaaccttgattataattattatagtgttcccatccagataaaggaccggcacggtctggtggctacacacatgttgactgtccgggtgtgtgattgtagcactccatcggagtgtcgtatgaaggataagagcacaagagacgtaaggcctaacgttattctgggcaggtgggccattctggctatggtcctagggagcgttctcctgctttgcatcctgttcacctgtttttgtgtgaccgctaagaggaccgttaagaagtgctttcctgaagatatagcccagcagaacctgatagtgagtaatacagagggcccaggtgaggaagttactgaggcaaacattagactgcctatgcagacttccaatatatgtgatacgtctatgtctgtcggtactgtcggaggtcaaggcattaaaacgcagcaatcctttgagatggtcaagggcggttataccctggacagtaataaaggtgggggtcaccagacccttgagtctgtcaagggcgttggccaaggcgatacagggaggtacgcctacaccgactggcagagttttacccagcctagattaggggaaaaggtctacctgtgcggacaggatgaagaacataaacactgtgaagactacgtatgctcatataattacgagggcaaaggcagcttggccggatcagttggctgctgtagcgataggcaagaggaggaagggttggaatttctggatcacctggagcctaaattccgaacgctcgcaaagacgtgcatcaagaagtag

SEQ ID NO: 220654 - DNA, 2691 bp, Artificial Sequence
  Description of Artificial Sequence: Synthetic coding sequence
atggcggctgccggacctcggagaagcgtgcgtggtgctgtgtgcttgcacctactgctaacactggttatcttttctagagctggcgaagcgtgtaaaaaggtgatcttaaacgttccgagcaaactcgaagcagacaaaatcatcggtcgtgtcaatctggaggagtgcttccgttccgcagaccttatcagatccagtgatccggactttcgtgtgttaaacgacgggtcagtatacacagccagagcagtcgccctctctgacaaaaaacggtcttttacaatctggctgtcagataagcgcaaacagacacagaaggaggtgacagtcctcctggagcaccaaaagaaagttagtaagaccagacacacaagggaaaccgtgctgcgacgggcaaagcgacgctgggccccaatcccttgttctatgcaagagaactccctagggccattcccgctctttctgcaacaggtggaatctgatgcagcccagaactatacagtgttctactcaatttccggacgtggagtggacaaagaacctctgaacttattttacattgagagggatactggaaatctgttctgcacccggccagttgatcgtgaggaatatgacgtatttgatctgattgcttacgctagcaccgcagatggatattcagcagacctcccccttccactgcctattcgggttgaggacgagaacgacaaccatcctgtgtttaccgaggccatttataacttcgaggtgttggagtcgtccagaccagggacaacagtaggcgtggtgtgtgcgacagatcgcgacgagccagatactatgcacaccaggttgaaatactcgatactgcagcaaactccccgaagccccggattgttttctgtgcacccatccacaggagtgataaccaccgtctcccactacctagatcgcgaggtggttgataagtacagtctcataatgaaagttcaggatatggacggccaattttttggactcatcggtacttccacctgcattatcactgtaactgactcaaacgataacgcacccactttcagacagaatgcttatgaagcctttgttgaggagaatgcattcaacgtagaaatcctccgcatacccattgaggataaagatcttatcaacaccgccaactggcgagtcaacttcaccatcctgaaaggaaatgaaaacggacattttaagatctctactgacaaagaaacaaacgaaggcgtccttagtgtcgtcaaaccacttaactacgaggaaaatcgccaggtgaatctggagattggggtgaacaacgaggccccattcgcacgagatatccctcgtgtgacagccttgaaccgagcactcgtaaccgtgcacgtacgcgatctggatgaaggaccagagtgcacacctgctgcccagtacgtgagaattaaggagaatctggcagttgggtcaaaaataaacggttacaaggcttacgaccctgaaaatcgaaatgggaacggcttgcgctacaagaagcttcatgacccaaaggggtggatcacgatcgatgagatttccggctcaattattacctccaagatactggacagagaagttgaaaccccaaagaatgagttatacaacataactgtcctggcgatcgacaaagatgatcgctcttgtacaggaaccctggcagttaacatcgaagacgtgaatgataacccaccggaaattcttcaggagtacgtggtgatttgtaagcctaaaatggggtatacagacattctggcagttgaccccgacgagcccgtccatggcgctcccttttacttctcattgccaaacacctcccccgaaataagccgcttgtggtctctgacgaaggtgaacgacaccgctgcaagattgagttatcagaagaacgccggatttcaggagtatactatcccaatcacagtgaaggatcgggcaggtcaggccgctaccaagctccttagggttaacctatgtgagtgcactcaccccacccagtgtagagcaacctcgagatcaaccggagtgatcttgggtaaatgggcaatattggcgattttgctgggcatagcattattattctctgttctactgaccttagtttgtggggtgttcggcgcaaccaaagggaaacggtttcccgaggacctggcccaacagaatctgataatcagtaataccgaggcaccaggggacgacagggtgtgttcagcgaacgggtttatgacgcagactaccaacaacagcagccagggcttctgcgggactatggggtccggcatgaaaaacgggggtcaggagacaatagaaatgatgaagggcggaaaccaaaccctggaaagctgtaggggggcaggccatcaccatactctcgatagttgtaggggtggccatacagaggtagacaactgccgctatacgtactctgaatggcatagtttcacacaacccagactgggagagaaattgcatagatgcaaccagaatgaggaccgaatgccctcccaggactatgtgctgacatacaactacgagggcagggggagcccggctggcagtgttgggtgctgcagcgaaaaacaggaggaagacggcctcgacttccttaataacctcgaaccaaagtttataactctagccgaggcttgtactaagcgctag

SEQ ID NO: 220655 - DNA, 2520 bp, Artificial Sequence
  Description of Artificial Sequence: Synthetic coding sequence
atggccgctgccggtccaaggagatccgtgcgcggagccgtgtgtcttcatctgctgctgacactcgtgatcttttcacgggctggggaggcttgtaagaaggtgatcctgaatgttccctcaaagctggaagccgataaaatcatcggcagagtcaatctcgaagagtgcttccgaagcgcagacctcattaggtcgagcgatccagacttcagagtattgaacgacggatcagtgtacacggccagggcagtggccctgagtgataaaaaaaggtcatttacgatttggttgtctgataagcgcaagcaaactcagaaggaggtgaccgtgctgctagaacaccagaagaaggtgtcaaaaaccaggcacactcgggaaacagtcctgagacgagccaaacgtaggtgggcccctatcccttgcagtatgcaagaaaactcactgggacctttcccactatttttgcagcaggtagaatcggacgccgctcaaaactacacagtcttttattctatttctggaaggggggtggataaagagcccctcaaccttttttatatagagcgggacaccggaaacctcttctgcacccgacctgtggatagagaagaatatgacgtatttgacctgattgcttacgcgtccaccgcagacgggtattccgccgatctgcctcttccactaccaatcagggtagaagatgagaatgacaaccatcccgtcttcactgaggcaatatacaatttcgaagtcctggagtcaagccgccctggaacaacagtgggcgtcgtatgtgctaccgaccgggatgaaccagataccatgcacacccgcctcaagtactccattctgcagcagacacctcggtcacctggtctgtttagcgtgcaccctagcacaggagtaatcactacagtgtcccattatttagaccgcgaagtcgtggataagtattcactcattatgaaggttcaggacatggatggccaattctttggactgatcggaactagcacttgtatcattacagtgactgactccaatgataatgcacccacatttcgccagaatgcctacgaggccttcgtcgaggagaatgcatttaatgtggaaatcctgaggatacctatcgaggacaaggatctaatcaatacagccaattggcgagttaattttacgatcctcaaagggaacgagaacggccactttaagatctccacagataaggaaactaatgagggggtgttatcggtcgtgaaaccgctaaattatgaagagaataggcaggttaatttggaaattggtgtcaacaatgaggctccttttgctcgagacattcccagggtcaccgcccttaaccgggctttagtgacagtgcacgtgagagacctcgacgaaggacctgagtgtactccagcagcccagtacgtcaggatcaaggagaacttagccgtgggaagcaagattaacggttacaaggcttacgaccctgaaaaccgcaacggaaatgggctgcgctataaaaagctccacgatccaaaggggtggataacgatcgacgagattagcgggagtatcattacctccaagatcttggatcgggaagtggagaccccaaagaacgagctctataacattacagtcttggcgatcgataaagacgaccgctcttgcacaggaaccctcgctgtgaacatcgaggacgttaatgataatccccctgagatcttacaagagtacgtcgtgatctgcaagcccaaaatgggttatacagatatcctggcagtcgaccccgacgaacctgttcacggggctccgttttacttctcactgccgaatacttcaccagaaatttcccgactttggagtctcacaaaagtgaatgacactgctgctcgcctgtcctatcagaaaaatgcaggattccaggagtacaccatcccaatcacggtgaaagaccgcgcaggccaggccgctacaaagctgctccgcgttaacctgtgcgagtgtacgcacccaacgcaatgccgagccacctcgagatctaccggagtaatcctggggaaatgggccatcctggccatcctactgggcatagctctgctatttagcgtcctgctgacacttgtgtgcggggttttcggtgcaactaaagggaaacggtttcctgaagacctcgcccagcaaaatctgatcatttctaatacagaggcaccaggggatgacagagtgtgcagcgctaatggctttatgactcagaccacaaacaactctagccagggattttgtgggaccatgggttcgggcatgaagaacggcggacaggagactatcgagatgatgaagggtggtaatcagacgctggagtcttgtcgaggggctggccatcatcacaccctcgacagttgtcgtggaggccacaccgaggtcgataactgtcgctacacgtatagtgagtggcacagctttacacaacccaggctgggagaagaatccattaggggccacacagggtag

SEQ ID NO: 220656 - DNA, 3150 bp, Artificial Sequence
  Description of Artificial Sequence: Synthetic coding sequence
atggactggtctttcttccgtgtagtggcgatgctgttcatcttcttggttgtggtcgaagtcaattctgaattccggatccaagtccgagattacaacactaagaatgggactattaagtggcactctattaggcgccagaagagagagtggattaaattcgccgctgcttgtagagagggcgaagacaattccaaaagaaatccaatcgctaagatccatagcgactgcgctgctaaccagcaagtgacctacaggatctctggggtgggaatcgatcagcccccatacggaatctttgtgataaaccagaaaactggcgagatcaatatcacttccattgtggaccgtgaagtgacacccttttttatcatctactgtcgagctctaaattctatgggccaggacctagagagaccactggagctcagggtgagagtgttggacatcaacgacaacccaccagtgttttctatggccacattcgcgggacaaatcgaggagaactccaacgccaataccctggtgatgatcctgaatgctaccgatgccgatgaacctaataatttgaactcaaagatagcgttcaagatcataagacaggagccatcagatagccccatgtttattattaatcggaatacaggcgagatccgaacaatgaataatttcctcgaccgcgagcagtacgggcagtacgcactagccgtgaggggtagcgacagggacgggggagccgacggaatgtcggcggagtgcgagtgtaacattaagattcttgatgtcaatgataatattccctacatggaacagagctcatacaccattgaaatccaggaaaataccctcaacagtaacctgttagaaatccgggttattgatttggacgaggaattctcggccaactggatggccgtcatcttctttatttccgggaacgagggcaattggtttgaaatcgaaatgaacgagcgcactaacgtgggtattctcaaggttgtcaaacctctcgattacgaggccatgcagtcccttcagctgagcattggcgtcaggaacaaagccgaattccatcattcaattatgagccagtacaagctgaaggcttctgctatcagtgtaactgttctgaatgtaattgaagggccagtcttcagacctgggtcgaaaacatacgttgtgacagggaatatgggtagcaacgacaaggtgggcgattttgtggccacagacttggacaccggcagaccaagtactaccgtcagatatgtgatgggcaacaaccccgctgatctgctcgccgtagattcccggacggggaaactcactctaaaaaataaggttaccaaagaacaatacaatatgcttggcggaaagtatcagggcacaatcttaagtatcgatgacaatctgcagagaacatgcaccggaacaatcaacatcaacatccagtcttttggcaacgacgatcgaaccaatactgaacccaataccaagatcaccactaacacgggcaggcaggaaagcacctcatcaactaactatgatacaagcacgacttcaaccgacagtagtcaggtctactcatctgaacctgggaacggcgctaaagacctattgtccgacaatgtccacttcggccctgcagggattgggttgctgattatggggtttctggtgctgggtcttgtccctttccttatgatctgttgcgactgcggaggggcacctagatctgccgctggcttcgaacccgtccctgagtgtagtgacggggctattcactcctgggcagtagaggggcctcagcctgagccacgagacatcactacagtgattccacagattccgcctgacaatgcaaatataattgagtgtattgataactctggcgtctacacgaatgaatacggcggtcgagagatgcaagacctcgggggaggagagcgcatgacaggattcgaactgacagagggagtaaagactagcggcatgcccgaaatctgtcaagaatacagtggaactctgagacggaattcaatgcgggagtgtagggagggaggcctgaacatgaacttcatggagtcctatttctgtcaaaaggcgtatgcttatgccgatgaggatgagggccgaccttctaatgactgcttgctgatctacgacatagaaggagttggcagtccagccggaagcgtgggttgctgtagtttcatcggggaggacctcgacgacagcttcctcgatacactgggcccaaagtttaagaaactcgctgatattagccttggcaaggaatcttatcccgaccttgatccctcgtggccgccacagtctactgagccagtttgtcttcctcaagaaactgagcccgtcgttagtggccaccccccaatttcgccccacttcgggacgacgaccgttattagtgagtctacatacccatccgggcctggtgtgctgcacccaaagcccatcttggatcccctggggtatggcaacgtgaccgtgaccgagtcatatactacatcagacacactaaagccatctgtgcacgtgcacgataaccggccagcgtcaaacgtcgtggtgaccgaaagggtagtcggacccatttctggggcagaccttcatgggatgctggaaatgcctgatttacgggatggtagcaatgttattgttaccgaacgggtgattgcaccatctagcagtctgccaactagtctcaccatccaccatcccagagaatcatctaacgtggtggttactgagagggttatacagcccacctctgggatgatcggcagcttatccatgcaccccgagcttgccaatgcccacaacgtcatcgtgacagagagggtggtctccggagctggcgtgaccggcatctcaggcaccaccggcatatctggtggtataggctcatctggattggtgggaacctcaatgggagccggttccggagcactgtctggcgcaggaatctcaggcggaggaatagggctctccagtctgggcggaactgccagtatcggccacatgcgaagctctagtgatcaccacttcaaccagaccatcggatccgctagcccctctaccgcccgtagcagaatcactaagtactcgacagtgcagtacagcaagtag

SEQ ID NO: 220657 - DNA, 3357 bp, Artificial Sequence
  Description of Artificial Sequence: Synthetic coding sequence
atggcgaggtcgccaggtcgtgcatatgccttgttgcttctactgatctgtttcaacgtcgggagcggactgcacctgcaggtcctgagcacacgaaatgagaataaattgttacccaagcaccctcacctcgtacgtcagaagagggcctggattacagccccagtggcgctgagagaaggcgaggacctgtcaaaaaaaaatccgatcgcaaaaatccactcggacctcgcagaggagagggggttgaaaatcacttataagtacactggaaagggcatcacggaaccacctttcggtatctttgtttttaataaggacactggcgaattaaatgttactagcattctggatcgtgaagaaaccccgttttttctgcttacagggtacgcactggatgcccgtgggaacaatgttgagaaaccactggaattacgcatcaaggtgttggacattaatgataatgagccagtgtttacccaggatgtatttgtaggaagcgtggaagagctttctgccgcacatactcttgttatgaaaatcaatgctaccgatgctgacgagcctaacaccctgaacagcaaaatctcatacagaatcgtgtcactggagccagcctacccccctgtcttctatctgaacaaagacacgggggagatctacactacatctgtaaccctcgacagggaagaacattcaagctatacactgaccgtcgaggcaagagatggaaatggagaggttacagacaagcccgtcaagcaagcacaggtccaaatccgaattctcgatgtgaacgacaacattcctgtcgtggaaaacaaggttctggaaggaatggtggaagaaaatcaggtcaatgtggaagtgacccgcattaaagtcttcgatgctgacgagataggatctgacaactggctggctaatttcacctttgcttctggcaatgaaggaggctactttcatattgaaacggatgcccagacaaacgagggcatcgtcaccttaatcaaagaggttgactatgaggaaatgaaaaatctcgatttttctgtcatcgtagcaaataaggcggcatttcacaagagcattcgctctaaatacaagcctacacccattcctataaaggtgaaagtcaagaatgtgaaggaaggtatacacttcaaatcttcagtcatctctatctacgtaagcgaatccatggatagatcttcaaaaggccaaattataggtaacttccaagcttttgatgaggatactggacttccggctcacgctcgatacgttaaacttgaagatagagataactggatttcggtggactccgtgacatccgagataaagttggccaagctgcccgacttcgaatctagatacgtgcagaacggaacatataccgttaagatagtggcaatcagtgaggattacccacgtaagacaattactggtaccgttctcatcaacgtggaagatattaacgacaactgcccaacattgatagaacccgtgcagaccatctgccatgatgccgagtacgtcaatgtcacagcagaggatctcgacggacatccaaattccggacccttttcattctccgtcatcgataaaccccctggtatggccgaaaagtggaagattgcaagacaggagtctacatcagttttgcttcaacagagtgagaagaaactaggccgaagtgagatccagtttcttataagcgacaaccaggggttcagctgtcctgagaaacaggttctaaccctgacagtgtgtgaatgcctgcacggctccggctgcagggaagctcagcatgactcatatgtcggacttggacctgctgccattgctctgatgatcctggcatttctgctgctgttgctcgtccccctgctgctgttgatgtgtcattgtggaaagggggcaaaaggctttacgcctataccaggcactatcgagatgctccacccgtggaataatgagggagctcctccagaagataaggtagtgcctagcttcctgcctgtcgaccaagggggaagcctagtcggcaggaacggcgttgggggtatggctaaggaagcaacgatgaagggctcctcttctgccagtatcgtcaaaggccagcatgagatgtcggagatggacggaagatgggaagagcatcgatctctactgagtggtagagctacccagttcactggggcaaccggcgctatcatgactaccgagaccacaaagaccgcaagggccacaggcgcttctcgcgacatggcaggcgcacaggccgcagctgtggccctgaacgaggaattcttgcgtaattactttacggacaaagcggcatcatatacggaggaagatgagaatcacacggccaaggactgcttgctagtctactcgcaggaagagaccgagtcactcaacgcaagcattgggtgttgcagtttcatcgaaggcgaactggatgatcgattccttgacgatttgggcctgaagttcaagaccctcgcagaggtttgtttgggccagaagatcgacattaacaaggaaattgaacaaagacaaaagcccgctacagagacctcaatgaataccgcaagtcacagcctgtgcgaacagactatggtaaactcggaaaacacttacagttcagggtctagttttccagtgcccaagagtctgcaggaggccaatgccgagaaggtaactcaggagatcgtgactgaaaggtccgtctcctcacgccaggctcagaaagttgccactcctttgcctgaccccatggcctcccgcaacgtaatcgccactgagacatcctatgtgaccggctcaaccatgcccccaacgactgtgattctgggcccatcccagcctcagtccctgattgttaccgagcgagtctacgcccctgcgtccacactggtggaccagccttacgccaatgagggcaccgtggtcgtgacagagagggtaatacagccccatggcggaggcagtaaccccctggagggcactcagcatctgcaggatgtcccctacgtgatggtgagagagagggagtcatttctagccccttcttccggggtgcagcctacactggccatgcctaacatcgccgttggacagaatgtgaccgttaccgaaagggtgctggctcccgctagtacactgcaatcctcctatcagattccaacagagaactctatgacagcacggaatactactgtttctggagccggagtcccgggtccactgcctgacttcggcctggaggaatccggccactccaactctacaattaccacctccagcactcgagttactaaacactccacagttcagcactcatacagctag

SEQ ID NO: 220658 - DNA, 3123 bp, Artificial Sequence
  Description of Artificial Sequence: Synthetic coding sequence
atggactggctcttttttcggaatatttgtctccttatcatactgatggtggtgatggaagttaattccgagttcattgttgaagtcaaagagtttgatatcgagaacggaaccacaaaatggcagacagtgcggcgacagaaaagggagtggattaaattcgctgccgcttgtcgtgagggggaggacaatagcaagcgtaaccccatcgctaaaatccgcagtgattgcgagagcaaccaaaagatcacatatagaatctctggggtaggaatagacaggccaccctacggcgttttcaccataaatcccaggacgggtgaaatcaacatcactagtgtagtggacagggagattactccgttatttctcatctattgtagagcactcaatagtaggggagaggacttggagaggccactggaactgagggtcaaagtgatggacataaatgataacgcaccagtgtttagtcagtctgtttacactgcaagtatcgaagagaattctgacgccaatactctcgtggtaaagctctgcgcgactgacgccgacgaagagaatcaccttaattcaaagattgcctacaagatagtgtctcaagagccttccggcgctcccatgttcatcctgaatcgctacaccggagaagtctgcactatgagttccttcctcgaccgtgaacagcactctatgtacaatctcgtggtaagaggtagcgatcgcgatggcgcagctgatgggctttcaagcgagtgcgattgtcggatcaaggtgctcgatgtgaacgacaacttcccaaccttagaaaagacctcatactctgcttcaatcgaggaaaattgcctcagttcagagctaatcaggctgcaggctattgacttagacgaagagggcaccgacaattggctggcccagtacttaatcctcagcggaaatgatggaaattggtttgacatccagaccgaccctcagactaacgagggcatacttaaagtggtgaaaatgcttgactatgaacaagctccaaatatccagttgtcaattggggtcaagaaccaggccgactttcattattctgtcgcatcacagtttcagatgcaccctacacccgtacgaatccaagtcgtggacgtgcgcgaagggcctgccttccacccgtccacaatggccttttccgttagggaaggcataaaagggagttctctgctgaattatgttctggggacttataccgcaatagacctggacaccggcaaccccgcaaccgatgtgcggtatatcattggccacgacgcaggtagctggttaaaaatcgactcacggactggggagatccagtttagtcgcgagttcgataaaaaaagtaagtatatcataaacgggatctatacagcagaaatcctggctatcgatgatggatcagggaagacggccacgggaactatttgcatcgaggtcccagacattaacgactattgccccaatatcttcccggagcggaggacgatttgtatcgactccccatcagtgctgattagtgtgaatgagcatagttatggatcaccttttacattctgcgttgttgatgagcctccaggaatcgcggatatgtgggacgtccgttcaaccaacgcaacatcggctatcttgacagcgaagcaggttctttcgcctggattttatgagatccccatccttgtgaaagatagctataacagggcctgcgagttagctcagatggtacagctttacgcatgtgactgcgacgacaaccacatgtgtttggatagcggagccgcaggcatctatacagaggacattacaggcgacacctacggcccagtgacagaagaccaggcaggcgtcagcaatgttggcctggggccagcaggcatcggaatgatggttctgggtatcttactgcttattctggcccctctcctccttcttctctgctgttgcaagcaacgccagcccgaaggacttggcacgcggtttgccccagtccctgagggtggggaaggcgtcatgcagtcttggaggatcgagggagctcatcccgaggaccgggatgtgtcaaatatctgcgcacccatgaccgcctccaacacacaggatagaatggattcttcagagatctacacaaacacctatgctgccggagggactgtggaggggggagtttctggcgttgaactgaatactgggatgggcactgccgttggccttatggccgcaggggcagccggagcatctggcgcagcccgaaagcggtctagcaccatgggcactttgagggactatgccgacgctgacattaacatggcctttctggactcctactttagcgaaaaggcgtacgcttatgcagacgaggacgaagggcgtcccgcaaacgactgtctgttgatttatgatcacgaaggagtcggaagcccagtgggcagtattgggtgttgtagttggatagttgatgacttggatgagagctgcatggagactctcgacccaaagttccggaccctcgccgagatctgtctcaatacggagattgagccattcccctcacaccaggcttgcataccaatatcaaccgacctgccccttttggggcctaattactttgtcaatgagtcaagtggcctgaccccaagtgaggttgaatttcaagaagagatggcagcctccgaacccgtcgttcacggcgacataatcgtgaccgaaacatacggcaatgcagacccttgcgtgcagcccactacaataatcttcgatccgcagctggcccctaatgtggtggtgactgaagcagtcatggcacctgtctacgacatccagggcaacatatgcgtaccagcggaacttgctgactataataatgtgatctacgccgagcgggttctggcttcgccgggtgttcccgatatgagcaactcttctaccaccgaggggtgcatgggccctgtgatgtcaggcaacattctggtcggacctgaaattcaggttatgcagatgatgtcgccagacttacccataggacagactgtggggagcactagtccaatgacctccaggcacagggtgactaggtactccaatattcattacacccagcagtag

SEQ ID NO: 220659 - DNA, 3180 bp, Artificial Sequence
  Description of Artificial Sequence: Synthetic coding sequence
atggactggctgttctttaggaatatctgcctgctgattattctcatggtggtcatggaggttaacagtgagttcatcgttgaggtgaaggaatttgacattgagaatgggactacaaagtggcagaccgtgcggaggcagaagagggagtggattaaattcgccgctgcctgcagagagggcgaagataacagcaagaggaatccaatcgccaaaatacgaagtgactgcgagtccaaccaaaagatcacttaccgaataagtggcgttggaatcgatcgccctccatacggtgtgtttactatcaatcccaggaccggcgagatcaatatcacctccgttgtcgaccgagagattacgcctcttttcctcatctattgccgggcacttaattctcggggtgaggacctggagcgacctttggaacttagagtgaaagtgatggacatcaatgacaacgctccagtgtttagccagagcgtctacacggcctcaatcgaagagaattccgatgccaacacacttgtggttaaactctgtgccacagacgctgatgaagaaaatcacctcaattcaaagatagcttacaagatcgtcagccaagagccctctggagccccaatgtttatcctgaaccgatacaccggggaggtctgtaccatgtcttcattcttggatcgagagcagcactctatgtataatctcgttgtgagagggtccgatcgagacggagctgccgacggcctgtcctctgaatgtgactgccgcatcaaagtgctagacgtgaacgataatttcccaactcttgagaagacttcatatagcgcaagcatcgaggagaattgtctgtcctctgagctaataaggttgcaggcgattgacctagatgaggagggcaccgacaactggctcgctcagtatctcatcttgtctggaaatgacgggaactggttcgacatccagactgatccacagactaacgaaggcatcctgaaggtcgtgaaaatgctcgattacgagcaggccccaaatatccaactgtccattggagtgaagaaccaggccgatttccactacagtgtcgctagccagtttcaaatgcaccccactcctgtgcgcatccaggtggtcgatgtgcgggagggccctgccttccatcctagcacaatggccttctctgtacgcgagggtattaagggttccagtctcttgaactacgtccttggaacttacaccgccatcgacctcgataccgggaaccccgcaactgacgtgaggtacataatcggacatgatgctgggagctggttgaaaatcgatagccgcaccggtgaaattcagtttagcagagagttcgacaagaagtcgaagtacattatcaacggtatctatactgcggagattctggcaatagacgatgggtcgggcaaaaccgccacaggcactatctgcattgaagtgcccgacataaatgactactgtccaaacatattccccgagagacgaacaatttgcatagactctccttccgtcctaataagcgtgaacgagcacagctacgggtcccccttcaccttctgtgttgtcgacgagccccctggaattgctgatatgtgggacgtcagatctacaaacgccacatctgccattttgaccgccaaacaggtattatctcctggcttctacgagatacctattttggtcaaagacagctacaatagagcttgtgaattagcacagatggttcaactctacgcgtgcgattgcgatgacaaccatatgtgtttagactcaggagcagcaggaatttacaccgaagatatcaccggggacacatacggaccggtgacggaagatcaggcaggcgtgtcaaacgtgggcctgggcccagccggtatcggtatgatggtgctgggtatcctgctgcttatccttgcccctttactcctcctgttatgttgctgcaagcagcgacagccagagggcctggggaccaggttcgcgcctgtgccggaaggtggtgaaggcgtcatgcagagctggcgcattgaaggagcccatcccgaagaccgcctgtttagcgcctacgccctccccggaggcggagggaccgcggatgggggagggtccgttttagggcgttgcgcattgcaagcaaccccagcgttactcaaccagcatcctcccttttccgaaatttacaccaatacttacgctgccggtggaaccgttgaaggcggagtgagtggggtggagctgaatacagggatgggaacagctgtgggactaatggccgctggtgccgcaggcgcttcaggtgccgcacggaagcgatcttctactatgggcacacttagggattacgccgacgcagacatcaatatggctttcctagatagttattttagtgagaaggcctatgcatatgcggacgaggacgagggcaggcccgctaatgactgcctgttaatctatgatcacgagggtgtgggctcccccgtaggttcaattgggtgctgctcatggatcgtggatgacttggatgagtcctgcatggaaaccctagatcctaaattccggaccctggctgaaatctgtctgaataccgagatcgagccatttcccagccatcaggcttgcattcccatctcaacagacctgccattgttggggcctaattatttcgtcaatgaatcatctgggctgacccccagcgaagtagagtttcaggaagagatggccgctagcgaacctgtggtgcacggggacataattgtgaccgaaacctatgggaacgcagacccatgtgttcagccaaccaccattattttcgacccccagcttgctcctaacgtggtggtcactgaggcagtgatggcacccgtatatgacatccagggtaatatctgtgttcctgctgaactggccgactacaacaatgtcatttatgctgagagagtgctggcgtctccaggcgtccctgacatgtcgaattcgagtacgaccgagggctgcatggggcctgtgatgagcggcaatatcctggtgggtcccgagatccaggtgatgcaaatgatgtccccggacttgcccatcggtcagacagtcggttctacctccccgatgacctctaggcacagggtcacccgatactcaaacatccattacacccagcagtag

SEQ ID NO: 220660 - DNA, 498 bp, Artificial Sequence
  Description of Artificial Sequence: Synthetic coding sequence
atggcatcaggcgtgcaggtggccgacgaggtttgcagaatcttctacgatatgaaggtgaggaagtgtagcacacctgaggagattaagaagcgaaagaaggctgtgatcttctgcctgtccgccgacaagaaatgtattatcgttgaggagggaaaggaaattctcgttggcgatgtgggagtgaccataactgacccctttaagcattttgtggggatgctccctgagaaggactgccggtatgccctgtacgacgcgtctttcgagactaaggagtcaaggaaggaagaactgatgttcttcctttgggctccagagttggcgccactcaagagtaagatgatctatgccagctccaaagatgcgattaagaaaaaattccaggggattaagcacgaatgtcaagccaatggacctgaagacttaaaccgggcttgcatcgccgagaagcttgggggatctctgattgtagcttttgagggatgccctgtttag

SEQ ID NO: 220661 - DNA, 447 bp, Artificial Sequence
  Description of Artificial Sequence: Synthetic coding sequence
atgaaggtgaggaaatgctctacccccgaagaaataaagaagcgcaagaaggctgtgattttctgcttgtcagcagacaagaagtgcatcatcgtggaggaagggaaagagatactggtgggggacgtaggtgtgaccattactgaccccttcaagcatttcgttggaatgttacccgaaaaggactgcaggtacgcactctatgatgcctcttttgaaactaaggagagccgaaaagaagagctcatgttcttcctctgggccccagaactggcacccctgaagagtaagatgatctacgccagctccaaagacgcgatcaaaaaaaaatttcagggaatcaaacatgagtgtcaggccaatggtcctgaagatcttaatcgggcatgtatcgccgaaaaactgggcggatcactaatcgtggccttcgagggctgcccagtatag

SEQ ID NO: 220662 - DNA, 897 bp, Artificial Sequence
  Description of Artificial Sequence: Synthetic coding sequence
atgtcggacgctaacctcgattcaagtaagaagaacttcctcgaaggggaagtagacgacgaggagagcgtcattctcacccttgtgcctgtcaaggacgatgcgaatatggaacagatggagccgtcagtgtcttctacatcagatgttaagctagaaaagccgaagaaatacaatccgggtcacttgctgcagactaatgagcagttcactgccccacaaaaagccagatgtaagattccagccctccctttacccaccatcctcccaccaatcaacaaggtttgccgtgatacactgcgggactggtgtcagcagctgggtctgtccaccaatggaaagaagatcgaggtgtacttaagactccaccggcacgcctaccctgagcagcggcaggatatgcctgagatgtcccaggagacccgactacaacggtgctctagaaaaagaaaggcagttactaaacgagccaggctgcagcggagctacgagatgaatgaacgcgcagaagagaccaacacggtggaagtcatcacaagcgccccaggggctatgctagctagttgggctcgtatcgctgcacgcgctgttcagcccaaggctctcaattcttgctccatccctgtcagtgttgaagcgtttctgatgcaggcttcaggtgttcggtggtgcgttgttcacggtagactcctgagtgctgacactaagggctgggtcagattacaattccacgccggtcaggcatgggtcccgaccactcacaggcgcatgatcagcctatttctcctgccggcttgcatctttccctcccccggaattgaagataacatgctgtgtccagattgcgcaaagcgcaataagaaaatgatgaagcggctgatgactgtcgaaaaatag

SEQ ID NO: 220663 - DNA, 480 bp, Artificial Sequence
  Description of Artificial Sequence: Synthetic coding sequence
atggacccgtcgcagtttaatcccacttatatccccggatcccctcaaatgctcactgaagaaaacagcagagatgactcaggagcgtctcaaatttccagtgagactctgatcaagaatctcagtaacttgaccataaacgcttcttccgagagcgttagcccactgagcgaggccctgctgagaagggagtcggtgggcgcagctgtgctccgcgaaattgaggatgaatggctatactcgagacggggtgtgaggacgctcctcagtgttcagcgcgaaaaaatggctagactgcggtacatgctcctaggcggtgtgagaacgcacgagcggagacctaccaacaaagagcctaagggtgttaagaaggagagtcgtccttttaaatgcccatgtagcttctgtgtcagcaacggttgggatccttccgaaaatgccagaatcggcaatcaagatactaagcccctgcagccatag

SEQ ID NO: 220664 - DNA, 915 bp, Artificial Sequence
  Description of Artificial Sequence: Synthetic coding sequence
atgctgcgcggttctgcatccagcacaagcatggagaaggccaaggggaaggaatggacctcaactgaaaaaagtcgggaggaagatcagcaggcttcgaatcagcccaactcaatcgcattacctggtacatctgctaaaaggaccaaagaaaagatgtcaattaaaggctccaaggtcctgtgtcccaagaagaaggccgaacatactgacaatcctcgcccacagaaaaaaattccaatccctcccctgcctagcaagctgccacccgtgaacctcatccaccgagatatcctgagggcctggtgccagcagctgaagttatcttccaagggccaaaagctcgatgcatataaaagattatgtgcatttgcctaccctaatcagaaagattttccctcaacagctaaagaggcaaaaattaggaagtctctgcagaaaaagttaaaggtggagaagggcgagacatctctgcagtcttcagagacacacccccctgaggttgccctgccccctgttggcgagcctccagccttagagaattccactgccttgctggaaggcgtgaatacagtcgtggtcaccacttcagcacctgaggcattgctagcttcatgggcccgaattagtgccagggctcgcacccctgaagctgtggagagtccgcaggaggcctcaggcgtccgatggtgcgtggttcacggcaagtctctgcctgctgatactgacggctgggtacacctccaattccacgcaggtcaggcatgggtgcccgagaagcaggaaggcagagtgagtgccctttttctcctgcccgcaagcaacttcccaccccctcatctggaagataatatgctgtgtcctaagtgcgtgcatagaaacaaggtgctcatcaaatccctccaatgggaatag

SEQ ID NO: 220665 - DNA, 351 bp, Artificial Sequence
  Description of Artificial Sequence: Synthetic coding sequence
atggggaccctgccagcccgtaggcacatacctccatgggtcaaagtgcccgaagacctaaaagatccagaagtctttcaggtacaaactcgcctcctgaaggccattttcgggccagacggtagtcgaatcccctatattgagcaggtgtcaaaagcgatgcttgagctaaaggcactggaaagcagtgatttgaccgaagtagttgtgtatggctcttacctgtataaactgaggaccaagtggatgttgcagtccatggccgaatggcatcgacaacggcaggagagaggcatgctaaagctggccgaagcaatgaatgccctggaattaggaccatggatgaaatag

SEQ ID NO: 220666 - DNA, 1104 bp, Artificial Sequence
  Description of Artificial Sequence: Synthetic coding sequence
atgagttcaaccctagctaagattgccgaaattgaagccgaaatggcaagaactcagaaaaataaagccactgcccaccacctcggcctgttaaaggccaggctggcaaagctgcgccgtgaactgatcacccccaagggcggtgggggtgggggacccggagaaggctttgacgttgccaaaacaggggacgcgaggattggtttcgtgggcttcccatccgttgggaaatcgacactgcttagtaacctagctggagtgtactccgaggtggcagcttacgaatttaccacactgacaacagttcccggtgttatccgctataagggagcaaagattcaattgctcgacctcccagggattattgagggagcgaaggacgggaaggggagagggagacaggtgattgctgttgcaaggacctgcaacctgatactcatagtgctggacgtgctaaagcctctggggcataagaaaatcattgaaaacgaactcgagggcttcggcatcaggctgaattctaaaccacctaacatcggatttaaaaagaaagacaagggcggaattaatctgaccgccacttgccctcagtcggagctagacgcagagacagtaaaatctattcttgcagaatacaagatccacaatgccgacgtgacgctgcgctccgatgccaccgccgacgatctcattgacgtggtcgagggaaacagagtctacattccctgcatctatgtcctgaacaagatagatcaaatcagcatcgaggagcttgacatcatctacaaggtaccccattgcgtcccaatcagtgcgcatcaccggtggaattttgatgatttgctggagaaaatctgggactatctgaaacttgtacggatttacacaaaaccgaaaggccagctgcctgactacacctctccggtcgtgcttccatattcccgaaccactgtcgaagacttctgcatgaagatccacaaaaatctaattaaagagtttaagtatgccctcgtttggggcctcagcgtcaaacacaacccccagaaggtgggtaaggatcatacattagaggacgaagacgttattcagattgtgaaaaaatag

SEQ ID NO: 220667 - DNA, 396 bp, Artificial Sequence
  Description of Artificial Sequence: Synthetic coding sequence
atggctgcagcggtggccatggagactgatgatgccggaaaccggctgaggttccaattggaacttgagttcgttcagtgccttgccaaccctaactatttaaacttcctcgcacaaaggggttacttcaaggataaggccttcgttaattacctgaagtatttgctgtactggaaggaccccgaatatgcaaagtatctgaagtacccgcagtgcttacatatgttggagttgttgcagtatgaacattttcgcaaggagctggtcaatgctcagtgcgccaaattcatcgacgagcaacaaattcttcattggcaacactacagtagaaaacgcatgaggttgcagcaggcccttgcggagcaacaacagcaaaacaatacttcgggaaagtag

SEQ ID NO: 220668 - DNA, 1032 bp, Artificial Sequence
  Description of Artificial Sequence: Synthetic coding sequence
atgggcatcctcgaaaagattagcgagatcgagaaggagatcgctcggacacagaagaataaagcgactgaataccatctgggtctactgaaagcaaaattggctaaatacagggcgcagctgctcgagccaagtaagagtgcatcatctaaaggagaaggattcgatgttatgaaatcaggagacgcacgggtggccctgattggatttccatcagtcggaaaaagtacatttctgagcttaatgacctcgactgccagcgaggctgcatcctacgagtttacaacccttacatgtatacccggagtgattgagtacaagggtgccaacattcagttgcttgacttgccaggaattatcgaaggcgctgcgcaaggaaaaggacggggtcggcaggtgattgccgttgcaaggactgctgatgtcatcattatgatgttagacgccacgaagggggaagtgcaaagatcacttctggagaaagagttggagtcggtcggaatccgcctcaacaagcataaaccgaatatttactttaagccgaaaaagggcggtggaatttcatttaattccacagttacgctaacgcagtgctctgaaaagcttgtgcaactgattctgcacgagtataaaatcttcaacgcagaggtcctcttccgcgaggactgtagtcccgacgaattcatcgacgttatagtggggaatcgggtgtatatgccgtgtctgtatgtgtacaacaaaatcgaccagatcagcatggaagaggtagatcggctggcgaggaagcctaatagcgtcgtgattagttgtgggatgaagctgaacctggactatcttctggaaatgctgtgggagtacctcgccctcacttgtatttataccaaaaagcgaggtcaaaggccagactttacagatgccattatcctgcgaaaaggcgcatccgttgagcacgtgtgtcaccgcatccatcggtcgctggcttcgcagttcaaggcgccagcccctagcactgtgaggtccggatgggcctag

SEQ ID NO: 220669 - DNA, 2037 bp, Artificial Sequence
  Description of Artificial Sequence: Synthetic coding sequence
atggaactgcgctcctatcagtgggaggtgattatgcctgctctggagggaaagaatatcattatatggcttccaacaggagccggtaaaactcgcgcagccgcatacgttgccaagaggcaccttgagaccgtggatggagccaaggtcgtggtcttggtaaatcgagttcacttggtgactcagcacggagaagagtttcgcagaatgctggacggtcgttggactgtaaccactctcagtggcgacatgggtcccagggctggtttcggacacctagcgaggtgtcatgatcttctaatctgtaccgcagagctgctacaaatggccctgacaagcccggaggaggaggaacacgtggagctgaccgtcttctctttgatagtggtggacgagtgtcaccacacccataaagatacagtatacaatgttatcatgagccagtacttggagttgaagctgcagagagcgcaacccctgccccaggtactgggcctgacagcatcgccgggaaccgggggtgcgagtaaattggacggtgctattaatcatgtcctccagctgtgtgccaacctagacacctggtgtatcatgagtccgcagaactgttgccctcaattgcaggaacatagccaacagccatgcaaacaatacaacctctgccataggcgcagccaggatcctttcggagatctgctaaaaaaactgatggatcagattcacgatcatctagagatgcccgagttgagccggaagtttggtacccagatgtatgagcagcaagtggtaaagctgagtgaggccgcagctttagcaggcctacaggagcagcgggtgtatgccctgcacctgcggagatacaacgatgcactcctgatacacgatacagtgagagcagttgacgcactggccgctctgcaggacttctatcacagagagcacgtcacgaaaacacagattctctgtgcggagagacgcctgttggctctctttgacgatagaaagaatgagctggctcacctggccacgcacggcccagaaaatcctaagctggagatgctcgaaaaaattcttcagcgccagttttcctcgtcaaacagccctcggggtatcattttcacacggacaagacagtctgcccactccctgctcttatggctacaacaacagcagggtctccagaccgtcgacatcagagctcagctcttaataggggctggtaatagcagccagtcaacccacatgacccaacgcgatcagcaagaagtgatccagaagttccaggatggcactcttaatttgctcgttgctaccagcgtcgctgaggagggcttggacattccccactgcaacgtggttgtgagatacggacttcttaccaatgaaataagtatggtgcaggcacggggacgtgcacgagctgaccagagtgtgtatgcctttgtggccacagaaggatccagggagctcaagcgggaactcattaatgaggctctcgaaacactcatggagcaagcagtggctgccgtgcagaaaatggaccaagcagagtatcaagctaagatcagggatctacagcaagccgctctgactaagagggccgcacaggcggctcagagggagaaccagcgacaacaattccctgttgagcacgtccagctgttgtgcatcaattgcatggtggctgtaggccatggttccgacctgcggaaggtcgagggaactcatcacgtgaacgtgaaccctaatttctccaattactataacgtttctcgagaccccgtggtgatcaacaaagttttcaaggactggaagccgggaggcgtaattagctgtcggaactgtggcgaagtatgggggctgcagatgatctacaagtctgtgaaacttcccgtactgaaggtgcgaagcatgctcttagagactcctcagggacggatacaggccaagaagtggtctagggtccccttttcagttcccgactttgacttcttgcagcactgcgccgaaaacttgtcggacctctccttagattag

SEQ ID NO: 220670 - DNA, 909 bp, Artificial Sequence
  Description of Artificial Sequence: Synthetic coding sequence
atggagctgcgttcctatcagtgggaggtgatcatgcccgcactggagggaaagaacattattatctggctgcctaccggcgcaggaaaaacgcgtgccgcagcatatgtcgcaaagcgccatctggagaccgtggacggagccaaggtcgtggtgctggtgaaccgtgtgcatctcgtgactcagcacggggaggagttccgccgaatgttggacgggaggtggaccgtcacaaccctcagcggcgatatgggcccacgggcaggcttcggccacctggccaggtgtcatgacttattgatttgcaccgccgagctgcttcagatggccctgacctcgcctgaagaggaagaacatgtcgaattaacagtgttttccttgatcgtagtggacgagtgccaccacacccacaaagacactgtgtataacgtgatcatgtcccagtatcttgagctgaaactgcagcgagcgcagcctctcccccaggtgttggggctaacggccagtcctgggacaggtggggcaagcaaactggacggagctattaatcacgtactacagctgtgtgcaaatctggatacttggtgcatcatgtcccctcagaattgctgcccacaactgcaagagcattctcagcagccatgcaagcaatacaacctctgccacaggcgaagccaggacccctttggggacttacttaagaagcttatggatcaaatccatgaccacctggagatgcctgaactctctcgcaaatttggcacccagatgtatgagcagcaggtggttaaactgtcggaggccgcagccttggctggcctgcaggaacagagagtctacgctctgcatcttagacgttataacgacgccttactgatccacgacaccgttcgtgcagtggatgcatag

SEQ ID NO: 220671 - DNA, 1464 bp, Artificial Sequence
  Description of Artificial Sequence: Synthetic coding sequence
atggagctaagatcgtaccagtgggaagtgattatgcctgccctggaggggaagaacataatcatatggctacccaccggggcaggcaaaaccagggccgctgcctacgtagctaagcgccatctggagacagtggacggcgctaaagtggtggtgttagtcaaccgggttcacctggtgacgcagcacggggaggaatttcgcagaatgctggacgggaggtggacggttactaccctctccggggacatgggcccaagagcgggattcggtcaccttgccaggtgtcatcatacacataaagataccgtatataacgtgattatgagccaatatcttgaactcaagttgcagagagcgcagccactcccgcaagttttgggtctgacggcctctccaggtactggaggagcttccaagctggacggcgcaatcaaccatgtacttcagctttgcgccaacctggacacctggtgcatcatgtcaccccagaactgttgtccacagctgcaagagcactctcagcagccctgcaaacagtacaacctctgccacaggcgcagtcaagatccttttggggacctgctgaagaaactgatggaccagattcacgatcatctggagatgccggagctttcaaggaaattcggcacacagatgtatgaacaacaggttgtcaagttgtccgaggccgcagcccttgctggactgcaggagcaacgcgtgtatgccctgcaccttcgcaggtataacgacgcccttctgatccacgatacagtcagagctgtcgacgccttggcggcactccaggacttttatcaccgtgagcatgtcacgaagacgcagatcttgtgcgcggaaagacgacttttggccctcttcgatgatcgaaagaatgagcttgcccatttagcaacccacggtcctgagaaccccaaattagaaatgctggaaaagatcttgcagaggcaattttctagttctaacagccccaggggaatcatatttacccgaactaggcagagcgcccactccttgctgctgtggctccagcagcaacagggactgcagaccgtcgatatccgagcccagctgctgattggtgccggtaactcttctcagtctacccacatgacgcagagagaccagcaagaggtgatccaaaaattccaagatggcacacttaacctactggtggcaacttcagtcgccgaggaaggtctcgatatacctcactgtaacgtggtcgtgagatacggcctcctgacaaacgaaattagcatggtgcaggccagaggtcgagcacgtgccgaccagtcagtctatgccttcgtcgctaccgaaggctcgcgagaactcaagcgggaattgatcaacgaggccctggagaccctgatggaacaggcagttgcagccgttcagaaaatggaccaggccgagtaccaagccaaagaattgctctag

SEQ ID NO: 220672 - DNA, 471 bp, Artificial Sequence
  Description of Artificial Sequence: Synthetic coding sequence
atggaattgagatcctaccagtgggaagtgattatgcctgcactggaggggaaaaatattatcatctggcttcctacaggagccggaaagacccgagccgcagcttatgtggccaagcggcacttagaaaccgtcgatggagcaaaggtagtggtgctcgtgaaccgagtgcatctcgtaacgcagcacggcgaagagtttcgacgaatgctagacggaaggtggaccgtcacaaccctcagcggtgacatgggtccgagggcaggatttggtcatctagccaggtgccacgatctgctgatctgcacagcggagctactgcaaatggccctaacatcccccgaggaggaagagcacgttgaactgacagtgttcagcctgatagtcgtagacgagtgccatcacacccataaggatactgtctacaatgtgattatgagccagtatctagagctaaaactgcaaagatag

SEQ ID NO: 220673 - DNA, 2208 bp, Artificial Sequence
  Description of Artificial Sequence: Synthetic coding sequence
atggctaaggaacggggtctgatatcgccctcagattttgcccaattgcaaaagtacatggagtactcaaccaaaaaggtcagcgacgtgctgaagctcttcgaggatggcgaaatggcaaagtacgtacagggagacgccatcggatatgagggtttccaacagtttctgaagatctatctggaggtggataacgttccacggcacctgtccctggcactcttccagagctttgagaccgggcattgcctgaatgagactaacgtgacaaaggatgtcgtctgcctcaatgatgtcagttgctacttttcactacttgaaggaggacggccagaagataagctcgaatttacctttaaactctatgatactgaccggaacgggattctcgattcttctgaagtcgacaaaatcatcctccagatgatgagagtggccgagtacctcgattgggacgtgtctgagttgcgtccaatcctgcaggagatgatgaaggagatcgattatgacggtagcggcagcgtctcacaggcagaatgggttagggctggtgccaccacggttcctctactggtgttgctcggcctggagatgactttaaaggatgacggccagcatatgtggagaccgaagcggttccctcgcccagtgtactgcaacctgtgcgagagcagtattggtctagggaaacaaggcttgagctgtaatctctgtaagtatactgttcacgatcaatgtgccatgaaggccctgccttgcgaagttagcacttacgcgaagagcaggaaagatattggtgtgcagtcccacgtatgggttcgaggcggttgcgagtctgggaggtgcgatcgatgtcagaaaaaaatcaggatttaccactccttaacgggcctccactgtgtgtggtgccacctggaaatccacgatgactgtttgcaagccgtgggtcatgagtgcgactgtgggctgttgagggatcacatattaccgccatcttccatatatccgtcggtgcttgcctctggccctgacaggaagaacagtaagactagccagaagaccatggatgacctcaatctgagcacatcagaggcactccgtatagatcccgtgcctaacacacatcccctgttggtatttgttaatccaaaaagtgggggtaagcagggacagcgggtcctgtggaagtttcaatacatattgaatcccaggcaggttttcaatctgcttaaggacggcccagaaatcgggctgaggctattcaaggacgtccccgattcaaggatcctggtgtgtggaggcgacggcaccgttggttggatattggagaccatcgacaaagcgaatttaccagttctgcctcccgttgccgtgctccctctgggtacaggcaatgatctggcccgatgtctgaggtggggaggtgggtatgaaggtcagaacctcgccaagatcctgaaggacctggaaatgtctaaggtggttcatatggaccgctggagcgtggaagtgattccacagcagacagaggagaagagtgatccagtgccttttcagatcattaataattatttctctatcggcgttgacgcctcaatcgcccacagattccacatcatgcgggagaaatacccagagaagttcaattcccggatgaaaaataaactatggtactttgagtttgcaacttccgagtccatttttagcacctgcaagaagctggaagagtctctgaccgtggagatttgcgggaaaccactcgacctttctaacctcagcttggagggtatagccgtgctgaacatccctagtatgcacggcggttctaacctatggggtgacaccagacgaccacacggagatatctatggcatcaaccaggctcttggggctaccgcaaaagtaattaccgatcccgatattctcaagacatgtgtgccagatctctcagataaaagacttgaagtggtgggacttgagggcgctatcgagatgggacaaatatatacaaaactgaagaacgctggcagacgtttggccaagtgcagtgagatcaccttccacaccacaaaaacacttcctatgcaaatagatggcgagccttggatgcagactccctgtaccattaagattactcacaagaatcaaatgccaatgttgatgggacccccacctcgatcgactaacttcttcggttttctctcctag

SEQ ID NO: 220674 - DNA, 2208 bp, Artificial Sequence
  Description of Artificial Sequence: Synthetic coding sequence
atggctaaagaaagggggttgatctccccatctgatttcgctcagttacagaagtacatggagtactccactaaaaaagtgagcgatgtgttgaaactgttcgaagatggcgagatggcgaagtatgttcaaggagatgcgatcggttatgaggggtttcagcagttcttgaaaatatatctcgaagttgacaatgtgccccgtcatttgtcactggctctgttccagtcatttgaaaccggacactgcctcaacgagaccaatgtgaccaaagatgtagtctgtctcaatgacgttagctgctacttttctcttctcgagggtgggaggcctgaagacaagttagagttcacgttcaaactttatgataccgaccgaaatggaatcctagatagcagcgaggtggataaaattatactgcagatgatgagggtagcagagtatctcgattgggacgtgagtgagctacggccaatcctgcaagagatgatgaaggaaatcgattacgacggttccggtagcgtgagtcaggcagaatgggttcgggcaggcgctacaacggtgcctttactcgtcctgttgggcctggaaatgacgctgaaagatgacggccagcatatgtggcgtcctaagcggttccccagacctgtctactgtaatctgtgtgaatcttcaatcggtttgggtaagcagggcctttcctgcaatctctgcaagtacacagtgcatgaccaatgcgcaatgaaagcactgccatgtgaagtctcaacgtatgccaaatctcggaaagacatcggggtgcagagtcacgtgtgggttaggggcggttgcgaatctgggaggtgcgaccgttgtcagaagaagatccgtatttaccattcacttaccgggctccactgtgtttggtgccacctcgaaatccacgacgactgcttacaggctgtaggacatgagtgtgactgcggactcctccgtgaccatatcctgcccccatccagtatctacccatcggtattagctagcgggcctgatcgtaagaattccaagaccagccagaaaactatggatgatctgaacctctccacctcagaggcattgcggattgacccggttcccaacacgcatcctctccttgtgtttgttaatcctaaaagtggcggaaaacaggggcaaagggtgctatggaaattccagtacattctgaaccccagacaggtattcaacttgctcaaggacgggcctgaaatcggtctgagattatttaaagacgttccagatagccgaatactggtgtgtgggggtgatggtactgtgggctggattcttgaaacaatcgacaaggccaatctacctgtcctgccaccagtggcggtattaccgctgggcaccggtaacgacctggccagatgcctgaggtggggaggcggatacgaaggccagaatctagctaagatcctgaaggatcttgaaatgagtaaggtggtgcatatggacaggtggtcagtcgaggttattcctcaacaaacagaggaaaagagcgaccccgtgccctttcaaatcatcaacaattacttctcaattggagtggacgcatccatagcccaccgcttccacatcatgagggaaaaatacccagagaaatttaactctagaatgaagaacaaactgtggtacttcgagttcgccacgagcgagtctatcttcagcacctgtaaaaagttggaggaatccctcaccgtggagatctgcgggaagccgctcgatctgtccaacctgagcctggaagggattgcagtgctcaatattccctccatgcatgggggatcgaacctgtggggagataccaggcgaccgcacggagacatttatggtatcaatcaagcactcggggcaacagccaaggtgatcaccgatccagatatactgaagacttgtgtgcctgatctgtctgacaagcgattggaagtggtgggcctggagggggcaatagaaatggggcaaatctacactaagctcaagaatgccggacgccgactggctaagtgcagcgagattacttttcacacaactaaaaccttaccaatgcagatcgatggggagccgtggatgcaaactccttgcaccataaagataacccacaagaaccagatgcctatgttgatggggccacccccaaggtccaccaacttctttggtttcttaagttag

SEQ ID NO: 220675 - DNA, 744 bp, Artificial Sequence
  Description of Artificial Sequence: Synthetic coding sequence
atggctaaagagcggggactgatctcgccctccgacttcgcacagttacagaaatatatggaatattctactaagaaagtgtcagacgtgctcaagctttttgaggatggagagatggcaaaatacgtgcagggcgatgcgatcggctacgaaggtttccaacagttcctgaagatctatttggaggtggataatgtccctcgacacctgtcactagcattgttccagagcttcgagactgggcattgtttgaatgagaccaacgtaacaaaggacgtggtatgcctaaacgacgtttcatgctacttctccctgctggaggggggaaggcccgaagacaagcttgagttcacattcaagctgtatgacacagaccggaacggtattttggacagtagtgaggtagacaagatcatcctgcagatgatgagggttgctgagtacctcgattgggatgtgtccgagttgagacctatcctgcaggagatgatgaaggaaatcgattatgacggatctggcagcgtttcccaagctgagtgggtcagggcaggagcaactaccgtccccctgctagtactgctggggttagagatgacccttaaggatgatggccagcacatgtggaggccaaaaaggtttccacgcccagtgtattgtaacctctgcgaatcttcgataggcctgggcaagcagggtctttcttgcaatcgccctataacgtgcgttggggctagacgcctttag

SEQ ID NO: 220676 - DNA, 351 bp, Artificial Sequence
  Description of Artificial Sequence: Synthetic coding sequence
atggctaaagaacggggacttatcagccccagcgactttgcccaacttcagaagtatatggaatacagcaccaaaaaagtgagtgacgtcctaaaattgtttgaggatggtgagatggccaaatacgtgcagggggatgcgataggctatgaggggttccagcagttcctcaaaatttatcttgaggtggacaatgtgccacgccatttgagtctcgctctcttccaatcctttgagactggtcactgcctcaacgagactaatgtaacaaaggacgtggtgtgtctaaacgatgttagttgttacttcagcctcctcgagggcggacggccagaggataagctggagtag

SEQ ID NO: 220677 - DNA, 177 bp, Artificial Sequence
  Description of Artificial Sequence: Synthetic coding sequence
atggcgaaggaacgaggcttgataagcccctcggacttcgcccagctgcaaaaatacatggaatactctaccaagaaagtatctgatgttcttaagctgtttgaggacggagaaatggccaagtacgtgcagggcgatgctattggatatgagggctttcagcagtttctgaaatag

SEQ ID NO: 220678 - DNA, 66 bp, Artificial Sequence
  Description of Artificial Sequence: Synthetic coding sequence
atggccaaagagcgcggtctcataagcccgagtgacttcgctcaactccagaagtacatggaatag

SEQ ID NO: 220679 - DNA, 444 bp, Artificial Sequence
  Description of Artificial Sequence: Synthetic coding sequence
atggctaaagagcgtgggctaatttcaccttccgattttgcccagctccagaaatacatggaatactccaccaaaaaggtctccgacgtacttaagttgtttgaggatggtgaaatggcgaaatacgtgcagggggatgccatcggatatgaagggtttcagcaatttctgaagatttatctggaggtcgacaatgtgcccagacatttgagcttggcgctatttcagtccttcgagacaggacactgtcttaacgaaacgaacgtgaccaaggacgtggtctgcttgaacgacgtgagttgttacttctcactgctggaaggaggtcgtcccgaagataagctcgagttcacctttaaattgtatgatacagacaggaacggtattctcgatagcagtgaggttgataaaatcatcctgcagatgatgcgcgttgcagagtag

SEQ ID NO: 220680 - DNA, 2208 bp, Artificial Sequence
  Description of Artificial Sequence: Synthetic coding sequence
atggcgaaggaaagaggtctgatctccccatccgatttcgcacagctgcagaagtacatggagtatagtactaagaaagtttccgacgtactgaagctattcgaagatggggagatggcaaagtatgtccaaggcgacgcaatcggatatgaaggatttcagcagtttttgaagatttaccttgaggtcgacaacgtccctagacaccttagtttagctctgttccagagcttcgagaccggccactgtctcaacgaaacaaacgtgacaaaggatgtagtctgtctgaatgatgtgtcctgttacttctccttactggaggggggaagaccagaagataaactcgaatttacattcaaactgtacgataccgacagaaatgggatcctggacagttcggaggttgacaaaatcatcctccaaatgatgcgcgtcgccgagtatctggattgggatgtgtcagagctccgccctattctgcaagaaatgatgaaggagatagattacgacggttctgggtccgtgtctcaggctgaatgggtaagggctggagccacaaccgtacctctcctcgtgcttttaggcctcgaaatgaccctgaaggatgatgggcagcacatgtggagacccaaaaggtttcctcgcccagtgtattgcaatctctgcgagagctccatcggcctgggaaagcagggattgtcttgtaatttgtgtaagtacaccgtacacgaccagtgcgccatgaaagctttaccctgcgaagtgtccacttatgcaaagtcacggaaggatattggtgtccagagccacgtgtgggtaaggggcggttgcgaatccgggcgatgcgaccggtgtcagaagaaaattaggatctatcacagtctgaccggcctgcactgtgtctggtgccatttagaaatccacgatgactgcctgcaggccgtgggccacgaatgcgactgtggtctcctgcgggatcatatcctgcccccatcctcaatttaccctagtgtcttagcttcagggccagatagaaaaaatagtaagacctctcaaaaaaccatggatgacctgaacttgagcacctccgaggcactgagaatcgaccctgtccccaatacccaccccctgctcgtgttcgtcaacccaaaatccggcggtaagcaaggacagcgggtcttgtggaagtttcagtatatactgaatccacgtcaggtttttaaccttctgaaagacggacctgagatcggccttcgtctattcaaagacgttcccgactccagaattctcgtgtgtggcggagatgggacagttggctggatcctcgaaacaattgataaggccaatctgcccgtcttgcctcccgttgcggtgctgccactggggaccggaaatgacctggctcgctgtctgcgttggggcggtggttacgaagggcagaacctggcgaaaattttgaaagatttggagatgagcaaagtggtgcacatggacagatggagcgtggaagttattccccaacaaacagaggaaaagagcgatccggtgccatttcagatcatcaacaattacttctccatcggagtcgatgcctctatagctcacaggttccacataatgcgtgaaaaataccctgaaaagttcaacagccgcatgaagaacaaactttggtacttcgaattcgcaacgagcgaaagcatcttcagtacatgtaagaagctggaggagtcactgacagtcgagatttgcgggaagcccctggacctcagcaatctctccctggaggggatcgcagtgttaaacatcccctctatgcacggaggttctaatctttggggagatacaagacggccacacggggatatctacggaataaaccaagcgctgggcgcaaccgctaaggtaataaccgatccagacattctgaaaacttgcgtcccagacctttcagacaagcgcctcgaagtggtgggactggagggggcaattgagatgggacaaatctataccaaactgaagaacgcgggtcggcgacttgccaagtgctccgaaatcacttttcacactacgaagaccttgcctatgcagatcgacggcgagccttggatgcaaactccctgcacaattaaaatcacgcataagaatcaaatgccaatgctgatgggcccacccccacgatcaacaaattttttcgggttcctttcctag

SEQ ID NO: 220681 - DNA, 402 bp, Artificial Sequence
  Description of Artificial Sequence: Synthetic coding sequence
atggccaaagagcgaggcttgatatccccatccgacttcgcccaactgcagaaatacatggaatatagcactaaaaaggtgtctgacgtcctgaagttgttcgaggacggtgagatggctaagtacgttcagggtgatgctatcgggtacgaggggtttcagcagttcttaaaaatttacctggaggtggacaacgtgcctcgtcacctgtctctggcactgttccaaagtttcgaaactggacattgcctgaacgaaactaatgtgaccaaggacgttgtgtgcctcaatgacgtttcatgctactttagcttgctagagggcggacgaccagaagacaaactggagtttacttttaagctgtatgatacagaccgcaacggaatccttgactcgagctag

SEQ ID NO: 220682 - DNA, 324 bp, Artificial Sequence
  Description of Artificial Sequence: Synthetic coding sequence
atggccaaagaaagaggcctgatatcaccatccgacttcgcccagctgcaaaaatacatggagtacagcacaaaaaaggtcagcgatgttctgaagctgtttgaggatggtgagatggccaagtatgtccaaggggatgccatagggtatgagggttttcagcaattcctgaagatctaccttgaggtcgataacgttccaagacacttgagcttggccctgtttcagtctttcgaaacgggccactgtctaaacgagacaaacgtgacgaaagatgttgtgtgtctgaacgacgtgagctgttacttttctctcctggagtag

SEQ ID NO: 220683 - DNA, 135 bp, Artificial Sequence
  Description of Artificial Sequence: Synthetic coding sequence
atggccaaagagcgcggactgatttccccctctgactttgctcagctgcagaagtatatggagtatagcactaaaaaggtgtccgatgtccttaaactgttcgaggatggagaaatggccaaatatgtacagtag

SEQ ID NO: 220684 - DNA, 135 bp, Artificial Sequence
  Description of Artificial Sequence: Synthetic coding sequence
atggcgaaagagcggggtcttatttctccttctgactttgcacagctccaaaagtacatggagtacagtacgaaaaaggttagcgacgtactgaagctgttcgaggatggcgaaatggccaaatatgtccaatag

SEQ ID NO: 220685 - DNA, 402 bp, Artificial Sequence
  Description of Artificial Sequence: Synthetic coding sequence
atggccaaagagcgcggactcatcagcccgagcgattttgcccagctccaaaagtatatggagtactccacaaagaaggtgtctgacgtcctgaagctgtttgaggacggggagatggctaaatacgtgcaaggggacgctatcggctacgagggcttccaacaattcctgaagatctatctcgaagtcgacaacgtccccaggcacctgtctctcgcattattccagtcctttgagactggacattgcctgaatgagactaacgtgaccaaagatgtggtttgcctgaatgatgtttcatgttacttcagtctcctcgaaggcggtcgtcccgaggataaactggagttcacatttaagctttacgatacagaccgtaacggaatactggatagttcctag

SEQ ID NO: 220686 - DNA, 135 bp, Artificial Sequence
  Description of Artificial Sequence: Synthetic coding sequence
atggcaaaagaacgaggactgataagtccctcagattttgcccagctgcagaaatacatggaatattcgaccaagaaagtgtccgacgtgctgaaactgttcgaggatggcgaaatggctaaatatgtgcaatag

SEQ ID NO: 220687 - DNA, 2415 bp, Artificial Sequence
  Description of Artificial Sequence: Synthetic coding sequence
atgacaaaccaggagaagtgggcacacttgagcccgtcagaattttctcagcttcaaaaatatgccgagtattccactaaaaaacttaaggatgtgctggaggagttccacggcaatggggtgctggcaaagtacaatcctgagggaaaactggttgtgctcggaaataccatcgattttgagggctttaagctgtttatgaagacatttctggaagctgagctacctgacgactttacagcacatctgttcatgtcttttagtaacaagtttccacacagttcccctatggtgaagagcaagcccgcactgctcagcggtggtctgcgaatgaataaaggcgcaattactcccccaaggaccaccagccccgctaatacctgctcccctgaggtcattcacttgaaggatatcgtgtgctatctgagtctgctggagcggggacgcccagaagacaagctggagttcatgtttcggctctacgatacagatgggaatgggttcctggacagtagtgagttggaaaatattatctcacagatgatgcatgtggcggaatatctggagtgggacgtcactgaattaaaccctattcttcatgaaatgatggaagagattgactatgaccacgatgggactgtttccctggaggagtggattcagggcggaatgaccactattcctctcctcgtgctcctagggctcgaaaataacgtaaaagacgacgggcagcatgtctggcggctcaaacatttcaataagcccgcttactgcaatctgtgcttgaatatgctgattggcgtgggaaaacaagggctgtgctgcagtttttgcaaatatactgtccacgagagatgtgttgccagagccccaccaagttgcattaagacctatgtgaagtcaaagcggaacaccgacgtcatgcatcattactgggtggaggggaactgtcctactaagtgtgacaagtgccacaaaacagttaaatgttaccagggtctaaccggtctccattgcgtgtggtgccagatcactttgcacaacaagtgcgcttcacatcttaaacctgaatgtgattgcggaccacttaaagaccatatcctgcctcccactaccatttgccccgtggttctccaaacactgcccacctctggagtgtccgttcccgaagaacggcaatccactgttaagaaggaaaagtccggctcccagcaacctaataaggtgatcgacaagaataagatgcagagggctaactcggttaccgtggacggacaaggcctgcaagtgacccccgttcccggaactcatccgctactcgtctttgtgaaccccaagagcgggggtaaacaaggggaacgcatctatcggaagtttcagtacctgctgaaccccaggcaggtgtactcgttgtcgggaaacgggcctatgcctgggctgaacttcttcagggatgttcctgacttccgagtactggcctgcggcggagatggtactgtgggctgggttcttgattgcatcgaaaaagccaatgtggggaaacatcccccagtggcgatcctacccttaggcaccggaaacgacctggccaggtgcctgcgatggggcggagggtatgaaggggagaacctgatgaaaatcctgaaggacatcgagaatagcacagaaataatgctggatagatggaaattcgaggtaatcccaaacgacaaggacgagaaaggggaccctgtgccctattctatcattaacaattacttttcgatcggcgtcgacgcatccattgcgcatcggttccacatcatgagggagaagcatccggaaaagttcaattcccgcatgaagaataagttttggtactttgaatttgggactagcgagacatttagcgctacgtgcaagaaattacacgagtctgttgagattgagtgcgacggcgtgcagatcgatcttatcaatatatccctggagggaatcgcaatattgaacatccccagcatgcacggcggatctaacctgtggggcgaatctaagaagcgcaggtcccacagaaggatcgagaaaaaaggttctgacaagcgcacaacagtcaccgatgcaaaggagcttaagtttgccagtcaggacctaagcgaccagcttctagaagttgtgggactcgagggtgcaatggaaatggggcagatttatactggcctgaagagcgcaggcaggaggctagctcagtgctcttgcgtggttatccgcacgtcaaaatcacttccaatgcagatcgacggggagccgtggatgcagacgccgtgtacaattaaaattactcacaagaatcaggcccctatgctgatgggccctccacctaagactggtctgttctgctctctcgtgaaacgcaccagaaatcgctccaaggagtag

SEQ ID NO: 220688 - DNA, 2415 bp, Artificial Sequence
  Description of Artificial Sequence: Synthetic coding sequence
atgacaaatcaggaaaagtgggcccacctatccccaagtgagttcagtcagttgcaaaaatacgcagaatattctaccaagaaactgaaggatgtgctggaggagtttcacggaaacggcgttctggccaagtataatcccgagggaaagcaggacattcttaaccagacaatagacttcgagggtttcaagcttttcatgaagaccttcctcgaagctgagctccccgatgattttacagcgcacctgttcatgtctttttctaacaaatttcctcatagtagtcctatggtgaaaagtaaaccagcgcttcttagtggcggactgaggatgaacaagggagcgatcactccccctaggaccactagtcctgccaacacctgtagtcccgaagttatacatctgaaagatatagtgtgttatctttcactgctggagcggggtcgccctgaggataaactcgaattcatgtttcggctatacgatactgatggcaatggttttctggactcaagtgaactggaaaacatcattagccagatgatgcatgtcgcggaatacctcgagtgggatgtgaccgagctgaacccgatacttcacgaaatgatggaggagatcgactatgatcacgatgggaccgtgagcctggaagagtggatacagggcggaatgacaaccatcccactgctcgtattgctgggcctcgagaacaacgtgaaagatgatggccagcatgtgtggcgcttgaagcatttcaataaaccagcatattgtaatctctgcctgaacatgctgattggcgtggggaaacaaggcctctgctgctccttctgtaaatatacagtccacgaacggtgcgtggcccgagctcctccctcttgtatcaagacttatgtaaagtcaaaaaggaataccgacgtcatgcaccactattgggtagaagggaactgcccaactaaatgtgataagtgtcacaagactgtgaaatgttatcaaggactgacaggactccactgcgtttggtgtcagatcaccctccacaataaatgcgcctcacacctgaagcctgagtgcgattgcggccctttgaaagaccacattctgccgcctactaccatctgccccgtggtgcttcagacactgcccacctctggcgtgagtgtgcccgaggagcggcaatctacagttaaaaaggaaaaaagtggcagccaacagcctaataaagtaatcgataagaataagatgcaacgcgcaaacagcgttacggttgacggtcagggtctgcaggtgactcctgtgcctggtacgcacccactcttggtgttcgtaaaccccaagtccgggggtaaacagggtgaaaggatttatagaaagtttcagtacctcctcaaccctagacaggtgtacagcctgagcggaaacgggccaatgcccggactaaacttttttcgagacgtacctgattttagggtgctggcatgtggtggtgatggcaccgtcgggtgggtgttagattgcatagaaaaggcaaacgtagggaaacacccaccagtggccatcctgcctctcggaaccggaaatgatttggcacgctgtttgcgttggggtggtggctacgaaggcgagaatctcatgaagattctcaaagacatcgagaactcaacggaaattatgctggacagatggaagttcgaggttattcccaatgataaggacgagaaaggagaccctgtgccttactctataatcaataactatttctcaattggggtggacgcctccatcgcccatagattccatatcatgcgagagaaacatcccgaaaaatttaactcacgaatgaagaacaagttctggtatttcgaatttgggacttccgagaccttttcagcaacctgtaaaaagctgcacgagtcagttgaaatcgagtgcgacggggtgcagattgatctaatcaatatctccctggagggaattgctattttgaacattccttccatgcatgggggttcgaatctgtggggggagtcaaagaagcgcaggagccacaggcgcatcgagaaaaaagggagcgacaaacgaaccaccgttactgatgccaaggagttaaagttcgcctcccaggatctctcagatcagctcctggaggttgtgggactggagggcgctatggagatgggtcagatctacaccggcctgaagtcagctggaaggcggctggcccagtgcagctgcgtggtcatacggacaagcaagagcctgcctatgcagatcgacggtgagccgtggatgcaaaccccctgcaccataaagattacacacaaaaaccaggctccgatgctcatggggcctccccctaagactggactcttctgctccttggtgaagcggacccgtaacaggtccaaggagtag

SEQ ID NO: 220689 - DNA, 2412 bp, Artificial Sequence
  Description of Artificial Sequence: Synthetic coding sequence
atgaccaatcaggagaaatgggcacacctctcccccagcgagttttctcagttgcagaagtatgctgaatactcgactaagaagctgaaggacgtcctagaagagttccacggtaatggggtgctggcaaagtacaatcccgagggtaagcaggacattctgaaccagaccattgatttcgagggcttcaagctattcatgaagacatttctcgaagccgagctgcctgatgacttcactgctcacctctttatgtcattttccaataagttccctcacagttccccgatggttaagtccaagcccgctctgctcagtgggggtctgaggatgaataaaggggcaatcacaccaccgcgaacaacttcaccagcgaacacctgcagccctgaagtgattcacctgaaagatatcgtgtgttatcttagtttacttgagagaggcaggcccgaagataagttggagtttatgttcagactttacgacaccgacggaaatggattcctagactcttccgagctggagaatattatatcccagatgatgcacgtcgcagagtatcttgagtgggacgttaccgagctcaatccaatcctccatgagatgatggaggagattgactacgaccatgacggcacggtctccctggaagagtggatccagggaggaatgacgacaattccattgctggtgttacttgggctggagaacaacgtcaaggatgacgggcagcacgtttggcgcttgaaacatttcaataaacccgcatactgtaatttatgtctcaatatgctgataggcgtcggtaagcaagggctgtgttgtagcttctgcaagtacacggttcacgagcggtgcgtggctagagccccaccgtcttgcattaaaacctatgtgaaaagtaagcggaatactgacgtcatgcaccactattgggtcgagggcaactgccctacaaaatgcgataagtgccataagacggtgaaatgttaccagggcctcaccggattgcattgcgtgtggtgccagatcacgttgcataacaagtgcgcatctcacctgaagccagaatgcgactgcgggccactaaaggaccacatcctcccccctactacaatctgccccgtcgtgcttacactaccaacctccggagtatccgttcccgaggaacgccagtctacagtgaagaaagaaaaatcagggtcgcagcagcccaataaggtcatagacaaaaacaaaatgcagagggccaattctgtgactgttgacgggcagggcctgcaggtcactccggttcctggcactcacccactgttggttttcgtgaatccaaagtccgggggaaaacaaggagagaggatttatagaaaatttcaatacctcttaaatcctagacaggtttattccctatctggcaatggccctatgcctggcctcaacttctttcgggatgtccctgacttcagggtgctggcctgcgggggagatggcaccgtaggttgggtgctcgattgtattgagaaagctaacgtcggcaagcaccctcccgtagcaattctcccgcttggcactggaaatgatctggccaggtgtctacgctggggaggcggatacgaaggcgagaacctgatgaagatcctgaaagacattgagaactcaacagagatcatgttagaccggtggaagttcgaagtaatacctaacgacaaagacgagaagggtgacccagtgccgtattccattataaacaattattttagtattggtgtggacgcttcaatagcacaccgatttcatatcatgcgcgaaaagcacccagagaagttcaatagccgcatgaagaacaagttttggtacttcgagttcggtacttccgaaactttctcagctacctgtaagaaactgcacgagagcgtggagatcgaatgcgacggtgtgcagatcgatctgattaacatctctcttgagggtattgcgatcctgaacattccatcgatgcatgggggttcaaatctctggggcgagagtaaaaaacgtaggtctcatagacgaattgaaaaaaaaggatctgataagagaactactgtgaccgatgcgaaggaactcaaatttgctagtcaagacttgtccgaccaactgctcgaggttgttggcctcgagggggcaatggaaatgggccagatttatacagggctcaagagcgctggaagacgacttgcccagtgcagctgtgtggttatccgcactagtaaaagccttccgatgcaaattgacggagaaccatggatgcaaaccccatgcacaattaagataacccataaaaatcaggctccaatgttaatgggacctcctccaaaaactggactattttgctctctcgtgaagagaacaagaaatcggagcaaggagtag

SEQ ID NO: 220690 - DNA, 2415 bp, Artificial Sequence
  Description of Artificial Sequence: Synthetic coding sequence
atgactaaccaggagaagtgggcacacctgagcccgagcgagttcagtcagttgcagaagtatgccgagtacagtactaagaaattaaaagacgtgctcgaggagtttcatggaaacggagtgcttgctaagtacaaccctgagggcaaacaggatatcttgaaccagaccatcgatttcgaggggtttaagttgtttatgaagaccttcctggaggcagagctgcccgacgactttacagctcacctgtttatgtcatttagcaataagttcccccacagctcaccaatggttaaatctaagccagcactgctttctggcggtctacggatgaacaagggcgctatcacaccccctcggactacaagtcccgcaaacacctgctcccccgaagtgattcacctcaaagacatagtgtgttaccttagcctcttggagcggggacgccctgaggacaaactggagtttatgttcagactgtacgatacggacggaaacggattcctggatagcagtgaactggagaatattatttcacagatgatgcacgtcgccgagtatcttgagtgggatgttacagagctgaatccaattctccatgagatgatggaagagattgattatgatcacgacggcactgtcagtcttgaagagtggatacaggggggtatgacaacgatcccactgcttgtgttgctgggacttgaaaacaatgtgaaggacgacggccaacacgtctggcggctcaagcattttaataagccagcctattgtaacctctgtcttaacatgctgattggcgtcggtaagcagggcttgtgttgcagtttttgcaaatatacagtacacgagaggtgcgtggcccgtgctcccccatcttgcattaagacatacgtcaagagtaaaagaaatactgatgttatgcaccattactgggtggaaggcaattgccccacaaagtgcgataagtgtcacaagacagttaagtgctaccaaggcttgaccggcttgcattgcgtatggtgtcagataacacttcataacaaatgtgcatcccacttgaagccagagtgcgactgcgggccactgaaggatcacatccttccgcctacgactatttgtccagtcgtgctgcagacccttccaacctcaggagtgagcgtgccggaagagcggcagagtaccgtgaagaaggaaaaatcaggcagtcaacaacctaacaaggtcatagacaaaaacaaaatgcagcgcgctaactctgtcacagtggacggtcagggtcttcaagttacgccagtgcctggcacccatcccttgctggtgtttgtcaatcccaagagcggaggtaagcagggagaacgtatttatcggaagttccagtatctgttaaacccccgtcaggtgtactcactgagtggcaatgggcctatgccgggtctgaatttttttagagatgtccccgatttcagggtgctggcttgtggtggagacggaaccgttggttgggttctcgactgtatagagaaggcgaacgtggggaaacatccccctgtagctatacttcccctgggaaccggaaatgatctggccaggtgtttgcgatgggggggtgggtacgagggagaaaacctgatgaaaatactcaaggacatcgaaaattccacagagatcatgctggaccgctggaagttcgaagtaatccctaatgacaaagatgagaaaggcgaccccgtgccttactctattataaacaactacttctccattggcgtggatgcgtccattgcccacaggttccatatcatgcgggaaaagcacccggagaaattcaactcacgtatgaaaaacaaattctggtatttcgaattcggcaccagcgagaccttctccgccacctgtaaaaaactacatgaaagcgtggagatcgagtgcgacggagttcagatagacctgatcaacatttccttggagggtatcgccatcctcaacataccgtccatgcacggaggctcaaacctctggggagagtctaaaaagaggaggtcgcatcgccgaatagaaaagaaagggtctgataagagaacaacagtcaccgacgccaaagaactgaagtttgccagtcaggatctgagtgaccaattactggaagtggtaggcttggaaggtgccatggaaatgggacagatatacactggattgaagagcgcagggagacggcttgctcagtgcagctgcgtggttataagaacaagtaaatcactgccgatgcagattgacggagagccctggatgcagaccccttgcacaatcaagatcacccacaagaaccaggcaccgatgctgatgggccctccacctaagacagggctcttttgttctctggtgaagagaacgcggaatcgctccaaggaatag

SEQ ID NO: 220691 - DNA, 2322 bp, Artificial Sequence
  Description of Artificial Sequence: Synthetic coding sequence
atgactaaccaagaaaaatgggcgcatctgtctccttctgagtttagccagttgcagaagtatgccgaatactcaacgaagaaactcaaggatgtactcgaagaatttcacgggaatggagtactcgccaagtacaaccccgagggtaagcaggatatcctgaaccaaacgatagacttcgagggctttaaactgtttatgaaaacctttctcgaggccgagctccctgacgacttcacagcccacctgtttatgtcattctcaaataagttcccgcattcttcacccatggttaagtctaagcccgctcttcttagcggaggattgagaatgaacaaaggcgctatcaccccgcctcggaccacctctcccgcaaatacctgctcacctgaagtgatacatctcaaggacatcgtatgctacctctctcttctggaacgaggacgcccagaagacaagctcgagttcatgttcagattatacgacaccgatggcaatggattcctcgactccagcgagttggagaatatcataagccagatgatgcatgttgcagagtatttagaatgggatgtgacagagctaaatcctatcttgcatgagatgatggaagaaatagactatgatcacgatggaactgtgtccctagaggagtggattcaaggaggcatgacaactattcctctcctcgtcttattagggctggaaaacaatgtcaaggatgacggccagcatgtctggcgactgaagcactttaataagcctgcatattgcaacctctgtctcaatatgctgataggagttgggaaacagggattatgctgtagcttttgcaagtacacggtccacgagagatgtgtggcccgtgcacctcccagttgcatcaaaacatacgtgaaaagtaagcgaaacactgacgtcatgcatcactactgggtggagggaaattgtcccaccaaatgtgacaagtgccacaagactgttaagtgttaccagggactgactggactgcactgtgtctggtgtcagattaccctccataacaaatgcgcatcacacctgaagcccgaatgcgactgcggcccactcaaagatcacattctccctccaacaactatttgtcccgtggtgctgcagacactaccaaccagtggagtatctgtgccagaggaaagacagagcactgttaagaaagagaagagcggcagtcaacagccaaacaaagtcatcgacaaaaacaagatgcaaagagctaattcggtgacagtcgacggccaaggtcttcaggtgacccccgttccagggacccacccattactggtgtttgtgaacccaaaatccgggggaaagcagggagaacggatttatagaaagttccagtatcttttgaacccacgccaggtatactctctgtctggcaatggccctatgccgggactgaattttttcagggatgtaccagattttcgggttcttgcttgtggaggtgacgggaccgtgggctgggtgctcgactgcattgagaaggctaatgtgggcaaacatccacctgttgcaattctcccactcgggacaggcaacgatctggcacgatgtctacgatgggggggaggatacgagggagaaaacctgatgaaaattttgaaagacattgagaattctactgagataatgctggatcgctggaagtttgaggtcatccccaacgataaagatgagaagggtgatcccgttccatattctattataaataactatttcagtatcggagtggatgcctctatcgcgcacagatttcacattatgagggaaaagcaccccgaaaagttcaattcccgaatgaagaacaagttctggtatttcgagttcgggacatccgagaccttctccgccacctgcaaaaaactgcacgaatccgttgaaatcgagtgtgacggtgttcagattgacctcattaacatatccctggagggtattgccatcttgaatattcccagtatgcatggaggctccaacctgtggggagagagtaagaaaagacgctctcatcgcaggatagagaaaaagggaagcgacaagagaaccaccgtgacagacgcaaaggagctgaagtttgcctcacaggatctctccgaccagctcttagaagtggtcggcctggagggggctatggagatgggccagatctacacaggcctgaagagcgccggtagacgtttggctcagtgttcatgtgtggtgatccggacgtccaaatccttgcccatgcagatcgatggagagccttggatgcagacaccctgtactgtgtctactgagtag

SEQ ID NO: 220692 - DNA, 2391 bp, Artificial Sequence
  Description of Artificial Sequence: Synthetic coding sequence
atgactaatcaggagaagtgggcacatcttagcccatccgagttcagccagcttcagaagtatgccgaatattccacgaaaaagctgaaggacgtgttagaggaatttcacggaaatggggtcctagcaaagtataatcccgaaggcacaatagacttcgaaggattcaaactgttcatgaaaacatttctggaggctgagctccccgatgatttcacagcccacctgtttatgtcattcagtaataaatttccacattccagccctatggtgaaaagtaagccagcccttctgtccggcggactccgtatgaataagggggctataacccctccccgaaccacaagccctgccaacacatgctctccagaagtgatccatctcaaagacattgtttgttatctgtctctcctcgaacgagggcgtcctgaagataagctggagtttatgtttcgtttatatgatacggacggaaatggttttctggactcctcggagctggagaacattatctctcagatgatgcatgtggcggagtatctcgagtgggatgtgactgagctcaacccaattctgcacgagatgatggaggagattgattacgaccatgacggtactgtgagcttggaagagtggatccagggcggtatgaccacaatcccgctattagtgctactggggcttgagaacaacgtgaaggatgacggccagcacgtgtggcggctgaagcacttcaacaaacccgcttactgcaacctctgcttgaatatgctgattggtgtggggaaacagggactgtgctgttcgttctgcaaatacacggtgcacgagaggtgcgtggctcgcgcacccccaagctgcatcaagacctacgtgaagagtaaaagaaataccgatgttatgcatcactactgggtggaaggcaattgtcctacaaagtgcgacaaatgccacaaaaccgtgaaatgttaccagggactcacaggcttgcactgcgtttggtgccagattaccctccataacaaatgtgcctcacacctaaaacccgagtgtgattgtgggccactgaaggaccacattctccctcctacaactatatgtccagtggtgctcacactacctacatcaggcgtgtccgtgcccgaagagagacagtctacagtgaaaaaggaaaagtccggcagtcagcaacccaacaaagtgattgataagaacaagatgcagagagccaacagcgtcaccgtggatggccaggggttgcaggtgacccctgtccctggcacccatcccttactggtgtttgtaaacccaaagtccggcggaaagcaaggcgagaggatctaccgcaagttccagtacttattgaacccaagacaggtctactcgttgtccggtaacggccctatgcccggattgaacttcttccgcgacgtgccggatttccgcgtgcttgcatgtggcggagacggcaccgtcggatgggttctggattgcatcgagaaggcaaacgtgggcaagcatcccccagtagctatcttgccccttggtacaggtaacgacctggcaaggtgtcttaggtggggtggcggttatgagggcgagaatctgatgaagattttgaaggatatcgaaaacagtacggaaatcatgttggatagatggaaatttgaagtgatacctaatgacaaagacgagaaaggcgacccggttccgtactccatcatcaacaattacttctctattggtgtcgacgcctcgatcgctcatagattccacatcatgagggagaagcatcctgagaagttcaattcacggatgaagaataagttttggtatttcgagtttggaacttccgaaacgtttagtgccacctgcaagaagcttcacgagtccgtggaaatcgagtgcgacggcgtacagattgatctgattaacatcagcctggaagggatagccatcctgaatatcccctctatgcatggcggatccaacctgtggggggagtcaaagaaaagacgcagccaccggaggattgagaaaaaggggtctgacaagagaacaaccgtcactgatgctaaggaactgaagttcgccagtcaggacctttccgatcagctcctagaagtggtgggtctggaaggggctatggagatgggccagatttataccgggctgaaatctgctggacgcagactagctcagtgcagttgtgtggtaattaggacaagcaagagcctgccaatgcagattgacggcgagccatggatgcaaacgccgtgcacaataaaaattacacataagaatcaggcacctatgctcatgggccctcccccaaagactgggctgttttgcagccttgtaaagaggacacggaataggagcaaagaatag

SEQ ID NO: 220693 - DNA, 228 bp, Artificial Sequence
  Description of Artificial Sequence: Synthetic coding sequence
atgacaaaccaggaaaagtgggcccacctgtctccctctgaatttagtcagttgcagaaatacgcggaatatagcaccaagaagctgaaggatgttctcgaagagtttcacggaaatggggtcctggccaagtataatccagaggggaagcaggacatccttaatcagacgatagattttgaaggatttaagctgttcatgaagacattcttggaagcagagctctag

SEQ ID NO: 220694 - DNA, 2358 bp, Artificial Sequence
  Description of Artificial Sequence: Synthetic coding sequence
atgacaaatcaggaaaagtgggctcacctgagcccatctgagttcagccagctccagaaatatgctgagtactcaaccaaaaaacttaaagacgtactcgaggagttccatggaaacggcgtgcttgctaaatataaccctgaggggactattgatttcgagggtttcaagctctttatgaaaacattcctcgaagcagagctccccgatgactttacagctcacctgtttatgagcttttcaaataaatttccccatagttctcctatggtgaagagtaagccggcactcttgtctgggggtcttcgcatgaataagggtgcaatcactccccctcgaacaacatcccctgccaatacatgttcacccgaggttattcacctaaaggacattgtctgctatctgagtcttcttgagagagggaggcctgaggacaagctagaattcatgtttcgattgtacgacaccgatggcaatgggttcctcgattcatccgaactggagaacattatctctcaaatgatgcacgtcgccgaatacttagagtgggatgtaacagagttgaatcccattcttcacgagatgatggaagagatcgattacgatcacgatggaactgtgtcgctggaggagtggattcaagggggaatgaccacaatcccccttcttgtacttctgggcctggagaacaatgttaaggacgacgggcagcacgtttggaggctcaagcactttaataagcccgcttattgtaatctttgcctcaacatgctcatcggggtgggtaagcaagggttgtgctgttccttttgtaaatataccgtgcacgaacgctgcgttgcaagagctcccccatcttgcatcaaaacatatgtgaaatccaagcggaatacagatgtcatgcatcactactgggtggaaggtaattgccccacaaaatgcgacaagtgccacaagaccgtgaagtgctaccagggactcactggacttcattgcgtgtggtgccaaatcaccttgcacaataaatgcgccagccacctgaagcccgagtgtgactgcgggcctctgaaagaccatatcctgccccctaccacaatctgcccggtcgtgctggagaggcagagcaccgtgaagaaggagaagtcagggtcccagcagcccaacaaggtcatagacaagaacaagatgcagcgcgcaaactccgttaccgtcgacggacagggcctccaagtgacaccagtgccaggaacacatccgttgctggtgtttgttaatcctaagagcggtggaaagcagggggagagaatttaccggaagttccagtatctgcttaacccacgacaggtgtattcactctctggcaatgggccaatgcccggactgaacttctttagagacgtaccagacttcagagtgctcgcctgcgggggagatggcacggtggggtgggtgcttgattgcatcgaaaaagccaacgtaggcaagcacccccctgttgctattctgccactcggaaccggcaatgacctcgctcggtgccttcggtgggggggtggttacgagggtgagaacttaatgaaaatcttgaaagacatagaaaatagtaccgaaatcatgcttgaccggtggaaattcgaggtgatccccaacgacaaggacgagaagggtgacccagttccctactccatcatcaataattatttcagtataggtgttgacgcgagcattgctcaccgattccatataatgcgagaaaaacatccagaaaagttcaacagccggatgaagaacaaattttggtactttgaatttggcacatccgagaccttcagcgctacctgtaaaaaactacatgaaagtgtagagatcgagtgcgatggcgttcagatagatctgattaacatctccttggaggggattgctatcctcaatatcccaagcatgcatggaggatccaacctgtggggggagagtaaaaagcgccgatctcacaggaggattgaaaagaaaggctctgataagaggacaacagtgacagatgccaaggagttaaagtttgccagccaggacctgagcgatcagctgctagaggtggtgggactggaaggagcgatggaaatgggtcagatctacaccggcctgaagtctgccggtaggagactggcccagtgctcctgtgtggtaataagaaccagcaaatccctgccaatgcagattgacggcgaaccctggatgcagaccccatgtaccattaagatcactcataaaaaccaggccccaatgctcatgggaccacccccaaagaccggcctgttttgttcgctggtgaagaggactcgaaataggtctaaagaatag

SEQ ID NO: 220695 - DNA, 3645 bp, Artificial Sequence
  Description of Artificial Sequence: Synthetic coding sequence
atggccgcagccgcaggagcacctccccctggtcccccacagccacctcccccacctcctccagaggaaagttctgacagcgagccagaagcagagcccggaagtccccagaaactcatccggaaggtgagtacatcaggccagatccgccagaaaacaatcataaaggagggcatgctgaccaagcagaataattcatttcagagatccaagcggcgatatttcaagctgagagggagaacactgtactacgcgaaaaccgctaaatcaatcatcttcgacgaagtcgacctaacagacgcctccgttgccgaatcctcaactaagaatgtcaataatagctttactgtgattaccccgtgtaggaagctgattctgtgtgctgataatcgcaaggaaatggaggactggattgcggcattgaaaaccgttcagaacagggagcattttgaaccaacccagtattctatggaccacttctccggaatgcataattggtacgcctgcagtcatgcacgacccacatactgtaacgtgtgtagggaggcactgagtggcgtaacaagtcacggtcttagttgtgaggtgtgtaagtttaaagctcacaaacgctgtgccgtccgcgcaaccaataattgtaagtggacaaccttggcctcaattgggaaagatattatagaggatgctgacggaatcgccatgcctcaccaatggctagagggtaatctaccagtgtccgccaagtgcacggtatgtgataagacctgtggctccgtactgagactgcaagactggcgatgtctttggtgcaaagccatggtgcatacttcatgtaaagaaagcttgctaacaaaatgccctctaggactgtgcaaggtgagcgtgatcccaccgactgccctcaactcgattgattctgacgggttctggaaggcatcatgtcctccatcttgcacaagtcccttgctggtctttgtaaactctaaatccggggacaatcagggtgtgaaatttctccgacggtttaagcagcttctcaatcccgctcaggtcttcgatttgatgaacggagggcctcatctgggcctgaggcttttccagaaattcgacacgtttaggattctcgtatgcggcggagatgggtccgtggggtgggtgctgagtgagatcgactctctaaatctccacaaacagtgtcaactgggtgtcctacccttgggcacaggaaatgatttggcccgtgtactcgggtggggctctgcctgcgacgatgatacccaattgcctcagatcctggagaagctcgagcgggcttccaccaaaatgctcgatagatggagcgtgatggcctacgaggccaagttgccccgtcaggcttccagctcaacagtgaccgaggatttctcggaagactccgaagtgcagcagatactcttttatgaagactccgtcgccgctcatttatcaaaaattttgacgagcgatcagcattccgtggtgatcagctctgccaaagttctctgtgagactgtgaaagacttcgttgccagagtgggcaaagcctatgagaagaccaccgaatcttcggaggagagcgaagtcatggccaaaaaatgtagtgtgttaaaggagaagttggacagcctactcaaaacactggatgacgagagccaggcatcttcttctctgcctaaccccccacccaccatcgcggaggaagccgaagacggcgatggcagcggatccatatgcgggtctaccggggaccggcttgtggcttctgcatgtccggctcgaccacagatttttaggccacgggagcagctcatgctgcgagctaactccctaaaaaaggctattcgacagattattgagcacaccgaaaaggccgttgacgagcagaacgcacaaacccaagaacaggaaggctttgttctggggctatctgagtccgaggagaaaatggatcaccgggtttgccccccacttagccactctgagtcttttggcgtccctaagggcagatctcaacggaaagtaagcaaaagcccttgtgagaaattgatctccaagggtagcctgagtcttggaagcagcgcatctctgccgcctcagcctggttcccgtgatggccttcccgcactgaacaccaaaatcctgtaccctaacgtacgagcaggaatgtccggatcactgcctggcggatcagttatctcccgactgcttattaatgccgatcctttcaacagcgagccagagaccctcgagtactataccgagaagtgcgtgatgaacaactacttcgggattgggttagacgcgaagatctccctcgacttcaacaataaaagggacgaacaccctgaaaagtgccgatcaagaactaagaacatgatgtggtatggcgtgctgggcacgaaggagttactccatcgtacttacaagaacctggagcaaaaggtactgttggagtgtgacggacgccctatccccctaccaagcctgcaggggatagcggtgctgaacattccctcgtacgctgggggaaccaatttttggggcggtaccaaagaggacgataccttcgctgccccatcgttcgacgacaaaatcctcgaggtggttgccgtctttggatcaatgcagatggccgtttccagggtgatccgacttcagcaccaccgtatcgcacagtgtcggaccgtgaaaattagcatactgggagatgaaggggtgccagtgcaggtcgatggggaggcatgggtccagcctcccggttacatccgtatcgttcataaaaacagagcccagacattaacccgagatagggcttttgagtctacacttaagtcctgggaagataagcagaaatgcgagcttcctcgccctcccagttgcagcttgcaccccgaaatgttatcagaagaggaagccactcagatggatcagttcggccaggctgccggagtcctgattcactctattcgagagattgcccaatctcacagagatatggagcaagaattggcccacgccgtgaatgccagctccaaatccatggacagagtatatggaaaacctagaactactgaagggttgaattgcagctttgtattggagatggtgaacaactttcgggcactccgctctgagacagaattgttactgtccgggaagatggcattacagctggaccctccccagaaggagcagctgggatctgccctggccgaaatggatcggcagcttcgacgtctggctgacacaccctggctttgccaatcagccgagcctggggatgaagaatcagttatgctggacctcgctaagcggtctcgatcgggcaagtttagacttgtaaccaagttcaaaaaggaaaaaaataataaaaataaggaggcacactcctcattgggtgcgccagtgcacctttggggtaccgaagaggtggcagcttggctagagcatctctccctatgtgaatacaaagacatcttcacaagacatgatattcgcggatccgagctgttgcacctagaacgtagggatctgaaagacctcggagttacgaaagtcggccacatgaagaggatcttgtgcggtatcaaggagctgtcaaggtctgcccctgcggtggaggcatag

SEQ ID NO: 220696 - DNA, 3513 bp, Artificial Sequence
  Description of Artificial Sequence: Synthetic coding sequence
atgaatatgttcctctactttcaaaccattattaaagagggtatgctaacaaaacagaataactcttttcagagatctaaacgtcggtacttcaaactcaggggcagaaccctctactacgcaaaaaccgccaagtcaattattttcgacgaggtggatctgacagacgccagcgttgccgagtcttccacaaaaaacgtgaataactcttttacggtaatcactccatgtaggaagctcatcctgtgcgcagataacagaaaggaaatggaggattggatcgccgctttgaagacggtgcagaatagggaacactttgagcccacccaatactcaatggatcacttttcaggaatgcacaattggtacgcctgtagccatgcaaggcccacgtattgtaacgtctgtagagaggcactgagcggtgtgacttcacacgggctttcatgtgaggtgtgtaaatttaaggctcacaagagatgtgcggtcagagccacaaacaactgtaagtggacaaccttggcttccatcggaaaagacattatagaagatgcagacggcattgccatgcctcaccagtggttagaggggaatctcccagtgagcgcaaaatgcacggtatgtgacaagacctgtgggtccgtcctgaggctccaggattggcggtgtttgtggtgtaaagcaatggtgcacaccagctgtaaggaaagtctgctcacaaagtgcccactaggcctttgtaaagtctctgttattccgccaactgccctgaattcaatcgatagtgatggtttttggaaagccagctgtccgccttcatgtacgagcccactgttagtcttcgtgaattcaaaaagtggggacaaccaaggggtcaaattccttcgccgttttaagcagctgcttaaccctgcccaggtgtttgatctgatgaatggcggtccacatcttggcttacgtctctttcagaagttcgacacttttaggatcctggtatgtggaggtgacggctctgtgggttgggtcctgtcagagatcgatagcctgaaccttcacaagcaatgccagttaggcgtgctgccgcttggcaccggcaatgacctagctcgagtattgggctgggggtcagcttgcgatgacgatacacaattgccacagattctagagaaactggagcgtgccagcactaagatgctggataggtggtcagttatggcttacgaggcaaagttgcccagacaggcatcatctagcaccgttactgaggacttcagcgaggacagtgaggtgcaacagattctgttctatgaagactccgtcgccgctcacctctctaagatcctgacctcagaccagcactcagtggtgatttcatccgctaaggtactttgcgagactgtcaaggattttgtcgcccgtgtgggaaaagcctatgaaaagacaacggaatcgtctgaagagagcgaagtcatggccaagaagtgttccgtgctgaaggagaagctggacagccttttaaagacactggacgacgaaagtcaggctagcagctccctgccaaatccccctcctaccattgccgaggaggctgaagacggagatggtagcggttctatatgcggcagcactggcgatcgactggtagcatcagcttgccccgctcgtcctcagatctttaggcctcgggagcaactgatgctgcgcgcaaattctctgaagaaggccatccgccagattatcgagcacacagagaaggcggtggacgagcaaaatgcgcagactcaggagcaggaaggcttcgtgctgggtctgtctgagtccgaggaaaagatggatcaccgtgtatgtcctcctttgtctcatagtgagagctttggcgtgccaaaaggcagatcccagagaaaagtatctaaaagcccctgtgaaaagctgatctctaaaggcagcctctcacttggaagcagtgcctctctgccaccacagccagggagcagggatggcctgcccgctctgaataccaagatcctgtatcccaatgtgcgagccggtatgtcagggtccctgcccggaggcagcgtcatttcaaggctcctgattaatgctgaccctttcaactcagaacctgagacgctagaatattacacggaaaagtgcgtgatgaacaactatttcggcatcggactagacgccaaaatttccctcgattttaataataagagagatgagcaccctgaaaaatgtagatcccgcaccaaaaatatgatgtggtatggcgtgctggggaccaaagaactcctgcacaggacttacaagaatcttgagcaaaaggttcttttagaatgcgacgggaggcctatacccctcccatccctgcaggggattgcagtgctaaacatcccttcttatgctggcggaactaatttttggggcggtacaaaggaggatgacactttcgcagctccaagcttcgacgataaaatacttgaagtggtggccgtctttggctccatgcagatggccgtgagtagagtgatccgactccagcaccacagaatcgctcaatgtaggaccgtcaaaataagcatacttggggatgagggggtgccggtgcaggtggatggcgaggcctgggttcaacctccaggatacattaggatagtgcataagaacagagcacagacactgaccagggatcgggcatttgaaagtaccctcaagagctgggaggataaacagaagtgtgagcttccgagaccccctagctgttccctgcacccagaaatgttgtcggaggaggaagcgacccaaatggatcagttcgggcaggccgcaggagtactcattcactcaattcgagagattgcacaatcacatcgcgacatggaacaagaactggctcatgcggtgaacgcatcatccaagtctatggacagagtgtacggcaaaccacggaccaccgagggcctcaactgtagcttcgtcttagagatggtcaataacttcagggccctccgctctgagaccgaactgctgctctcagggaaaatggctctccagctggatcctccacagaaagagcagctgggcagcgccctggcagaaatggaccgccagctccgccgtctggccgacaccccgtggttatgccagagcgccgagcctggcgacgaagaaagcgttatgcttgaccttgccaagcggtcacgatctggaaaattccggctggttacaaagtttaagaaggagaagaacaacaaaaacaaagaggcccacagtagtcttggagcaccagtgcacttgtggggtactgaagaagttgctgcttggctcgaacatctcagcctgtgtgaatataaggacatctttaccaggcacgacattaggggcagtgagcttttgcacttggaaagacgggacttaaaagaccttggcgtgacaaaagtcggccacatgaagaggattctgtgtgggatcaaagagctgagtaggtcagctcccgcagtggaagcttag

SEQ ID NO: 220697 - DNA, 1704 bp, Artificial Sequence
  Description of Artificial Sequence: Synthetic coding sequence
atggaggctgagagacgcccagcccctggcagtccctctgagggactgtttgccgacggtcacttgattctatggactctgtgctctgttttgttacccgtgttcatcacattctggtgtagcttacagaggtcccgacggcagctccatagaagggacatttttagaaagtcaaaacacggttggcgagacacggacctgttttcgcagcccacttactgttgtgtatgcgcgcaacatatcctacagggggctttttgcgattgctgtgggttgcgcgtggacgagggttgccttcggaaggcggataagcggttccaatgtaaggaaataatgctgaaaaatgatacaaaagtgttggatgcaatgccacaccattggattaggggaaatgtccctctatgcagttactgtatggtgtgtaagcaacagtgtggctgccagccaaagttatgcgactacagatgtatatggtgccagaagacagtgcacgacgagtgcatgaaaaattccctgaagaatgagaagtgtgattttggtgaatttaagaatctcataatacctcccagctatctcacctcgattaaccagatgagaaaggataagaagacggactacgaggttctggcgtctaaactgggcaagcagtggaccccccttattatccttgcaaactctagaagcggaaccaacatgggcgaggggcttctgggcgagttcagaatcctgctcaaccccgttcaggtgtttgacgtgaccaaaacacctccaatcaaggccctgcagttgtgtactctccttccttattatagcgcaagggtactggtctgtggcggagatgggacagtcgggtgggtattggatgccgtggacgatatgaagattaagggtcaggaaaagtacattccacaggtggcagtcctgcctctcggaacagggaacgatctgtccaacactctaggatggggcacaggctacgcaggggaaattcctgtggcccaggtgctgcgaaacgtgatggaagctgatgggattaaactggataggtggaaggtacaagtgacaaataagggctactataacctgcggaaacctaaggaattcacgatgaataactatttttctgttggaccagacgccctcatggccctgaacttccacgcgcatcgtgaaaaggccccttcccttttctcttctagaattctcaataaggcagtgtatctgttttacggcactaaagactgccttgtgcaggagtgcaaggacctgaacaaaaaggttgaactggagctggatggggagcgggtggcgctcccgtctcttgaaggaattatcgtcctgaacatcggatattggggcggtggctgccgcctgtgggagggaatgggagatgagacttaccctctcgcacgacatgatgatggtctgctggaagtcgtcggcgtctacggctctttccactgcgcccagatccaagtgaaactggccaacccttttcggatcgggcaggcccatacggtgagacttattctgaagtgctcaatgatgcccatgcaggtggacggagaaccttgggcccagggtccctgtaccgtcaccatcactcacaaaacacacgcgatgatgctctacttctccggcgaacagaccgatgacgatattagctctaccagcgaccaggaagatataaaggccactgaatag

SEQ ID NO: 220698 - DNA, 2376 bp, Artificial Sequence
  Description of Artificial Sequence: Synthetic coding sequence
atgggggaggaacgctgggtcagcctgactcccgaagagtttgaccagctccagaagtatagtgagtactccagcaaaaagattaaggatgccttgacagagtttaatgaggggggatccctgaagcagtatgatccacacgaacccatctcctacgatgtgtttaagctgttcatgcgtgcatatctcgaggttgacctaccccagccactgagtacacatctcttcctggctttcagccagaagcctagacatgagaccagcgatcatcctaccgaaggggcaagtaattctgaggccaacagcgccgatactaatatccagaacgccgataacgccactaaagccgatgaagcgtgcgcaccagacacagagtcaaatatggcagagaaacaagcacccgctgaggaccaagttgccgcaacacctctcgaaccaccagtgcctaggtcctcttcctccgagtctccagttgtgtacctgaaggacgtggtgtgttatctttctcttctagagacaggtcgccctcaggacaagctggaatttatgttcaggttgtacgactctgatgaaaatggcctgcttgatcaagctgagatggattgtatcgtgaaccaaatgctgcacattgcacagtacctcgaatgggacccgactgaacttcgcccaattctaaaggagatgcttcaaggaatggattacgaccgggacggattcgtttctttacaggaatgggtgcacggcggaatgaccaccattccgctgctagtgctgctggggatggatgactcaggcagcaaaggagatggacgacatgcctggaccatgaagcactttaaaaagccgacatactgcaacttttgccacatcatgctcatgggcgtacgcaaacaaggactgtgctgcacttactgtaagtatactgtgcatgaaaggtgcgtgtctagaaacattcccggttgtgtgaaaacatactccaaggcaaagcgctccggggaagttatgcagcacgcctgggttgagggtaacagctctgtgaaatgcgatcggtgtcacaaaagcataaagtgttaccagtcagttacggctaggcactgtgtgtggtgtcgcatgacatttcacagaaaatgtgagttgtccacactgtgtgacggcggtgaacttcgggatcatatattgctgcctactagcatctgtcctatcacccgtgaccgacccggagagaaatccgacggctgtgtgtccgcaaagggcgagctggtgatgcagtacaagatcatcccaactcccggaacccacccactgctggtgttagtcaaccccaagagcggtggcaggcaaggcgagaggattttgcgaaaatttcattacttattaaaccctaagcaggtgtttaatctggacaatggcggacccacccctgggctcaatttcttccgcgatacaccggactttcgggtcctggcttgtggaggagatggaacagtgggctggatcctcgactgcatcgacaaagccaactttgccaaacatccacctgttgcagtgctccccttgggaacgggcaatgacctggctcgttgcctgcgatgggggggaggttacgaggggggaagtctgacgaaaattctgaaggacatcgaacaatctccgctggtgatgctggatcgatggcacttggaagtcatcccacgcgaggaagtggagaatggagatcaggtgccatacagcataatgaacaactacttcagcattggggttgatgcctcaatcgcacatcggtttcacgtgatgcgtgaaaagcatcctgagaagttcaacagccggatgaagaacaagctgtggtacttcgaatttggtacttccgagaccttcgcagccacgtgcaaaaagctgcatgaccacattgagctggagtgtgatggtgtgggggttgacctgtcaaacatttttcttgaaggaattgctattttaaacatcccaagcatgtacggcggtactaacttgtggggggagaataaaaagaatagagcggtgatcagggagtctaggaagggtgtcacagacccaaaggagctgaagttttgtgtgcaggacctgtccgaccagttgctggaagtggtgggcctggaaggggcaatggaaatgggccagatatataccggtcttaaaagcgcaggacgtaggcttgcacaatgtgctagcgtcactatcagaaccaacaagctccttcccatgcaagtggatggcgaaccatggatgcagccctgttgcacaatcaaaatcactcataagaatcaagctcctatgatgatgggcccacctcagaagtccagcttcttctccctccgaagaaaatcgaggagtaaggattag

SEQ ID NO: 220699 - DNA, 2301 bp, Artificial Sequence
  Description of Artificial Sequence: Synthetic coding sequence
atgggggaagagcgatgggtgtccttgacccccgaggaattcgatcagctgcaaaagtactctgaatactcttctaaaaagatcaaggacgccctgaccgaattcaacgagggtggcagcttaaagcagtacgacccccacgagcccatcagctatgatgtgttcaaactgtttatgcgagcctacctggaggtcgacttaccgcaaccattatcgactcatttattccttgctttttcccagaagcctaggcacgagactagcgaccatccaaccgagggcgcaagcaattctgaagcaaattctgctgacaccaacatccagaacgctgacaacgccacaaaagccgatgaagcttgcgcacctgacaccgagtctaatatggctgagaaacaggcccctgctgaggaccaagtggccgctactcccctcgaacccccagtgccaagaagctcttcatcagagtcgccggtcgtgtacctgaaagacgtcgtttgttacctgtcactactggagacggggaggccccaggacaaactcgaattcatgttccgattgtacgactcagacgaaaatggacttctggaccaggccgaaatggactgtatagtgaaccagatgctccacatcgctcagtacctcgagtgggatccgacagaactgcgacctatcctcaaggaaatgctgcaaggcatggactatgatagggacggcttcgtttccctgcaagagtgggtccacgggggaatgacaactatccccttgctggtcctgttgggcatggatgatagcggaagtaagggagacggccgtcacgcctggacaatgaagcatttcaagaaaccaacctactgtaacttctgccacattatgttgatgggcgtccggaagcaagggttgtgttgtacttactgcaagtatacagtgcacgagcgatgcgtctctcggaatatccccggatgtgttaagacctatagcaaggctaagcgatctggcgaagttatgcagcacgcctgggtggaggggaacagtagtgtcaaatgcgaccgttgccataaatctatcaagtgttaccagtcggtgaccgcaagacattgtgtttggtgtcgcatgacgttccatcgaaaatgcgagcttagcacattatgtgatggcggtgaactgcgggatcacattctgctgccaacgtctatctgtccaatcacccgcgaccggccaggcgagaagtctgatggttgtgtgtcggccaagggcgagctcgttatgcaatataagattattcctacccccggaactcatcctctacttgtgctggtgaacccaaaatccgggggacgtcagggtgagcgcctgaatttcttcagagatacccctgattttagggtattggcctgtggcggagatgggaccgtcggatggatcctggactgcatcgataaggctaacttcgccaaacatccccctgtcgctgtcttgccactgggaactggcaacgatttggccaggtgcctacgatggggcggtgggtatgaggggggtagccttaccaaaatcttgaaggatatagagcagtctcctctcgtcatgttggatagatggcacctcgaggtcatacctcgtgaggaagtggagaacggtgatcaggtgccctactctattatgaataattacttcagcatcggagtggatgcctctatcgcccatcgattccatgttatgcgcgaaaagcacccggagaagtttaatagcaggatgaaaaataagctgtggtactttgaattcggcacctccgagacgttcgctgcaacatgcaagaagctacacgaccacattgagcttgagtgtgacggcgtgggcgtcgatttgagcaacatttttctggaggggatcgctattcttaatattccctccatgtatggtgggaccaacctgtggggggaaaacaaaaagaaccgcgctgtgatccgggagtctaggaagggggtgaccgaccctaaagagctaaagttctgcgtgcaagacttatccgaccaactgctggaggtggtcggactggaaggcgcaatggagatgggtcaaatctacacaggccttaagtcagcagggagaagactcgcccaatgcgcctccgttaccattaggaccaacaaacttctgcccatgcaggtggatggggaaccatggatgcagccgtgctgtacaattaagatcacccataaaaaccaggcacctatgatgatgggacccccacaaaagagtagcttcttttccctgcgccgaaagagcagatccaaggactag

SEQ ID NO: 220700 - DNA, 2259 bp, Artificial Sequence
  Description of Artificial Sequence: Synthetic coding sequence
atgggagaagaacgttgggtctcccttactcctgaggagttcgaccaactgcagaagtatagtgagtatagttcaaagaagatcaaggacgccctgacggaatttaatgaggggggaagtcttaaacaatacgacccacatgagcccattagctatgatgtctttaaactgttcatgcgggcatacctcgaggtcgatctgccacaaccactgtccactcacctgtttctggctttttcccagaagcctagacatgaaaccagcgatcaccctactgaaggtgcaagtaactccgaagctaacagcgcggacacaaacattcagaatgccgacaacgccacaaaagctgatgaggcttgcgcccctgacactgagagcaatatggctgagaagcaggctcccgcagaggaccaggtggccgcaacgccacttgagcccccagtgcccagatcaagttcaagtgagagcccagtggtgtatttgaaagacgtcgtgtgctatctgagcttgctcgaaactggcaggcctcaggataaactagagtttatgtttcgactttatgactcagacgagaacggtctgcttgaccaggcagagatggactgcatagttaaccaaatgctgcacattgcccagtatctggagtgggatccaaccgaactacgtcccatcctgaaggaaatgctccagggaatggattacgatagggatgggttcgtgtctctccaagagtgggtgcatggaggcatgaccacaatccctcttttggtgctcctggggatggacgatagcggcagtaagggagatggtcgtcatgcatggacgatgaagcactttaagaaacccacgtattgcaatttctgtcatattatgctgatgggcgtgcgcaaacaggggctgtgttgcacctattgtaagtatactgttcatgagaggtgtgtgagtaggaatataccaggctgcgtgaagacatattctaaggcgaaaaggtcaggggagttccaccgcaaatgtgagctgtcaaccctctgtgacggaggagagctgcgcgatcacatcctcctgcccaccagcatctgcccaattactcgggacaggccaggcgaaaagtcggacggctgtgtgtctgcaaaaggagagttagtgatgcagtataagattattccaacccctggcacccacccactcttggtgcttgtgaaccctaagagcggtggtaggcagggggaacggattctccgaaagttccattatttgctcaaccccaagcaggtgtttaatctggacaatgggggtcctaccccgggactgaatttctttcgcgatactcctgacttccgggtcctggcctgcggcggagatggaacagtcggctggattctagactgtatagataaagcgaactttgcaaagcacccccctgttgcagtcctcccccttggcaccgggaatgacctggcaaggtgcctgcgctggggcggtgggtacgagggcggatctctgactaagatactcaaagacatagaacagtctcccttggttatgctcgacagatggcaccttgaggtgatccctcgcgaggaagtcgaaaacggagaccaagtgccctacagtataatgaataactacttttccatcggagtcgacgcatctatagcacaccggttccacgtcatgagggagaagcatccagagaaattcaactcaagaatgaagaacaaactgtggtacttcgagttcggcacctctgaaacattcgccgcaacttgcaaaaaactgcacgatcacatcgagttggaatgcgacggcgtgggggtggatctgtccaacattttcctggaggggatagccattcttaacatcccgagtatgtacggaggaacaaatctctggggagagaacaaaaagaaccgcgctgtcatccgggagtcaaggaaaggagtaacagatcccaaggagctcaaattctgtgtgcaggacttgtccgatcagctgctggaagtggtgggccttgaaggagccatggagatggggcaaatctatacggggctcaagtcggcaggcagaagactggctcagtgtgcttcagtgaccattcgcactaataagctactgccgatgcaagtcgatggcgaaccttggatgcagccctgttgcactatcaagatcactcataagaaccaggctccaatgatgatgggtccaccacagaaatcctcctttttctcactcaggcgaaaatcaaggtcgaaggactag

SEQ ID NO: 220701 - DNA, 1818 bp, Artificial Sequence
  Description of Artificial Sequence: Synthetic coding sequence
agcctgaaaatgggggaagagagatgggtgtcacttacacctgaggaatttgatcaactccagaaatactctgagtattcttctaagaagattaaagacgccctgactgaattcaacgagggaggttcactgaagcaatatgatccgcacgagcccatctcttatgacgtcttcaagctgtttatgagggcatacttggaagtggatctccctcaacccctgagtactcatctcttcctggcgttctcgcagaagccacggcatgagacttccgaccatccaactgagggcgctagcaattccgaggctaactcggcagacacaaacatccagaacgccgataacgctactaaggccgatgaagcctgcgcccctgacaccgagtctaacatggcagaaaaacaggcacccgctgaagaccaggtggccgcaaccccactagagcccccagttcccagatcctccagcagtgagtcaccggtggtgtacctcaaggatgtagtatgttatctgtcactgctcgaaacaggcagaccacaggacaaacttgagttcatgtttcggctgtatgattcagacgaaaacggtctactggaccaggcggaaatggattgtattgtgaaccaaatgctccatatcgctcaatacttggagtgggacccaactgaactccggccaatcctcaaggaaatgctccagggcatggattatgatagagatggattcgtgagcctgcaggaatgggtccatggaggtatgaccaccattcccctgctggtactgctcggaatggacgactccggtagcaagggagacggtcgacatgcatggacgatgaagcactttaaaaagcccacttattgcaatttttgccacattatgctgatgggcgtgcgaaagcagggtctctgttgcacatattgcaagtacacagtgcacgagagatgcgtgtctcggaacataccaggctgcgtgaaaacctactccaaagctaagagatctggcgaatttcacaggaagtgtgagctgagcactctgtgtgacgggggtgagctgcgcgaccacatccttctgcctacttcaatctgccctatcactcgagaccggcctggggaaaaatcagatggctgcgtgtccgccaaaggagagctggtgatgcagtacaagatcattcctacgccgggtactcaccccctgcttgtcttggtaaacccaaagagtgggggtagacagggcgaacggatcctgcgcaagttccactacttgctaaacccaaagcaggtgttcaatctggacaacgggggtcctacccccggactgaatttctttcgcgacacgccagactttcgggtgttggcctgcggaggtgacggaactgtgggatggattttggattgtatcgataaagccaactttgccaaacacccgccagtcgcagtgctgcccctcggtaccgggaatgatctggcaaggtgcctaaggtgggggggtggatatgaagggggaagccttaccaagatccttaaggacatcgagcaaagccctctggtcatgctggacagatggcacttggaagtcatccctcgggaagaggttgaaaatggcgatcaggtcccatattctataatgaataattatttcagcatcggagtggatgctagcatcgcccatcggttccatgtgatgagggagaagcaccctgagaagttcaactccagaatgaaaaacaagctgtggtattttgagtttgggacctcagagacctttgctgccacttgtaaaaaactccacgaccatattgagctggagtggtgttag

SEQ ID NO: 220702 - DNA, 2199 bp, Artificial Sequence
  Description of Artificial Sequence: Synthetic coding sequence
atgggggaggaacgctgggtaagtttgactccggaggaattcgaccagttacagaagtacagcgaatactcaagtaaaaaaattaaagacgcgctaacagaatttaacgagggagggtccctcaaacagtatgatccccatgaacctatcagctatgatgtgtttaagctttttatgcgtgcttacctggaagtggacctgccccaacccctgagcacccacctatttcttgcgttcagccagaagccaaggcatgaaacaagcgatcatcccacagagggggcatctaactccgaggcgaattccgccgataccaatatacagaatgcggacaacgccactaaagccgatgaagcttgcgcgccagacacggaatctaacatggctgaaaaacaggccccagctgaagatcaggtggccgctacacctctcgaacctcctgtcccacggagttccagttctgaatcccccgtggtatatttaaaggacgtcgtgtgttacctctctctcctggagaccggtcggcctcaagacaaacttgaattcatgttcagactctatgactcagacgagaacggactcctcgatcaggctgagatggattgcatcgtgaaccagatgctacatattgcccagtacttagagtgggacccaacggagctacggcctattctcaaggagatgttgcagggcatggattacgatcgagatggttttgtaagcctacaggagtgggtgcacgggggtatgactacaattcccctgcttgtcctgttaggtatggacgacagtggatctaaaggtgacggacggcacgcctggacaatgaagcacttcaaaaaacctacgtactgtaatttctgccacattatgctaatgggagtcagaaaacaggggctgtgctgcacctattgcaaatataccgtgcacgagcgttgcgtgtccaggaacatcccaggatgtgtaaagacctacagtaaggctaaacgctcgggcgaattccacagaaagtgcgaacttagtactctgtgcgatgggggagagctccgggaccatatcctcctgccaacgtctatatgtcctatcacccggtataaaattatccctacccctggaactcatcccctcctcgtgctggtgaatccgaagagcggtggtcgccagggtgaacggatcctaaggaagttccactatctccttaatccgaagcaggtgtttaacctggacaatgggggaccaacgcctggcttaaacttcttccgcgatacgccagacttccgcgtcctggcctgcggaggcgatgggaccgtgggatggattcttgactgcatcgacaaagccaattttgccaaacacccaccagtcgccgtgctgcctctcggtaccggcaatgacttggcccgatgtctgcggtggggcggtggttatgagggcggaagcctcaccaagatccttaaagatatcgagcaaagtcccctcgttatgctcgaccggtggcaccttgaggtcatccctagagaggaagtcgagaacggagaccaggtgccttactccatcatgaacaattacttttcaattggcgtcgacgcctcaatcgcccatcgttttcatgtcatgagagaaaaacatccggagaagtttaacagccgaatgaagaacaaactttggtatttcgagttcgggacctcagagactttcgcagccacctgtaagaagctccacgatcatattgaacttgagtgtgacggagtcggggtagacctctccaacatcttcctggagggcatcgctatcctcaacatcccaagtatgtacggaggcacaaacctctggggcgaaaacaagaagaacagagccgtgattagggagtccaggaaaggtgtaactgaccctaaggagctcaagttctgcgttcaggatctaagcgaccaacttctggaagtggtcggcttagaaggcgctatggagatgggacagatctatacagggttaaagagcgctgggagaaggctggcacagtgtgcaagtgtgacaatcagaacaaataaactgctgccaatgcaggtggacggtgagccttggatgcagccctgctgcacaataaaaatcacgcacaaaaatcaggcgcctatgatgatgggtcctccccaaaaatccagcttcttctcccttcgccgaaagtctaggagcaaagactag

SEQ ID NO: 220703 - DNA, 3198 bp, Artificial Sequence
  Description of Artificial Sequence: Synthetic coding sequence
atggatgccgctggtcgcggttgccatctcctgccactgcccgctgccagaggccctgccagagctccagctgcagccgcagctgctgctgcttcccccccaggcccttgtagtggagcagcatgcgcgcctagtgccgcagccggagccggagccatgaacccctctagttccgcaggggaggagaaaggcgctacggggggatcctctagtagcggcagtggagccggatcctgttgtctgggcgctgaaggcggtgcagaccctaggggagcaggttccgctgctgcagccggagcagcagcactggatgaaccagctgcagccggacagaaggagaaagacgaagctctcgaagaaaagctacgcaacctcacgttcaggaagcaagtgagttaccggaaggccatcagtcgagcgggtctgcagcatctggcacctgcacaccccctatccctcccagttgctaacggccctgccaaggaaccaagagcaacacttgattggagtgaaaatgcagtaaatggagagcacctgtggttagaaaccaacgtctccggggacctatgttatttgggagaggagaactgccaagtccggttcgctaagagtgctctgaggcggaagtgtgccgtatgtaagatagtggtgcatacagcgtgtattgaacagctcgagaaaattaactttcgatgcaaacccacatttagggagggtgggagccggtcccctcgggagaacttcgtcaggcaccattgggtccacagacgcagacaggagggaaaatgtaaacagtgtgggaagggctttcagcagaagttctctttccactcaaaagaaatcgtggcaatcagctgtagctggtgcaaacaagcctttcacaacaaagtcacatgctttatgcttcaccatatcgaagaaccctgtagccttggagcccacgccgctgtgatcgttccacccacttggattattaaagtcaaaaagcctcagaattctctgaaggccagtaatcgtaagaagaagcgaacctcttttaagagaaaagccagcaagagggggatggaacaggaaaacaagggcaggcctttcgtgatcaagcccataagttctcccctcatgaagcccctgttagtgttcgtgaatccaaaatcaggagggaaccaggggacaaaggtgctgcaaatgttcatgtggtacttgaatcctcgccaggtatttgatctgtcacaggagggccctaaagatgcgctggagctttaccgtaaagtgcccaacttgcgcattctggcttgcggaggggacgggacagtcggctggatcctcagtattctggatgagctacagctgagcccccagccccctgttggcgtgttgccacttggaaccggcaacgatttggcaaggaccctgaactggggcggtgggtatactgatgagcctgtttctaaaattttatgccaggtcgaggatggcacagtggtccaactcgacagatggaatctgcacgtggagagaaaccccgaccttccacccgaagagctggaggacggagtctgtaaattgcctctgaacgtgttcaacaattatttcagcctcggcttcgacgctcacgtgacactggagtttcatgagtcccgcgaggcaaacccagagaaatttaacagccgcttcagaaacaaaatgttctacgccggtgctgcgttttcagatttcctccagcgatctagtagagacttgtccaagcacgttaaagttgtgtgtgacgggacagatctgacgccgaagattcaggagctgaagtttcaatgcatagtgtttttgaacatcccacgctattgtgccggtacaatgccttggggcaaccctggtgatcatcatgactttgaaccacagaggcatgatgatgggtatattgaagtgatcggctttactatggcatctctggccgctttgcaggtcgggggacacggggagaggctccatcaatgccgggaagtgatgctcctcacatacaagtcgattccaatgcaggtggacggcgagccatgccgactggcacccgcaatgatacggatcagcctccggaaccaggcgaacatggtgcagaagtctaaacggaggacatccatgcccctcctgaatgacccacagagtgtgcccgaccgacttcggatacgggtgaacaaaatttcactacaggactatgagggctttcactacgataaggagaaacttagagaagccagtatctctgactggctccgaaccatcgctggagaactagtgcagagttttggggcaatcccgttgggcattcttgtggtgcggggagattgcgacctggagacatgtagaatgtatattgacagattgcaggaagatcttcagtcagttagctctggaagccagcgcgtacactaccaggatcacgaaacaagcttcccacgggctttatcagcacagcgcttatcacccaggtggtgctttctggatgatcggtcacaggaacatctccattttgtgatggaaatctctcaggacgaaatttttatactggatccggacatggttgtgagtcaaccagctggtaccccaccgggtatgccagatctggtggtagaacaggcctcaggaatcagcgactggtggaacccagcactgaggaagagaatgctatccgactctggtctcggcatgatagcaccatattatgaagactccgacctgaaagacctgtcccactctagagtgctccagtcccctgtgtcctctgaggaccacgccatcctccaggcagtaatcgctggcgacctgatgaagctgatcgagtcctacaagaatggcggttcactgctcattcagggacctgaccactgctctctcctgcactacgctgccaagaccgggaatggtgaaattgtcaaatatatccttgatcacgggccttcagagctgctggacatggcagatagtgagacgggcgagacagctctacataaagctgcatgtcaaaggaacagggctgtctgccagctgttggttgacgccggtgcctctctcagaaagaccgatagcaagggaaagactccccaggaaagggctcaacaagctggtgatcctgacctggctgcatatctggaatcccggcaaaattataaagtcattggccacgaagacctggagacagccgtatag

SEQ ID NO: 220704 - DNA, 3207 bp, Artificial Sequence
  Description of Artificial Sequence: Synthetic coding sequence
atggacgcagccggacggggttgccacctactccccttacctgcagcaagagggcctgctcgggcaccagccgcagccgcagctgccgcagcctcccccccagggccttgctccggcgctgcttgcgcgccatccgctgccgcaggtgccggagccatgaaccctagtagtagtgcaggggaggagaagggggctactggaggcagctcatccagtggttctggagctgggagttgctgtttgggggctgagggcggagctgaccccaggggagctggcagcgcggctgcagcgggagcagctgccttggacgaacctgccgcagcgggtcagaaggagaaagacgaagctctcgaggagaaactgagaaacctgaccttcagaaaacaggtgtcttataggaaggccatttcgcgcgctggactacagcacctggcccctgcgcatcccctgagcctacccgtggccaatgggcctgcgaaagagccaagagctacgctcgattggagcgagaatgccgtcaacggggagcacctgtggctcgaaacgaacgtcagcggcgacttgtgctacttaggcgaagagaactgccaggtgaggttcgcaaaaagtgccctcaggagaaaatgtgcagtatgcaagatcgtggttcacacagcatgcattgagcagcttgagaaaatcaacttcaggtgtaagccaacattccgggaaggaggatctcgctcacccagagagaattttgtgcgccaccactgggtgcaccgaaggcgccaggaaggcaagtgtaaacagtgtggtaaggggttccaacagaagttcagcttccactccaaggaaatcgtggcaataagttgttcctggtgcaagcaggctttccataacaaggtcacatgttttatgctgcatcacattgaggagccatgcagccttggggctcatgcagcagtgatcgtgcctcccacatggatcattaaagtcaagaagccgcagaatagtttgaaggcaagtaatcgaaagaagaagagaacatcgtttaaacgcaaagcctctaaaagggggatggagcaggagaacaagggccgtcccttcgtgattaaaccaatttcgagcccacttatgaaaccgctattggtgttcgtcaatccaaagtctggaggaaaccaaggcacgaaggtcttacagatgtttatgtggtatctcaaccctcggcaggtgtttgacctcagccaggaagggccaaaagacgctctggagctgtataggaaggtgcctaatctgcgtatccttgcctgcgggggagatggcacagttggctggatattgtcaatacttgatgagctgcagctctcaccccagccacccgttggagtactgccactaggcacaggcaatgacttggctcgcactctcaattgggggggaggatatacagacgagcccgtgtccaaaatcctgtgccaggtggaggatggcaccgtcgtgcagctggaccggtggaacctgcacgtggaacgtaatccggatctgccaccagaagagcttgaggatggcgtctgtaaacttcctctcaatgtctttaacaactactttagcctgggatttgatgcgcatgtcaccctggaatttcacgagtcccgggaggctaatcctgaaaaattcaatagcagatttagaaacaagatgttctatgctggggctgccttctcagatttcttgcagcgcagttcacgtgatctgagcaagcatgtcaaggtcgtgtgtgatggaacggatctgactcccaagattcaggaactaaaattccaatgtattgtgtttctgaacatacctcgctactgcgcaggaacaatgccgtggggcaatccgggtgaccaccacgactttgagcctcaacgtcacgatgacgggtatatcgaggtgattggctttaccatggcttcacttgcggctctgcaggttggcggacacggtgaaagactgcatcagtgccgagaggttatgctgctcacgtataaatcaatcccgatgcaggtcgacggggagccatgtcgtcttgcacctgctatgatacgcatatctttgaggaatcaggcaaacatggtgcagaagtcgaaacggagaacatccatgccactacttaacgatatccaccaggtacagaccgccgatcttcgacgagtgtcagcacctccaggatcgtttaccatacctcaatccgtccccgaccgcctgaggattcgtgtgaataagatcagcctgcaggattacgaaggctttcactacgataaggaaaagctaagagaggctagtatcccattaggcattctagtggtgagaggtgactgtgaccttgagacttgcaggatgtacatagacagattacaggaggatctccagtctgtctcgagcggaagccagcgggttcactatcaagaccatgaaacctcatttccaagagccctgagcgcacagcgcttaagcccgagatggtgcttcctagatgacagatcacaggagcatctgcactttgtcatggaaatttcacaagacgaaatttttatacttgatcccgacatggtggtgtcacagcctgccggaacccctcctggaatgcctgacctggtcgtggagcaggccagtggaatttccgactggtggaatccagcattgcgaaagcgtatgctgtccgattccgggttgggcatgatagcaccttactacgaggatagcgacctgaaggatctgagccattctcgcgtgttacagagtccagtttcttccgaagaccatgcaattctgcaggcagtaattgcaggagacctgatgaaattaatagagagctataagaatggcggatctctgctgatccaaggacctgatcattgcagtctgctccactatgcagctaagactgggaacggtgaaattgtaaaatatattctggaccacggcccaagcgagctgctagacatggcagattccgagacaggggagactgccttacacaaggcagcctgtcagagaaatagagcagtatgccagctactagtcgacgccggagctagcctgcgcaaaaccgattcaaaaggcaagaccccgcaagagcgtgctcagcaggcaggtgatcccgacctagctgcctacctggagtccagacaaaattataaggttattgggcacgaagatcttgaaacggcggtctag

SEQ ID NO: 220705 - DNA, 2949 bp, Artificial Sequence
  Description of Artificial Sequence: Synthetic coding sequence
atgaacccatcgtcctctgcgggagaggaaaagggagcgacgggaggtagcagctcctccggtagcggagcgggtagttgctgcctgggcgctgaggggggtgccgaccccaggggcgctgggagtgctgccgcagctggtgccgctgccctcgatgagcctgctgcagcgggtcagaaggaaaaggacgaggctcttgaggagaagttgcggaacctgacgttccgaaagcaggtaagttacaggaaagctatttcaagagccggattgcagcacttggctcctgcccaccctctttcgcttccagtcgcaaatggaccagctaaggaaccaagagccaccctcgattggagcgagaatgctgtcaacggagaacatctgtggcttgagaccaacgtcagcggagatttgtgctatctaggggaggaaaactgtcaggtgcgctttgccaaaagcgcccttcgcaggaagtgcgccgtgtgcaagatcgtagtacatacggcatgcatagagcagctggagaagattaattttcgttgcaagcccacttttcgggagggcggttcccgaagtcctagggaaaactttgttcggcaccactgggtgcaccggagacggcaagaaggtaaatgtaagcagtgtggaaaaggattccagcaaaagttcagcttccatagcaaggagatcgtggctataagttgctcatggtgcaaacaggcgtttcacaacaaagtcacctgcttcatgctgcaccacatcgaagagccgtgcagcctcggcgcacacgccgctgtgattgtgcctcctacctggatcatcaaggttaagaagcctcagaactctttaaaagctagcaaccgtaaaaagaaacggacttcttttaaacggaaagcttccaagcgcggaatggagcaggagaacaagggcaggccctttgtgatcaagccaatatcttcccctctcatgaaacctttgttggtatttgtcaatcctaaatctggaggaaatcaaggaacgaaagtgttgcaaatgttcatgtggtatctcaatcccagacaggtgtttgacttaagccaggaggggccaaaagatgccctagagctttatcggaaagttcctaacctccggatcctggcctgcggtggggacggcactgtgggatggatcctgtccattctcgacgaactccagctgtcacctcaaccgcctgttggagtgcttcccttgggcactggcaacgacttggccaggacactgaactggggcggaggctacacagacgaaccagtctccaagatcctttgtcaagtggaagatggcacggtggtccagctcgaccgctggaacctccacgtagagaggaaccccgacctgcctcccgaggaactcgaagatggggtttgtaaactcccgctgaatgtgttcaacaattatttcagtttgggcttcgatgctcacgttacacttgaattccacgaaagccgagaggcgaatcccgaaaagtttaattcccggtttcggaacaagatgttctacgcaggggcagccttttctgacttcctccagcgctcctctcgcgacctgtctaaacacgttaaagtggtatgcgacgggaccgacctgactcccaagatacaagagttgaagtttcagtgcatcgtgtttctgaacattcctaggtactgtgctgggacgatgccctggggaaacccgggagaccatcacgactttgaacctcaaaggcacgatgacgggtatatcgaagtgataggcttcacgatggctagcttggctgcattacaagtggggggacacggggaaagactgcaccagtgccgcgaggtgatgctgctgacctacaagtccatcccaatgcaggtggacggggagccctgtaggcttgcacctgcgatgattcggatctcattaaggaaccaggctaatatggtgcagaaatcaaagcggaggacatcgatgccactgctgaatgaccctcagagtgtgccagatagactgaggattagagtaaataaaatctctctccaggattatgaaggctttcactacgacaaggaaaagttacgggaggcctctattagtgactggctacggactatagccggagagctcgtgcagagttttggggctatcccactgggcatactagtggtgaggggcgactgcgatctcgaaacttgccgaatgtatatcgatagattgcaagaagacttacagagtgttagttcagggagccaaagagttcactatcaagatcacgaaacctcttttccacgcgcactgagtgcgcagaggttgtctcctcggtggtgtttccttgatgcaacctctgccgataggttctacagaattgaccggagtcaggagcacctgcattttgtcatggagatcagccaggatgaaattttcatcctcgaccccgatatggtagtgtcccagccagccggaacaccaccaggaatgcccgatctcgtggtggagcaagcctctggcagccccgtgtctagcgaggaccacgcaatcttgcaggccgtgattgcaggggacctgatgaaactgatagagtcctataagaatggcggatcccttctgattcaaggtccggaccactgtagtttactgcactacgccgcaaagacggggaatggggagatcgtcaaatatatccttgatcacgggccttctgagctccttgatatggccgatagcgagactggtgaaactgccctgcataaagccgcatgtcagaggaaccgggctgtgtgtcagctgctggttgacgccggtgccagtctgcgtaaaactgacagcaaggggaaaaccccgcaggaaagagcgcaacaggctggggaccccgatctggctgcctatctggaaagtcgtcagaactataaggtgatcgggcacgaggatctggagaccgcagtgtag

SEQ ID NO: 220706 - DNA, 2829 bp, Artificial Sequence
  Description of Artificial Sequence: Synthetic coding sequence
atggcagctgctgctgagcctggagctcgggcttggctcggcggaggctcacctcgtccaggcagtccagcatgcagccctgtcctcgggagtggcggtcgtgctagacctggccctgggccaggccctgggccagaacgggctggggtgagggcccctggtcccgctgctgcacccggacacagtttccgcaaagtgacattgaccaaacccaccttttgtcatttgtgttcagactttatttgggggctggcagggttcctctgcgatgtctgtaattttatgtctcatgaaaaatgcctgaaacacgttaggatcccatgcaccagcgtggcgccaagtctcgtgagggtgcccgtggcccactgcttcggccctcgcggtttacataaacggaagttttgcgcagtctgtagaaaggtgctggaagcacccgctttgcactgtgaagtgtgtgagctacacctccatccagactgtgtgccttttgcctgcagcgactgccgccagtgtcaccaagatggccaccaggaccacgatacacaccatcaccattggagagaggggaacctccctagcggagctcgatgcgaggtgtgtcgaaagacttgcggaagtagtgatgtgctagcgggtgtaagatgcgagtggtgcggagtgcaggcccatagcctgtgcagcgcagcactcgctccagagtgcgggttcggcagactgcggtccctagtccttcctccggcttgcgtgcggctattgcccggagggttctccaagacacagtcgtttcgcattgtggaggccgctgagccaggtgaaggaggggatggagcggacggatcagccgcagttgggcctggtagggagacccaagccacaccagaatctgggaagcagactttaaagatctttgatggcgatgacgctgtgcgccgatctcagttcaggttagttacggtttcccgccttgctggggcagaagaggtgctggaggcagccctacgggctcaccatatcccagaggatcctggacatctggaactctgtcgactgcccccatcctcacaggcttgtgacgcgtgggccggaggaaaagcaggttcagccgtgatatctgaagagggaaggtcgcccggttccggagaggcaacgcccgaagcatgggtcatccgcgcactgcccagggcacaggaggttctcaaaatttaccccggatggctgaaagtgggtgtcgcatacgtgtccgtgagggtgactccaaagagcacagcaagaagtgtggtgctggaggtgctgcccctgctcggcaggcaggccgagtcccccgaatcttttcaattggttgaagtggctatgggatgcagacatgtccaaagaactatgctgatggatgagcagcctcttctggatcggttgcaggatatccgacagatgtctgtgcggcaagtgagccagacccggttttatgttgcagagagtagggatgtggctcctcatgttagtctctttgtcgggggattgccacccggattgtctcctgaggaatactcctctctcctccatgaggccggagccaccaaggccactgttgtatctgtcagccacatctatagttcgcaaggcgcagtcgttctcgatgtggcatgttttgccgaagcagaaaggctctacatgctcctgaaagacatggccgtgcggggtcgccttctcaccgctttggtattgccggatttgctacacgccaagctccccccagactcttgtcctctgcttgtattcgtgaatccgaagtctggtggcctcaaaggtagggacctattgtgtagcttcaggaaacttctcaatccgcatcaggtgttcgacctgaccaatggagggccactccctggcctgcacctgtttagccaggttccatgtttcagagtcctggtctgcggaggcgatggcacggtcggctgggtcctgggagcactggaggagacaagatatcgactagcctgtcccgaaccttccgtggcgatactgccgcttggcactggaaacgatcttggtcgcgtcctgcggtggggcgcaggttactcaggggaagatcctttttccgtgcttctgagtgttgacgaagcagacgcagtgctgatggatcgctggaccattcttctcgatgcccacgaagccggatctgctgaaaatgacacagccgatgcagaaccccctaagatcgtccaaatgtccaactattgcggtataggaattgacgcggagttgagcctggacttccaccaggctcgtgaggaagaacctggcaaattcacaagccgcttgcacaacaaaggcgtttatgtccgcgtcgggttacaaaaaattagccactcacgaagcctgcataagcagatccggctgcaagtggagcgccaggaagtggagctgccatccatagagggcctgattttcatcaacataccaagctggggtagcggagctgacctgtggggctccgactccgatacaaggttcgagaagcctagaatggacgacggtctcctagaagtagtcggggtcaccggcgtcgtgcatatgggccaggtccagggcggactcagatcaggtatcagaattgcccaggggtcctacttccgggtgactcttctcaaggctacgcccgtgcaagtcgatggggagccctgggtgcaggccccaggacacatgattatctccgcagctgggccaaaagtgcacatgctgcggaaagccaaacagaagccacgcagggccggaactactagggacgcaagagctgacgcagcccctgcacctgagtctgatcctaggtag

SEQ ID NO: 220707 - DNA, 1632 bp, Artificial Sequence
  Description of Artificial Sequence: Synthetic coding sequence
atgcctgggatggtgctctttggcagaaggtgggctatcgcttccgatgaccttgtgttccctggtttttttgagctcgtggttagagtcttgtggtggataggcatcctgactctctatttaatgcatagaggaaaattggactgcgctggcggtgctctcctcagcagttatctcatcgtgctgatgatcttattagcagtagtgatctgcacagtgtccgccattatgtgcgtgtcaatgcgcggaacaatctgcaaccccggacctagaaagagtatgtccaagcttctgtacatacgactcgcacttttctttcctgagatggtgtgggccagtttaggggctgcctgggtggcagacggcgtgcagtgtgatcggaccgtggttaatggcattattgcgacagtagtggtgcgtacccagatctggtgtccagccacactgagacgggctagcccctgttttatcagtaatcgaacaatctctggtactaccaagagcctccccaggtggagtgccatgccccaaggggctcctagctgtagaagtaggactaccgactatgatctggtgggtggcgaccaattgaactgtcactttggatcaatcctgcatacaacgggtctgcagtaccgggactttattcacgtgagctttcatgataaagtgtacgaactccctttcctcgtggcattggatcatcgaaaagaatccgtcgtcgttgcggtacgtggtaccatgtccctccaagatgttttgaccgatttgagcgcagagagtgaagtattggatgtggagtgtgaggtgcaggatcggttagctcataagggcatctctcaagcagcaaggtacgtctaccagcgcctcatcaatgatggcatcctaagtcaggccttttccatcgcccctgagtatagattggtaattgtgggccattccctgggaggtggagccgctgcgcttttggccacaatgctgagagctgcatatcctcaggttcggtgctatgctttctcccctcccaggggactgtggtcaaaggcgctgcaggagtattctcagtcctttatcgtaagtttagtccttggcaaggacgtgatccctagattatccgtaacgaatctggaagatcttaaacggaggatcctccgggtggtggcacattgtaataaaccaaaatataaaattctgctccacggactgtggtacgagctgttcggcggtaatcccaacaatcttcccaccgagctggatggaggcgaccaggaagtgcttacccaacctttgctcggggagcagtccctgctgacaaggtggtcgccagcatattcatttagttctgactcacctcttgattcctctcccaagtatccaccactctaccctcctgggaggattattcacttacaggaagagggggcatccgggagattcgggtgctgctcagcagcacattacagcgctaagtggtctcatgaggcagagttctcaaagattcttattggacccaagatgctgacagatcacatgcccgatatccttatgcgcgctctagattcagtggtaagcgaccgagctgcatgtgtctcgtgccccgctcaaggcgtgtccagtgtcgatgtcgcctag

SEQ ID NO: 220708 - DNA, 3129 bp, Artificial Sequence
  Description of Artificial Sequence: Synthetic coding sequence
atgcccggaatcgtggtctttcgacgacgctggtccgtgggtagtgacgatctggtgctgccagccattttcctgtttttgctccacacaacctggtttgttatactgagcgtcgtgctgtttgggctggtctataacccccatgaggcctgcagcctgaacctggtcgatcacgggcgaggctacctggggattttgctctcctgcatgatcgccgaaatggccattatatggctgtctatgcggggaggcattttatacaccgaacctcgagatagcatgcagtacgtcctatacgtgcggctcgcaattctcgtgatcgaatttatatacgctattgtcggaattgtgtggctgacacagtattacacctcctgtaatgatctcacggccaagaatgtcaccctcgggatggtggtgtgcaattgggttgtgatcctctccgtctgcattaccgtgctctgtgtattcgatcccacaggacgaactttcgtgaagctgagagctacaaagagacgtcagcgcaatctgagaacatataacctgagacacaggctggaagaggggcaagcaacctcgtggtcaagaagattgaaagtattcctctgctgtactcgcaccaaggacagtcagtcagacgcatacagtgaaatcgcttatttgttcgcggaattcttccgggatctggacatcgtccccagcgacataatcgctggcctggttctcctgcggcagagacaacgagcaaaaagaaacgctgtgctggatgaggctaataacgacattcttgcattcctttctggtatgcccgtgaccaggaacacaaaataccttgatttaaaaaatagccaggaaatgcttagatacaaagaggtgtgctattacatgttattcgcacttgctgcttatggctggcccatgtaccttatgcgaaaacctgcctgcgggctgtgtcagctggctcgttcatgcagttgctgtctgtgccctgcgcgacccaggttcgcccctggcgtgacgatcgaggaggataattgctgcggctgcaacgcgattgccattcggagacattttctggacgagaatatgactgctgtggacattgtgtatacatcttgccatgacgcagtgtacgagacccccttctatgttgctgtggaccatgacaaaaagaaggtcgtgatttcaatccggggaaccctaagccctaaggacgccttaacagaccttaccggagacgcagagcgcctgcctgtcgaagggcatcatggaacatggctaggccataaggggatggtgctgtccgccgagtacatcaagaaaaaactagagcaggagatggtgctgagccaggctttcgggagagatctggggcgtggaaccaagcattatgggttaattgtggtgggccactcactgggagccggaaccgcagcaatactcagctttctgctgagaccccagtaccctacgctaaagtgtttcgcatattcaccgcctggtgggctcttgagcgaggatgctatggagtatagtaaggaattcgtgactgcagtggtccttggcaaagacttagtgccacggattggtctgtcgcaactggagggcttccggagacagcttctcgacgtcctgcagaggtccacaaaaccaaagtggaggatcatcgtaggagcaacaaagtgcatccctaagtctgagctgcctgaggaagtagaagtgacaaccttggctagcacgcggttatggacacacccttcagacctcacgattgcactgagcgcttctacccctctatatcccccagggaggattatacacgtggtccacaatcaccctgctgagcagtgttgttgctgcgaacaggaggagcccacatatttcgccatctggggcgacaataaggcatttaatgaagtgattatctcaccagccatgctgcatgaacatctgccttatgttgtcatggaaggcttgaataaggttctcgaaaactataataagggcaaaaccgcccttctgtccgccgcaaaagtgatggtctctccaactgaggtggacctaacgccagagctcatttttcagcagcaacctctaccgactggaccccctatgcctacaggattagctctcgagctgcccacagctgaccatagaaattcctctgtaaggagtaaaagccagtccgaaatgtccctggaaggcttcagtgagggacgattgttatcaccagttgtggccgctgcagctcggcaagacccagtggaactgcttctgttatcgacccaggagaggttggccgcagaactgcaggccagaagggcgccactggctaccatggagagcttatcagataccgaatctttgtactctttcgacagccgtagaagtagcgggtttcggtctataagggggtccccgagccttcatgcagtgttggagagagatgagggacacctattctacatcgacccagcaatccccgaagagaatccatctctaagcagcaggaccgagttgctcgccgctgatagcctgagcaagcacagccaagatacacagccattggaggccgcattaggttccggcggagtgacccctgagcggcctccctccgccgctgctaacgatgaagaggaggaggtcgggggaggcggtggtggacctgcgtcaaggggcgagctggctctgcataatggtaggctgggtgacagcccttctccacaggtgttggaatttgccgaatttatcgactcactgttcaacttggactccaagtcctcctctttccaggacctgtactgcatggtggttcctgagtcccctacgtctgactatgctgaagggcctaaatccccttcccagcaggagatcctgcttcgcgctcagttcgagccgaatctggttccgaaacccccacgcctcttcgctggaagcgcagatccctcctcaggaatctctctgtctccctcttttcccctgtccagttctggcgaactcatggatctgactcctacgggactgtcatctcaggagtgcttagcagcagacaaaatccggacaagtaccccaacaggacacggcgcttcccccgctaagcaggacgaactggtcatcagcgctcgttag

SEQ ID NO: 220709 - DNA, 2019 bp, Artificial Sequence
  Description of Artificial Sequence: Synthetic coding sequence
atgcctggcatggtgctgttcggtcggagatgggccatcgcaagtgatgatctggtgtttccaggcttctttgaattggtggtgcgggtgctgtggtggatcggtatcctgactctgtacctgatgcaccgaggcaagctcgactgtgcaggcggagcacttttgtctagttacctgatagtcctgatgatcctgctggccgtcgttatttgcacggtgtcggccatcatgtgcgtgagcatgaggggtacaatctgtaatcccggaccacgaaaatccatgtctaaattgctctacatcaggctagctctctttttcccagagatggtgtgggcaagccttggggctgcatgggtggccgatggcgtacaatgtgacagaaccgtcgtgaacgggatcattgctactgtcgtggtgagctggattattatcgctgctacggtggtctcgatcatcatagtattcgatcccctgggtggcaagatggccccatacagctcagcgggaccatctcatctggattctcacgactcctcccagttgctgaacggacttaagaccgccgcaacctctgtatgggagaccaggattaagctgctgtgttgctgcatcggcaaagatgaccacacacgcgtagcgttctcctccactgcagagttattctcgacatacttttccgataccgacttagtaccgagtgacattgctgccggactggcactgcttcaccagcaacaggacaatattaggaacaaccaggagccggcacaggtggtctgccatgccccaggttctagccaggaagctgaccttgacgctgagcttgagaattgtcaccactatatgcaattcgccgcagccgcttatggctggcctctgtacatctatagaaatccccttacaggactttgccgcatcggtggggattgctgtagatcacgaacaaccgactacgatcttgtggggggtgatcaactcaactgccattttggttccatcctgcatacgacaggtctgcagtaccgcgatttcattcacgttagctttcacgataaagtctacgagctacccttcctggtggcccttgatcaccgcaaggagagcgttgtagtcgcggtgcggggaacaatgagcctccaggacgttctaaccgatctgagcgctgagtctgaagtgctcgacgtggaatgtgaggtgcaggacaggctggctcacaaaggaatctcccaagccgctaggtatgtataccagaggttgattaacgacgggatcctgtcgcaggcgttttcgatcgccccagagtatcggctcgtgatcgtggggcattctctcggcggaggcgcagctgcccttctggcaaccatgttaagagcagcgtaccctcaggtgcgctgctatgccttctcaccacctcggggactgtggtccaaagctctgcaggaatacagccagtcattcatcgtgtcactcgttctagggaaggatgtaattcctcggctgtctgtgacaaatctcgaagatcttaagcggagaatccttagagtcgtcgcccactgtaacaagcctaaatacaaaatcctgctgcacggactgtggtatgaattgtttggcggaaacccgaacaacttgcccacggagttggacggaggtgatcaagaggtcctgacccaacctttgcttggcgagcagagcctactcacgagatggtctcccgcttactctttcagcagtgatagtcccctggattcttctcctaagtacccacctctgtatccgcctgggaggatcatccaccttcaagaagagggcgcttcaggaaggtttgggtgttgtagtgccgctcattatagtgcgaaatggagtcacgaagcagagttttccaaaatccttatcggaccaaagatgctgacggatcatatgcccgatattttaatgagggccctggacagcgttgtctctgatagggctgcatgcgtgagttgcccggctcagggtgtgagttccgtcgacgtggcatag

SEQ ID NO: 220710 - DNA, 663 bp, Artificial Sequence
  Description of Artificial Sequence: Synthetic coding sequence
atgtactgcgtatctcatcatgtgtgccagcacgaaaggactcagatatggtgtccagcaacactacggagagcaagcccgtgctttatttccaaccgcaccatctcgggcactaccaaaagcctccccagatggtctgccatgccacagggcgctccatcctgtcgcagcagaacaaccgactacgatctcgtcggaggcgaccaactcaactgtcacttcggatctatcctgcacaccacaggcctgcagtatcgagactttattcacgtctcatttcacgacaaagtttatgagctcccattcctcgttgctctcgaccacaggaaagagtctgttgtggtggcagtacgaggtactatgtcacttcaggacgtgctgaccgatttgtccgccgaatctgaggttctcgacgtggaatgtgaggtacaggataggcttgcccataaaggcatatcccaggccgctagatacgtgtaccagcgcctgattaatgatggaatcttatcccaagcgttctctattgctccggagtacagactcgtgattgtcggacatagtctcggcggtggagccgctgcgctactggctactatgttgcgggctgcatatccccaagtgagatgctacgcttttagtcctccacgagggctttggagatag

SEQ ID NO: 220711 - DNA, 1140 bp, Artificial Sequence
  Description of Artificial Sequence: Synthetic coding sequence
atgtactgcgtgtctcatcacgtctgccagcatgagtcttggattataattgctgccaccgtggtgtcaataattatcgtgtttgacccactgggtgggaaaatggccccatactccagcgcaggcccttctcacctcgactctcatgacagtagccagcttcttaatggtttgaagacggccgcaacctctgtgtgggagactcggatcaagctgctgtgctgctgcattggcaaagacgatcacacaagggtggcttttagttcaaccgctgaactgttctcgacctatttttctgacactgatctggtccctagcgacattgccgcaggcttagccctgctgcaccagcagcaggataatatccgcaacaatcaagaaccagcacaggtggtatgtcatgccccagggagctcccaggaagcagacctggacgctgagctggaaaactgtcaccattatatgcaattcgctgctgccgcttacgggtggcctttgtatatttatcgcaacccgctcaccgggctctgtcggatcggaggagactgctgtagaagcaggacaacagattacgacctagtcggcggtgatcagctgaattgccattttggatcaattcttcatactaccggcctgcagtaccgcgactttatccacgttagcttccatgataaagtctatgagttgccatttctggtggctctcgaccaccgcaaagaaagcgtggtcgttgcagtccgaggcacgatgtccctccaggacgttcttactgacctcagcgcggagtcagaggtgcttgacgtagagtgtgaggtccaggatcgcttggcgcacaagggcatatctcaagctgcccgatacgtttatcagcgacttatcaatgatgggattctgtcccaggccttcagtatcgctcccgagtaccgtctggtcatagttggccatagccttggtgggggagccgctgccctcctggcaactatgctgcgggctgcttacccgcaacagagttctgctggcatattctccgagcttcaccgcgtgacaagacctggcgagggttgcgactcacaggctcagtgcgatcaacttggaagatcagaagagaaaaaccttgctagtgggcgtgcgctgcagtag

SEQ ID NO: 220712 - DNA, 804 bp, Artificial Sequence
  Description of Artificial Sequence: Synthetic coding sequence
atgccaggtatggtgctgttcggtcggagatgggccattgccagtgatgacctggtgtttccaggcttcttcgagttggtcgtgcgagtgctttggtggatcggaattctgactctatatctgatgcaccgaggaaagttggattgcgccggaggcgcattgctatctagctacctcattgtgctaatgatcctgctcgccgtcgtcatctgcacagtctcagccattatgtgcgtctcaatgcggggaacaatctgcaatccaggccctcggaagtcaatgtcgaaactgctatacatccgtctcgctctgttttttcccgagatggtctgggcctcactgggtgctgcctgggtagcagatggggtacagtgcgaccgcactgtggtgaacggtatcattgcaacagttgtcgtctcatggattatcatcgctgccacagtggtcagtatcattattgtctttgaccctctaggcggtaagatggctccgtactcctccgctggaccttcacatctcgacagccacgattcatctcagcttctgaatggtctgaagacggccgctacttcggtctgggaaaccaggatcaagctcctgtgttgttgtataggaaaggatgatcatacgagggttgcgttctcatcaacagcggaattattcagcacttattttagcgatacagacctggtgcccagtgacatcgctgccggactggccttgctgcatcagcagcaggacaacacgcgagcgactggtaactgcccaagaaacgacggcctgacccttctctctcttaactag

SEQ ID NO: 220713 - DNA, 1467 bp, Artificial Sequence
  Description of Artificial Sequence: Synthetic coding sequence
atgggtgatagaggctccagccggcgaaggcgcacgggttcacgtccttcctctcatggtggcggaggccctgcagccgcagaggaagaggtgcgcgatgccgcagcagggccagacgtcggggcagccggtgacgcccctgcgccagctcccaacaaagacggcgacgctggagtcggctcggggcactgggagctgaggtgccatagattgcaggacagcctgttctcatcagactccggtttttcgaattatcgcggtatcttgaattggtgcgtggtgatgcttatcctcagtaatgcaaggctctttctggaaaatctgatcaagtacggcatcctggtggatcctatacaagttgtgtctctgtttctgaaggacccatacagctggcctgccccttgtcttgtcatcgccgctaacgtattcgctgttgccgcattccaggttgagaagcggctggcggtgggagcactaacagagcaggcaggcctgctgcttcatgtggccaatctcgctactatcctctgcttccctgctgccgtggttctcttagtggagagcatcaccccggtggggtcactactggctctgatggcacacaccattctgttcctgaaacttttctcatatcgggatgtaaacagttggtgcaggcgggcacgcgcaaaggccgcttctgccggaaaaaaagcttctagtgccgctgctccacacaccgtgtcctacccagataacctgacctaccgggatctgtactactttctgttcgcccctactctctgttatgaattaaactttccaagatcaccacgaatcagaaaacgcttcctcctaagaagaatccttgagatgctttttttcacccaactccaggttgggttgatccagcagtggatggtccctacaattcagaacagcatgaagccctttaaagatatggactattcaagaataatagaaagactcctaaagctcgcagttccaaaccacctcatatggctcatctttttctactggctgtttcactcttgcctgaatgcagtagctgagctcatgcagtttggggaccgcgagttctacagagactggtggaatagtgaatccgttacctacttctggcagaactggaatattcccgttcataagtggtgtatccgtcacttctataaaccaatgctgagacggggttcgtctaaatggatggcacgcaccggcgtgtttttagctagtgcattctttcatgagtacctggtctcagtgccgcttaggatgttcagactctgggcctttaccggaatgatggcccagatccccctggcctggtttgtcggaagatttttccaagggaactacggcaatgccgcagtgtggttaagccttattattggtcagcctattgcagtgctaatgtatgtgcatgattactacgtccttaactatgaggctccggctgccgaagcatag

SEQ ID NO: 220714 - DNA, 282 bp, Artificial Sequence
  Description of Artificial Sequence: Synthetic coding sequence
atgaagctgctgatggtcctgatgctagccgctctatcgcaacattgttatgcaggctcaggttgccctttgctggaaaacgtaataagtaaaacaataaatccccaggtgtccaaaaccgagtataaggagctgctgcaggagttcattgacgataatgctacaaccaatgctatcgatgagttgaaagagtgtttcctgaatcagacggacgaaaccctgagcaatgttgaggtgtttatgcaattgatatatgattcttccctttgtgacctcttctag

SEQ ID NO: 220715 - DNA, 1038 bp, Artificial Sequence
  Description of Artificial Sequence: Synthetic coding sequence
atgaagaccctgatcgctgcctacagcggcgtcctccgtggtgagcgtcaggcagaggcagacaggtcacagaggtcacacgggggacccgctttgagtagagaagggtcgggcagatggggagtggcctgtagcgctatattgatgtatatcttttgcacagactgctggctgatcgcagttctgtatttcacatggctggtgtttgactggaatacccccaagaagggcggacgcagaagccagtgggtgaggaactgggctgtgtggagatacttcagagattacttccctatccagctggtcaagacccataatcttttaacgactcggaactacatcttcggctaccatccacatggtatcatgggcttgggagcattctgcaatttctctacagaggcgaccgaagtttccaaaaagttcccagggatcaggccttacctggccaccctcgctggtaacttcagaatgcctgtgctacgggagtatctcatgtccggcggaatctgcccagtctcaagggataccatcgactacctgctgtccaagaacggatccggcaatgctatcattattgtggtgggtggcgctgctgaatccctgtccagcatgcctgggaagaacgccgtgactctccgtaaccgcaaggggttcgtaaaattagcgctcaggcatggtgcagacctggtgccaatctattctttcggtgagaacgaagtgtataaacaggtgatattcgaggagggatcatggggcaggtgggtacagaagaaattccagaaatatatcggcttcgctccttgcatcttccatgggagagggcttttttcttccgacacttgggggctggtaccttactccaagcccattactaccgtcgtaggtgagcccattacaatacctaaattggagcatccaactcagcaggatatcgatctctaccacacaatgtacatggaagctttagtgaagctgttcgataagcacaaaacaaaattcggcctgcccgagactgaggtgctcgaggttaactag

SEQ ID NO: 220716 - DNA, 3306 bp, Artificial Sequence
  Description of Artificial Sequence: Synthetic coding sequence
atggagcagccaggtgccgctgcctctggagctggcggaggctctgaagaaccgggtggaggcagatctaataaacgcagtgctggcaaccgcgctgccaacgaagaggaaacaaaaaataagcccaaacttaacattcagattaaaactctcgccgacgacgtgagagaccggattacctcattcaggaaaagcaccgtgaaaaaagaaaagccattgattcaacaccctatcgatagtcaggtggcgatgtccgaatttccggctgctcagcccctttacgacgagcggagtttaaacctgtcagagaaagaggtgctcgatctttttgaaaagatgatggaagacatgaatttgaacgaggaaaagaaagctcctctgaggaacaaggacttcaccactaagcgtgaaatggtggtccagtatatctctgctaccgccaagtctggcggtctgaaaaacagtaaacacgagtgtacactgagcagccaggagtatgtgcacgaactgcgcagcggcatcagtgacgaaaaattactcaactgcctcgagagcctcagggtgagtctgacgtcaaaccccgtctcttgggtgaataatttcggccacgagggactgggtttactgctggacgaactggagaaactcctggacaaaaagcagcaagaaaacatcgataagaagaatcagtacaagctgattcaatgcctcaaggcttttatgaacaacaagttcggcctgcaaagaatactcggagatgagaggagcctgctgctcctggcccgagccattgaccccaagcagcctaacatgatgacagagatcgtgaagatcttgagcgcaatttgtatcgtgggagaagagaacattctagacaagctactgggggctattaccactgccgctgaacgaaacaaccgggagcggttcagcccaatcgtggaaggactggagaatcaggaagctctgcagttacaggttgcctgcatgcaattcatcaacgctctcgtgacttccccatatgagctcgacttcagaattcacctgcgaaacgaattccttcgctcaggtctaaagactatgctccctgatctcaaagagaaggagaacgatgagctggacattcagctcaaggtgtttgatgagaacaaggaagatgaccttacagagctgtcacacagactgaatgatattagagctgagatggatgatatgaatgaagtgtatcatctcctgtataacatgctgaaggataccgccgctgaaaactatttcttatcaattcttcaacatttcctcctgattcgaaacgattattacatacgacctcaatattacaagataatagaggagtgcgtttcgcagatagtactacactgttcaggcatggacccagacttcaagtatagacagcgacttgacatcgacctgacacatctgattgacagctgtgtgaacaaagctaaggtcgaagaatcagagcaaaaagccgctgaatttagtaagaagttcgacgaggaattcacagcacgtcaagaagcccaagctgaactacagaagcgggatgagaagattaaggaactggaagccgaaatacagcagctcaggactcaagctcaggtgcttagttcatcgtccggaataccgggaccccctgctgcaccccctcttcccggagtggggcctcctccccctccccctgctccacctctgcctgggggagcaccgttacctccccctccacctccactccctggcatgatgggaattcccccaccccctccaccccctctgttgtttggcggacctcccccacccccaccactgggcggagttccccctccacccggaatttcactaaacctgccctatggaatgaagcagaagaagatgtacaagccggaggtttctatgaagcggataaactggagcaaaatcgaaccaacggaactgtctgagaattgtttctggctcagggtgaaggaggataaattcgagaatcccgatttgttcgccaaactagccctgaatttcgccacccagattaaggtacagaaaaacgccgaagcgctagaagagaagaaaacaggaccaacaaagaaaaaagtgaaagagttgcggatcctggatccgaaaacagctcagaatttgagcatttttctgggaagctaccgtatgccttacgaggacatccggaacgtcatcctagaggtgaacgaggacatgctgagcgaagccttaattcagaaccttgtgaaacatttgcctgaacagaagattttaaacgaactggccgagttgaagaacgagtatgatgacctttgcgagcccgagcagttcggcgttgtgatgtcaagcgtcaaaatgctacagcctcgtttaagctctattttgtttaagctcaccttcgaggagcatatcaataatatcaagccctctatcatagccgtcaccctggcatgtgaagaactcaaaaagagtgagagcttcaatcggctgctcgagctggtcctactggtgggcaactacatgaacagcggctcccgcaacgcccagtccttgggcttcaagatcaacttcttgtgtaagataagagacaccaagagcgcagatcagaaaaccaccctgttacactttattgctgatatctgcgaggaaaaatacagagacatactgaaatttcccgaagaattggagcatgtagagagcgccagtaaagttagtgctcaaatcttgaagtccaatctggcctccatggagcaacagattgtccacctcgagagggacataaagaaattcccacaggcagagaatcagcatgacaaattcgttgagaaaatgacctcattcactaaaactgccagggaacaatacgagaagctatctaccatgcataacaatatgatgaaactttacgaaaacctgggagagtatttcatctttgactctaagacagtgtccatcgaggagttctttggagatctaaataacttccgaactttgttcctggaggcagtacgagaaaacaataaacgcagagagatggaggaaaaaacgagacgggcaaagctagccaaagagaaagccgaacaagagaaactggagagacagaagaagaaaaagcagttaattgatatcaataaagagggcgatgaaaccggcgttatggacaacttgctggaagctttgcagagcggcgcagcttttcgcgatcgacggaagagaataccaagaaacccagacaatcggcgtgtgcccctggaaagaagtaggagcagacacaacggtgccattagctcaaaatag

SEQ ID NO: 220717 - DNA, 3291 bp, Artificial Sequence
  Description of Artificial Sequence: Synthetic coding sequence
atggagcaacctggagcagccgctagtggagctgggggaggctctgaggaaccaggcggaggacgaagtaacaagcggtctgcagggaatagagcggcaaacgaagaggagactaaaaataagcccaaactgaacatccaaatcaagacattggccgacgacgtgagggatcgaattacttcatttaggaaaagcacagtgaaaaaggagaagccattgatccagcatcctatagattcccaggtagctatgtctgaattccccgcagcccaaccactttatgacgagcgctctctgaatctttcagagaaggaggtgcttgatctgtttgaaaaaatgatggaagacatgaatctgaatgaagaaaaaaaggcccctctgcggaacaaagattttaccacaaaaagggaaatggtcgtgcagtacatatccgctacagccaaatcaggaggtctgaaaaactcaaaacacgaatgtacactttcttcacaggagtatgtgcacgagctgcggtctgggatcagcgatgagaaattgctaaattgtctggagtccctgagagtctccttgacctcaaaccccgtcagttgggtgaataattttggccacgagggtctgggccttctactggacgagctggaaaaacttctggacaaaaagcagcaagagaacatcgacaaaaagaaccaatataagctcatccaatgcctcaaagcattcatgaacaacaagtttggcctccagcggattctgggtgacgagcggagcttgctactgttagctcgtgccattgacccaaaacagcccaatatgatgaccgagattgtcaaaattctgtctgccatttgcattgtgggcgaggaaaatattctggataaattactcggcgcaatcacgaccgccgcagaaaggaataatcgggaacgattttctcctatcgtcgaaggcctagaaaatcaggaagcactgcagctgcaggtggcttgtatgcaattcataaacgccctggttacatcaccctacgaacttgacttccgcattcacttgcggaacgagttccttcgcagtgggctaaagaccatgctccccgacctgaaggagaaagaaaacgatgaactagacatccaattgaaggtttttgatgagaacaaagaagatgaccttactgaattgtcacaccgcctcaacgacatccgagccgagatggacgacatgaatgaggtgtaccacttattatataacatgctaaaagatacagcggcagagaattattttctgtctatattacagcatttcctgctcatcagaaacgattattatatccgcccacagtattataaaatcatcgaggaatgtgtttcccagatcgtgctccactgttcgggcatggatcccgatttcaagtaccgccagaggctcgacatcgacctgacacacctgattgatagttgcgttaataaggccaaggtcgaagaatctgagcagaaggctgccgaattctcgaagaaattcgatgaggaattcactgctcggcaggaagcccaagccgaactgcagaagcgggacgagaaaatcaaggaactggaagctgagatacaacagctgagaacacaggcacaggttctgtccagttcctcagggattcctggacctccagcagcacccccattgcctggcgtcggaccgcctcccccaccaccagcaccacctttgcccggtggagccccactgccaccgcctcctcctccattacctggtatgatgggcatccctccaccaccacccccaccactgctgtttggcggtccgcctcctcctccacctctggggggtgtgcctcccccacctggcataagcctgaacctcccttacggaatgaagcagaagaaaatgtataaacccgaagttagtatgaagcgcatcaactggtctaaaatagagccgactgagttatccgagaactgtttttggttgcgggtgaaagaggataaatttgaaaacccggatctcttcgccaagctggccttaaactttgcaacacagattaaggttcagaaaaacgcagaggccctggaagagaagaagacaggcccaactaagaagaaggtcaaggaactgcgaatcctcgacccaaaaacggcccagaatctgtctatcttccttgggagttaccgcatgccttacgaagacatcagaaatgttatcctggaggtcaatgaggacatgctgtccgaggccttaattcagaatctagtgaaacatctgccagagcagaaaatcctgaatgaattggcagaactgaagaacgagtacgatgacctgtgcgagcctgagcagtttggagtggttatgtcttctgtcaaaatgttacagccacgcttatccagtatcctatttaaactgacctttgaagagcacatcaacaacatcaagcctagcattatcgctgtcactctggcgtgcgaagaactgaaaaagagcgaatctttcaaccgcctcttggagctcgttcttctggttggcaattacatgaatagcggctcacgtaacgcccagtctctagggtttaaaatcaacttcttatgtaaaattcgcgatacaaaatcggccgaccaaaaaacaactctgctacactttattgccgacatttgcgaggaaaagtacagggatatcctcaagtttccagaggagctcgaacacgtcgagtctgcatcgaaggtctccgctcaaatcctgaagagcaatctggcctctatggagcagcagatcgtgcatctcgaaagagacattaagaagtttccgcaagccgaaaaccaacacgacaagttcgttgagaaaatgaccatattcaccaaaaccgccagggagcagtatgaaaagctgtctaccatgcataataatatgatgaagctgtacgagaacctcggggaatacttcatcttcgactctaagactgtgagtattgaggagtttttcggtgacttgaacaatttccggacactttttctcgaggcagtgagggaaaataataagcggagggaaatggaggaaaaaacacggcgagcaaagctggctaaagaaaaggcagagcaggagaagttggagaggcagaagaaaaagaagcagctgatcgatattaataaggagggagacgagactggagtgatggacaacctgctggaggccctgcagtcaggcgcagcattccgcgacagacgcaagagaatcccgcgaaatcctgtggtgaatcacccctgtgccacccgcgcaaacccgcgaagcgcgacttag

SEQ ID NO: 220718 - DNA, 3291 bp, Artificial Sequence
  Description of Artificial Sequence: Synthetic coding sequence
atggaacagccgggagcggcagcctctggcgcaggaggagggagtgaggaaccgggagggggacgatccaacaaaaggtctgctgggaatagggcagctaacgaagaggagactaagaataagcctaaactgaacatccagatcaagaccctggctgacgacgtcagagaccgtattacatcctttaggaaatcaactgtgaaaaaggaaaaacccctgatccaacaccctatcgattcccaggtggccatgagtgagttccctgctgcccagcctctatacgacgaacgcagcttaaatctatccgagaaggaggtcctggatcttttcgagaaaatgatggaggatatgaacttgaacgaggaaaaaaaagcccctctgcggaacaaagacttcactaccaagcgtgagatggtggttcagtacataagcgccaccgcgaagagtggaggcttgaagaattccaagcatgagtgtactctgagcagccaggagtacgttcacgagcttcgctcaggcattagcgatgagaaattgctgaactgtcttgaatccctccgggtgtccctcacgtccaatcctgtcagctgggtaaacaatttcggtcacgagggattgggactgctgttggacgagctggagaaactgttagataagaagcagcaggaaaatattgataaaaagaaccaatacaagctcatacaatgcttgaaggctttcatgaataacaaattcggccttcaaagaatccttggtgacgaaaggtccctgcttcttctagcacgcgcaattgatcccaaacagcccaatatgatgactgaaatcgtgaagattctaagcgcaatctgtattgtgggcgaagaaaacatacttgataaactgctgggcgctatcacaacggcagccgagcggaataatcgtgagagattcagcccaattgtggaaggactggagaaccaggaggctttgcagctccaagtagcatgcatgcagttcatcaacgcactcgtgaccagcccttacgagctagatttccggatccatctgagaaacgaattccttcggtcaggtcttaagacaatgttacccgacctaaaggaaaaagaaaacgatgaactcgatatccagttaaaggtgtttgatgaaaacaaagaggacgatctgaccgagctaagccaccgattgaatgatatcagggccgagatggatgatatgaatgaggtttatcacctactgtataacatgcttaaggatactgccgctgaaaactacttccttagcatcctgcagcatttccttttaatccggaatgactactatattaggcctcaatattacaagatcatcgaggagtgcgtgtcacagattgttctgcactgttccggcatggaccctgatttcaaatataggcagcgtctcgacattgaccttacgcatctgatcgattcatgtgtcaataaagcaaaggtggaggaaagtgagcaaaaagctgccgaatttagcaagaagttcgatgaggagtttacggctagacaagaagcccaggccgaattgcagaaaagagacgaaaaaattaaagaacttgaagcggaaattcagcaactccgcacacaggcacaggttctttccagtagtagcgggataccagggcctccagctgcgcctccattgcctggggtgggaccgcctcccccaccaccggctccccctctgcctggcggagcgcctttacccccacctcccccacctctaccaggcatgatgggaattccacctcccccaccgcctccactactgttcggaggcccaccgccacctccacctttgggcggagtgccaccaccccctggaatcagcttaaacttgccatatgggatgaagcagaaaaagatgtataaacctgaggtgagtatgaagaggattaactggtctaaaatagagccaacggaactgagcgagaattgcttctggctaagagtgaaagaagataagttcgaaaacccagatctctttgccaaactcgctttaaatttcgctacccaaatcaaggtgcagaaaaatgcagaagctttagaggagaagaagactggtcccaccaaaaagaaagtaaaagagctgcgcattctcgacccaaaaactgcacagaacctcagcattttcctcggctcctatcgcatgccatacgaagatattagaaacgttattctggaggttaacgaggatatgctgtccgaagccctaatacagaacctggtcaagcaccttcccgagcaaaaaatcttgaacgagctcgcagagcttaagaatgaatacgacgatctgtgtgagcccgagcagttcggggtggttatgtcctctgtgaaaatgttgcaaccgcgtctgtccagtattttgttcaagctcactttcgaggagcatataaacaatatcaagccttctattatcgctgtgacgctggcctgtgaggaattgaaaaaatccgagtcttttaaccggctcctggagttggtcttgctagtaggaaattatatgaactccggctccaggaacgcccagtcgttaggatttaaaataaacttcttgtgtaagatacgtgatacaaagtctgctgatcagaaaaccaccctgctccattttatcgccgacatatgcgaagagaagtaccgggatatcctgaagttcccagaagagctagaacacgtagagtccgcctccaaagtgagtgctcagatcctgaagagcaacctggcatctatggaacagcaaatcgttcacctcgaaagggacatcaagaaatttccacaagctgaaaatcagcatgacaaatttgtcgagaagatgacaagtttcactaaaaccgcccgtgagcagtacgaaaagctgtccacgatgcataataatatgatgaagctgtacgaaaatctgggcgagtattttatcttcgacagcaaaacagtcagcattgaagagttcttcggcgacttgaacaacttcaggacacttttcctagaggccgtcagagaaaataacaaaagacgtgagatggaagagaagacacgcagagccaagctggccaaggagaaagccgaacaggaaaaactcgagcgccagaaaaagaagaagcagctcattgacatcaacaaggagggagatgaaacaggagtgatggacaatctcttggaggcactacagtccggtgctgcttttcgggatcgacggaagaggattcccaggaacccagttgtgaaccacccttgtgctacacgtgccaaccccagatccgctacttag

SEQ ID NO: 220719 - DNA, 3294 bp, Artificial Sequence
  Description of Artificial Sequence: Synthetic coding sequence
atggagcagccaggcgcagcagcctcaggagccggtggaggtagtgaagaacctggcggtggccgatcaaacaagagaagtgcaggaaatcgcgcagcaaacgaggaggagacaaaaaataagccaaaattgagggatcggatcacaagcttccgcaagtccacagtgaagaaggagaagcccctgatacagcaccccatcgattcccaagtggcgatgagcgaattcccagccgcacagccactgtacgacgaaaggtccctgaatcttagcgaaaaggaggtactggaccttttcgagaaaatgatggaagatatgaaccttaacgaggaaaaaaaggcgcctctgagaaataaggacttcacaaccaagcgcgaaatggtggtccagtacatttccgccacagccaaaagtgtgataagctcacacattaaagggggtctcaagaactccaagcacgagtgtaccctttcttcccaagaatacgtgcatgagctccgatcgggtatctcggatgagaagctgctaaactgtctggaatccctgagggtgagtctcacttccaaccctgtgagctgggtcaacaactttggtcacgaaggactgggcttgctacttgatgagttggaaaaactgcttgacaagaagcaacaagagaatatcgataagaagaatcaatataagctgattcagtgccttaaggcattcatgaataataagttcggtcttcaaaggattctgggcgacgagagatctctgctgctgttggccagagccatcgacccaaagcaacctaatatgatgacagagatcgtgaaaattctgagcgctatatgcatcgtgggggaggaaaatatacttgacaagctgctgggcgctatcaccacagcagcagagcgtaataaccgggagcggttcagcccgatcgtcgaagggctcgagaatcaggaggcactgcagcttcaagtggcctgtatgcagtttatcaatgcactggttacaagtccctatgaactggactttagaattcatctgcgaaacgagttcctgcgcagcggactaaagaccatgctgccagacctgaaggaaaaggagaatgacgaactcgatatacagctgaaagtttttgatgagaacaaggaggacgacctgacagaactgtcacatcggctcaatgatattagggcagaaatggatgacatgaatgaggtgtaccacttgttgtacaatatgctgaaggataccgcggcagaaaattacttcctgtcaatcctccaacatttcttgttaattcggaatgactactatatccgcccacaatattacaagattattgaagaatgcgtaagtcagatcgtgttgcactgcagcggtatggaccccgatttcaagtacagacaacggctagacatcgatctgacccatctgattgactcgtgcgttaacaaggctaaagttgaggagtccgagcaaaaagccgctgagttctccaagaagtttgacgaggagttcacagctagacaggaagctcaagctgaattacaaaagagagacgaaaagatcaaagagctggaagctgagatccagcaactgaggactcaagcacaggtcttgtcatccagctcgggtatccctggcccaccagctgcacctcctctgcccggtgtgggccctcctccccctcccccagcccctcccttaccaggaggggcacctctccccccacccccaccccctctgcctggcatgatgggaattcccccaccaccccctcctcctctactattcggaggacctccaccaccgcctcctcttggaggggtgcccccacctccaggcattagtttgaaccttccttatgggatgaaacaaaaaaagatgtacaaacccgaggtctctatgaagagaatcaactggagcaaaattgaaccaaccgaactgagcgagaactgcttctggctgagagtgaaagaagacaagtttgagaacccggacttgttcgccaaactggctctgaattttgcgacacagatcaaggtacagaagaatgctgaggccctcgaagagaagaagaccggaccaactaaaaaaaaagtgaaagagttgagaatcctagatcccaagacagctcagaatctgagtatttttctaggtagctacagaatgccatacgaagacatcagaaacgttattttggaggtcaacgaagacatgctttcagaagccttgatacaaaacttggtgaagcacctgccagaacaaaaaatcctgaacgagctggcagagctgaagaatgagtatgatgacctctgcgagcctgaacaattcggggtggtgatgagtagcgtcaaaatgctgcaacccagactgtcttccattctatttaagctaactttcgaggagcacatcaacaatattaagccatcaattatagccgtcactctcgcatgcgaggaattaaagaaatctgaaagctttaatcgcctcttggaattagtccttttagttggcaactatatgaatagcggatctagaaatgctcaaagtttgggatttaaaatcaattttttgtgcaagattcgcgatacaaagagcgccgaccagaagaccaccttattgcacttcatcgcagacatctgcgaagaaaagtaccgggacattctgaaattccctgaagagttggagcatgtagaatccgcaagcaaagtgtccgcccagatccttaagtctaacttagcctccatggaacaacagatcgtgcatttggaacgcgacatcaagaaattccctcaggccgagaaccaacatgataaatttgtggagaaaatgacaatatttacaaagacagctcgcgagcagtacgagaaattaagtacaatgcacaacaacatgatgaagctgtatgagaatctaggtgagtattttattttcgatagcaaaacggtgagtatcgaggagttctttggcgatctcaacaatttcaggaccctgtttcttgaagctgtcagggagaacaataagagaagagagatggaagaaaaaacaagacgggcaaaactggctaaggagaaggccgaacaggagaagctagaacgacagaaaaaaaagaagcagctaatcgatatcaacaaagagggagatgagactggagtcatggataacctgctggaggccctccagtctggcgctgcttttcgtgatagacgcaaaaggattcccagaaacccagataaccgacgcgtaccactcgagagatctcggtcccgccataacggagccatttccagtaaatag

SEQ ID NO: 220720 - DNA, 3306 bp, Artificial Sequence
  Description of Artificial Sequence: Synthetic coding sequence
atggaacagcccggtgctgctgctagtggagctggtggaggctccgaggagcccggaggcggaagaagcaacaaaagatcagcgggaaatagagccgctaacgaagaggagactaaaaacaaacctaagctcaatatccaaataaaaactctagctgacgatgtacgggataggattacttctttccgaaagtccactgtcaaaaaggagaaacccctgattcagcatcctattgattcccaggtggccatgtcagagttccctgccgctcagcccctgtacgatgagagatccctgaatctcagcgagaaagaggtgttggacctgttcgagaaaatgatggaggacatgaacctgaacgaggagaaaaaggccccactgaggaacaaagattttacaaccaagcgggaaatggtggttcagtatatcagcgccactgctaaaagcggaggcctgaagaacagtaaacacgaatgtactctttctagtcaggaatacgtgcatgaattgagaagcggtatctctgacgaaaagcttcttaattgcttggaaagcttacgggtctccctgacgtccaaccctgtgagctgggtgaataactttggccacgaagggctgggtctgctgctggacgaactggagaaattactggataaaaaacagcaggaaaatatagataaaaaaaaccagtataagttgatccagtgcttgaaggcctttatgaataataaatttggactccagcggatcctgggggatgagaggagccttctgctgctcgccagagcaatcgatcccaagcagcccaatatgatgacggagattgtaaaaatactatcagcgatctgtattgtcggcgaagagaacatcctcgacaaactgctcggagccatcacaaccgccgcagaaaggaataaccgggagagatttagcccaattgttgagggccttgaaaatcaagaagccctacagctgcaagtggcgtgtatgcagtttattaatgccctggtgacttccccctatgaattggactttaggatccatctcaggaacgaatttctacgcagcggtctaaaaacaatgttaccagatttgaaagagaaagagaatgacgagttagacattcagctgaaagtgtttgacgagaataaggaagacgacttgacagaactctcccatcgactgaacgatatccgcgcagaaatggacgacatgaatgaggtttaccatctgttgtataacatgcttaaggataccgccgctgaaaattactttctgtccattttgcagcatttcctgctcatccgcaacgactactatattcgcccacagtattataaaattatagaagaatgtgtcagccaaattgttctgcattgcagtgggatggatcctgattttaaataccggcagcggctcgacattgacctgacacatctcattgactcctgcgttaataaggccaaagtggaggagtctgaacagaaagccgctgagttctccaagaaattcgacgaagagttcacagcgagacaggaggcccaggcagaactgcagaaacgggacgaaaaaattaaagagctcgaagcagagatacagcaacttagaactcaagctcaggtgctgtcctcatcttccgggatccccggtcctcccgcagcccctcctctccccggagtgggcccacctccacctccgccagcgcctccactccctggaggggctcccctgcccccaccacccccacctctcccaggcatgatggggattcctcccccacctccccctcctctgctcttcgggggacccccaccgccaccgccactggggggtgtaccgccaccacctggcatcagcctgaatctcccttatggaatgaagcaaaaaaagatgtataagcccgaggtgtctatgaaaaggatcaattggagtaaaattgagccaacagagctgagtgaaaattgcttctggctgagagtgaaggaggataaattcgagaacccggacctgttcgctaagttggctttaaacttcgctacccagataaaagtccaaaaaaatgcagaagcccttgaagaaaaaaagactggccctacgaagaaaaaggtgaaggagcttcgcatcctggatcctaagaccgcccagaacctgtcaatctttctcggaagctatcggatgccctacgaagatatccgcaatgtgattttggaagtcaatgaagacatgctctccgaagcgttaattcaaaatcttgtaaagcatctgcctgagcagaaaatactgaatgagctggcagagcttaagaacgagtacgacgacctttgcgagcctgagcaatttggtgttgttatgtctagtgtgaagatgttgcagcctcggttatctagcattcttttcaagcttacatttgaggaacacattaacaacattaagccaagtattattgcagtgacattggcatgcgaggagctgaagaagtcagagtccttcaatagattactggagctggtgctgctggtggggaactacatgaattccggcagcaggaacgctcaatccctgggttttaagataaactttctgtgtaagattcgagataccaaatctgccgatcagaaaacaactctcctgcacttcattgcggatatctgcgaggaaaagtaccgggatatcctgaaattcccagaagaactggaacacgtggaaagcgcttcaaaggtgtccgcccagatccttaaaagtaacctggcaagtatggagcagcagatcgtacacctagaacgcgatattaaaaagtttccccaggcagagaatcagcatgataagtttgtagaaaagatgacaatctttaccaagaccgccagagaacagtacgagaagctctccactatgcacaataatatgatgaaactgtatgaaaatctaggagagtatttcatctttgattcaaagaccgtctcaatcgaggaattctttggagacttaaacaactttcggaccctgtttctggaagccgttcgggaaaataataagcgccgagagatggaggaaaagacaagacgggcaaagctggccaaagaaaaagctgagcaggaaaaacttgaacggcagaagaaaaaaaagcagcttatcgatatcaacaaagaaggggatgagaccggcgtcatggacaacctcctggaggctcttcaatccggagccgcatttcgcgaccggagaaagcgaattcccagaaacccagataatcggagggtccctctcgagcgcagtaggtccaggcacaacggggcaatcagctctaagtag

SEQ ID NO: 220721 - DNA, 3312 bp, Artificial Sequence
  Description of Artificial Sequence: Synthetic coding sequence
atggagcaaccaggtgccgctgccagtggagcaggtggcggatccgaagagcccggtgggggtagatccaacaagagatccgcaggaaatcgggctgccaacgaggaagagacaaaaaataagcccaagttaaatatccagatcaagactctcgccgatgacgtgcgcgacaggatcacctctttccgtaaatccactgtaaagaaggagaaaccgctgatccagcacccaatcgattcccaggtggccatgagcgaattcccagccgcacagccgctctatgacgaacgctcgctgaacctgagcgagaaggaagtccttgatctatttgagaagatgatggaggatatgaacttaaacgaagagaaaaaagccccattgcgtaataaggactttacaaccaagcgagagatggtggtacaatatatttctgccactgctaaatccattgtcggcagcaaagtcacaggtgggcttaagaatagcaagcatgaatgcactttgagcagtcaggagtacgtgcacgagctgagatccggcatctccgacgaaaagttactgaattgcttggaatctctcagagtctccctgacatcaaatcccgttagttgggtcaataactttggccacgaagggctcgggcttctcctggatgagctggagaaactgttggacaagaaacagcaggagaatatcgataagaagaaccagtataagctgattcagtgtctgaaagcttttatgaataacaaattcggcctgcaacgaattttgggcgacgagcgaagcctcctcctgctggcccgagctatcgaccccaaacagcctaatatgatgactgagattgttaaaatcctgagcgcgatctgcatcgtaggtgaagagaacatcttggacaaactactcggagcaataactaccgccgcagagagaaataatcgggagaggttctctccgatagttgaagggctagagaaccaggaggccctccagcttcaagtggcttgcatgcagtttattaatgcgctcgtgacgagtccatacgagctggatttccggatccatctccgtaacgaatttctgaggtctggactcaaaacaatgctgccagacctcaaagagaaggagaacgacgaacttgacatccagcttaaagtctttgacgaaaataaagaggacgatttaaccgagttgtcccaccgtctgaacgatatccgcgcagaaatggacgacatgaacgaggtgtaccacttgctttataacatgctgaaggatactgcagcagagaactattttctgtcaatactgcagcactttttgttaatccggaacgattactatattagaccccagtattataagattattgaggaatgtgtatctcaaattgtcttacactgttctgggatggaccccgactttaaatatagacagcgactcgatatcgatctgactcacctgattgattcttgcgtgaacaaggccaaagttgaagagagcgagcaaaaggccgcagagttttctaaaaaatttgacgaggagttcactgcacggcaggaggcccaggcggaactccagaaaagagacgagaaaataaaggaactggaagccgagatacagcagcttaggactcaagcccaggttctctcctcttcgtctggaatccctggccctccggcagccccaccccttccaggcgtgggcccaccaccgccaccacccgctcccccactgcccggaggggcacccctgcccccacccccacctccgttacccggaatgatgggcattccacccccaccaccacctccgctcctgttcggcggtcctcctccacctccaccactgggtggcgtccctcctcctcccggaatctctctaaatttaccatatggaatgaagcaaaaaaagatgtacaaaccggaggtgtccatgaagcgcattaactggtcaaaaattgaacctaccgagctgagcgaaaactgtttttggctgcgcgtaaaagaagataaatttgagaatcccgatttattcgctaagctcgcattgaattttgcaacacagataaaagtgcagaaaaatgccgaggccctggaggaaaaaaaaaccggaccaacaaagaaaaaggtgaaagagctgaggatattggaccctaaaaccgcacagaatctttcaatcttcttggggtcctaccggatgccctacgaggatatccgaaacgttattctcgaagtcaatgaggatatgctctctgaagcactgattcagaaccttgttaagcacctgccagagcagaagatcttgaatgaactggccgagttgaaaaatgaatacgacgacttatgtgaacctgagcagttcggcgtggtcatgtctagcgtgaaaatgctgcaaccacgcctgagcagcattcttttcaagctaactttcgaagaacacatcaacaatataaaacccagtattattgcggtgaccctggcttgtgaagaactgaagaagtcggagtccttcaaccgactcctggagcttgtgctcctggtgggcaactacatgaacagtggatcacggaatgcccagagccttgggtttaaaataaattttctttgtaagatccgggacactaagtctgcagatcaaaaaactacactgctccatttcatcgctgacatttgtgaggagaagtaccgggacattttgaaattcccagaggaactggaacacgtggaatctgcctctaaagtgagcgcccagattctgaaaagtaatctggcttctatggagcagcaaatcgtgcatctggagagggacattaaaaagtttccccaggcagagaaccagcatgataaatttgtcgagaagatgacgatcttcaccaagacagccagggaacaatatgaaaagctgtctacgatgcacaacaacatgatgaaactgtatgaaaacctgggcgaatatttcatcttcgactctaaaactgtatctattgaggaattttttggagatctcaacaattttcggactttgttcctggaggctgttcgcgaaaataacaaaagaagagagatggaggaaaaaactcgcagggcaaaactggcgaaggaaaaggcagaacaagaaaagctcgaacgacagaagaagaaaaagcaactcatcgatatcaacaaggagggtgatgagactggcgtgatggataatttgttggaagccctgcaaagcggggctgcattccgggatcgaaggaaaagaataccgcgaaatcctgtggtcaaccatccatgcgccacaagggcgaatcctcggagcgcaacctag

SEQ ID NO: 220722 - DNA, 735 bp, Artificial Sequence
  Description of Artificial Sequence: Synthetic coding sequence
atggaattatttctggccggacgtcgggtgctggtaaccggcgcaggcaagggaatcggccgagggacagtgcaggccctccacgccactggagctcgcgtggtggccgttagccggacccaagccgacttggactctctagttcgcgaatgtcctgggatagagcccgtttgcgtggatttaggggattgggaggccaccgaacgcgcattgggctcagtgggccctgtggatctgctggtaaataacgccgctgtggcactactgcagccattccttgaggtaactaaggaggctttcgaccggtccttcgaggtgaacctacgcgctgtcattcaggtgagccagatcgttgcgaggggtctgattgctcggggtgtgcccggagccattgtgaatgtgagctctcagtgctcccagcgggcagtcacaaaccattctgtttattgcagcacaaagggcgcactggacatgttgacgaaggtgatggccttagaactaggtccgcacaaaattcgtgtcaatgctgtcaaccctaccgtggtaatgacatcaatggggcaggcaacctggtccgacccacacaaggctaaaaccatgcttaacagaatcccgttgggaaagtttgcagaggtagagcacgtcgttaatgccatacttttcctgcttagcgacaggtccgggatgaccacgggctccactctgcccgtggaaggaggattctgggcatgctag

SEQ ID NO: 220723 - DNA, 5768 bp, Artificial Sequence
  Description of Artificial Sequence: Synthetic coding sequence
atgaaatcccccgctctgcagccactcagcatggctggcctacagctcatgaccccggcaagctcacccatgggacccttttttggcctcccctggcaacaggaagccatccacgataacatttacacccccagaaagtaccaagtggagctcctggaggcagccttggaccacaatacaatcgtttgcctcaacaccgggagcggaaagacatttatcgccgttctgctcacgaaagaacttagctatcagatccgaggggacttttcacgcaacggaaagaggaccgtgtttctggttaactccgctaaccaggttgcacaacaggtgtcagccgttcgcacacacagtgatctgaaggtgggagagtactcgaacctagaggttaatgcatcctggacaaaggagcgatggaatcaggagtttacaaaacaccaagtactgatcatgacctgttacgttgccttgaatgtgctgaagaatggttaccttagcctgtctgatatcaaccttctagtgttcgacgagtgtcacctcgccatcctggatcatccctatagggagatcatgaaactgtgcgagaattgcccaagttgccccagaatcttgggcctcaccgctagtatactgaacgggaagtgcgatccggaagagctggaggagaaaattcagaagctggaaaaaattttgaagtccaatgccgaaactgccacagaccttgtggtgctcgataggtatacgtctcaaccctgtgaaatcgttgtggattgtggtccatttactgaccgttcaggactttacgagcgtctgcttatggagctcgaggaagccctgaatttcataaacgactgcaacatctcagttcatagcaaggagcgcgactctacactcatttccaagcagattctgtcggactgtcgagcagtcctcgtggtgctagggccatggtgcgcggataaagtcgcaggcatgatggttagagagctccagaaatatattaagcacgagcaggaagaattgcatagaaagtttctgctcttcaccgacacctttttgcgaaaaatccacgccttgtgtgaggagcacttcagcccagctagccttgacctcaagtttgtcacccccaaggtgatcaagctattagaaattctccggaaatacaagccttatgagcgtcagcaatttgaaagtgtcgagtggtataataacagaaaccaggacaactatgtttcatggagtgattccgaggacgatgacgaagatgaggagattgaagagaaagagaaacccgaaacaaatttcccttcgccgttcacgaatatactgtgcggcataatctttgttgaaaggagatatacagcagtcgtcttgaacagactgattaaggaggctggcaagcaggaccccgagctagcatacatcagctccaacttcatcacaggtcacggcatcggcaagaaccagcccagaaacaagcaaatggaagcagaatttcggaaacaggaggaggtgctgcgaaaatttagggctcatgagactaacctcctcattgctactagcattgtcgaggaaggggttgacattcccaagtgcaatctcgtggtcaggttcgatcttccaactgaataccggtcctatgtgcagagcaaaggcagggccagagcccctattagtaactatattatgctcgcagacacggataaaattaagtcatttgaggaagatctgaagacatacaaggctatcgagaagattctgcgaaataaatgttccaagagtgtggatacgggggagacagatatcgatccagtgatggacgacgacgacgtctttcctccctacgtcctgaggcccgacgacggcggacccagggtcacgatcaatactgctatcggacatatcaatcgctactgcgctagactgccttccgacccatttactcacctcgcccctaaatgtcgcacgcgagaactcccagatggcacattctactccacattgtatttacccatcaactctcctctccgggctagtatcgttggcccaccgatgagctgcgttaggcttgctgagagggtcgtggcactgatatgctgtgagaagttgcataagattggtgagcttgacgaccatcttatgcctgtcggaaaagagaccgtcaagtacgaggaagaactcgatttgcacgatgaggaggaaacctcagtcccagggcgacctggtagcaccaaaagaaggcagtgctatccaaaggccattcccgaatgtctgcgcgattcgtatcccaggcccgaccaaccatgctatctgtatgtcatcggaatggtgcttacaacacctttgccagatgagctgaactttcgtaggcgcaaattgtacccacctgaggacacaaccagatgctttggtatcttgactgctaaaccaatcccgcaaataccccactttcctgtttacactagatctggcgaggtgaccatttcaatcgagctcaagaagagtggtttcatgctctcacttcagatgttggagctgataacacgtcttcaccagtacatcttttcgcatatcctgcgactagaaaagccagccctggagttcaagcccacggatgccgactcagcctactgcgttctgccactgaatgtggtgaacgactcctccacactggatattgactttaagttcatggaagacattgaaaagtcagaggcacggatcggaataccatctacaaaatataccaaggaaactccctttgtgttcaaactggaggactaccaggatgccgtcattatccccaggtacaggaatttcgatcagccgcatcgtttctacgtggcagatgtgtatactgatcttacaccactgtcaaaattcccatcacccgagtacgagacgttcgccgaatattataaaactaaatacaatctagatctaaccaatctcaatcagcccctactggacgtggatcatactagctctcggctgaatctgttaacacccaggcacctcaatcaaaaagggaaggccctgcctttgagttcagcagaaaaacgtaaggccaagtgggaatcactgcagaataagcagattttggtcccagagctttgtgccatacacccaattcctgcatctttgtggcggaaagccgtgtgtctccctagcattctctacaggctccactgtctcctcaccgctgaagagctccgggctcagactgcgagcgatgctggtgtgggagtcagaagtctgcccgctgatttcagatatcccaaccttgattttggatggaaaaagtctatcgattccaaaagctttatctctatatcaaactctagttctgcagagaacgacaattactgcaagcattctactatcgtgccagagaatgcagcccaccagggggctaatcggacttcttcgctggagaaccacgatcaaatgagcgtgaactgtcgcacactcttgtctgagtcgccaggcaagctgcatgtggaagtaagcgcagatttgactgctatcaatggcctctcctataaccagaatctggcaaacggaagttatgatctcgccaacagggacttttgtcagggcaatcaactgaactattacaagcaggagatccctgtgcagccgaccactagctattccatccagaacttatattcctatgaaaatcaaccacagccatcggatgagtgcaccttgctctcaaacaagtatctggacggtaatgccaataagtctacttcagacggctcaccagtaatggccgtgatgcctggaaccaccgataccattcaggtgctaaaaggcaggatggattctgagcagtccccctctatcggatatagcagtcggacactcggaccaaatcccggtctcattttgcaggccttaaccctcagtaatgcctcagacggcttcaacctggagagacttgagatgctcggtgactcattcttgaaacacgccatcacgacctacttgttctgcacatatccggatgctcatgaaggcagactgtcttatatgcgctccaaaaaggttagcaactgtaacctgtaccggctggggaaaaagaaggggctcccaagtcgcatggtggtctctatcttcgatcctccggttaactggttacctccaggctacgttgttaatcaagataaatctaacacagacaagtgggaaaaagatgaaatgactaaggactgtatgcttgccaatggtaagctagatgaggattacgaagaagaagatgaggaggaggagtccctgatgtggagagcgcctaaggaagaggccgactatgaggatgacttcctggaatatgatcaagaacacatcagatttatcgataatatgctgatggggtccggggctttcgttaagaaaatctcgctcagtccattttcaaccaccgattccgcatacgaatggaagatgccaaagaaaagctccctcgggtcaatgcctttctcctcagacttcgaggatttcgactactcttcttgggacgccatgtgttacctcgacccctccaaagccgttgaagaggacgattttgtcgtcggtttctggaaccccagtgaggagaattgcggtgttgacaccggcaaacagagcatttcatacgaccttcacactgaacagtgcatcgctgacaagtcaatcgctgattgtgttgaagcactcctggggtgctaccttacttcttgtggtgagagggccgctcagctgttcctctgcagtctgggcttgaaggtcctgcccgtaatcaaacgcactgatcgtgagaaagcactctgccctacgcgcgaaaacttcaattcccagcagaaaaatctgagtgtgagctgtgccgcagcatcagtcgcctctagtaggtcaagcgtgctgaaggatagcgaatacggatgccttaaaattccccctcgctgcatgttcgaccaccctgatgccgacaaaaccctgaaccatctgatttccggattcgaaaactttgaaaagaaaatcaattacaggtttaagaataaagcatacctattgcaggccttcacccacgcctcttaccactataatactataaccgattgctatcaacgccttgagttcctgggcgatgccattttagattatctgataaccaaacacttatacgaagatccccgacaacacagccctggtgtcctgaccgaccttagaagtgccctcgtgaataatacaattttcgcctctttagccgtgaagtacgactatcataaatatttcaaagcagtgagtcctgagctgttccatgtcattgacgattttgtgcagttccagctggaaaaaaacgaaatgcagggaatggactctgaattgcgcaggagtgaagaggacgaggaaaaagaggaggacattgaggtgccaaaggcaatgggagatatcttcgaatccctggctggggctatctacatggactcaggcatgtcactcgaaactgtctggcaggtttactatcctatgatgcgcccactgatagagaagtttagcgctaacgtaccacgctccccggttagggaactcctggaaatggagcccgaaaccgcgaagttcagcccagccgagcggacttatgacggcaaagttagagtaactgtggaagtggtcggcaaaggtaagttcaagggcgtaggaagatcataccggatcgccaaatcagccgctgcgaggcgggcactgaggagtctgaaagctaaccagccgcaggtgcctaatagcta

SEQ ID NO: 220724 - DNA, 5768 bp, Artificial Sequence
  Description of Artificial Sequence: Synthetic coding sequence
atgaagtcccctgctctgcagccactgtccatggcaggcctgcaattgatgacacctgcatcaagcccgatgggcccattcttcggccttccttggcagcaagaggcaatccacgataatatctacaccccacgaaaatatcaggtcgagcttctggaggctgcactggatcataacacgatcgtatgcttgaacaccggtagtggaaaaaccttcattgcagtgctgctcaccaaggaactctcttaccaaattcggggagacttttccaggaatggaaagcgaaccgtgttccttgtcaacagcgctaatcaggtggcccagcaggtgagcgctgtaagaacccacagtgacctgaaagtcggggaatactcaaacctcgaagtaaatgccagttggaccaaagaacgatggaatcaggaattcactaaacatcaagtcctcattatgacgtgttacgttgcactgaatgtactgaagaacggatacctttctctgagcgatatcaacctccttgtgttcgacgaatgtcacctggctatccttgaccacccctatagggaaattatgaagctgtgcgagaactgtccctcttgtcccagaatactgggactgacggcaagtattcttaacggcaaatgtgacccggaagagctcgaagagaaaatacagaaactagagaaaatccttaagtccaacgctgaaacggcgacggacttagtggtgctcgaccgctatacctcacaaccctgtgagatcgtagtggattgcgggccattcactgatcgtagtggactgtatgagcgccttctgatggagttagaggaggctctgaactttattaacgattgtaacatttctgtccactccaaagagagggattcgactctcatttcaaagcagattttgagtgactgccgcgctgtcctcgtggtccttggcccatggtgcgcagataaagtcgccggtatgatggtccgcgaactccagaagtatatcaagcatgagcaggaggagctgcatcgcaagtttctgctgttcactgatactttcctcagaaagatccacgctctgtgcgaagaacatttcagcccagctagcttagacctgaagttcgtgacacccaaagtgataaagctcctggaaatcctaagaaaatataagccctatgagcgccagcagtttgagtctgtggagtggtacaacaaccgtaaccaggataattatgtgtcctggtccgactctgaagatgatgatgaggacgaggaaatcgaagagaaggagaagcctgagaccaacttccctagtccattcaccaacatactctgtggcattattttcgtggaaagacgttacactgccgttgtgttaaacagactgatcaaggaagcaggaaaacaagaccccgagctggcctatatctcctccaactttattacaggacatggcatcggcaaaaatcagccacgcaacaaacaaatggaggccgaattcaggaaacaggaggaagtgctgcggaagtttcgagcccacgaaacaaacctgcttattgctacttccatcgtcgaagaaggtgtggacattcctaagtgcaacttggtggtccgcttcgatctgccgactgaatatagatcctacgtgcagtctaaagggcgtgctagggctcctatttcgaactacatcatgctggcggatactgacaaaattaagagtttcgaggaggacttgaagacctacaaggcaatcgagaaaattctgaggaacaagtgttcaaagagtgttgacactggcgaaacagacatcgaccctgtgatggacgacgacgacgtatttcctccatatgtcctccgccctgacgacggcggaccaagagtgactataaatacggccatcggacatatcaaccggtactgtgcacgtttgcccagtgatccatttacccatctcgcccctaagtgcagaacacgcgagcttcccgacggcacattttactctacactgtatcttccaattaactctcccttacgggcatctattgtgggtcctccaatgtcgtgcgtcagactagccgagcgcgttgtagctttgatttgctgcgaaaagcttcataagatcggggagctggacgaccacctgatgcccgtcggaaaagagacagtgaaatatgaagaagagctggatctgcacgacgaggaggagacttccgttcccggacgtcccggttccactaaacgacggcagtgctatccaaaagccatccctgaatgcctgcgggacagctacccaagaccggaccagccttgttacttatatgtcatcggtatggtcctaaccaccccccttccagatgagctgaacttcagacgaaggaagttgtacccaccagaagacactactcgttgttttggtattctcactgcaaagcccattccccaaataccacatttcccagtgtacactcggtcaggagaggtcaccatctccattgaattgaagaaatccgggtttatgctcagccttcagatgctggaactgattacccgcctccaccagtatattttctcccacatcctcaggctagagaagccggcattggagttcaagccaaccgacgcagattctgcctactgcgtgctgcccctgaacgtcgtgaacgacagctctaccctcgacattgactttaagttcatggaggatattgaaaagagcgaggctagaatcgggatcccatcgactaaatataccaaggaaactcctttcgtgtttaaacttgaagactatcaagacgcagtcataatcccaagatatcggaattttgatcagccccaccgtttttacgtcgccgacgtgtacaccgatcttacgccactttccaaattcccatcacctgagtacgagacatttgccgagtattataaaaccaaatacaatcttgaccttacgaacctaaatcaaccactgctggatgtggaccacacatcctcccggctgaatctactgactccgagacatctgaatcagaaaggtaaggcactgccgctgagcagtgcagagaagagaaaggcaaagtgggagagcctgcaaaataagcagattcttgtccctgagttgtgcgccattcaccctatacccgctagcctctggcggaaggcagtctgcctccctagcattctgtacaggttgcattgcttacttaccgctgaagagttaagagcccaaactgcctctgatgctggcgttggggttagaagtctaccagctgacttcagatatccaaacctggacttcgggtggaagaaaagcattgatagtaaatcattcatctcaatctctaactccagttccgccgaaaacgacaactactgtaagcacagtacgattgttccagaaaatgctgcccatcaaggtgccaatcgcacttcttcacttgagaatcacgatcagatgtccgtcaactgtaggacccttctgagtgagtccccagggaaactgcacgtggaagtctccgctgacttaaccgccatcaatggactgtcttataaccagaacctagcgaatgggtcctacgatctcgccaacagagacttctgccagggtaaccaactcaattactacaagcaggaaatccccgtgcagccgacaacaagctacagcattcaaaacttatattcatatgaaaatcaacctcagccgagcgatgaatgcactttattatccaacaaatatctggatggcaacgctaacaagtctacctcagatgggtcaccggtcatggctgttatgcctgggactacggacacgatacaggtattgaagggaagaatggacagtgaacagtctccaagtatcggttattctagtcgcaccctgggccctaaccccggtctgatcttgcaggccctgacactgagcaatgcctcagacggctttaacctggagcgcttggagatgttgggggacagctttcttaagcatgcgataaccacctatcttttctgtacgtaccccgacgctcatgagggacgtctgagctacatgcgatccaaaaaggtgtctaattgcaatttgtaccggcttggcaaaaagaagggtctcccctccaggatggtggtcagtattttcgatccgcctgtcaattggcttccaccagggtatgtggttaaccaggataagtccaatacagataaatgggaaaaggatgaaatgactaaagactgcatgctggctaacggtaagttagacgaagactacgaagaagaagatgaggaagaggaatctctgatgtggcgcgcaccaaaagaggaggccgactacgaggacgactttctggaatacgaccaggaacatatcagatttattgacaatatgcttatggggtctggagcattcgtgaagaagattagcctgtcccctttttccacaaccgactctgcttatgaatggaagatgcccaagaaaagttctctgggttcaatgccattcagctctgacttcgaggattttgactacagctcgtgggacgcgatgtgttatctcgacccctccaaggcagttgaagaagacgactttgttgtcggtttttggaacccttctgaggaaaattgcggagtggacacaggtaagcaatccatctcgtacgatctgcacaccgaacagtgtatagccgacaaaagtatcgcagattgtgtagaggccttactcggatgctatctgacctcgtgcggcgaacgagccgctcagctattcttgtgctcattggggttgaaggtgctgccggtcatcaagcgaaccgatagagagaaggctttgtgccctacgcgagaaaattttaattcccagcagaagaatttgagtgtctcatgcgctgctgcctctgtagccagctctagatctagtgtgctgaaggatagtgagtacgggtgtctgaaaatacccccaagatgcatgttcgaccatccagacgcagataagactttaaaccatctcatttcaggcttcgagaattttgagaaaaaaattaattatagattcaaaaataaggcctatctgcttcaggctttcacccacgcctcataccactataatactattaccgactgttaccagagactagagttcttgggagatgctatcctggattacctgattactaagcacctgtatgaggatccacgacaacacagccctggagttctcaccgacctgaggagcgctcttgtcaacaatactattttcgcttcacttgccgtgaagtacgactaccacaaatattttaaagctgtctcccccgagttgttccacgttatagatgacttcgtacagttccaactggaaaagaacgagatgcaaggaatggatagcgaactgaggaggagcgaagaggacgaggaaaaggaagaggatattgaggtgcccaaggcaatgggggacatttttgaatcgctggcgggagctatatatatggatagcggaatgtccttggagacagtatggcaggtatattaccctatgatgaggcccctgattgaaaaattcagcgctaacgtgccaagaagccccgttcgcgagctgttagaaatggagcctgaaacggcgaaattcagtccagccgagagaacatatgatggcaaagtgagggttaccgtggaggtcgtcggaaagggcaaatttaagggcgtgggccgatcttaccggatcgccaagtcagcagccgctagacgtgccctgagatcgctgaaggccaaccagccacaggtgccgaactccta

SEQ ID NO: 220725 - DNA, 5768 bp, Artificial Sequence
  Description of Artificial Sequence: Synthetic coding sequence
atgaagtcaccagcactccagcctttgtccatggccggactccagctcatgacaccagcctcaagtccaatggggccattctttggcttgccatggcaacaagaagccatccatgataacatttacactcctcgcaaatatcaggtcgaacttttggaggcagctttggatcataatacaatcgtgtgcctcaacacagggagtggaaaaacctttattgccgtgctcctcaccaaggagctgtcataccagattcgcggtgacttctccagaaacggtaagagaactgtttttctggtaaactctgcgaaccaggtagcacaacaggtttcagctgttcggacgcacagtgacctcaaggtaggcgagtacagcaatcttgaggtgaacgcctcctggaccaaagagagatggaaccaagaattcacaaagcatcaagtgctgatcatgacctgctacgtagctctgaatgtgcttaagaatgggtacctcagcctctccgatatcaatcttctggtatttgacgagtgtcacttagcaattctggatcacccatacagagaaataatgaaactctgtgagaattgccctagctgtccgaggatcctgggactgaccgcaagtatcctgaatggaaaatgcgaccctgaagagcttgaagaaaagatccaaaagctggagaagattctgaagtctaatgccgagactgcaactgatctcgtggttttggatagatatacatcccaaccctgtgaaatagtcgttgattgtggtccgttcaccgatcgctctggtctttatgaaaggctgctaatggagctggaggaggcattaaactttataaatgactgtaacatctctgtgcacagcaaagaacgagatagcacccttatttctaagcagattcttagcgactgccgagctgtactggtggtcctgggcccatggtgcgccgacaaggttgctggcatgatggtgagggaattgcagaagtacattaagcatgagcaagaagaactgcataggaagttcttgctattcacggacactttcctgcggaaaattcatgcactgtgtgaggagcacttcagtcctgcctctctggacttgaaattcgtcacacccaaggtgataaagctcctagagatccttcggaagtacaaaccgtacgagagacaacagttcgagagtgtggagtggtacaataacaggaatcaggacaattatgtgtcctggagcgatagcgaagacgacgacgaggacgaggaaattgaagagaaagagaagcccgaaacaaactttccctcgcctttcacgaatatcctttgcggcattatattcgtggaaagaagatacactgctgtggttcttaaccggctgatcaaagaagccggtaagcaggacccagaactggcttacatttcgagcaactttatcacggggcacggaattgggaagaatcaaccacgcaataagcaaatggaggcagaattcaggaagcaagaggaagtcctcagaaaatttcgcgctcacgaaaccaatctcttaatcgctacctcaatcgttgaggagggagtagatatcccaaagtgcaatttggtggtgcggtttgatctccctaccgagtatcgctcatatgttcagagtaagggaagagctcgtgctccaatatccaactacattatgctagccgacactgacaagataaagagcttcgaggaagacctgaagacatataaagctatagagaagattctgcgaaacaaatgttccaaatctgtcgatactggggagacggacattgaccccgtgatggatgatgatgatgttttccccccttacgtgctgcggccagatgatggcggaccacgcgttaccatcaataccgccatcgggcacatcaaccgctactgcgccagattacctagcgacccatttacccacctcgccccaaagtgccgcacaagggaattgcccgacggcaccttctacagtacactgtatctgcctatcaactccccactaagggcttccatcgttggcccacctatgtcatgcgtgagactggctgaacgtgtggtggccctcatctgttgcgagaagctccataagatcggcgaactggatgatcacctcatgcccgtgggaaaagagacagtgaaatatgaagaggagttggacctacatgatgaggaagagaccagcgtgcctgggagacccggttctacgaagcgccgacagtgttaccccaaagccatcccagaatgcttacgggatagttaccctcgcccagaccagccgtgttatctgtatgtaataggcatggtgctcaccacccctctgcccgatgaactgaacttcagacggaggaagctgtacccaccagaagacacgacgcgctgttttggcatcctcaccgccaagccaattccgcagattccacacttccccgtctataccagaagcggagaggtgacgattagcatagaactgaagaagagcggattcatgcttagcctacagatgttggagttgataacacgcctgcatcagtatatattctcccatatcctcaggctcgaaaagccagctttggagtttaaacccactgacgccgatagcgcttattgcgtgctccctcttaatgtggtcaatgacagctccactcttgacatagacttcaaatttatggaagatattgagaaaagcgaagcccgtatcgggattcctagcacgaagtatactaaagagacaccatttgtgttcaaattagaggattatcaggatgctgtgattatcccccgatacagaaatttcgatcagccgcatcggttctacgtagctgacgtgtacactgacctgacacccttgtccaagtttccatccccggaatacgaaacgtttgctgagtattataagacgaaatataacctagatctcaccaacctcaaccaaccattactcgatgtggatcacacctctagccgcctgaacttgctgaccccaaggcacctgaatcagaagggtaaggcgctcccactgagcagcgccgagaaacggaaggctaagtgggagtccctccagaataagcagattttggtacctgaattgtgcgccatccatcctatcccggcaagcctttggagaaaagcagtctgcctgcctagcattctctaccggctacattgcctactgacagctgaggaactgagggcccagactgcttccgatgcaggcgtgggcgtccggtcgctcccagccgattttagatatcccaacctggactttggttggaaaaaatccatcgacagtaagtcctttatctctatttcaaatagctcgtccgcagagaatgataattactgtaaacacagtaccatcgttcctgagaatgccgctcaccaaggagctaaccgtacaagcagtctcgaaaaccatgaccagatgagcgtgaactgcagaactctactcagcgagagccctggaaaactgcacgtggaagtctctgcggatctcactgccatcaatggactgtcgtacaaccagaacttagcgaatggttcctatgacttagccaatcgagacttttgtcagggaaaccagcttaattactacaaacaggagattccagttcagccgactacatcatattccatccagaatctgtattcctacgaaaaccagccacagccctccgacgaatgtactctgctgagtaacaagtatttggatggcaacgccaataagagtacctccgacggcagcccagtaatggctgtgatgcccggtaccacggatacaattcaggtgctgaagggccgtatggactctgaacaatccccaagcattgggtacagttctcgtacactgggtcccaatccgggactgattctgcaggcactcaccttaagcaacgcctccgatggattcaatcttgagcggcttgagatgcttggggattcgttccttaagcacgccatcacgacctacttgttctgtacttatcctgacgcccatgaaggaagactgtcgtatatgcggagtaagaaagtgtcaaattgtaacctgtacagactgggtaaaaagaaggggctgccgagccggatggtcgtcagcatctttgatccacctgtcaattggctgcccccaggatatgtggtcaaccaggacaaaagcaacaccgacaaatgggaaaaggatgagatgacgaaagactgtatgctggcgaatggcaagctagacgaggattatgaggaagaggacgaggaggaagaatcactgatgtggagagctcccaaggaggaggctgattatgaggacgattttttagagtacgatcaagagcatatccgctttatcgataatatgctcatggggtccggtgcatttgtcaagaagatcagcctcagtcctttctccaccactgattccgcctatgaatggaaaatgccaaaaaaatcctcgctcggctccatgccctttagctccgacttcgaggattttgactattcatcctgggatgccatgtgctatctcgatccttctaaggccgttgaagaagacgattttgttgtagggttttggaacccctctgaggagaactgcggcgttgatacaggtaagcagtccattagttacgatcttcacactgagcagtgtatcgccgacaagtctattgcggattgcgtcgaggcgctgttggggtgttatttgaccagttgtggggaaagagcagctcagctcttcctctgttctctcggtttgaaggttcttccggtaatcaagaggacagaccgcgagaaggcgctgtgtccgacccgcgaaaatttcaattcccagcagaagaatctgtctgtgagttgcgcagccgctagtgtggcatcctcacgatcctctgtgctgaaggactcagagtatgggtgtctgaaaattcctccccgatgtatgtttgaccatcctgacgctgacaagactctgaatcacctcatcagcggttttgaaaactttgagaagaaaatcaactatagattcaaaaataaagcgtacctgttacaagcttttacacacgcgagttaccactacaacacaataactgattgctatcagcgcctggagtttctgggagatgcgatcttagactacttgataactaaacacctctatgaggatcccagacagcattcccccggagtgcttacggatctgaggtctgctctggtgaacaatacaatcttcgcctctctggccgtgaagtatgactaccacaaatatttcaaggccgtgagtcccgaactgttccacgtgatcgatgacttcgtgcagtttcagttagagaagaatgagatgcaggggatggactctgagctgaggagatctgaggaggatgaggagaaggaagaggacattgaggtcccgaaggcaatgggagatatcttcgaaagcctcgctggtgccatctacatggacagtggcatgtctctcgagactgtctggcaggtgtactacccgatgatgcgacccctcattgagaagttctccgctaatgtgcccagatccccagtgagagaactgcttgaaatggagccggaaactgctaagttcagtcctgcagaacggacatacgatggaaaagtccgggtgaccgtcgaagtcgtgggcaaaggcaagtttaagggcgtgggcagatcgtaccgcatcgctaagagcgcggctgctagacgcgctctgcggtcactaaaagccaaccagcctcaggtccctaattcata

SEQ ID NO: 220726 - DNA, 5768 bp, Artificial Sequence
  Description of Artificial Sequence: Synthetic coding sequence
atgaagtcacctgcacttcagccactgagtatggccggactgcagctgatgactcctgcctccagtccgatgggccctttttttggtctaccctggcagcaggaagctattcacgataacatttacacccctaggaaatatcaggttgagcttttggaagccgcacttgaccacaacactattgtctgcttaaatacagggtcaggcaagacgttcattgccgtgctgttgaccaaagagctgtcttaccaaattcgcggagatttttcacggaatggaaaacgcaccgttttcctggtcaatagcgccaaccaagtcgctcagcaggtgtcagctgtacgaactcattccgacttgaaggttggtgagtactctaacctcgaagtgaacgcttcttggaccaaagaacgatggaatcaggagttcactaaacatcaggtgctcattatgacctgttatgttgccttaaatgtcctcaagaacggatacctcagcttgtctgacattaacttactggtattcgacgagtgccacctggccatcctcgaccacccataccgggagattatgaagttgtgcgaaaattgcccatcatgcccgagaatccttggcctaactgctagcatattgaatggcaagtgtgatccagaggagctggaagagaagatccaaaagctcgagaaaatcctcaagtccaacgctgagaccgcaacggatctggtggtgctagataggtacacctctcagccctgcgagatcgtggttgactgcggtcctttcaccgaccggtcaggcctatacgagcgcctgctcatggagctggaggaggcgcttaactttattaatgactgcaacatctctgtccactctaaagagcgcgattccacactcataagtaagcagattctttctgattgtcgtgcggttttggtcgttctcgggccatggtgcgcggacaaggtggctggaatgatggtcagggaactccaaaaatacattaaacatgaacaagaagaactccaccggaagtttctccttttcacagacacatttctgagaaagattcatgccctgtgtgaagaacacttttcccctgcttctctcgatcttaagtttgtgacaccaaaggtcatcaaactgctggagattctccgtaagtacaagccatatgagagacagcagttcgagtcggtggagtggtacaacaatcgaaatcaagataactacgtgagttggtctgatagcgaggatgatgatgaagatgaggaaatcgaggaaaaggaaaaacctgagactaacttcccttcgcctttcactaacatcctctgtgggatcatttttgttgaacgccgttacacggcggtggtgctcaatcgactgattaaggaggctgggaagcaagaccccgagctagcctacatcagttcgaattttataacaggccatggaatagggaagaatcaacccaggaacaaacagatggaagcagaatttaggaaacaggaggaagtcctacgcaagttcagagctcatgaaaccaatcttctaatagccactagcattgttgaagaaggagtcgacattccgaagtgcaatcttgtcgtcaggtttgacctgcctaccgagtataggtcgtacgtgcagagcaaaggacgcgctagagcacctatctccaattatatcatgctggctgacaccgacaaaattaagtcctttgaggaggacctgaaaacctataaggccattgaaaagattttacgcaataagtgttcaaaatccgttgataccggggagactgacatcgatcctgtgatggatgacgacgatgtgttccccccatacgtcctgaggcccgacgacggcggaccccgagtcactataaatacagctatcggccacatcaacaggtattgcgctcggctaccatctgacccctttactcatctcgccccaaagtgcagaaccagggaactcccagacggaacattttatagcacactttatctgcccatcaattcccccctacgggcttctattgtaggccctccaatgagctgcgtacgactggccgaacgcgtggtggccctgatctgctgcgaaaaactccataagatcggtgaacttgacgatcatttaatgccagtgggtaaggagaccgtgaaatatgaagaggaactggatctgcatgacgaggaagagacatctgtgcccggaaggcccggttctacgaagcgacgccagtgttaccctaaggctattcctgaatgcttaagggactcctaccctcggccagatcagccctgttatctgtacgtaataggaatggttctgacaacccccctgcccgatgagctaaacttccggagaaggaagctttacccaccagaagacactacccggtgttttggtattctgaccgccaagcctatccctcagattcctcatttcccggtttacacgcgctctggtgaagtgacaattagtattgagctcaaaaagtcaggtttcatgttaagcctgcaaatgttagagcttattacccgcctgcaccagtacatcttctcccatatcctgagactggaaaagccagctctggagttcaagcctactgatgccgactcagcctactgcgtgttacccctaaacgtggtgaatgatagctctacactcgacatcgattttaagtttatggaagacattgaaaagagtgaggcgcgtattgggattccaagcacaaagtacacgaaggagactccatttgtgtttaaacttgaggattatcaagatgccgtgatcattccgaggtaccgaaattttgaccagccccacagattctacgtcgcagacgtctatactgacctcaccccactttccaaatttccatcccctgaatacgaaaccttcgctgagtattacaagaccaaatataacctggatctaaccaaccttaatcagcctctcctggacgtggaccatacatcctcccggctcaacctcctgaccccaaggcaccttaatcaaaaaggcaaagctcttcccctcagcagcgctgaaaaacgcaaagccaaatgggagtccctgcagaataagcagatcctcgtgcctgagctgtgcgccatccatcctataccggcatcactgtggcgcaaggccgtttgtcttcccagtattctgtacaggcttcattgtctcctcaccgcagaagagttgagagcgcagactgcgagcgatgctggagtcggtgtgagaagcttaccagcggattttcggtaccctaacctcgatttcggttggaagaaaagcattgacagcaagtcctttattagcatttccaactcttcgtccgcagagaatgataattactgcaaacatagcaccatcgttcccgaaaatgcagcgcaccagggggcaaacagaacgtcatcgttggagaaccacgatcagatgtcagttaactgtcggaccttgctcagtgagagtcctggcaagcttcacgtcgaggtttcagccgacctaaccgcaatcaatgggctgtcttataatcaaaatttggcgaatggaagttacgatctcgcgaatcgagatttttgtcaaggtaaccagctcaactactataagcaggagattccagtgcagcctacaactagctattctatccagaacctctacagctacgaaaaccagccgcagccttccgatgagtgtacactgctgagtaacaaatacctggatgggaatgctaataaatcaacatctgacggatcaccggtcatggcagtgatgcccggaacaacagacaccattcaagtgctgaaaggcagaatggactcagagcaaagcccaagcatcggctattcctcacgcacccttggacccaatccaggtttgattttgcaggccctgaccctgagcaacgccagcgacggttttaacctagaaaggctcgaaatgctcggtgactcctttctgaagcacgccatcacaacctacctattctgcacgtaccctgacgctcacgaaggcagattaagttacatgagatctaagaaggtgtccaactgcaatttgtaccgcctggggaagaaaaagggactaccatcaagaatggttgtgagcatcttcgacccaccagttaattggctaccccctggatacgttgtgaatcaggacaagagcaataccgacaaatgggagaaggatgaaatgactaaagactgtatgctggctaatggaaagctagacgaggactatgaagaagaagatgaagaagaagagtcactgatgtggcgagcaccaaaggaagaggcagattacgaggacgattttctagaatatgaccaggaacatattcgcttcattgacaacatgctcatgggaagtggggcatttgttaaaaagattagcctgtcccctttttccaccacagatagcgcttacgaatggaaaatgcctaagaagtcttcactggggtccatgcctttctctagcgatttcgaggacttcgattacagttcgtgggacgccatgtgctacctggacccaagcaaggccgttgaagaagacgacttcgtcgttggcttttggaatccgtcagaagagaattgtggcgttgataccggcaaacaatctatttcctacgatcttcacactgagcagtgtatcgctgataaatcaatcgccgattgtgtggaggccctgctcggttgctacctgactagttgcggcgagcgtgccgctcaacttttcctttgctcactgggcctgaaggttttacccgtgattaagcggaccgatagagagaaggccctgtgtcccacacgtgaaaacttcaactcccagcaaaagaatctgtcagttagttgcgctgccgcaagcgtggcaagcagccgttcttcggtgttgaaagatagtgaatacggttgtctgaagatccctcccaggtgtatgtttgaccatcccgacgcagacaagacactgaatcatttaattagcgggtttgagaattttgagaagaaaattaactatcggttcaaaaataaggcgtatctattacaggccttcacgcatgctagttatcactataacacaattaccgattgctaccagcgactggaattcctgggggatgcgattctcgattacttgataactaagcatctgtatgaggaccctcggcagcattcccccggagttctgaccgatctgcgtagcgcacttgtaaacaacactatttttgcgtctttggctgtaaagtatgattaccacaaatacttcaaggccgtgagccccgagttatttcacgtgatcgacgatttcgtgcaattccagctggaaaagaatgaaatgcagggaatggatagcgagttaagacggtcagaagaggatgaggaaaaggaagaggacattgaggtacctaaagccatgggagacatctttgaatctctagccggtgcaatctatatggactccggtatgtctttggagaccgtgtggcaagtgtactatccaatgatgaggcccctgattgaaaaattttctgccaacgtcccgagatctcccgtacgggaactactcgagatggaacctgagacagccaaattctcccccgctgaacggacctacgacggtaaagttcgagtgactgtagaagtggtcggcaaggggaagttcaaaggggtcggaagaagctaccgcatcgcgaaatcagcagctgcccgtcgtgcactcagatcactgaaggcaaaccaaccccaggtccccaacagtta

SEQ ID NO: 220727 - DNA, 213 bp, Artificial Sequence
  Description of Artificial Sequence: Synthetic coding sequence
atgaaatccccagccctccaacccctaagcatggctgggctgcagttgatgacccctgcttcctccccaatgggtcccttcttcggactgccgtggcagcaggaagccattcacgacaacatctataccccacggaagtaccaggtcgaactcctggaggcagctctagatcacaatacaattgtctgtctcaacaccggttccgggaaatag

SEQ ID NO: 220728 - DNA, 213 bp, Artificial Sequence
  Description of Artificial Sequence: Synthetic coding sequence
atgaaatcccctgccctacaacccctgagcatggcgggactgcagctgatgactcctgcgtcttctccaatgggtcctttttttggtctgccgtggcaacaggaggccattcatgacaatatttacacaccgaggaagtaccaagtggagctcctggaggccgctctggatcacaacacgattgtgtgtcttaataccggatctggtaaatag

SEQ ID NO: 220729 - DNA, 5489 bp, Artificial Sequence
  Description of Artificial Sequence: Synthetic coding sequence
atgaagagcccggctttacagccgttgtccatggccggactgcagctcatgacccctgcctcaagcccaatggggcctttttttggattgccgtggcaacaggaggctatccacgataacatctacaccccccgaaagtaccaggtggaactccttgaagcagccctcgatcacaataccattgtgtgcctgaacacaggcagtggcaagacttttatagcggtgttactaacaaaagagctgagctaccaaattcgtggggatttctcacggaacggaaaacggacagtgttcttagtcaactccgccaatcaagtggctcagcaggtatctgccgtacgcactcatagcgatcttaaagtgggcgagtacagcaatctggaagttaacgcgtcttggacaaaggaacgctggaatcaggagttcactaaacaccaggtcctgatcatgacttgctatgtggccctcaatgtgttgaagaacgggtatctgtctctgtcggacatcaatttgctggtctttgacgagtgtcacctggccattctcgaccatccgtacagagagattatgaaactgtgtgagaattgtcctagttgccccagaatactaggccttacagcttcaatcttgaatggtaagtgcgatcctgaggaattggaggagaaaatacaaaagctggagaagatccttaagagtaatgcggagactgctactgacctggtcgtcctggaccggtacacttcacagccctgcgagatagtggtggactgcggaccctttacggaccgttctgggctgtatgagcggttactcatggagcttgaggaggccctcaacttcatcaacgattgcaatattagtgtgcacagcaaagagcgggactccaccctgatttctaagcagatcctatccgattgcagagcagtgttggttgttctgggcccttggtgcgccgacaaagtcgctggtatgatggtgagagaactgcagaaatatattaaacacgaacaggaagaactccatcgcaaattcttgctgttcacagacacctttctgcgcaagattcatgcgctttgcgaggaacacttcagccctgcctcactagatctgaagtttgtgacccccaaagtgattaaactgttggagatcctgcgaaagtacaagccctacgaacgccagcagttcgagtctgttgagtggtacaataaccggaatcaggacaactacgtctcctggtcagattcagaggacgatgacgaggacgaggagatcgaggagaaagagaaacctgagactaactttcctagcccctttacgaacatactgtgcggcataatcttcgtagaaaggcgatacacagccgtcgttttaaacaggctgatcaaagaggccggaaaacaggatcccgagctagcttatatttcttccaatttcatcacgggtcacggtatcgggaagaaccaaccacggaacaagcaaatggaggccgagttccggaagcaagaggaagtgctacggaagttccgggcacatgagactaacctcttgatcgctacatctatcgtggaggagggcgtggacatcccaaaatgcaaccttgtcgttagatttgatttgccgacggagtaccggtcatacgtccagtctaaaggaagggcaagagcccctatctctaactacatcatgctcgcagacactgataagattaagtcctttgaggaagacttgaagacatacaaagccattgaaaaaatcctgcgcaataagtgctctaagtcagtggacaccggagagaccgacatcgaccccgtaatggatgatgatgacgtgttcccgccttacgtcctgagacccgatgacggaggcccacgggtgaccatcaacacggctatcggccacattaaccgctattgtgcacgactgccatccgatccctttacccatctggccccaaaatgccggactcgagaactgccagacggaacattttactccaccctctatctgcccattaatagtccactccgcgcttcaattgtgggccctcctatgagttgcgtccgccttgcagaaagggtggtcgccctcatctgttgcgagaagctccacaagattggtgagctcgatgaccatctgatgccagtgggcaaagagaccgtgaagtacgaagaagagctcgatcttcacgacgaagaagagacttctgtgcccggaagacccggttctacaaagcgcagacagtgttatcctaaggccatcccggagtgcctgagagactcctacccccgaccggaccagccatgttacctttatgtcattggtatggtgctcacaacccccctgcccgatgagctaaatttccggaggcggaaactttacccacctgaagacactacgcggtgttttggaatcctgaccgcaaagcccatccctcagattccccatttccctgtgtacactcggagcggagaagtgactatatcgatagagctcaagaaatccgggtttatgttgagcttgcagatgctcgagctgatcactagactgcatcagtatatcttctcccatatccttcgcctggagaagccagcactagagttcaagccaactgacgctgatagcgcatattgtgtcctaccgctaaatgtggtgaacgattctagtacactggacatcgacttcaaatttatggaggatatcgagaagagcgaggcccgaataggaatcccaagcacaaaatacacaaaggagacacccttcgtattcaagttagaggattaccaggatgccgtgattattccacgataccgcaacttcgatcagccgcacagattctacgtcgctgatgtttacacggacctgacccccctttcaaagttcccgagccctgagtacgagacgtttgcagagtattataagaccaaatacaatctggacttgaccaatttgaatcagcccttgctggacgttgaccacacgagctctaggttgaaccttctgacaccaaggcacctaaatcagaagggtaaagcattgcctctgtcctctgctgaaaaacgaaaagctaaatgggaatctctccagaacaaacagattctagttccggagctctgtgcgattcacccgatcccggcttctctgtggcggaaagccgtctgcctgcccagtatcctataccgtttgcactgtttacttacagctgaggaactgagggcacagaccgcatctgacgcaggagtgggagtgcgatccctgcccgcagatttcaggtatccaaatctcgacttcggatggaagaagagtatcgacagcaagagctttatcagtatttctaactcatcctccgccgaaaatgacaattactgtaaacactctacaatagttcccgagaacgcagcacatcagggagccaatcgtacctcttcgcttgaaaaccatgatcagatgagcgtcaactgcagaacacttttgtccgagagtcctggtaagttacacgtggaggtctctgccgacttgaccgcaattaatggactgagttacaaccagaacctcgcgaatggctcctatgaccttgccaatagggatttttgtcaggggaaccagctgaactactataaacaggaaatacccgtccagcccactacaagctacagcatccagaacctctactcatacgagaatcaaccccaacctagcgacgaatgtaccctgctctcaaataagtatctggacggcaatgctaataaaagtacctccgatggaagccccgttatggccgtcatgcccggaaccaccgacaccatacaggttctgaagggcagaatggattccgagcagtcacccagtatcgggtattcatccaggacactgggcccaaatcctggcctgatcctgcaggcccttacattgtcaaacgcatctgatggttttaatctggaaaggctcgagatgctcggggactcctttctaaagcacgctatcaccacatacctgttctgcacatacccagacgcccatgaagggaggctgagttatatgaggtcaaagaaagtttccaattgcaatttataccggttgggtaaaaagaaagggctcccctcccgtatggtggtcagtatttttgacccccctgtgaattggctgccccctggttacgtggtgaatcaggataaatcaaatactgacaagtgggagaaggacgagatgactaaggattgcatgcttgctaatgggaagctggacgaagactatgaggaagaggatgaggaagaggaatctctcatgtggagagcacccaaggaggaagccgactatgaagatgacttcttagagtatgaccaggaacatatccgcttcatagataatatgttgatgggaagcggggcttttgtgaagaaaatcagcctgagccctttctccactacagattctgcctacgaatggaaaatgcccaagaagtcttcactgggcagcatgccgttttcctctgactttgaggactttgactattcatcgtgggatgcaatgtgctatctggaccccagcaaagcagtagaggaggacgacttcgtcgtgggcttttggaatcctagcgaagagaactgtggagtggatactggaaagcagtctatctcctacgacctgcatactgaacaatgcattgcggataaatctattgccgattgtgtggaagctctgcttggatgctatcttacctcttgtggagaacgggcagcccagctgttcctctgttcgctagggctcaaggttctccccgtcattaagcgcacagaccgcgaaaaggctctgtgtccaacacgcgagaactttaatagccagcagaaaaatctgtctgtgagctgcgccgctgcctccgtggcgagtagtagatccagtgttttaaaggactcggaatatggctgtttaaagattcctccaaggtgcatgttcgatcatccagacgcggacaagaccctgaatcacttgatcagcgggttcgaaaatttcgaaaaaaaaatcaactataggtttaagaataaggcatatcttttgcaggcatttacccacgcctcttaccactacaacaccattactgattgttaccaaaggctcgaattcttgggggacgcaatcctagactatctgataacaaaacacttatacgaggaccctcgccagcatagtcctggtgtgctgaccgacttgagatccgcgctggtgaataatacgatctttgcctccctcgccgtgaaatatgactatcataaatacttcaaggccgtcagtcctgaactcttccacgtaatcgacgatttcgtacaatttcagctggagaaaaatgagatgcagggcatggactccgaaaaatcgttcctgcagatgtaccccgtgccgctgtgtgagaactgtctgaagtggaatcagaagctgcccaatctggctagattgagagaactgaccaccggaaggtccgaatccttgtggaaata

SEQ ID NO: 220730 - DNA, 2463 bp, Artificial Sequence
  Description of Artificial Sequence: Synthetic coding sequence
atgctcgcttgggaatctgaccactttctgagaatcctcgctgaaaacgataactactgtaaacatagcacgatcgtcccagagaatgcagcccatcagggcgcaaatagaacttcctccctggagaaccacgaccagatgagcgtgaattgccggacactcctcagcgagtctcctgggaaattgcacgtagaagtgagtgccgatcttactgctattaacggcctgtcatacaatcaaaatttagcaaatggctcttatgatctggctaatcgtgacttttgtcagggcaatcagttgaactactataaacaggaaataccagtgcagcctacaacttcatattcaattcagaacctgtacagctatgagaatcagccccagcctagtgacgagtgcacccttctaagcaacaagtaccttgacggaaatgcgaacaagtccacgagtgatggatctcccgttatggctgtgatgccagggaccaccgacacaatccaagttctgaagggtcggatggatagtgaacaaagtccctccataggatactcatcaaggaccctggggccaaatcctggcctgattcttcaagcgcttacactgtctaacgctagcgatgggttcaacctcgaaaggctggaaatgctgggggactcatttctgaagcacgccatcaccacgtatctgttctgtacttatccggatgctcacgagggcaggctgtcttacatgcgctctaaaaaggtctctaactgcaacctgtataggctgggaaaaaaaaagggcttgccctctcgaatggtcgtctccatctttgatcctccagtaaattggctgcccccaggttacgtggtcaatcaggacaagagtaacaccgacaagtgggagaaggatgagatgacgaaagattgcatgttggctaatggaaaactagatgaggactacgaggaggaagacgaagaggaggagtccctcatgtggagagctccaaaggaggaggctgactatgaggatgatttcttggagtacgaccaagaacacatacggtttatcgacaatatgctcatggggagtggcgctttcgttaaaaaaatcagccttagtccgttttccaccactgactcggcttacgagtggaagatgcccaagaaatcctcccttggctcaatgcccttttcgagcgatttcgaggacttcgattatagttcttgggacgccatgtgctatctagatccttccaaggccgtagaagaagacgatttcgtagtggggttttggaatccatcagaggagaattgtggggtggacaccggcaaacagagtattagttatgatcttcacaccgagcaatgtatcgccgacaaatccatcgccgattgtgtcgaggcactgctgggctgctacctgacgagttgtggagagcgtgctgcccagttgttcctatgcagcttaggactcaaagttctccctgtgattaaaaggacagaccgcgaaaaggcgctgtgccccacccgcgaaaatttcaactctcaacagaaaaacctgtcagtgagttgcgctgctgcatcggttgccagcagtagaagtagtgtgctgaaggactccgaatacgggtgcctgaagatccctccccgttgtatgtttgatcacccagatgcagataaaacccttaaccaccttatctcaggcttcgaaaatttcgaaaagaagatcaattatcgctttaagaacaaggcttacctgttacaggcgttcacccacgcttcatatcactacaatacaatcaccgactgctaccagcgactcgagttcctgggcgacgccattcttgactatctgataaccaaacatctgtatgaggatcctagacaacatagcccaggtgtccttacagacctccggtcagcactggtgaataacaccatcttcgccagcctcgctgtgaaatacgactaccacaaatacttcaaggccgtgtcaccagagctgttccatgtcatcgacgacttcgtgcagtttcagctggagaagaatgagatgcaagggatggatagcgagctgaggcgatcagaggaagacgaggagaaggaggaggatattgaagttccaaaggctatgggtgacattttcgagtccctggcaggagctatctacatggacagcggcatgtccctggagacagtgtggcaagtgtactaccctatgatgcgcccactcatcgagaagttctctgccaatgtgcctaggtctcccgtacgagaactgctagagatggaacctgagactgccaaattctcgcctgccgaaaggacttacgacggaaaggtcagggtcacggtggaggtggtgggcaagggtaagttcaagggtgtcggccgttcttatagaattgcaaaatcggccgcagctcgaagggccctccgctcgctcaaggccaatcagccgcaggtgcctaacagctag

SEQ ID NO: 220731 - DNA, 801 bp, Artificial Sequence
  Description of Artificial Sequence: Synthetic coding sequence
atgatggctctcggcgcagccggtgccacacgcgtgttcgtggccatggtggcagcagctctggggggtcacccactgctcggtgtgtccgcaaccctcaactctgtcctgaattctaatgctatcaagaatctgcctccacctctagggggtgccgcaggacacccagggagcgctgtgtcagctgccccaggcattctttaccccggtggtaataagtaccaaaccatcgataactaccagccctacccctgtgctgaggatgaggaatgtggaactgacgaatattgcgctagtccgaccagagggggagatgcaggcgtacagatttgcctggcttgtcggaagaggcgtaagcgctgtatgagacacgctatgtgttgccctggcaactactgcaagaatgggatatgcgtaagcagtgaccagaaccattttagaggggagatcgaggaaaccatcacagaatcctttggaaatgatcacagcaccctcgatggttacagccggagaacaaccctgtcctcaaagatgtatcacactaagggacaggaagggtctgtatgtctgaggagcagcgactgcgcctccggactgtgttgtgcccgacacttttggagcaaaatttgcaagcctgttctgaaagaagggcaggtatgcactaagcatagaagaaaagggagccatggactggaaattttccaacggtgctattgtggagagggtctctcctgtcgcattcaaaaagaccatcatcaagcatctaattcaagcagactccatacttgtcagagacattag

SEQ ID NO: 220732 - DNA, 1689 bp, Artificial Sequence
  Description of Artificial Sequence: Synthetic coding sequence
atggacgctatgaagagagggctgtgctgtgttttacttctatgtggcgcagtctttgtgtccccaagccaggagatccacgctcggttccggaggggggctaggagctatcaggtcatctgccgggatgagaaaactcaaatgatttatcagcagcatcaatcttggcttagacccgtcttgaggagcaatagagtggaatactgttggtgtaacagtggtcgcgctcagtgccattccgttcctgtaaagtcctgtagtgaaccaagatgcttcaacggcggaacttgtcagcaggccctgtacttctcggattttgtgtgccagtgccctgaaggatttgcagggaagtgttgcgaaattgacacaagagccacgtgttatgaggatcaggggatctcctaccggggaacatggtccacggccgagagcggggctgagtgtaccaattggaactcctccgcactagctcagaaaccatactctgggagaagaccagatgccataagactcggcctgggaaaccataattactgtaggaatccagacagggactcaaaaccctggtgctacgtgtttaaggctggcaagtatagctccgagttctgtagtacccctgcatgcagcgagggcaatagcgactgttatttcgggaacggatcagcttatcgcggaactcactccctcacagagtcaggtgcatcttgtttaccttggaactctatgattctgatcggcaaggtttatacagcacagaatcccagtgcgcaggctcttgggctagggaaacacaattactgcaggaaccccgacggcgatgctaaaccttggtgccatgtgttgaagaacaggagattgacctgggaatattgcgacgtaccaagttgctctacctgtggactcagacaatacagccaaccccaatttcgtatcaaaggtggtttgttcgccgacatcgcttcacatccttggcaggccgctattttcgctaaacaccggcgatctcctggcgagcgctttctttgcggaggtattctcataagtagttgctggattctttcagctgctcattgcttccaggaacggtttcctccccatcacttgaccgtaattttgggcagaacataccgggtggtacctggagaggaagaacagaagttcgaggtagagaagtacatagtgcataaagagttcgatgatgacacttatgataatgatattgcattgctccaactgaaatcagatagcagtagatgtgcgcaggagtcttcagtggtgcgcaccgtttgcctgccacccgctgacctccagttacctgattggacggagtgtgagctttcaggatacgggaagcacgaagcgcttagccccttctattcagagcggttgaaagaagcacatgtccgtctttacccaagctctcgatgtacgtcacaacacctcttgaaccgaacagttacagacaacatgctgtgcgcaggagatacccggtccgggggtcctcaggccaacttacatgatgcctgtcagggcgacagcgggggacccctggtgtgtctcaacgacggcaggatgacccttgtcggtattatttcatggggcctgggatgcgggcagaaggatgtgcccggtgtgtacaccaaggtgactaactacctggactggatccgtgacaacatgcggccatag

SEQ ID NO: 220733 - DNA, 420 bp, Artificial Sequence
  Description of Artificial Sequence: Synthetic coding sequence
atggtcgcagctgtcctcctgggtctctcctggttgtgttcacctctgggcgcattggtccttgatttcaataacattaggagctcagcagacctgcatggcgctcgcaagggcagccaatgcttgtctgacactgactgcaatacgagaaaattctgcctccaacctcgagatgaaaaacccttttgtgctacctgtagaggactccgcagacgttgtcagagggacgccatgtgttgtcccggaacgctctgcgtgaatgatgtgtgtaccacaatggaggacgccacccctattttagaacggcagctggatgagcaagatggaactcacgcggaaggaaccaccggccatcccgttcaggaaaatcaaccaaagagaaagccatcaattaaaaagagtagttctatgttggattag

SEQ ID NO: 220734 - DNA, 1683 bp, Artificial Sequence
  Description of Artificial Sequence: Synthetic coding sequence
atgcgggacctccctctgacatccttagcccttgtcttatcagctcttggggcactattgggaaccgaggctctgcgggcagaagagccagcggtcggtactagcggtcttattttccgggaagacctcgactggccgccaggcagtcctcaggaaccactgtgcctggtcgctctcggcggtgatagcaacggaagtagttcaccattgcgggtggtgggtgcactctccgcttacgaacaggcttttctgggggctgtgcagagggccaggtggggaccgagggatttagccacttttggggtctgtaacactggtgaccgccaggctgctctgccttcgttgcggaggctgggcgcttggctgagggacccaggcggacaaagactcgtcgtactgcacttggaggaggtgacgtgggagcccacaccgagcttgcggtttcaggagcctcctcccggtggcgcaggacctcccgaacttgcactccttgtgctttacccgggtcccggaccagaggtcacggtcacaagagctggcctgccaggggcacagtcgctctgcccttcccgtgacaccagatacctcgtgctggccgtggaccgtcccgcaggggcttggcgtgggtcaggcctagcgctgactctgcagccgaggggggaagattcccgactctcaactgcaagactgcaggccttgctctttggcgatgaccacagatgctttaccagaatgacaccagccctgttacttctgcccagaagcgaacctgcacccctgccagcccacggtcaactggatactgtaccttttcctcccccacgcccatccgccgagctcgaagagtctcctccatctgccgatccatttctggagactttgacgagacttgttagggccttgcgggtgccgcctgctagggcttccgcccctcggctcgccctcgatccagatgccctggccggttttcctcagggtctcgtaaacttatctgatccagcggcactcgagagattgcttgatggggaagaaccattgctgctcttactgaggccaactgccgctaccactggcgatcctgcaccactgcacgacccaacaagcgcgccttgggctactgctctggcaaggagggtagccgcagaattacaagccgcagccgcagaactgaggtctctgccgggtttacctccagctaccgctccgctgctggccaggctgttagcattgtgtcctggcggacccggaggtttgggggacccgctcagagctctgctgctgcttaaggccctgcagggtctccgggttgaatggaggggtagggaccctagaggccctggcagggcccagcgctccgccggagcaacagctgcagacggcccatgcgctctccgcgaactgtcagtggacttacgggcagagcgatctgttctaatccccgagacatatcaggccaacaattgccagggagtctgcggatggcctcaatccgacaggaatccacgttatgggaaccacgtggtgctgttgctcaaaatgcaggtgcggggagccgcactggcaagacctccctgctgcgttcccaccgcttacgcaggcaaactacttatctcactcagcgaggagagaattagtgctcaccatgtcccaaacatggtggcgacagagtgtggttgcaggtag

SEQ ID NO: 220735 - DNA, 600 bp, Artificial Sequence
  Description of Artificial Sequence: Synthetic coding sequence
atgggcgaggcatctccgccagccccagctcgacggcacttgctggtcctgctgctgctgctcagcacactcgtcataccttctgccgcagccccaattcatgatgcagacgcccaggagagcagcttgggcttgacaggactacagtcccttttgcaagggtttagcagattattcttaaaagggaaccttctccgcggaatagactccttattctcagcaccaatggacttccggggattgccgggaaactatcataaagaggagaatcaggagcaccagttgggcaataataccctgtcttctcacctgcagatagataaagtaccacgcatggaggagaaggaggccctagtcccgatacaaaaagccactgattcgtttcacacagagcttcatcccagggtcgccttctggatcataaaacttcctagacgcagaagccatcaggacgccctcgaaggaggccattggcttagcgagaaacgccaccggctccaggcaatccgtgatggtttgcggaaaggtacacacaaggatgtcctggaagagggaactgagtcatcaagccattctcgactgagtcccaggaagacatag

SEQ ID NO: 220736 - DNA, 1896 bp, Artificial Sequence
  Description of Artificial Sequence: Synthetic coding sequence
atggctctgcggaaggaattgcttaaaagtatttggtatgcctttactgcattggacgtcgagaagtccggcaaggtcagcaaatctcagctgaaggtcctgtctcataacctgtacacagtgcttcatattccccatgacccagtggctctagaggagcacttccgggacgatgacgatggtcctgtgtctagtcaggggtacatgccttatctaaacaaatacatattggataaagtggaagagggagcatttgtgaaggaacatttcgatgaactttgctggacgctgactgcaaaaaagaactacagggcggatagtaatggcaacagcatgctgagcaaccaagacgcctttcgtctttggtgcctgttcaacttcttaagcgaggataaatatcccctgatcatggtcccggatgaagtggaatacttgctcaagaaagtgttaagctcaatgagcctcgaggtctctctgggagagctggaggaacttttagcacaggaggctcaagttgcccagactactggtggactttccgtatggcagttccttgagctgtttaatagcggacggtgtctgaggggcgtcggccgagatactctgagcatggctatacatgaagtgtatcaggagctgatccaggacgttctgaagcagggttacctgtggaagagagggcacctgcgccgtaactgggctgaaagatggttccagctccaaccatcttgtctgtgttatttcggatcagaggagtgcaaggaaaaaaggggaatcattcccctcgatgcccactgctgcgtggaagtgttgccagacagggacggcaagcgctgtatgttctgtgttaaaaccgctaaccggacatatgagatgtccgcatccgatactcggcagagacaggagtggactgccgctattcagatggcgattaggctgcaagcagaaggtaaaactagcctccacaaagatttaaaacagaagcgccgtgaacagagggaacagcgcgaaaggcggagggctgcaaaagaggaagagttacttcgactgcagcaattacaggaggaaaaagaacgaaaacttcaggagctggagttactgcaagaagcacagcggcaagccgagagattgctccaagaagaggaggagaggagacgctctcagcaccgggagttacagcaggctctggaaggacagttacgagaggcagaacaggctcgagcatccatgcaagccgagatggagctgaaggaagaggaggctgccagacagagacagaggatcaaggagctggaggaaatgcagcagaggctccaagaagctctccagctagaagtcaaagccagaagggacgaagagagcgtgcggattgcccaaacccggctgcttgaggaggaggaggagaagcttaagcaattaatgcagttgaaggaagaacaggagcgctatatcgagcgtgcgcagcaggaaaaagaagagttacagcaggagatggcacagcaatcccggagcttgcagcaggctcagcagcaactcgaagaggtaagacaaaaccgtcagagagctgacgaagacgtggaggcagcacaacgaaagcttcgccaagcatcaactaacgtgaagcactggaacgtgcagatgaaccgattgatgcatccaattgagccaggggataagcggccagtcacatctagctcttttagcggcttccagccgcctctccttgcacatagagatagcagcctaaaaaggctaacgaggtgggggtcccaaggtaacagaacaccatcaccgaattctaatgaacagcagaagagcctgaatggcggtgatgaagcccctgcacctgcctcgaccccacaggaagataagctggatccggctcctgagaactag

SEQ ID NO: 220737 - DNA, 555 bp, Artificial Sequence
  Description of Artificial Sequence: Synthetic coding sequence
atggcacttcgtaaggagcttctaaaatctatctggtacgctttcacggcgctcgatgtagaaaagtccggaaaggtgtctaaatcacaactgaaggtgctttcccacaacctgtataccgtgctacacatcccccacgaccccgtggcactcgaggagcattttagagatgatgacgatgggccagttagttctcaggggtacatgccataccttaacaaatacatcttggataaggatgcttttcgcctttggtgtctttttaattttttgagcgaagacaagtatccactgattatggttcctgacgaagtggaatacttgctgaagaaggtgctcagctctatgagccttgaagtgagcctcggcgaactggaagaactgctggcccaggaggcccaggtagcacagacgactggtggcctgtccgtgtggcagttcttggagttgttcaatagcggtaggtgtctccgcggagtgggcagggacaccctgtcgatggctatacatgaagtttaccaggaactgatccaagatgtgctgaaacaaggttag

SEQ ID NO: 220738 - DNA, 393 bp, Artificial Sequence
  Description of Artificial Sequence: Synthetic coding sequence
tagagagacgatgatgatggacctgtatctagtcagggctatatgccttatctcaacaagtatatactcgacaaggatgcctttcggctctggtgtctgtttaacttcttgtcggaggataagtacccgctgatcatggtccccgacgaggttgagtatttactgaagaaagtcctgtcctctatgagcctggaggtgtctctgggcgaactggaagaactgctcgcgcaggaggctcaagtggcacagactaccggtggactcagtgtttggcagtttttggagctctttaattcgggacggtgtcttcggggtgtcggaagggatactctcagtatggctatacatgaagtgtaccaggaattgatacaggacgtgttgaagcagggctag

SEQ ID NO: 220739 - DNA, 1131 bp, Artificial Sequence
  Description of Artificial Sequence: Synthetic coding sequence
atgatctgtccgcctagaccacccaaagtgctaggcctgcaagtgctgccggatagagatggcaagagatgtatgttttgcgtgaagactgccaacaggacctacgagatgagcgcttcagacacaaggcagagacaagagtggacagcggcaatccagatggcgatccgcctgcaagccgaaggcaaaacctccctacacaaggatcttaagcagaagagaagggaacagagggagcagagagaacgcaggagagcagcaaaggaagaagaactgctcagacttcaacaacttcaggaggagaaggaacggaaattgcaggagctggagctgcttcaggaggcccagcgccaagcagagaggcttctgcaagaggaggaagaacgcaggcgaagtcagcatagggagctgcagcaggctctcgaaggccaactgcgggaagccgaacaggctagagcatcaatgcaggccgaaatggaactcaaggaagaggaagccgcacgccagcgccagcggataaaggaactagaagagatgcaacaaaggcttcaagaagcactgcagctggaagtgaaagcacggagagacgaggaatccgtgaggatcgcacagacacggctgctggaggaagaggaagagaaattaaagcagctgatgcaacttaaggaggagcaggaaaggtacattgagagagctcagcaggaaaaggaggagctgcaacaggagatggcccagcagtcaaggtctctgcagcaagcgcagcagcagctggaggaagttaggcagaatagacagagagccgatgaagacgtggaagccgctcaacggaagctgcggcaagcgtctaccaatgtcaagcattggaacgtccagatgaaccgtttaatgcacccaatcgagcccggagataagcgccctgttacttcctcgagcttttccggctttcagccacccctattggctcatagggactcgtccctcaagagactaacccgatggggatctcagggcaaccggacaccgtcacccaactctaatgaacagcagaaatctttgaatggcggagacgaagctcccgcaccggcttcaacgccgcaggaagataaactggatcccgcaccagagaattag

SEQ ID NO: 220740 - DNA, 708 bp, Artificial Sequence
  Description of Artificial Sequence: Synthetic coding sequence
atgactcaagtgaccgaaaaaagcactgagcatcccgaaaaaacgactagtacaacggagaagactacaagaacaccagaaaaacccaccctctattccgagaagacaatttgtacaaagggtaagaatacacctgttccagaaaaacccaccgagaacctaggcaataccacattgaccaccgaaactattaaggcacccgtcaagtctacagaaaaccctgagaagacggccgctgtaaccaaaacaattaaacctagtgtgaaggtcacaggtgacaagtcgctgaccaccacttcgagccatctgaataaaactgaggtaactcaccaggtgccaaccgggagtttcactttgattacgagcagaactaagctgtcatcgattaccagcgaggccaccggaaatgagagtcacccatacctgaacaaggatggctcccagaaaggtatccatgcaggccagatgggggagaatgactccttccccgcttgggccattgtaatagtagttctggtcgctgttatcctgctcttggtgttcttaggcctcatctttctcgtctcttatatgatgagaacccgcagaacactcacccagaacacccaatataatgatgctgaggacgaaggcggacccaatagctaccccgtttacctgatggagcagcagaacctggggatgggccagatcccttcccccagatag

SEQ ID NO: 220741 - DNA, 1524 bp, Artificial Sequence
  Description of Artificial Sequence: Synthetic coding sequence
ccactcgcgaatgagaaaacaaccctctctcctgccgaaccaacagagaacggtgagcgcacacccttcactaatgaaaagaccaccccgtccagcgcagaaccaacagaacatggagagagaacccccctcgcaaacgagatcactacaccatctcgtgccgagccaaccgagcatggcgagaggattgctaatgagaaggccaccccatctccagctaagcctactgagcatggtgaaacaacagttaatgaggacaccacacccagcagcgctgaacctaccgagaacggggaaagaaccccacttgccaatgagaacacaaccacttcacctaccgaaagtacagaacatggcgagcggaccgctaatgagaaaactacacccagccctgcggaacctacagagcatggagagcgcaccccctcagcaaacgagaagacaatcccatcacccgctaaacctacagagcacgaagagatgaccccctcggctaacgaaaacaccaccccaagccccgtcaaacctacagagcacggcgaaaagacaaccctcgcaaatgaaaaaattaccttatcccctgaaggacccaccgaacacggagcaaaaacgacctcagccaacgaaaagatcacaccatccctggccaagcctaccgaacatggagagcgcacaacatcccccaacgacaaaattacatcctccgcagctgagagtactgagcaccgggacagagccacaagtgcaaacgtgatcactcccgcacccgcagagccaatcaaacacgccaagagaacgacactggcccatgaaaaaatgacgcaggtgaccgaaaagtcaaccgagcatcctgagaagaccacttctaccacggaaaagaccacacggactcccgagaagcctactctgtacagcgaaaagactatttgtacgaaaggcaaaaataccccagtgccagagaagcctacggagaacctcggcaatactactctgactactgagacaattaaagcacctgtcaagtccaccgagaaccccgaaaagacagctgctgtcaccaaaacaatcaagcctagcgtgaaagttactggggataagtccttgacaactaccagctcacacctgaacaaaactgaggtgactcaccaggtgcctacaggaagttttaccctcatcaccagccgaacaaagctgtccagcatcacctcggaggccacaggtaacgaaagtcacccctacttgaataaggatggatctcaaaaaggaatccacgcaggacagatgggagagaacgactcattccccgcttgggccatcgtgatagtcgttcttgtggctgttatcctgttactggtctttttgggactgatctttctggtgtcttacatgatgcgcacccgcagaactttgacccagaatactcaatataatgatgccgaagatgaaggcggtcccaattcctacccagtctacctgatggaacagcaaaatcttgggatgggccagattccatcccctcgatag

SEQ ID NO: 220742 - DNA, 1524 bp, Artificial Sequence
  Description of Artificial Sequence: Synthetic coding sequence
cctctcgctaacgaaaagacaacactcagtcctgctgaacccaccgagaacggggagaggacaccttttacaaacgaaaaaacaacgccaagctcagcagagccaactgagcacggcgaaagaacaccactggcaaacgaaattaccactccaagccgggctgagcccacagaacacggtgaaaggatcgcgaacgagaaggctactccctcacctgccaagcccactgagcacggagagacaacggtaaacgaagatacaaccccatcctctgctgaaccaaccgagaatggtgaaaggacccccttggcgaacgagaataccacaacttcgcctactgaatctacggaacacggcgagcggacggctaatgagaaaaccaccccatctcccgctgagccaacagaacatggcgagcggacacccagcgctaacgaaaagaccatcccctccccggctaagcccaccgaacacgaagagatgacacccagtgccaatgagaataccacaccatcacctgtgaagcctactgaacacggcgagaaaacaacattagcaaacgagaagatcactttgagccccgagggacctacagaacatggagctaagacaacaagtgccaacgaaaagataaccccgagtttagctaagcccaccgagcacggagagaggactacatccccaaatgataagatcacctctagcgctgccgagagcactgagcacagagaccgagccacgagtgctaacgtgatcactcctgcccctgccgaaccaataaagcacgccaagcggaccactttggcccacgaaaaaatgacgcaagtaacagagaaaagtactgaacaccctgagaagactacctcaacaacagagaaaacaacccggactcccgaaaaacccacgctgtactctgagaaaacgatctgcactaaagggaaaaatactccagtacctgaaaaaccgacggagaatctggggaatacaacactaacgaccgagacaatcaaggccccagtcaagagtacagaaaatcccgagaaaaccgcagctgtcacaaaaaccatcaaaccctctgtcaaggtgactggagataaaagtctaacaaccacttcgtcccatctcaacaaaactgaggtgacccatcaggtcccaaccggctccttcactctcattacatctcgaaccaagctgtcctcaatcacttccgaggctaccgggaacaagagtcacccctatctcaacaaggatggctctcagaaaggtatccacgcaggccaaatgggcgagaatgattcgtttcccgcatgggccatcgtgattgttgtgctagtggcagtcattctgctactggtgttcctaggcctcatttttctggtgtcctacatgatgcgcactcgacgtactctgacgcagaacacccagtacaacgatgcagaagacgagggaggacccaactcttaccctgtgtacctgatggagcagcagaacttaggtatgggacagatcccgagccctaggtag

SEQ ID NO: 220743 - DNA, 1524 bp, Artificial Sequence
  Description of Artificial Sequence: Synthetic coding sequence
ccccttgccaacgagaaaacaacactgagccctgcagagcctaccgagaacggggaacggaccccttttacgaatgagaaaaccacaccgtcctccgccgaacccactgaacatggcgagcgaaccccgctggccaatgagattacaacaccatctcgggctgaaccaacagagcacggagaacgcatcgcaaatgagaaggctactccatctcctgcaaagcctaccgaacacggtgaaacaaccgtcaacgaagacacaactcctagttctgctgagccaacagagaacggcgaacgaactccattggccaatgagaacaccactacctcaccaaccgagtctaccgaacacggagagagaaccgctaatgagaagacaaccccatcacctgccgaacccaccgaacacggtgaacgaacccctagtgctaatgagaaaactatcccttcccctgcaaaacctactgagcacgaggagatgactccttcagccaacgagaacaccaccccctctcccgtaaaacccaccgaacacggcgagaaaacaaccctggcaaacgagaagattacgctgtctcccgaaggcccaaccgagcacggtgctaagaccaccagtgctaatgagaagattactccgtccctggccaagcctacagagcacggagagcgaacaacttcgcccaatgacaagatcacatctagtgccgctgaaagcactgaacatagagatcgagccacatccgccaatgttattacacctgcccctgctgaacccatcaagcatgcaaaaaggaccacactggctcatgagaagatgacacaggtgaccgagaaatcaactgaacaccccgagaagaccacaagcacaactgaaaagaccaccagaacacccgaaaagccaactctgtacagcgagaagactatctgtaccaagggcaagaacactccagtgcccgagaagcccactgagaatctgggtaacacaacgctgaccaccgagacgattaaggctcccgtgaagagtacagagaatccagagaagacagcagcggtcacaaaaacaattaagccatctgtgaaggtcactggagacaaatccttgacgacaacttcttcgcaccttaataagactgaggtcacgcaccaggtccctacaggctcattcaccctgataacctcgaggaccaagctgtctagcatcaccagtgaagctaccggcaacgaaagccacccctacctcaacaaagacggttctcagaagggcatccatgccggtcagatgggcgagaacgattccttccctgcttgggcaattgtgattgtcgtgctggtggccgtcatactcctgctcgtgtttcttgggcttatattcctcgtcagttacatgatgcgaacccgaaggacgctgacacaaaacactcagtacaacgatgctgaagacgagggtgggccaaactcttaccctgtgtacttgatggagcagcagaatcttgggatgggacaaattccgtctccacggtag

SEQ ID NO: 220744 - DNA, 1554 bp, Artificial Sequence
  Description of Artificial Sequence: Synthetic coding sequence
atggctcagccagttcatagcctctgtagtgcctttggacttcagtgttgcctacttttcttgctagcaagctggggagccggagccactacattccaggagtaccagaaaactggggagctgagcaccagtgatcacatcttcccactcacacccggtctggtatacagtatcccctttgaccatatcgtgttgcactctggccagcgccctcccgagctcccgaagtcgaccgagattcatgagcagaaacgacattgtaacacgactaggcactccaagccgacagacaagcccaccggaaactcaaaaaccatcgaccacaagtccagcactgacaatcacgaggcaccacctacgagtgaggagaatagctccaatcaaggtaaagatccaatgatcaggaatcagaggagcgtagacccagccgatagcacaacaactcataaggaaagcgccggaaagaagcacataaccccagctccaaagtctaaaattaactgccgaaagagtacaaccgggaagagtactgtcaccaggaaaagcgataagaccggtcgacccctggagaagagcatgagcactctggacaaaacatcaaccagcagtcacaaaacaacgacctctttccacaattccggaaattctcagactaagcagaagtccacctcctttccagagaagatcacagcggcatcaaagaccacttataaaactacagggacacctgaagagagtgaaaagaccgaggattcaaggacaaccgtggccagcgataagttgttaacaaagaccaccaagaatattcaggaaaccatctctgcgaacgagttgacccagtccttagcggaacctaccgagcatggcggtcgcaccgctaacgagaacaacacacccagcccagcagagcccaccgaaaaccgcgaacggacggccaacgaaaacaaaaaaactatctgcaccaagggaaaaaacacgccagttcctgagaagcctacagaaaatttgggcaataccacccttacaacagagaccatcaaggctccagtaaaaagcaccgagaatccagagaagaccgccgcagtgacgaagacaatcaagcccagcgtgaaggtgacgggggacaaatctctgaccactacttcttcccatctaaacaagactgaggtcacgcatcaagtgccgactgggtcatttactttaattacatccaggacgaagctctcttccatcacgtcagaggccacaggcaatgaaagtcacccctacctgaacaaggatgggtctcagaaaggaatacacgctggacaaatgggagagaacgactcattccccgcatgggctattgttattgttgttctcgtcgccgtgatcttactactggtgtttcttggccttatattcctggtatcatacatgatgcgcacgcgaagaacactgactcagaacacccagtacaacgatgcagaagatgaggggggaccaaactcctatcctgtttatctcatggagcaacagaatctggggatgggccagattccgtcacccagatag

SEQ ID NO: 220745 - DNA, 1554 bp, Artificial Sequence
  Description of Artificial Sequence: Synthetic coding sequence
atggcccagcctgtgcattccctgtgttcggcatttggtctgcaatgctgcctgctgttcctcttggcctcctggggggcaggggcaacaacctttcaggaataccagaagactggcgagctgagcacctccgatcacatttttccgcttacccctgggctcgtttactccatcccctttgatcatatagtcctgcatagtggccagagaccacctgaactgccaaagtctacagaaattcatgagcagaagcggcactgcaataccactcgccactccaagcctactgataaacccacaggtaactctaagactattgatcacaagtccagcacagataatcacgaagctcccccaactagcgaggagaactccagcaaccagggcaaggatcccatgattaggaatcaacggagtgtggatccagcggattccacaacaacccacaaagagtccgcaggaaagaaacatattacaccagctcccaaatctaagatcaactgccgaaagagcacaaccggaaagtctaccgtgacaaggaagtccgataaaacaggcaggcctctggaaaagagtatgtccactttggataaaacctccacctcaagccacaagactacaactagtttccacaattccggtaactcgcagaccaagcagaagtcaacctcctttcccgagaagataacagcagcttcaaaaaccacgtacaaaacaaccgggacgcctgaggagagcgaaaagaccgaggactctcgtacaactgtggcatctgataagttgttgaccaagaccaccaagaacatccaggagacgatcagtgcgaacgagctgacccagagcctcgcagaaccaactgagcacgggggtagaactgccaacgagaacaatacaccctccccggcagaaccgaccgaaaaccgcgagagaactgctaacgaaaacaagaaaactatctgcacaaagggcaagaacacccccgttccggaaaagcctaccgagaacttgggtaacaccacacttaccaccgaaaccattaaggcgccagtaaaaagtacagagaacccagagaagactgccgcagtaactaagactataaagccctctgttaaggttacaggagataaatctctcaccactacctcatctcacctgaacaaaacggaagtgacccaccaagtcccgaccggatccttcacccttatcacatctcgaacaaagttgtctagcattactagtgaggccactgggaatgaatcacatccttacttaaataaggacggctcccagaagggaatccacgcaggtcagatgggggaaaacgattcctttcccgcttgggccattgtgatagtggttttggttgctgtcatacttcttcttgtgttcctgggacttatattcctcgtgtcttacatgatgcggacaagacggacgctgacgcagaacacgcagtataacgatgctgaggacgagggaggccctaatagttaccctgtgtatctaatggaacaacaaaacctgggaatggggcagatacccagtcctcggtag

SEQ ID NO: 220746 - DNA, 1554 bp, Artificial Sequence
  Description of Artificial Sequence: Synthetic coding sequence
atggcacaacccgtgcactctctgtgctctgcttttggcctgcaatgctgcttactgtttctgcttgcttcatggggtgctggggcaacaacattccaagaatatcagaagactggggagctgtccaccagcgaccacattttcccgctgactcccggtttggtctacagtatcccttttgatcacatcgtgttgcacagtgggcaaagacccccagagctgccgaaatccacagagatacacgagcaaaagcgacattgcaacactactcgtcattcaaagccaacggataaaccgactgggaactcaaaaaccattgatcataagtcatctacggacaatcacgaagcaccgcctacgagcgaagagaacagctcaaatcagggaaaagaccccatgatccgtaaccaacggagtgtggacccggctgatagtaccactacgcacaaagagagtgccggaaaaaagcatattacacctgctcccaagagcaaaattaattgccgcaagtctacgacaggtaagtctaccgtcacaaggaagtctgacaagaccggcagacctctcgaaaagtccatgtctaccctggacaagacgtcgacttcttctcacaaaactacaacaagcttccacaacagtggaaattcacagactaaacagaaaagcacatcttttcccgaaaaaattacagcagcgagcaaaacaacttataagaccactggcacacctgaggaaagcgaaaaaaccgaagatagtagaaccactgtcgcgtccgataagctgctcaccaaaacaactaaaaatattcaggagacgatcagcgccaatgagctgacgcaatctctggccgagccaaccgaacacggcggtcgtacagccaacgagaataacaccccatcaccagccgaaccaaccgaaaatcgcgagaggacggctaacgagaacaagaagactatctgtacaaaagggaaaaataccccagttcctgagaagccaacagaaaacttaggcaatacgacactgaccaccgaaacgattaaagcccctgtgaagagtaccgagaatcccgaaaagacagcagcggtgactaaaaccatcaaaccatctgtcaaggtgacaggagataaatctctgacgactacaagcagccacttgaacaagacagaagtgacccaccaggtgcctacgggctcttttaccctcattacctcccgcacgaaattatctagtattactagtgaggctacaggcaatgaatctcatccctacctgaacaaagatgggagtcagaaaggaatccacgctggacagatgggcgagaacgatagtttcccagcgtgggctattgtgatcgttgtgctcgtggcagtcattctgctcctggtgtttctgggacttattttcctagtgtcttatatgatgcggacccgacgcactctgacacagaacacccagtataacgacgcggaagacgaaggcggtccaaacagctatcctgtatacctgatggaacagcaaaatctgggcatgggccagataccttcacctcgctag

SEQ ID NO: 220747 - DNA, 4182 bp, Artificial Sequence
  Description of Artificial Sequence: Synthetic coding sequence
atggcacagccagtgcattcactctgctccgcatttgggcttcagtgttgtcttctgtttttgctcgccagttggggcgctggtgccacaactttccaggaataccagaagaccggcgaactgtccacctccgatcacattttccccctaactcctggactggtttactccatcccttttgatcatatcgttctgcatagcggccaacgacctccagagctgcctaagagtacagagatccacgagcagaaacggcattgtaacactacccgccactccaagccaactgataagccgaccggaaatagtaaaaccatcgatcataaaagcagcactgataatcacgaggctccccctaccagcgaagagaactcaagtaaccagggtaaggatcccatgattcgcaaccagcgatccgtggaccctgcagactcaactaccactcacaaagagagcgcagggaaaaagcacatcaccccagccccaaagagcaagatcaactgcaggaagtctaccacaggcaaatccaccgttacgaggaagagtgacaagacaggccgacctctggagaaatcaatgagtactcttgacaagacatccacttccagccacaagaccaccacgtcctttcataactctgggaactcacagaccaaacagaaaagtaccagttttccagaaaagattaccgcagcaagcaaaacgacctacaaaacaaccggcacacccgaggaaagcgagaagacggaggattcacggaccacagtggcttccgataagctgctgaccaaaacgacaaaaaatattcaggaaacaatttctgccaatgagttgacccagagcctggccgaacctacagaacatggcggtcggacggccaacgagaataatacaccaagtcccgctgaacccactgagaatcgcgagagaacagccaatgaaaacacaacactttcccccgctgagcctactgaaaaccgcgaacgtacagccaatgagaataccgctccattcccagccggaccgacagagaaccgcgagatgaccgcaaacgaaaacacgactcttttccccgctgaacctacagaacacggtgaaagaacagctaacgagaacactacaccttcccccgcagaacctaccgaacacggcgaacggactgccaacgagaacaccactccatctccagcggagcccactgaacacggcgagagaacccccttcgccaatgacaagaccacctcatcatcagcagaatccactgaacatggcgaaaggactcccttggccaacgaaaatactacgcctagtcctgctgagcccactgagaacagggagaggaccgccaacgaaaacactactccatctcccgcaggtcccactgagaatcgggaaacaacggcgaacgaaaaaaccacactgtcccccgttgagcctacagagaatagggagacaaccgcaaatgagaagacaacaccttctccagctgagccaacagagaatgggcagaggactccatttgcaaatgagaagaccacatcctcaagcgcggagcctaccgaacatggagagcggacccctctggccaatgagaacaccaccccgagccccgctgaacccactgagaacagggagcgtaccgccaacgaaaagactaccccgagccctgcggagcctacggagaacggagacaggactccactcgcaaacgaaaaaactaccccctcattggccgaacccaccgagaacgggcagcgcaccccgtttgcaaatgaaaaaacgacgtctagtagtgcagaaccaactgaacacgaagagcgcactccactggccaatgagaacactacacccagcccagctgagcccacagaaaacagggagcgcactgctaacgaaaacacaacaccaagtcccgctggccctactgagaaccgcgagatgactgcaaacgagaaaactacactgttccctgccgaaccaactgagaatagggagcggaccgctaatgagaagaccacctctagccccgctgaaccgactgaaaatggccaaaggacgccctttgctaacgagaaaacaacaagctctagtgctgagccaacagaacatggggagcgaacaccacttgccaacgaaaacacaacactttcacccgctgagccaaccgagaatcgagaacggaccgctaatgagaaaacaaccccctttccagccgaaccgactgagaatcgagaacggactgctaacgaaaacaccacgccttcccctgcccagccgaccgagaatggtgaccggacgccgttagccaatgagaaaacaacacccagccttgccgagccaactgagaacggaaagcgcactccttttgccaacgaaaaaaccactagtagctctgccgaaccgacagagcatgcagagaggacccccctggcaaatgagaacaccacaagctcccccgcagagccaactgaaaaccgcgaacgcaccgcaaacgaaaaaacaacacagtttccagctgagccgaccgaaaatagagaatctacggctaatgagaagacaactccattccccgctgagcccactgaaaatcgagagtggacggccaacgaaaacacgaccttgagcccagccgagccaactgaacatgaagaaatgactccactagcaaacgagaaaacaaccctgtccccagctgagccaacagaaaacggcgaaaggactccctttaccaatgaaaagaccactccatcaagcgccgagcctacagagcacggtgagagaacccccttggctaatgagataaccacccccagtcgcgcagagcccactgaacacggagaaagaatagcaaatgagaaagctacgcctagccctgctaagccgacagagcatggcgagacaacggtgaacgaggacactacaccaagctcagcggaacctacggagaatggggagaggacacccctagccaacgagaacaccacaacctcccctacagagtccacagaacatggagagcgaacggcgaacgagaagaccaccccatcgcctgcagaacctaccgaacatggtgaaaggaccccgtccgctaatgagaaaacaattccgtcacctgcaaaacccacagagcacgaagagatgaccccctcagcaaatgaaaacacgactccttcacccgtgaagcccaccgaacacggagaaaagacaaccctggctaatgagaagatcacactgagccctgaaggtcctaccgaacacggcgcaaaaactacctcagcgaatgaaaagattacccccagtcttgcgaaaccgacagaacacggagaacgaacgacctcacctaacgacaagatcacatcttctgccgcagaaagcaccgagcatcgcgacagggctacttcggcaaacgtcatcacccctgcacccgctgagcctattaagcatgctaagagaactaccctagcccacgagaagatgacccaggtgacagaaaagtccacagagcaccctgaaaaaactacttccacaactgaaaaaaccaccaggacaccagagaagccgacactgtatagtgaaaaaactatttgtactaaggggaagaacacgcctgtaccagaaaagcctactgagaatctgggaaacactaccctgacgactgagactataaaggcccctgtgaagtccaccgaaaaccctgagaagactgccgctgtgacaaagaccatcaagcctagtgtaaaggttacaggggacaaatcccttaccaccaccagctcacatctcaacaagacagaggtgactcatcaggtacccacgggcagctttacgctaattacatctcgtacgaagctgagcagtattaccagcgaggcaaccggaaacgagtctcacccatatctcaataaagacgggagtcagaaggggatacacgccggtcagatgggcgaaaatgatagctttccggcatgggccattgtgatcgtggtgctcgtagccgtcattctgctgctggtattcttggggctcatcttcctggtctcttatatgatgcgcacccgcaggacgcttactcagaacacgcaatataacgacgccgaggacgaagggggacccaactcttatccagtgtacttgatggagcaacagaacctgggaatgggccagattccatccccgagatag

SEQ ID NO: 220748 - DNA, 2670 bp, Artificial Sequence
  Description of Artificial Sequence: Synthetic coding sequence
atggcacagcccgtgcactcactttgtagtgctttcggattgcagtgttgtctcctgtttctgcttgctagttggggggcaggggctactacctttcaagaatatcagaagaccggggagctgtctacatctgatcacatattccctttgacacccggattggtatactctatacctttcgatcatattgtcctgcactcaggccagaggccccctgaactcccgaaaagcacagagatccacgagcagaaacggcattgcaataccacacgacactccaagccaactgacaagcctaccggtaatagcaaaactatcgatcacaaaagcagtacagataaccacgaggcaccaccaactagcgaggagaattcctccaatcaggggaaagatcctatgatcagaaatcagcgaagcgtcgaccccgctgactccactacgacccacaaggaatcagctggtaaaaagcacatcacacctgctcctaaatcgaaaatcaattgtcgaaagagtacaacaggcaaaagtacggtaacgagaaagtctgacaagaccggtcgcccacttgaaaaaagtatgtctaccctggataaaaccagcacaagctctcataaaacaacaacctctttccataatagcggaaattctcagactaagcaaaagtccacctcattccccgagaagatcactgcagcttcgaagaccacctataagactacaggtactccggaagaaagcgaaaagaccgaagattctcgaactactgtggcctctgataagctgctgaccaagactacgaaaaatatccaggagacaatctcagcaaacgaattgacacagtctctcgccgagcccaccgagcatggaggcagaactgccaacgagaataacacccccagtcctgcagaaccaacagagaaccgcgagcggacagccaacgaaaatacaaccctctccccagccgaacccaccgaaaatcgcgagcgtaccgctaacgaaaataccgcgccttttccggcaggtcccaccgaaaaccgggaaatgactgcaaacgaaaataccactctgttccctgccgaacccacagaacatggagaacgaacagccaatgaaaacacaacccccagtcctgccgagccaaccgagcacggtgaacggactgcaaacgagaacacaacaccgagccccgctgagcctaccgaacacggtgaacgcaccccctttgctaatgacaaaactacaagctcctccgctgagtctaccgaacatggtgaacgcacaccactcgcaaatgaaaacacaactccctcacccgcagaacccaccgagaatagggaacggaccgccaatgagaatacaacaccgagtcccgctgggccaacagagaatcgagagacaacggcaaatgagaagaccacgctctctcccgtcgaacccaccgaaaaccgcgaaactaccgcaaatgagaagaccaccccaagcccagccgagcccactgaaaatggccaaaggaccccatttgcaaacgaaaaaacaacgagctcctcagccgagccaaccgaacacggcgagcggacccccttggccaatgagaataccactccatcccctgctgagccaaccgagaatagagagcgaactgcgaatgagaaaaccaccccctcccctgcagagcccacagaaaatggcgaccggacacccttagccaacgagaagactaccccatctcttgctgagccaaccgaaaatggtcagaggacacccttcgcaaatgagaagactacaagtagttcagccgaacctacagaacacgaggagcggacccccttggccaacgagaatactaccccaagcccggctgagcctaccgaaaacagagagcggactgccaatgagaatacgacgcccagccctgcagggccaacagaaaaccgcgaaatgactgctaatgagaaaaccacccttttcccggctgaacccaccgagaaccgggagcggacagccaatgagaagacaactagctcacctgctgagcctacagagaatggtcaacggacgccgttcgctaatgagaagacaacctcatcctcggccgagcccactgaacatggtgaacggactcccttagctaacgaaaacaccaccttatctcctgcaggcccaaccgaaaaccgcgaacgtaccgcaaatgaaaagacgacacccttcccagccgaacctacagagaaccgggaaaggacggccaacgaaaatactacgccctcccctgctcaaccaactgagaatggcgaccgcacacccctagccaacgaaaagaccaccccatcgttggctgagccaactgaaaacggcaaacgaacaccctttgccaatgaaaagacgactagttcgtcggccgaacctacagaacatgccgaacggactcctctggcgaatgagaatactacttcctctccggctgagccaacagaaaatagagagagaactgctaatgagaagaccacacagtttcctgctgagcccacagagaatagggagagtacagctaacgagaagaccactcctttccctgctgagcccacagaaaatagggagtggaccgccaatgaaaacacaactttaagtcccgcagagcccacagagcacgaggagatgactccgctggcctag

SEQ ID NO: 220749 - DNA, 1653 bp, Artificial Sequence
  Description of Artificial Sequence: Synthetic coding sequence
atggtcccaaaggctgactctggagccttccttctgttgttcctgctggtgctgactgtcacagagcctctgcgccctgagttgcgttgcaatcccggacaattcgcatgtagaagcgggaccattcaatgcatccccttgccgtggcagtgcgacggatgggcaacctgcgaagatgagtctgacgaggctaactgtccagaagtgacaggggaagtcagaccgcaccacgggaaagaagctgtggatccaagacagggccgagccagggggggagatccttcccactttcacgccgtgaacgtcgcacagcctgtgcgctttagtagcttcctgggcaaatgccctactggatggcatcattatgaaggaaccgcaagctgctacagggtgtatctctccggagaaaactattgggatgctgctcagacctgtcagaggctaaacggatctctggccacgttctctacggaccaagagttgaggtttgtgctcgcccaggagtgggaccagcctgagagaagttttgggtggaaagaccagcgcaaactttgggtgggctatcagtatgtgattactgggcgaaacaggtctctagagggcagatgggaggtggcatttaaggggagcagcgaggtattcctgccacccgacccaatttttgcctccgcgatgtctgaaaatgataacgtcttctgtgctcaactacagtgtttccattttcctacattgcgacaccacgacctgcatagctggcacgcagaatcctgctacgagaagagctcattcctctgcaagaggtcccagacttgcgtagatatcaaagataatgttgtggacgaagggttttacttcacccctaagggcgacgacccttgcttgtcatgtacttgccacggcggagaacccgagatgtgcgtggcagccctatgtgaaagacctcaggggtgccagcagtacagaaaggaccctaaggaatgctgcaagtttatgtgtctggaccccgacgggaattccctgtttgatagtatggctagtggaatgcggctggtcgtttcctgcatttcaagcttcctgattctcagtttactgctgttcatggtgcataggctccgtcaacgcagacgtgagcggatcgaatcccttattggcgctaatctgcaccatttcaatctgggccgtagaatccccggatttgattacggccctgacggcttcgggacggggctaacccctctgcacttgagtgacgatggagagggcggtacctttcactttcacgaccccccacccccttatacagcctataaataccccgatattggacaacccgacgatccgccaccaccatatgaggcaagcattcatccagattctgtattttacgacccggcagacgatgacgccttcgagcccgtggaggttagtctgcccgcacctggtgacggtggctccgaaggtgctctgcttcgtcgtctggagcagccgttgcccacagcgggagcatccctggccgacctggaggacagcgccgacagcagctctgccttgcttgtgcctcccgatcctgcacagagcggttcaactcctgctgctgaggctctgcccggagggggtcgtcactcccgctcttctcttaataccgtggtttag

SEQ ID NO: 220750 - DNA, 984 bp, Artificial Sequence
  Description of Artificial Sequence: Synthetic coding sequence
atggtacctaaagccgatagtggggcattcctactactgttcctgttggtgcttaccgtgaccgaaccactgaggccagaactgcgttgcaatcctggccaatttgcctgcaggtccgggactatacaatgcatcccacttccatggcagtgcgacgggtgggctacttgtgaagatgagagcgatgaggctaattgccctgaggtcacgggcgaagtacggccacaccacggcaaggaagctgtcgaccctcgtcagggcagggcaaggggcggagacccttcccatttccacgccgtgaacgtcgcgcaacccgttcggttcagttcgttcctaggaaaatgtccaacaggatggcatcactacgaagggaccgcctcatgctacagagtgtatctgtctggggaaaactattgggacgccgctcaaacatgtcagagactaaacggcagtctcgctactttttccacagaccaagagctgcgtttcgtcctggcacaggaatgggatcagcctgaacgcagtttcggatggaaggaccagagaaagctctgggttggctatcagtatgtaatcaccggcaggaataggtctctggaaggacgatgggaggtagcctttaagggatcgagtgaagttttcttaccccctgaccctatcttcgcgagtgccatgagtgaaaatgacaatgttttttgtgcacagctacagtgctttcatttccccaccctccgccaccatgatctgcacagctggcatgcagaaagctgctacgaaaaatcatcctttctgtgtaagcgtagtcagacttgtgtagacattaaggataatgtcgttgacgagggcttttatttcacacccaagggcgatgatccatgcctctcctgcacttgtcatggaggcgagccagaaatgtgcgtggcggcactctgcgagaggccacaggggtgcagtcccctttcttgcaccgcccgagcgacatag

SEQ ID NO: 220751 - DNA, 1530 bp, Artificial Sequence
  Description of Artificial Sequence: Synthetic coding sequence
atggtgcccaaagccgacagcggcgcatttttgttactctttctgctggtcctcacagtgaccgagcccctccggccagaggtcaccggggaagttaggccccatcatggcaaagaagctgttgatcctagacagggtcgggctagaggtggggaccccagccacttccacgctgtcaacgtggcgcagcccgtgcggttcagcagcttcctcggcaaatgtcccaccgggtggcaccattacgaagggacggccagttgctaccgagtgtatctctccggtgaaaattattgggatgctgcccagacctgccagcgtttgaatggcagccttgcaactttctctaccgatcaagaactcaggttcgtcctggctcaggagtgggatcagcctgaacgatcctttggatggaaagaccagaggaagctctgggttgggtatcaatacgtcataaccggtcgtaaccgatctctcgaaggtcgctgggaagtggccttcaagggaagctccgaagtgtttctgccaccggatcccatcttcgccagtgctatgtcagagaacgacaatgtgttctgcgctcagctgcaatgctttcacttccctacgctgagacaccatgatcttcatagctggcatgcggagtcatgttacgaaaagtctagtttcctttgtaagaggtctcaaacttgcgtcgacattaaagacaatgtcgtcgatgagggtttttactttacgccaaagggcgatgacccctgcctttcatgcacatgtcacggtggcgagccagaaatgtgcgttgcggcactgtgtgaacggccacaaggttgtcagcagtaccgcaaggaccccaaagagtgttgcaaattcatgtgcttagatcctgacggcaactcactgtttgactctatggcctcgggtatgcggctggtcgtcagctgcatttccagttttcttattctgagtctgttgctgttcatggtgcatcgcctaaggcagcgccgtcgggaaagaatcgaatcactgataggcgctaatctgcatcattttaatctcggtaggaggattccagggttcgattacgggcctgatgggtttggaacgggactcaccccattgcacctaagtgatgatggcgagggagggacatttcatttccacgacccaccacccccatacaccgcatataagtatccggacattggtcagcccgatgatcccccacctccatatgaagcctccattcatccagatagtgtgttttatgatcccgctgacgacgacgcgtttgaacccgttgaagtgtcactacctgctcccggtgatggcggatcggaaggggcattactgcgcaggctggaacaacctctgcctacagccggtgcctccctcgccgacctggaggacagcgctgactcctcctcagctctactggtcccccctgatcccgcacaatctgggtccacccctgctgccgaagcgttgccaggcggtggacgacatagccggtccagcttgaatacagtggtctag

SEQ ID NO: 220752 - DNA, 810 bp, Artificial Sequence
  Description of Artificial Sequence: Synthetic coding sequence
atggtgccgaaagccgactctggagcattccttcttctgtttctgctcgtgctgactgtgacggagccacttagacctgaactgaggtgcaacccagggcagtttgcctgcaggagcggtacaatccagtgtatcccgttgccgtggcagtgcgatgggtgggctacatgcgaggacgagtccgatgaagcaaactgtcctgaggtgacgggagaggtgcggcctcaccatggaaaggaggccgtcgatcctcggcagggacgggctaggggaggagatcccagccattttcacgcagtgaatgtcgcacagccagtgcgtttctcccgtaagtgtccgaccggatggcaccactatgagggtaccgcctcgtgctacagggtctacctatcgggtgagaactactgggacgccgctcaaacctgtcagaggctgaacggatcgctcgcaacatttagtactgatcaggagttgagatttgtactcgcacaggagtgggatcagcccgaacgctctttcgggtggaaagatcagcgaaagctgtgggtcgggtatcagtatgtcataaccgggagaaataggagcctggagggcagatgggaggtggccttcaaagactggggcgtttcagacacaatggtgcaccgaagacttctttgtccatgcgtcggaaccctccatacacacctgaaactcggcgcacggtttcgcagggttcccgtgaggctgggcggagccctgtctcggagatccccacgtccgacccctgcctgtgagccacgcttgggagccaagacgctccaggtttag

SEQ ID NO: 220753 - DNA, 663 bp, Artificial Sequence
  Description of Artificial Sequence: Synthetic coding sequence
atggaacgatatgctggggcacttgaggaagttgctgatggcgctcgacagcaggagcgccattatcagttgctatctgccctgcagagcctcgtcaaggagcttccttcatcctttcagcaacggctgagttacacaaccctgtcagacctagccctcgcactgcttgacggtactgtcttcgagatcgtccaggggttgctagagatccagcatctgaccgagaagtcactttacaaccagagactcaggctccaaaacgaacatcgggtgcttaggcaggccctgcgacagaagcatcaggaagcacagcaggcatgtcggccacataacctgcccgttcttcaggcagcccagcagcgggagttggaggcggtggaacaccggatacgggaggaacaacgggctatggatcagaagattgtgcttgaactggacagaaaagtggctgatcaacagtcaacccttgaaaaagctggggtcgctgggttttatgtcaccaccaacccgcaggaactgatgcttcagatgaatctgctggagctgatcaggaagctacagcagagagggtgctgggcgggaaaggccgcactgggtctgggtgggccttggcagctccccgctgctcagtgtgatcagaagggctccccggtcccaccatag

SEQ ID NO: 220754 - DNA, 663 bp, Artificial Sequence
  Description of Artificial Sequence: Synthetic coding sequence
atggagcgctacgcagcagccctggaagaggttgccgacggcgcacgtcagcaggagaggcactatcagctgttgagtgctctgcaaagcctcgtgaaggagctgcccagttcctttcagcagaggctgtcttacactaccctatccgacttggcactcgccctcctcgatggcaccgtctttgaaatcgtgcaaggactgctggaaattcagcacctgacagagaaatcactgtataaccagcgacttcggctgcagaacgagcaccgagtccttcggcaagcgcttagacagaagcatcaggaggcccagcaggcttgtcgccctcataacctccctgtagtccaggctgctcagcagcgggaactcgaggccgtcgagcaccggatccgagaagagcagcgagccatggatcagaagatcatcctcgaacttgatcgtaaggtcgcagatcagcagtctaccctagaaaaagctggggtagcgggattttacgtgacgaccaatcctcaggaactcatgctgcagatgaatctcctcgaacttatccgcaaactccagcagcgtggttgccgggctggcaacgcagccctcggtctaggcggtccctggcagtccccagctgcacagtgcgatcaaaagggtagccccgttccaccttag

SEQ ID NO: 220755 - DNA, 2322 bp, Artificial Sequence
  Description of Artificial Sequence: Synthetic coding sequence
atggagaccgacgaatcaccaagtcccctgccatgcggcccagccggtgaggcagttatggagagtagagctcgccctttccaggccctaccacgcgagcagagccctcctccccctctgcagacatcatcaggcgctgaggtcatggacgttggatcaggcggagatggccagtcagagttaccggcagaagacccgttcaatttttatggggcttcactcctgtccaaaggaagcttctcaaagggtaggctgctgatcgacccgaattgctctggtcactctcctaggaccgctaggcacgcacctgccgtgagaaagttctcgcctgacctgaagctgttgaaggatgtcaaaatatccgtatctttcaccgagtcatgtaggagcaaagatagaaaggttttgtacactggcgctgagcgagacgttagggccgaatgcgggctcctcctctcccctgtctcgggcgatgtccatgcctgcccatttggtggaagtgttggggacggggttggcattggaggcgaaagcgctgacaaaaaggatgaggagaatgaactggaccaggaaaaaagggttgagtacgctgtgctagatgagctggaagacttcacagataacctggaactcgatgaagagggagcgggtggcttcacagctaaagcaatagtccagcgggacagggtggacgaggaggctctgaatttcccatacgaagacgactttgataacgacgtcgatgcgctcttagaggagggcctctgtgcaccaaagaagaggcggacggaggaaaagtacggcggagactcagaccaccccagcgatggagaaacgtcagtgcagcccatgatgaccaaaatcaaaacagttctaaaatccaggggaagacccccaacagaacccttgcccgatggctggatcatgacattccataactcgggcgtgcccgtatacctgcaccgggagtcccgcgtagttacctggtcccgtccctattttttgggtaccgggtctattaggaagcatgacccgccactatccagtatcccatgcttacattacaaaaagatgaaggacaacgaagagagagagcagagtagtgacctcaccccgtccggcgatgtgtcacctgtaaagcctttaagtcgcagtgccgaactggagtttccactcgatgaacccgactcgatgggcgcagatcccggacccccagatgagaaggatcccctgggagcggaagctgctcccggtgccctaggtcaggttaaagctaaggtggaagtatgcaaagacgagagcgtggatctcgaggagttcagatcttaccttgagaaacgcttcgactttgaacaggtcactgtcaagaagtttcgaacatgggctgagcgacggcagttcaaccgagaaatgaagagaaagcaggccgagagtgagagacccatcctccccgctaaccaaaagcttataactctgtctgtgcaggacgccccaacaaagaaggaatttgtgattaatcctaacgggaaaagcgaagtttgtatactacacgaatacatgcaacgggtgttgaaagtcagaccggtatataacttcttcgaatgtgaaaatccatccgagccttttggcgcatctgtgacaattgacggcgttacctacgggagcgggaccgccagtagcaaaaagctcgccaaaaataaagccgcaagagctaccctggaaatacttatcccagatttcgtgaaacaaactagtgaggaaaaacctaaagatagtgaggagctggagtattttaaccacatttctatcgaagattctagggtgtatgaactcacaagcaaagccggactactcagcccatatcagattctccacgaatgcctgaagagaaatcacggaatgggtgatacttccattaaatttgaggtggtcccaggaaagaaccaaaagtccgagtatgttatggcatgcgggaaacatactgtaagaggttggtgcaaaaataagcgcgtgggcaagcagttggcttctcagaaaatcctgcagctgctgcatccgcacgtgaaaaactggggaagcctgctgcgcatgtacggccgtgaatcttccaagatggtgaagcaggagacctctgacaagagcgtgatcgaacttcaacagtatgctaagaagaataagcccaacctccacatattgtcaaagttgcaagaagagatgaaacgtctggccgaggagcgcgaagaaacacggaagaagccgaaaatgagtattgtcgccagcgcccagccaggtggtgaacctctttgcacagtagacgtgtag

SEQ ID NO: 220756 - DNA, 2223 bp, Artificial Sequence
  Description of Artificial Sequence: Synthetic coding sequence
atggaaacggacgaaagcccctcgcctctcccgtgcggcccagccggagaagctgtgatggaaagccgcgctcgccctttccaggccctgccccgtgagcagtccccccctcctcctctgcaaacttcttcaggtgcagaggtgatggacgtcggttcaggtggagacggccaaagtgagctgccggcagaggacccattcaacttctacggagcaagtctgctctccaaaggttctttttccaaaggtcggctgctgattgacccgaattgtagcggccatagcccgaggacagctcgccatgcccctgccgttagaaagttttcccctgaccttaaactcctcaaagacgtgaagatttctgtgtctttcactgagtcttgccggagcaaggataggaaggtattatataccggagcggagagagatgtccgcgcagagtgcggtctcttgctgagccctgtgtccggcgacgtgcatgcctgccctttcgggggaagcgtcggtgatggcgtagggatcgggggagaaagcgcggacaaaaaagatgaagagaacgagctggatcaagaaaaacgtgtggagtatgctgtcttagatgagctcgaggatttcactgataatctggagctggatgaagaaggcgctgggggatttacagcaaaagcgattgtgcagcgtgaccgggtcgacgaggaggctctcaactttccatatgaagatgacttcgacaacgatgtcgatgcactcttagaagagggtttatgtgcacccaagaaacgtaggactgaggagaagtacggcggagatagtgaccatccttcagacggagagacctccgttcagccgatgatgacgaagataaagaccgtgctcaaaagtagaggaagaccaccgacagagcccctacccgacggatggatcatgaccttccacaatagcggtgtgcctgtttacctacatcgcgaatcaagagtggtgacatggtcaaggccttacttcctcggaactggcagtatcaggaagcatgatcccccactctccagcattccctgcctccactacaaaaagatgaaggataatgaggaaagggaacaatcatctgatttgacaccctctggcgatgtgtcacctgtgaagccccttagtcgcagcgccgaacttgagtttcctctggacgaacctgattccatgggggcagacccagggcctcctgatgagaaggatccgcttggagctgaagctgcccctggtgctctgggccaggtcaaagccaaggtggaggtctgtaaggacgagtcagtggatctcgaagaatttcgcagctatcttgagaagcgctttgacttcgaacaggtgacggtgaaaaagttcaggacctgggccgagcgaagacagtttaaccgtgagatgaaacggaaacaggcagagtctgagaggccaatcctccctgcgaatcagaagctcattaccttgagtgtgcaggacgctcctacaaaaaaagagtttgtgatcaatcccaatggcaaatcagaagtctgtatccttcacgaatacatgcaaagagtcctgaaagtgagacccgtgtacaacttttttgagtgtgcacgggctaccctggaaatccttatccccgacttcgtcaagcaaacttccgaagaaaagccaaaagatagcgaagagctggagtattttaaccacatctcaatagaggattctagagtgtacgagctgacgtctaaggcagggttgttgtctccatatcagattctccatgaatgcctcaaaaggaatcacggtatgggagatacgtcaataaaatttgaggtcgttcccggaaagaatcagaaaagcgaatacgttatggcatgtggtaagcacacggtgcggggatggtgcaagaacaaacgcgtaggaaaacaactggcatcccagaagatcctccagctcttgcatccgcatgttaagaactggggtagtttgttgcgtatgtacggaagggagagcagcaaaatggtcaaacaggaaacgtccgacaagagtgtcatcgagctgcagcagtatgccaagaaaaacaaacctaacctgcacatcctgagtaagctgcaggaggagatgaagcgcctggctgaggaaagggaggaaacacgaaagaagcctaaaatgtcaattgttgcgtctgcccagccgggaggcgagccattgtgcactgttgacgtctag

SEQ ID NO: 220757 - DNA, 2223 bp, Artificial Sequence
  Description of Artificial Sequence: Synthetic coding sequence
atggaaactgatgaatccccttctcctcttccgtgcggacctgccggtgaagcagtcatggagtcccgcgctcgcccttttcaggccctccctcgcgaacagtcccccccacctccgctgcagacctcctctggcgcagaggtcatggacgttggcagcggtggagacggtcagtctgagttgcctgccgaagatccctttaatttctacggcgcttctctcctgtcaaaaggttccttcagcaagggaaggttactcattgatcctaactgttccgggcattcgcccagaacagccaggcacgctccagcggtgaggaaattctcccctgacctgaagctcctgaaggatgttaagatctctgtgtcattcacagaatcctgtcgctccaaagatcgcaaggtgctctacactggcgcagagcgggatgtccgggcagagtgcggactgctgctgtctccggtgtccggggacgtccacgcctgtcccttcggaggctcagtgggcgacggcgtcgggatcggcggagaatcagcggataagaaagatgaggaaaacgaactggatcaagagaaaagggtggaatatgccgtcctggacgagctcgaagatttcacggataacttggaattggacgaagagggtgcaggcggatttacagctaaagccatagtacagcgcgatcgcgtcgacgaggaggccctgaactttccttatgaagacgatttcgataacgacgtcgacgccttactggaggaggggttgtgcgcaccgaagaagcgacgcacagaggaaaagtatggaggggattccgatcatcccagcgatggcgagacgagcgtgcaacctatgatgaccaagatcaagactgtgctgaagagtcgagggaggcccccaacagagcccctgcccgacgggtggatcatgacattccacaattcaggtgttccggtttaccttcaccgcgaatcgcgtgtcgtcacctggtctagaccatatttcctcggaacaggaagcataaggaaacacgacccccctctgagctcaatcccatgcctccattacaagaagatgaaagacaacgaggaacgggaacaaagctctgatctcaccccctcgggcgacgtgagccccgtcaagcctctgtcccggtcagccgaactggagttccctctggatgagccagacagcatgggagcagaccccggtccaccagatgaaaaagatccactgggggctgaggccgcacctggtgccttaggccaagtgaaggcgaaggtggaggtttgcaaggatgagtcggtcgacttagaagaatttcggtcttacctcgagaagagatttgatttcgagcaggttaccgtaaagaaatttcgcacctgggctgagcggaggcagttcaaccgagagatgaagcggaagcaggcggagtctgaacggccaattctgccggcaaaccagaagcttattactttgtccgttcaggacgcacctaccaagaaagaatttgttatcaatccaaacggtaagtctgaggtctgcatactccatgagtatatgcagagggtgcttaaagtgcggccagtctacaacttctttgagtgcgcacgcgctaccctggagatactgattccagattttgtgaagcaaacctcagaggagaagcctaaggacagtgaagagttggagtattttaatcatatcagtatcgaggattccagagtgtacgagttaacatctaaggcagggttgctctcaccctaccagatcctgcacgagtgccttaagcggaaccatggtatgggagacacctctatcaagttcgaggtggttccaggcaagaatcaaaaatctgaatacgtaatggcctgtggcaagcacacagtccggggatggtgtaaaaataaaagggttggaaagcaactcgcctctcagaagatactgcagttgctgcacccacatgtcaaaaattgggggagtttgctccggatgtacggcagagagtctagtaagatggtaaagcaagagacctcggacaagagcgtgatagaactccaacagtacgccaagaagaataaacccaatttgcatattctctccaagctgcaagaagagatgaagagattagctgaagaaagggaagagacacggaagaaacccaagatgtccatcgttgcctctgcccaacccggaggtgaacccctttgtaccgtagatgtttag

SEQ ID NO: 220758 - DNA, 378 bp, Artificial Sequence
  Description of Artificial Sequence: Synthetic coding sequence
atggagacagatgagagtcccagccccctgccgtgcgggccagctggagaggccgtaatggaatcccgcgcaaggcccttccaggccttacctcgggaacagtcgccaccgccacctcttcagacttcctccggcgctgaagtcatggatgtgggaagcggaggagacggccagagtgagttgcccgcagaagacccatttaatttttacggcgcatcactgctgtcaaaaggctcgttttcgaaagggcgtctcctgattgaccccaactgctcaggccactctccacgcaccgctcgtcacgcccctgctgtgcgcaagttctcccctgacctgaaattactgaaagatgtgaagatctctgtgagcttcacctag

SEQ ID NO: 220759 - DNA, 564 bp, Artificial Sequence
  Description of Artificial Sequence: Synthetic coding sequence
atggtgggctcgctcaactgtatcgtggccgtttcacagaatatgggcatcggcaaaaacggggacttgccttggccacccctaaggaacgaattcaggtattttcagaggatgactaccacaagcagtgtcgagggaaagcagaatctggtgataatgggtaagaagacatggtttagcatccctgaaaaaaataggccgctaaagggcagaattaatctagttctgagtcgcgagctcaaggagccccctcagggagcccactttctgtctagatccctggacgatgctctgaagctgaccgagcaacccgagttggcgaacaaagtggacatggtttggattgtgggaggctcttcggtttataaggaagctatgaatcatcccggtcacctgaaactctttgtcacaagaataatgcaggacttcgaatcggacacattttttcccgagatcgacctcgaaaagtataagcttctgccagaatacccaggcgtcctgtcggacgtccaggaggagaagggtattaagtacaagttcgaggtttatgaaaagaatgactag

SEQ ID NO: 220760 - DNA, 564 bp, Artificial Sequence
  Description of Artificial Sequence: Synthetic coding sequence
atggttggctccctgaattgtatcgtcgctgtgagccagaatatggggattggaaaaaatggagacttgccgtggcctccactgcggaatgaattcaggtatttccagcgtatgacgacaacgagctcagtggaaggtaagcaaaacctggtgatcatgggtaagaaaacctggttttcaattccggagaaaaacagaccgctcaaggggagaattaaccttgtgctgagcagggagctcaaggaaccaccccaaggggcacactttttgagccggtccctcgatgatgcccttaagttaactgaacagccggagcttgctaacaaggtcgatatggtgtggatcgttggaggtagttcagtctacaaagaggccatgaatcatcccggtcaccttaaactcttcgtcacgagaatcatgcaggactttgaatccgacaccttcttccctgagatcgacctagagaaatataagctgctgcctgaatatccaggcgtgttgtctgatgtgcaggaagaaaaaggcatcaaatataaatttgaggtctatgaaaaaaatgattag

SEQ ID NO: 220761 - DNA, 963 bp, Artificial Sequence
  Description of Artificial Sequence: Synthetic coding sequence
atggccgcagtgcgaatgctaaggacatggtcaagaaatgcaggtaaattaatttgcgtgcgctacttccaaacttgtggcaacgtgcatgtgctcaagcccaattatgtctgtttttttggatacccctccttcaaatactctcacccccatcacttcctcaagacaacagcagccctcagggggcaggtggtgcaatttaagctcagtgatattggggagggaatcagagaagtgacagtaaaggagtggtacgtgaaagaaggggacacagtgtcccagttcgactctatttgcgaggtgcagtcagacaaggcttcggtaactatcaccagccggtacgatggtgtcattaagaaactgtactacaacctggatgatatcgcctatgttggtaaacctttggtggacattgagaccgaggcccttaaagatagcgaggaggatgtggtggaaactcctgcagtgagtcatgatgagcacacgcaccaggagataaaaggcagaaaaacacttgctacgcccgcagtgcgcaggctagcaatggaaaacaacataaagttatcggaggtggttggcagcgggaaagacggcaggatacttaaggaagacatccttaattacttggagaagcagaccggggctatcctccccccatcccctaaagtcgagatcatgccacccccaccaaagcccaaagatatgaccgtgcctatccttgtgagcaagcccccagtctttaccggcaaagacaagactgaacctattaaaggattccagaaagctatggtaaagaccatgagcgccgcactgaagatacctcatttcggatactgtgacgagatagacctaacagagctggtcaagcttcgtgaagaactgaaaccaatcgccttcgcgagaggcattaaattaagctttatgccattttttctcaagtattatttcagctggaagtcctag

SEQ ID NO: 220762 - DNA, 1449 bp, Artificial Sequence
  Description of Artificial Sequence: Synthetic coding sequence
atggctgcagtccggatgctgaggacctggagccgaaacgccggaaaactcatctgcgtaagatacttccagacttgcggaaacgtccacgtactcaagcccaactatgtgtgctttttcggttaccccagcttcaagtacagtcacccacaccactttctgaaaacaaccgctgcactacggggacaagtggtccagtttaaactgtctgacattggcgaggggatccgagaagtgacggtaaaagagtggtatgtcaaagaaggggacaccgtgagtcaattcgactcgatctgcgaagttcagtccgataaggcctccgtgactatcacgagccgatacgatggggtgatcaagaaactgtactataacctggatgacatcgcttatgtggggaagcctttggttgacattgaaacggaggcgctcaaggattcggaggaagacgtagtggaaactccagcagtttctcatgatgagcatacacaccaggaaatcaaaggacggaaaaccctggcaactcccgcagtgcggcgtctagccatggagaacaacataaagttgtcagaggttgtcggaagcggaaaggacggccgaatactgaaagaggacatcctgaactaccttgaaaagcaaacaggcgctatactgccgccaagcccaaaggtggagatcatgccccctccacctaaacccaaggatatgacagtgccaattttggtctcaaaaccacccgtattcaccggtaaggataagacagagccgattaaaggattccagaaagccatggtgaagaccatgagtgccgcattgaagattccccactttgggtactgtgacgagattgatctcacagagttagtcaagctccgcgaggaactcaaaccaattgcattcgctcgagggatcaaactcagcttcatgcccttctttctgaaagcggcttcgcttggtctcttgcagttcccgatacttaacgcaagcgtggatgaaaattgccagaacatcacctacaaggcaagccacaacattggtatcgcaatggatactgagcagggtctcatagtgccgaatgtgaaaaatgttcagatctgttcgatttttgacattgcaacagaacttaatcggctgcagaagttgggaagtgtaagccagctctccacaacagacctgacaggtggcacattcacactcagcaatatcgggtccatcggcggaacattcgccaaacccgtgattatgccccctgaggtggcaatcggagccctaggtagtattaaagccattcccaggtttaatcagaagggagaggtgtacaaagctcagataatgaacgtatcgtggagtgccgaccacagagtcatcgacggagccaccatgtcccgcttttctaatctgtggaagtcctatctcgagaacccagcctttatgttattggatttgaagtag

SEQ ID NO: 220763 - DNA, 906 bp, Artificial Sequence
  Description of Artificial Sequence: Synthetic coding sequence
atggagaataacattaagttatccgaagtcgtcggtagcggcaaggacgggcgaatcctcaaggaggacatcttgaactatctcgagaaacagaccggggcaattctgccaccatctccgaaagtggagatcatgcccccaccccctaaacccaaggatatgacggtgccgattttagtctctaagccaccagtattcactggtaaggataagaccgagcctattaagggatttcagaaagccatggttaaaactatgagcgccgcattgaaaatcccacacttcggatattgcgatgagatcgatctcaccgagctcgtgaagttgcgggaggagctgaagcctatcgccttcgcacgcggtatcaaactgagtttcatgccatttttcctcaaagcagcctctctggggttgctgcagttcccaatcctgaatgcctccgttgacgaaaattgccaaaacatcacatacaaggccagccacaatataggcatcgctatggacacggagcaaggcctgatcgtgccaaatgtgaagaacgtccagatctgctctatcttcgacatcgccaccgagcttaatcgcctgcagaagctagggtccgtttcacaattaagcacaaccgacttgaccggtggcacctttacactgagcaacatcggaagtatcggaggtaccttcgccaagccagtaattatgccaccagaggttgcgatcggagctctgggctcaattaaagctatccccaggtttaaccaaaaaggcgaggtttacaaagcacagattatgaatgtcagctggagcgcagaccatcgggtgatagacggcgcaactatgtcacggttcagtaatctgtggaagtcttaccttgagaacccagcgttcatgctgctcgatctgaagtag

SEQ ID NO: 220764 - DNA, 5285 bp, Artificial Sequence
  Description of Artificial Sequence: Synthetic coding sequence
atgcaatttcagctgactctcttcctgcatctgggctggctgtcctattccaaggctcaggacgactgcaatagaggggcatgccatcctaccaccggcgatctcctggtcggacgtaacactcagctgatggcctcctccacatgcgggctgagtcgcgcacaaaaatattgtatcctcagctatctggagggcgagcaaaaatgctttatctgtgacagcagatttccatacgacccgtatgaccagccaaattctcataccatagagaatgtcattgttagtttcgagcctgacagagaaaaaaaatggtggcaaagtgaaaacgggctggaccatgttagcatccgccttgacttggaggctttattccggttcagtcacttaatcctgacatttaagacttttaggccagcggcaatgctggtggagcgctcaactgattacggccacaattggaaggtgttcaagtattttgcgaaagactgcgcgacatcgtttcccaatattaccagcgggcaagcccagggagttggggatattgtatgcgactctaagtacagtgatatagaaccgtcaactggaggtgaggtggtactgaaggtgcttgacccctcttttgaaattgaaaacccttattcaccttatattcaggacctggtgactctgactaacctgaggatcaacttcacaaaactgcacacgttgggagatgccctgcttggacgtagacagaatgattctctcgacaagtattactatgcattatatgagatgattgttaggggctcatgtttttgcaatgggcatgccagcgaatgtaggcctatgcagaagatgcggggagacgtgttttcccccccaggcatggtgcacggccagtgtgtgtgtcaacacaataccgacggcccaaattgtgaaaggtgtaaggatttcttccaggatgcaccttggaggcctgctgcagatctgcaggacaatgcctgcagaagctgctcctgtaattcccattccagcaggtgccatttcgacatgacaacgtatctggcttctgggggattatctggcggtgtgtgcgaggattgtcagcacaacacggaagggcagcactgcgaccggtgtcgacctctgttttacagagatcctttgaaaaccatttccgacccatatgcatgcattccatgcgagtgtgacccagatggtacaatctctggaggaatctgtgttagccactctgatccggcactgggctctgtggccggacaatgcctctgcaaggagaatgttgagggagctaaatgcgaccagtgcaagccgaatcactacgggttgtctgctacagatcccctcggctgtcaaccatgcgactgtaatcctttaggatcgcttcccttcttgacatgtgacgttgataccggccagtgcctctgtctgtcttacgtgaccggggctcattgcgaggagtgcactgtgggctattggggactcgggaatcatcttcatgggtgctctccctgcgactgcgatattggcggtgcttactccaatgtgtgttcgcccaagaacggccaatgcgagtgtcgccctcacgttacaggtcggagttgcagcgaacctgctccaggctacttctttgccccactgaatttttacttgtatgaagctgaggaggccaccacgctgcaagggctagctccgctcgggtccgagacgtttggtcagtctccagctgtacacgtggttctgggggagccagtcccagggaacccagtgacctggaccgggcctgggtttgctcgggttctgcctggagccggtcttaggttcgcagtgaacaacatcccatttcccgtcgactttactatcgcaatccactacgagacacagtccgcggctgattggacagtacaaattgtagtgaatcctccgggaggtagcgagcactgtattccaaagaccctacagtccaaaccacagagtttcgccctccctgctgccacgcggattatgctgctgcccacccctatttgtttggagccggatgtgcaatattcaattgacgtatatttttcacagccgctgcagggggaatctcacgctcactcacatgtgctggtcgattctctgggcctcatccctcagattaactctctggagaacttttgcagtaagcaggacctggacgaataccagctgcataattgcgtcgagatcgcaagcgcaatgggccctcaagtgttacctggagcctgcgaacgcttaatcatctccatgagcgccaaactgcatgatggagccgtggcctgtaagtgtcatccacagggaagcgtgggctccagttgcagtagattaggtggtcaatgtcagtgtaagcccctggtcgtgggcagatgttgcgataggtgctcgaccggctcttatgatctaggtcaccacggttgtcatccttgtcattgccatccgcaggggagcaaggatactgtgtgtgaccaggtaacaggccagtgtccgtgtcatggagaggtgagtggcaggaggtgcgaccgctgtctcgccggttactttgggttcccatcgtgtcatccctgtccttgtaaccggtttgcagaactgtgtgacccagagacaggatcctgctttaactgtggaggctttaccactgggcgtaactgtgagcgttgtatcgatggatattacggtaatccttcctcggggcagccttgtagaccctgcctctgtccagatgatccttcttctaatcagtacttcgcacattcctgttatcagaacctgtggagtagcgatgtcatctgtaattgcctccagggatatactggcactcagtgtggtgagtgttctacaggattctatggcaatccccgtatcagtggcgctccatgccagccctgtgcgtgtaacaacaacatcgatgtgaccgatcccgaaagctgttccagggttactggcgaatgtctgaggtgcttgcacaatacccagggcgcaaactgtcagctgtgcaaacccggacactacggctcggccctgaaccagacctgccggaggtgcagctgccatgcttctggagtcagtccaatggagtgtccccctggcggtggagcctgcttgtgcgatcccgtgactggagcatgtccctgcctacccaatgtaacaggtctagcttgcgatcggtgcgccgacggctattggaaccttgtgcccggacgcggatgtcagtcatgcgattgcgatccgagaacgagccagagtagccactgcgaccagctgaccggccagtgtccgtgcaaattaggctacggaggaaaaaggtgtagcgagtgccaggagaattattacggagatccaccgggaaggtgtatcccctgtgactgtaatcgcgctggaacccaaaaacccatttgcgacccggatactggtatgtgccgttgcagagaaggggtgtccggtcaaaggtgtgaccggtgcgccagaggacactcccaggaatttcccacctgtctgcagtgtcatctctgttttgatcagtgggaccacacaattagcagcttaagtaaggctgtccagggtctcatgcggcttgcggctaacatggaagataaacgtgagactctgccagtgtgcgaagctgatttcaaagacctgcgagggaacgtcagtgaaattgaacgaatcttgaagcacccagtgttcccctccgggaaatttctcaaagtgaaagactatcatgattccgttcgccgtcaaatcatgcagctgaacgaacagcttaaagccgtctatgagtttcaggatttaaaagacactattgaacgggcaaagaacgaggctgatctgttgctggaagatcttcaggaagaaattgaccttcagtcctccgtgcttaatgctagcatcgctgactccagcgagaacatcaagaagtattaccacatatcttcttctgccgagaagaagatcaatgaaactagcagtaccattaacacctctgcgaatactagaaacgaccttttgactatcctggacaccctcacatcaaagggaaacctctcactggaaaggctaaagcagattaagatccctgacatacagatactaaacgagaaagtgtgcggcgaccctggtaacgtcccgtgtgtcccccttccgtgtggaggggctctgtgcacaggcagaaaaggacatcgaaaatgcagggggcctggttgtcatgggtccctcaccctgtcaactaacgcgctccaaaaagcgcaggaggccaaatctatcatccgcaacctggacaagcaggtgcgcggtctgaagaaccagattgagagcatttctgagcaggccgaagtcagtaaaaataacgctctgcaacttagagagaaacttggtaatatcaggaaccagtctgacagcgaggaggagaatattaaccttttcataaaaaaggtaaagaattttctactggaagagaacgttccacctgaagacatcgagaaagtcgctaatggggttctggatatacacctgccgattccctcccagaacctgaccgacgagcttgtgaaaattcagaagcatatgcagctgtgtgaagattatcgaacagacgagaaccggttaaacgaagaggccgacggtgcccagaagctcctagtgaaggccaaggccgctgaaaaagccgcaaatattctgttgaatctggacaagactctgaaccagctacaacaggcccagattacccaagggcgtgccaattcaaccataacgcaactgaccgctaatattactaaaatcaagaagaatgtgcttcaggccgagaaccagacaagggaaatgaaatccgaattggagcttgcaaagcagagaagtgggctggaggatggcttgtcattgttgcaaacgaagctacagcggcatcaggaccatgcagttaatgccaaggtccaggccgaaagcgcccagcaccaagccggtagtctggagaaggagtttgtagaactgaagaagcagtacgccatcctccaacgcaaaacatctactacggggctgactaaagaaaccttgggcaaagtcaagcagttgaaagatgctgccgaaaagctcgctggagacactgaagctaagatcagacggatcaccgatttagagcgaaaaatccaggacctgaatctcagccgtcaggctaaggctgatcagctccggatactcgaagatcaggtggtcgccataaaaaatgagatcgtggagcaggagaaaaagtacgcgcgttgctacagtta

SEQ ID NO: 220765 - DNA, 1530 bp, Artificial Sequence
  Description of Artificial Sequence: Synthetic coding sequence
atgcagagctggagccgggtctattgctcactggccaagcgcggtcatttcaatcgtatctcacatggccttcaaggtctgtctgcagtccccttaagaacttatgctgaccaaccaatcgatgctgacgtgaccgtgatcggctcaggccctgggggatacgtagctgcgatcaaggccgctcagctcgggtttaaaacagtgtgcatcgaaaagaatgaaacactgggcggtacttgcctcaacgtggggtgtatcccctcaaaggcactcctgaacaacagtcactattaccacatggcacacggaaaggattttgcctcaaggggtatagagatgagtgaggttcgcctcaatctagataagatgatggagcaaaaaagcaccgctgtgaaggcccttaccggcggaatcgcccatcttttcaagcagaacaaggtagtccatgttaatggttatggtaaaattacaggcaaaaaccaggtgacagcaaccaaagccgacggaggcacccaggtgatcgataccaaaaacatcctgattgccacgggctctgaagtgacaccatttcctggtatcacaatcgacgaagacaccatagtttcgtcgaccggcgctctctctttgaaaaaagttccagagaaaatggttgttataggggcaggtgttataggggtcgagcttggtagtgtatggcagcgtttgggtgcagacgtaactgcagtagagtttctgggacacgtgggtggggtcgggattgatatggaaatttcaaagaacttccaaagaatcttgcagaaacagggctttaagtttaaactaaataccaaagtcaccggagctacaaagaagagcgacggtaaaattgacgtcagcatagaagcagctagcggcggaaaagcagaagtcatcacttgcgacgtactgctagtgtgcatagggagaagaccattcactaaaaacctagggctggaagagctggggattgaactggatcccagggggagaatcccagtgaacacccgtttccagactaaaatccccaatatctacgccatcggagacgtcgtggccggacctatgcttgcccacaaggccgaggacgaaggcatcatatgcgtggagggaatggccggtggcgctgtccatattgattataactgcgtcccttcagtcatatacacccatccagaagtggcttgggtgggaaaaagcgaggagcagttaaaggaggaaggtatcgaatacaaagtgggcaagttccccttcgctgctaattcaagggccaagacaaacgcagatactgatggcatggttaaaatcctgggacagaagagtacagatcgggtcctcggggcacatatcctgggcccaggcgctggcgagatggttaatgaggctgccttagccctcgaatacggcgcttcttgcgaagacatcgccagggtttgccacgcacaccctaccctgtctgaggcattcagagaggccaatcttgcagcttctttcggcaagagcataaatttctag

SEQ ID NO: 220766 - DNA, 1386 bp, Artificial Sequence
  Description of Artificial Sequence: Synthetic coding sequence
atgcagagttggagcagggtttattgttctctggccaaaaggggccattttaaccgcatctcacacggacttcagggtctatctgccgtgcctctccggacttacgcagaccaacctattgatgccgacgttaccgtgataggcagcggacccggtggttacgttgccgcaattaaggccgctcaattaggatttaagacagtgtgcatagagaagaacgagactctgggcggaacttgccttaacgtgggctgcataccttcaaaggcgctgctgaataatagccattactatcatatggcacacgggaaggatttcgcttcgagaggcatcgagatgagtgaagtacgtcttaaccttgataaaatgatggaacagaagtccaccgctgtcaaggcccttaccggaggaattgctcacttatttaagcagaataaaatagacgaggacactatagtttcctcgaccggtgcactgtctctcaagaaggtcccagagaagatggttgtgataggagcgggtgttattggagttgagctgggcagcgtgtggcaacggttgggggctgacgtgaccgctgttgaattcctgggtcacgtggggggagtaggaatcgatatggaaatatccaagaactttcagcgcattctgcagaagcaggggttcaagttcaagctgaacaccaaagtcaccggagcaacaaagaagtctgacgggaagatagacgtgtcaatcgaagctgcgtccgggggaaaggcggaagtgattacatgtgatgtgctgctggtctgcattgggaggcgaccgtttacaaaaaatctgggcctggaggaactgggcatcgaactagatccaagaggacggatcccagttaacacaagatttcagactaagatcccaaacatctacgccataggggatgtggtcgccggtccaatgttagcacacaaagccgaagacgaagggattatctgtgttgagggcatggctggcggagccgtgcatatcgattataattgtgtcccctcagtcatctatactcacccagaagttgcctgggtgggaaaaagtgaagaacagctgaaagaggaagggatcgaatataaggttggcaagttcccttttgccgctaactcgagagcgaagacgaatgccgatactgatggcatggtgaagatccttggacagaagtcgactgaccgcgtgttaggggctcacatcctcggcccaggtgctggagaaatggtgaatgaggccgcactggcattggagtatggcgctagctgcgaagacatcgcccgagtatgtcatgctcaccctacactgtccgaagcctttcgcgaggcgaacttagctgccagttttggcaagagtattaatttctag

SEQ ID NO: 220767 - DNA, 1461 bp, Artificial Sequence
  Description of Artificial Sequence: Synthetic coding sequence
atgcaaagctggtccagggtgtactgttctctggcaaagcggggacattttaatcgaatctctcacgggctccaaggcttgtctgccgtgccactccgtacttacgctgaccaacctatagacgctgatgtcacagtcattggaagcggacccggtggctacgtggcagcaattaaagccgcacaactgggctttaaggccctgctgaataattcgcattactaccacatggctcatggtaaagatttcgccagcaggggaattgagatgagcgaagttcgactgaatctggacaagatgatggagcagaaatccactgccgtgaaggcactgacgggcggtatcgcccacctcttcaagcaaaacaaggtggttcacgttaatggttatgggaagatcaccgggaagaaccaggtcaccgctacaaaggccgacgggggtacccaggtgattgataccaaaaacatcctgatcgctaccggatccgaagtgactcctttccctgggatcactatcgacgaggacacaattgtttcctctaccggagcgctcagcctgaaaaaggtgcctgaaaagatggtcgttatcggagctggtgtgatcggggtggagctgggctctgtttggcaacgccttggggcagacgtaaccgcggtggaattcctcgggcacgtgggaggagtgggaatcgatatggaaataagtaagaattttcaacggatcctccagaagcaaggtttcaagtttaaactgaacactaaggtgaccggcgcaaccaagaagtctgacggcaagattgacgtgtccatcgaggcagcctccggagggaaagcagaagtcattacatgcgatgtcctgctcgtatgcattggacgccgaccattcactaagaatctcgggctcgaggagctaggtatagagcttgatccacggggtcgtatcccggttaatacgaggtttcagacaaagatccccaacatttacgccatcggtgacgtggtggcgggacccatgctggctcataaggcagaggacgaaggtatcatctgtgtggaggggatggcaggcggagccgttcatatcgactacaattgcgtgccttctgtcatttacactcatcccgaagtagcctgggtgggaaagtccgaagaacaattaaaggaagagggcattgaatacaaagtcgggaagttcccttttgctgctaatagccgcgctaaaaccaatgctgacactgacggtatggttaaaatcctgggacagaaatcgaccgaccgagtgctgggggcacatatcctcgggccaggcgcaggtgagatggtcaacgaggccgcactggctttggagtacggggcatcatgcgaggacattgcacgggtgtgccacgcgcacccaactctgagtgaagcgttcagggaagcgaacttggccgcaagcttcggcaagtctatcaacttttag

SEQ ID NO: 220768 - DNA, 1233 bp, Artificial Sequence
  Description of Artificial Sequence: Synthetic coding sequence
atggcccatggaaaggactttgcaagccgcggtattgagatgtctgaggtgcggttgaacttagataagatgatggaacaaaaatcaaccgcggtgaaagccctcaccggcggaatcgcgcatctgtttaagcagaacaaagtagtccacgtgaatggatacggcaagatcactggtaaaaatcaggtaaccgctaccaaggccgacggcggtacccaggttatcgatacaaaaaacatcctcattgccaccggctcagaagtgacaccttttccgggaattactattgatgaggacaccatagtttctagcacaggggcactcagcctgaaaaaggtccctgagaaaatggttgttattggtgctggggtgattggagtggaactggggtctgtctggcagagacttggagcagacgtgaccgcagtcgagtttcttggccatgttggaggcgtgggaatcgacatggagatcagtaagaacttccagaggattttacagaagcaggggttcaagttcaagctgaatacaaaagtaacaggagcgaccaagaagagcgatggaaagatcgatgtctccattgaggccgcttctgggggtaaggcagaggtgatcacatgtgacgtgctgctcgtctgcattggacgcaggcctttcacgaagaatctcggtctggaggagctgggcattgagttggatccgcgagggaggattcctgttaacacacgtttccagactaaaatacccaatatctacgcaataggagatgtcgtggcaggcccaatgctggcccacaaagctgaggatgagggaataatatgtgtagaaggaatggctggtggggctgtccacattgattacaactgtgtcccgtccgtgatctatacacaccctgaggttgcctgggtaggaaagagtgaggagcaattgaaggaggagggcatcgagtacaaggtcggaaaatttccctttgccgctaacagtcgggctaagacaaacgcagatacagatgggatggtgaagattttaggccaaaagtctaccgatcgtgtcctgggggcacacattctcggccctggagccggtgaaatggtcaatgaggcggctctggcgctagaatatggcgcatcctgcgaggatatcgcgagggtatgccacgcgcatccaacactcagcgaggcttttcgagaggcgaaccttgccgcaagctttggcaagagcattaatttctag

SEQ ID NO: 220769 - DNA, 1380 bp, Artificial Sequence
  Description of Artificial Sequence: Synthetic coding sequence
atgctgatctacgtagccgctatcaaggccgcacagttgggcttcaagactgtctgcattgaaaagaatgaaaccctaggcggaacctgcctgaacgtcggatgtattcccagtaaagcattgctcaataacagccattattatcacatggcacacggcaaggactttgcaagcagagggatcgagatgagcgaggtgaggctgaatttggacaagatgatggaacagaagagcactgccgtgaaggccctcacaggtggcattgcccacttattcaagcagaataaggtggtacacgtgaatggttatggcaaaattaccggcaagaatcaggtgacagccacaaaagctgatgggggaacccaggtgattgacacgaagaatattctgatcgcaacggggtctgaggtaacccctttccctgggattacaattgatgaagacactatcgtgtcgtccacaggcgcactttccctaaaaaaagttcctgagaagatggtggttataggagccggagtgatcggagtggagctgggatccgtttggcagcgcctaggagctgacgtgaccgcagttgaatttctaggacatgtgggcggagtgggcattgacatggaaatctctaaaaacttccaaagaattctgcagaaacagggcttcaaattcaaattgaacacaaaagttaccggcgcaacaaagaaatcggacgggaagatcgatgtctccatcgaggcagcaagcggcggaaaggctgaagtgatcacatgcgatgtcctgctggtgtgcataggtcgcaggccttttaccaagaatctcgggcttgaagaactgggcatcgaattggacccaaggggccgaatccctgttaataccaggttccagaccaagatccctaatatctatgcgatcggagatgtggtggccggacccatgcttgcacataaggccgaagacgaaggaattatctgcgtagagggcatggccggaggcgctgtgcatatcgactacaactgtgtgccgtctgtgatctatacccatcccgaggtggcctgggtggggaaatcagaagagcaactcaaggaggaaggtattgagtacaaggtaggtaaattccctttcgctgctaattctcgggctaagacaaacgctgacacagatgggatggtgaagattctggggcaaaaatctacagacagggttctgggcgctcatattttggggcctggggcaggtgagatggtaaacgaggccgcattagccttagagtacggcgctagctgcgaggacattgcaagggtatgtcacgcgcacccaactctgagcgaagcttttagagaagctaacctagccgctagttttggcaagtcaataaacttttag

SEQ ID NO: 220770 - DNA, 1944 bp, Artificial Sequence
  Description of Artificial Sequence: Synthetic coding sequence
atgtggcgggtatgcgcccgacgagctcagaacgttgcaccctgggctgggctggaagcaaggtggacagccctccaggaggtccctgggacgcccagggtcacaagtcgctccgggcctgcccctgctcgcagaaattccgtgacaacggggtacggaggcgtgagggctctctgcggatggactccgtctagcggagccacccccaggaaccgactgcttcttcagctccttgggtctcctggcaggaggtactattccctgcccccacatcaaaaggttcctctgccctctctcagcccgacaatgcaagccggaactatcgcccgatgggagaaaaaggagggtgacaagattaatgaaggcgatctgattgcggaggttgagaccgataaggccacggtcggattcgagtcactcgaggagtgttatatggccaaaattctcgtggcggagggcactagagatgtgccaattggagctatcatttgcattacggtggggaagccagaggacattgaggccttcaaaaattacactctcgactcctctgccgcacctacaccacaggccgcacccgctcctaccccagctgctaccgcctcgcctccaaccccatccgcccaggcgcctggcagctcatatccaccccacatgcaggtgctgttaccggctctgtctccaacaatgacgatgggtaccgtccaacgctgggagaagaaggtcggcgagaagttgtccgagggcgaccttttggctgagattgaaaccgataaggcaaccatcggcttcgaggtccaggaagaaggatacctcgctaagatcttggtacctgaggggaccagagacgtacctctgggcacccctttatgcataattgtggagaaagaagcagatatttccgcctttgccgattataggcccactgaggtcacagacctcaaacctcaggtccctccccctacaccccctcctgtcgctgctgttcctcccacccctcagcccctggccccaactccttctgccccttgtccggctacccctgccggacctaagggcagagtgtttgtgtccccactggccaagaagttagccgtggagaagggcatagatctcacacaggtgaaaggaaccggcccagatgggaggataacaaagaaggatatcgactcattcgttcctagcaaggtggctcccgcacctgccgcagtagttccgccaaccggacccggtatggccccagtgccaaccggtgttttcaccgacatcccaatctccaacatcaggagggttattgcacagcgcttaatgcagagtaagcagacaattccccattattatttgtctatcgacgtgaacatgggagaggtcttgctagtgcggaaagagctcaacaaaatcttggaaggacgcagtaagattagcgttaacgatttcatcatcaaggcttccgctttggcttgcctgaaggttcccgaagcaaactcctcttggatggataccgtcattcgacagaaccacgtggtggacgtctctgttgctgtatctacccccgcagggctgataacgcccatcgtgttcaacgctcacatcaagggggtggagaccatcgcaaatgatgtggtgagcctcgctactaaggcccgagaggggaagcttcaaccacacgagttccagggaggcactttcaccatttctaatctcgggatgtttggcattaaaaactttagcgctataatcaaccccccacaagcctgtattctggccatcggcgcatccgaggataagctagtccctgccgacaacgaaaagggctttgacgtggcttcaatgatgtctgtcactttgtcctgtgaccaccgcgtggtcgatggggctgtgggcgcacaatggctggctgaattcaggaagtaccttgagaagcctatcaccatgctcttatag

SEQ ID NO: 220771 - DNA, 678 bp, Artificial Sequence
  Description of Artificial Sequence: Synthetic coding sequence
atgtggagagtttgcgccaggcgagctcaaaatgttgccccatgggctgggctggaagcccgatggactgccctgcaggaagttcccggtaccccaagggtgacctcacgctctggtcctgcacccgctcgacgcaactccgtgacaaccggatatgggggagttcgggctctctgcggctggactccatcgtctggagccaccccgcgaaaccgcctgctcctgcaactccttggttcccctggcagacgatactattcactgccccctcaccagaaagtaccactgcctagcctttcccctaccatgcaagccggaacaattgccagatgggagaaaaaggagggggataagatcaatgagggggacctgatagctgaggtcgagaccgacaaggcaactgtaggcaaaccagaagacatagaggcttttaaaaactatactttggactcatctgcggctccgaccccccaggccgctcccgctcctacccccgctgctacagcaagtcctccaaccccaagcgcccaggcgcctggttccagctaccccccacacatgcaggtccttctgccagccctgagtcctaccatgaccatgggtaccgtccaaagatgggagaaaaaggttggtgagaaactgagtgagggcgacctgttggctgagatgtctttatag

SEQ ID NO: 220772 - DNA, 1257 bp, Artificial Sequence
  Description of Artificial Sequence: Synthetic coding sequence
atgcaggcgggaaccatagcccgttgggagaaaaaagagggggataaaattaacgagggcgatttactggcagagatcgaaacagataaggctacaattgggttcgaagtgcaggaagaagggtatctggccaagatccttgtgcccgagggcacacgagacgtgccacttgggacacctctctgtatcatcgtggaaaaggaggccgacatatccgcttttgcagattacaggcccactgaggttacggatcttaagcctcaggttccacctccaacccctccaccagtcgccgctgtgccacccacacctcagcccctggctcctacgccatcagccccttgccctgcaacccctgctgggccaaaaggaagagtcttcgtgtctcccctcgcaaaaaaactcgcggtagaaaagggcattgatcttacgcaagtgaaaggcaccggccctgatggtcgtattaccaaaaaggacatagacagcttcgttccttcaaaagttgctccagcaccagccgctgtggtcccccctactggacctggtatggccccagtgcccactggtgtttttaccgacatcccaatcagcaacataaggagagtgatagctcagaggctcatgcagtccaagcagactatccctcactactatctaagtatcgacgtaaatatgggcgaggtcctgctggtgaggaaggagcttaacaagatcctggaaggaaggtccaaaatttcagtgaacgactttattatcaaggctagcgcccttgcctgtctgaaggtcccagaggccaattcctcctggatggacactgtgattaggcaaaatcatgtcgtggacgtgagtgtcgccgtgagtacgccagcaggtcttattacacccattgtgttcaatgcccacattaagggggtggagactatcgctaatgacgtagtcagccttgccacgaaggctagagaaggcaaacttcagccacacgaattccagggaggaacattcacaatctccaatctggggatgttcgggatcaagaatttcagtgcaattattaacccccctcaggcctgcattctcgccataggcgctagcgaggacaaactcgtgcctgctgacaacgagaaggggttcgacgtggccagcatgatgagcgtaacactgtcctgtgatcacagggtagtcgatggcgcagtgggagcccagtggctggccgaatttcgcaagtatctggagaaacccatcacaatgctgctgtag

SEQ ID NO: 220773 - DNA, 1104 bp, Artificial Sequence
  Description of Artificial Sequence: Synthetic coding sequence
atgacatggctgcagtcaaagccacaaagactccaaaacctctctcagagggaaatgagcggaggccgaaagacatccgttcaggtaccaagtccagctaacggcgtaatcgaagcgctgctggtgccagacggcggaaaggtagaaggcggaacccccctgtttactctgaggaaaaccggagccgctccagcaaaggcgaagcccgcagaagcccctgcagccgcagcgccaaaggctgaacccacagctgccgcagtgccccctccagcagcacctatccccacccaaatgccccctgtcccgagccccagtcagcccccatctggaaagcccgtgagcgccgtgaaacccaccgtagcaccccctctcgctgagcctggggctggcaagggcttgcgttccgagcacagggagaagatgaaccgcatgaggcagcggattgcccagcgtcttaaggaggcccagaacacctgcgcaatgctcaccacgtttaacgagattgacatgagtaatattcaagaaatgcgagcgcgacacaaggaagccttcctgaaaaagcacaatctcaagctcggctttatgagcgcattcgtgaaggcgagtgcatttgctttacaagaacagcctgtcgtgaatgcggtgatagacgatactacaaaagaagtcgtttatagggactacattgacatcagcgtggcggtcgccactcctaggggtctggtggtgcctgttatccggaatgtggaggctatgaacttcgccgacatagaacggaccattaccgagcttggcgagaaggcgaggaagaacgaactggcaatagaagatatggatggcggtacttttacaattagtaacggaggagttttcgggtccctcttcgggactcctataatcaacccccctcaaagcgccatactgggcatgcacgggatcttcgaccggcctgtagccattggcggaaaggtcgaggtgcgcccaatgatgtacgtggctttgacttatgaccaccgccttatcgacggcagggaagccgtgacttttctgagaaagatcaaagccgctgtcgaagatcccagagtgctgctgttggatctatag

SEQ ID NO: 220774 - DNA, 1362 bp, Artificial Sequence
  Description of Artificial Sequence: Synthetic coding sequence
atgctgagtcgctcacggtgcgtctctagagccttctcacgcagtctgagtgccttccagaagggcaactgccctctgggtagacgttcactgccaggggtgtcactctgtcaggggcctgggtatcctaacagtcgtaaggtggtgatcaacaacagtgtattctctgtgaggttctttcggacaaccgcagtgtgtaaggatgacctggtgacagttaagacgcccgcatttgccgaatcagtcactgaaggcgacgttcgatgggaaaaagctgtaggtgacacagtcgctgaggacgaggtggtatgcgagattgaaaccgataagacctcagtacaggtacctagtcctgccaatggtgttattgaggctctcctggttcccgatggcggaaaggtggaaggcggaacaccgctgtttaccctaagaaagaccggagccgctcctgccaaggcaaagcccgcagaggccccagcggcagcagcaccgaaagcagagcccaccgcggctgcggtgcctcctccagctgcccctatccctacacagatgcctcctgtaccttctccgtctcagcctcctagcggcaagcctgtgtctgcagtgaagcccaccgtcgcaccaccactcgccgaacccggtgcagggaaaggcctgagaagcgagcaccgcgaaaaaatgaataggatgcggcagcgcattgcgcagagactaaaggaggcccagaatacctgtgcaatgctgacgactttcaacgagattgacatgtccaacatacaggagatgagggcaagacataaagaggcgtttctgaagaaacataacctgaaattaggtttcatgagtgctttcgttaaagcctccgccttcgccctccaagaacaacccgttgtgaacgcagttatcgatgatacaaccaaggaagtcgtctatagggactatatcgatatttcagtggctgtcgcaacccccagaggactggtggtgcccgtgataaggaacgttgaagcaatgaatttcgccgatattgagagaacaatcactgaactcggtgaaaaagcgcgaaagaacgagctggccatagaagacatggatggagggacctttaccatctctaacggcggagtgttcggaagcctgttcggcactcccatcataaaccctccccagagcgcgatcctcggcatgcatgggattttcgatagacctgtggccattggcggaaaggttgaagtgcgcccaatgatgtatgttgctctcacttacgatcacagattaattgacggacgagaggcagttacctttctgaggaagatcaaggctgcagtggaggaccccagggtgctgctgctcgatctgtag

SEQ ID NO: 220775 - DNA, 282 bp, Artificial Sequence
  Description of Artificial Sequence: Synthetic coding sequence
atggacagacttcagacagcgttgcttgtggtgttggtccttctggccgtggcattgcaagccactgaggctggcccttatggcgcaaacatggaagacagtgtgtgttgtcgggattatgtccgctaccggctgccgctgcgtgtggtgaaacatttttactggacaagtgattcttgtcctagacctggggtcgtacttctcacattcagggacaaggaaatctgtgcagatccacgagtgccctgggtgaaaatgatcctcaacaaattgtcccagtag

SEQ ID NO: 220776 - DNA, 1560 bp, Artificial Sequence
  Description of Artificial Sequence: Synthetic coding sequence
atggccgcaccgtcccggctactcatacgcggtggcagggttgtgaacgacgacttctccgaagtggctgatgtgttggtggaggatggggtcgtgcgcgctctggggcacgatctgttgcctcccggaggggcacctgcagggctccgggttctcgatgctgccggaaaactggtgttgcccggagggatcgatacccatacacacatgcaattccctttcatgggatcaagatccatagatgacttccatcagggaaccaaagccgctctgtccggtggcacaacaatgatcattgattttgccatacctcagaagggaggatctttgattgaggcgttcgagacatggcgctcttgggctgatccgaaagtgtgttgtgactatagcctgcacgtggcggtgacatggtggtccgaccaggtcaaagaggagatgaaaattctggtccaggacaaaggtgtcaattcatttaagatgtttatggcttataaagatctttatatggtcaccgacctggaactgtacgaggctttctctagatgcaaagagatcggcgcaatcgcccaagtgcatgctgagaacggcgacttgatagcagagggtgcgaaaaagatgctcgccctggggatcactggtcccgaaggccacgagctttgtcggccagaggccgtggaagccgaggccacactgagagcaataaccatcgcttccgctgttaattgcccgctctatatagtgcatgtcatgagcaaatcagcagccaaggtaattgccgatgccagacgcgatggaaaagtggtctacggcgagcctatcgccgcttcgcttggaacagatggaactcactattggaataaggagtggcatcatgcagcacaccatgtgatggggccacctctgcgtcccgaccctagcacccctgatttcctgatgaatttgctggcaaacgacgatttaacaacaactggaactgataactgcaccttcaacacttgtcagaaagctttagggaaagacgactttaccaagatccccaatggtgtgaacggagtggaggatcgcatgagcgtcatttgggagaaaggggtgcactcaggaaagatggacgagaatcggttcgtggctgtgacctccaccaatgccgcaaagatttttaacctgtaccccaggaaggggagaatcgccgtgggatcggatgcagacattgtcatttgggaccccaaggggactagaaccatctcggccaagacgcatcaccaagccgtcaattttaacattttcgaggggatggtctgccacggagttcccctggtaactataagtcgcggaaaggtcgtttacgaggcaggtgtattttcagtcacagcaggcgatggcaaatttattccaagaaagcctttcgcagaatatatttacaaacgcatcaaacagcgggatcggacatgtaccccaacccccgtggaacgcgcaccatacaaaggcgaagttgccacactgaagtcgcgcgtgaccaaagaggacgccactgcaggtacgcgcaaacaggcccatccttag

SEQ ID NO: 220777 - DNA, 1719 bp, Artificial Sequence
  Description of Artificial Sequence: Synthetic coding sequence
atgtcataccagggtaaaaaaaatataccacggatcacaagcgataggttgctgatcaagggtgggaagatagtgaatgacgatcagtccttttatgccgacatatatatggaagatgggttaatcaaacaaatcggcgagaatcttatcgtgcccggaggggtgaagacaatcgaagcccattcgagaatggtaatcccaggtggtatagacgtccacacccggtttcagatgccagatcaggggatgaccagcgctgacgacttttttcaaggaacaaaagctgcacttgccggagggacgaccatgatcatcgaccatgtggtgccagaacccggaacttccttgctggccgcattcgatcaatggagggaatgggccgactcgaagagttgttgcgactactcgctccacgtagatatctccgagtggcacaaaggcatacaggaagagatggaagctttagtgaaggaccatggcgtcaatagcttcctggtgtacatggccttcaaggaccgctttcagttgaccgactgtcaaatctacgaagttctgtctgtgatccgtgatattggagctatcgcacaggtccacgccgaaaacggagacatcatcgccgaggaacagcagcgcatcctcgacctgggcattactggtcctgaaggccacgtattgtccagaccagaggaggtggaggcagaagctgtaaaccgggcaatcaccatcgccaatcaaacaaactgcccactgtatataacaaaggtgatgagtaagtcgtcggccgaggttattgcccaagcccgaaagaagggaaccgttgtttacggtgagcctattactgctagcctggggactgacggcagccactattggtccaagaactgggccaaggccgcagcctttgtaacctctccaccccttagtcctgaccccaccacacctgactttctgaattcactgctctcttgcggtgacttgcaagtgacaggatctgcacactgcacttttaatactgcccagaaggccgtgggcaaggataatttcaccttaattcccgaaggaactaacggtaccgaagaaagaatgtctgtaatttgggacaaggccgtagtgacggggaagatggatgagaatcagtttgtggccgtcacgagcaccaacgcagccaaagtgttcaatctctaccctagaaagggaaggatcgctgtcggatctgacgctgacttggttatttgggatccagattccgttaaaactatatccgccaaaacacataactcctcactcgaatacaatatttttgaggggatggaatgtaggggatccccactcgtcgtcatttctcagggtaagatagtgctagaggatggcacccttcatgtcactgagggctccggtcggtacatccccaggaaaccattcccagacttcgtttacaagagaattaaggcgaggtctaggctcgccgagctgaggggtgtccccagaggcctgtacgacggccctgtgtgcgaagtcagcgtcacccccaagaccgtcaccccggctagctctgcgaagacctctcctgcaaaacagcaggcaccacctgtacgcaatctgcaccagtccggattttcactctccggcgctcagatcgacgacaacatcccgcgtagaaccacgcaacgtatcgtcgcaccccctggcggaagggccaatatcacctcattaggatag

SEQ ID NO: 220778 - DNA, 1611 bp, Artificial Sequence
  Description of Artificial Sequence: Synthetic coding sequence
atggaggatggtctgataaagcagataggggaaaacttgatcgtgcctggaggcgttaagaccatcgaggctcactctcgcatggtcatccccggaggcattgacgttcacacccggtttcagatgccagaccagggcatgacctctgccgacgattttttccagggtactaaagccgctctcgccggtggcactacgatgatcatcgatcacgtggtcccggagcctggtacctcgctcttagcggcatttgaccagtggagagagtgggcagactccaagtcctgttgtgactattctctccacgttgacatttcagagtggcacaaaggcatccaggaggaaatggaagctctggtgaaggatcacggcgtaaactcgttcctcgtgtacatggccttcaaggaccggttccagctgacggactgccagatttacgaagtcctcagcgtgatcagggacatcggtgcgattgcccaggtgcacgctgagaatggagatatcattgcggaggagcagcagcgcattctggatttaggaattacggggcctgaaggacatgtgttgtcccgccctgaggaagtggaggccgaagcagtgaatagagccataaccatagccaaccaaacaaattgcccactctatataacaaaagtcatgtcgaaaagttccgccgaagtcattgctcaggcacgaaagaaggggacggtggtttatggcgagcccataactgcgagcctggggaccgacggttcccactattggtcaaaaaactgggcaaaagccgcagcctttgttacttccccccctttaagccctgacccgaccactcctgacttcctcaatagtctcctgagctgcggagacctccaggttaccggcagtgctcactgcacctttaacacagcgcagaaggccgttggcaaggacaactttaccttaattcctgagggaacaaacggcacggaggaacggatgtccgtgatctgggataaagctgtggtgaccggaaagatggatgaaaaccaatttgttgctgtcacaagcactaacgctgcaaaagtgtttaacctgtatccaagaaagggacgcatcgctgtaggtagcgatgccgacctggtcatttgggatcctgatagcgtgaaaaccatttctgccaagacacataactcttcccttgaatataatattttcgagggtatggagtgccgcggttctccgttggtcgtgatctcacaagggaagattgtgctggaggacgggaccctgcacgtaaccgagggttccggcaggtacattccgaggaagccttttcccgacttcgtttacaagaggattaaagccaggagtcggctggccgaactgagaggggtgccaaggggcctctacgacggccctgtctgtgaggtgtctgtgactccaaagaccgtgacaccagcttccagcgctaagacatctcctgccaagcagcaggcaccacccgtgcgtaatcttcaccagtccggcttcagtctgagtggcgcacagatcgatgataacataccgaggcgaaccacgcagaggatcgtggctcctcccggaggcagagccaatatcacatcactggggtag

SEQ ID NO: 220779 - DNA, 1719 bp, Artificial Sequence
  Description of Artificial Sequence: Synthetic coding sequence
atgtcataccagggtaagaagaacattccacgcataacctcggaccgcctccttatcaaaggcggtaaaatcgtgaatgacgatcagtccttctatgccgatatctatatggaggacgggctgatcaaacagattggtgagaatctaattgtgccaggcggtgtcaaaactatcgaggcccacagtcgcatggtcatcccagggggtatagatgtccacacccgattccagatgcccgatcagggcatgacatctgctgacgattttttccagggaaccaaggccgcactggccggtggcaccacaatgattattgaccacgtcgtgcccgagccaggcaccagccttctggcggcatttgaccagtggcgggaatgggccgattcaaagtcctgttgtgattatagtctccatgtcgatatatcagagtggcacaagggcatccaggaggaaatggaggctctggtgaaagaccacggtgtgaatagttttctggtatacatggcttttaaggacaggtttcagcttactgactgtcagatctatgaagtgctgtccgtgatcagggacataggggcaattgcccaggtgcacgcagaaaatggggatataatcgcggaggaacagcaaaggatcctcgatttagggatcaccggcccagaaggccatgtcctaagtcgacctgaggaagtggaggcagaggcagtgaaccgcgcaatcaccatcgcgaatcagacgaattgcccactgtacattaccaaggtgatgtccaaatcctcggctgaggtcattgcccaggccaggaaaaaggggacagtggtttacggcgaaccaatcactgcatccttgggaaccgatggcagccactattggagcaaaaactgggcaaaggcagctgccttcgtgacctcaccacctctgtcaccagatccgaccacccccgacttcctgaactcattgctctcatgcggcgatttacaggttaccgggagcgcacattgcactttcaataccgcacagaaggccgtgggcaaggataactttactcttattcctgagggtacgaatggaaccgaggaacgaatgtccgtcatctgggacaaggctgtcgtcaccggaaaaatggacgaaaaccaattcgtggcagtgacatccacaaacgctgcaaaggtgtttaacctctatccgcgaaagggccgtattgctgtcggcagtgatgccgatctagtgatctgggatcccgacagtgtcaaaacaatcagtgctaagacccacaactccagccttgagtacaacattttcgaggggatggagtgtcgtggctcacccctggtcgttataagccaggggaagattgtgttggaggatggcactttacacgtgactgaagggtccggaaggtatatacccaggaaacctttcccggattttgtgtacaagcgtataaaggctaggagtcggctggctgaactgcgcggagtgccccgtgggttgtacgacggccctgtctgcgaggtctccgtgactcccaagaccgtcactcctgcctcctcagctaagactagtccggctaagcaacaagcccctcctgtccgcaacttgcatcagtctggtttctctctgagtggcgcacaaatcgatgacaatattccacgcaggactacgcagagaatcgttgcacccccaggaggtcgggctaacatcaccagcctgggctag

SEQ ID NO: 220780 - DNA, 1611 bp, Artificial Sequence
  Description of Artificial Sequence: Synthetic coding sequence
atggaggatggcttgattaaacagatcggcgaaaacctgatagtgccagggggtgtcaagactatcgaagcccattcccggatggtgattccagggggtattgacgttcacacacggtttcagatgccagatcagggaatgacctctgcagatgattttttccaggggacaaaggccgcactggctggagggaccactatgatcattgaccatgtggtgcccgagcctgggaccagcctactggcagcattcgatcagtggcgggagtgggccgactctaaatcctgttgcgactattccttgcatgtggacatttccgagtggcacaagggtatacaggaggaaatggaggctctggttaaagaccatggtgtgaattcattcctggtttatatggcattcaaggacagattccagctgactgattgtcagatttacgaggtgttgtccgtgattcgcgacataggggcaatcgcccaggtgcacgctgagaatggagatatcatcgctgaagagcaacagcggatcctggacctaggcatcactggacctgaaggtcatgtcttgagccggccagaggaggtggaagccgaagcagtgaatagggccatcaccatcgccaaccaaacaaattgcccactgtatataacaaaagttatgtccaaatcctccgctgaggtcatcgcacaagccagaaagaaagggactgtggtttacggagagccgatcactgcttcactcggaacggacggttcacattactggtcaaaaaattgggctaaggcagctgcctttgtgacttctcccccattgagtcctgatcctactacgccagacttcctgaactctcttcttagttgtggagacctacaggtgacaggcagtgcccactgcacctttaataccgcacagaaggccgtcgggaaggacaactttactctgattcccgagggtaccaacggcaccgaggagcggatgagcgtcatatgggacaaagctgtggtgaccgggaagatggatgagaaccagttcgtagcagtcacaagtaccaacgccgcaaaagtttttaacctataccctcggaaaggaagaatcgcagtcggctccgacgcagacctagttatctgggatcccgattcggttaagactatatccgccaagacccataatagcagcctggaatacaacatttttgaagggatggagtgcagggggtctcctctggtcgtcatttcacagggaaaaattgtcctagaagacggcacattacacgtcactgagggatctggacggtacatccctcgtaagccatttcccgatttcgtgtacaagcgcattaaggctaggtcccgactggctgaactgaggggtgttccgaggggcctctatgatgggcctgtatgtgaagttagcgtgacacctaaaaccgtcactcccgcttctagtgcaaagaccagcccggctaagcaacaggcaccgccagtgcgtaatcttcaccagtcgggattcagcctgagcggggctcaaatagatgacaacattccacggcgtaccactcagcggatcgtggctccccctggcggacgggcaaatataacaagccttgggtag

SEQ ID NO: 220781 - DNA, 597 bp, Artificial Sequence
  Description of Artificial Sequence: Synthetic coding sequence
atgagcgtaatctgggacaaggccgtcgttacagggaaaatggatgagaaccagttcgtggcggtgacttctaccaacgctgccaaggttttcaatctatacccaaggaaaggccgaattgccgtagggtctgacgccgatctggtgatttgggatcctgatagtgtcaagactatttttgaggggatggagtgtcgtggatcacccctggtcgtaatctcgcaggggaagattgtgctcgaggatgggacgttacacgtaacggaaggcagcggccgatatatccccaggaagccctttccagactttgtgtacaagagaatcaaagccaggtctagacttgccgagcttcggggagttcccaggggactgtatgatggccctgtctgcgaagtgtccgtaaccccaaaaacggtgacaccagcttcaagcgcaaagacctcccctgccaagcagcaagcccctcctgtgcgaaacctccatcaatcagggttcagcttgtccggagcacaaattgacgataacatacctagacgaacaacacagaggatagtcgcacctcccggaggccgagcgaatatcacctcattaggatag

SEQ ID NO: 220782 - DNA, 2055 bp, Artificial Sequence
  Description of Artificial Sequence: Synthetic coding sequence
atggcttccgggcgacggggatgggactcctcacacgaagatgatctccctgtgtatctggcccgtcccggtacaactgatcaggtgcctagacagaaatatggaggaatgttttgtaatgtggaaggagccttcgagtccaagacgctggattttgacgccctatctgtgggccaaagaggtgccaaaaccccacggagcggacaaggttctgatagagggtcagggtcgcgcccaggtattgagggggatactccgagaaggggtcagggacgcgaagagagtcgtgagcccgctcccgctagccccgctcctgctggtgtggagatcaggtctgctaccggaaaagaggtcctccagaatctgggtcctaaagacaaaagcgaccggctgctgatcaagggaggacgaattgttaacgacgatcaatccttttatgcggacatatacatggaggatggactgataaagcagataggcgacaatctgatcgtgccagggggagtgaaaacaatcgaggctaacggaaagatggtgatccccggaggaattgacgtccatacccatttccagatgccttataagggcatgactacggtggacgactttttccaggggaccaaggccgcactggcagggggaaccactatgattatagatcacgtggtgccagaaccagaatcctccctcactgaggcatatgagaaatggagggagtgggcagatgggaaatcatgttgtgattatgcactgcatgtagatataactcactggaatgatagcgtgaaacaggaagtacaaaacctgatcaaagataagggtgtcaacagctttatggtgtacatggcttacaaggatctgtaccaggtcagtaacacagaactgtatgaaatcttcacctgcctaggtgagcttggcgcaatcgctcaggtgcatgctgaaaatggagacataattgcgcaagagcagaccaggatgctggagatgggaataacaggcccagaaggccatgtcttatcgcgcccagaagagctcgaggctgaggcagtcttccgagctatcaccattgcttcccagaccaactgtcctttatatgtaaccaaggtgatgtcaaagtcagccgctgacctgatcagccaggcgagaaaaaaggggaacgtagtctttggcgagcccatcactgccagcttgggaattgacgggacacactactggtccaagaactgggccaaggccgctgcgtttgtgacaagccctccgctgtcacccgaccccacaactccagactatatcaacagcctgctggccagcggggatcttcaactgagcggttccgcacattgcaccttcagtacagcacaaaaggcaatcggaaaggacaattttaccgcgattcctgagggtacgaacggggttgaggaacgcatgtccgtaatctgggataaggccgtcgcaaccgggaaaatggatgagaaccaatttgttgctgtcacctcgacgaatgccgctaagatttttaatctttatccacgaaaaggccgtattagcgtggggtccgactccgatcttgtcatttgggatccagacgccgttaagatagtctctgcaaagaaccatcagagcgctgccgaatacaatatcttcgagggtatggaactgcgaggggcaccgttagttgtcatttgccaagggaaaattatgctggaggacggcaatctacacgttactcagggggctgggagattcataccctgctcccctttttctgattacgtatataaaaggattaaggctaggcggaagatggctgacctccacgccgttccaaggggaatgtatgacggccctgtttttgatctgacgacaactcctaaggggggtacccccgctggttctgcaagggggtctcccacacgaccaaatccacccgtacggaatctgcaccagtcaggattctccctgagcggcacccaggttgacgaaggagtcagatctgcaagcaagagaatcgtcgcccctcccggaggcaggagcaatattacctccttatcctag

SEQ ID NO: 220783 - DNA, 1713 bp, Artificial Sequence
  Description of Artificial Sequence: Synthetic coding sequence
atgtcatatcagggtaaaaagaacatccctcgaattaccagtgacaggctgctgattaaaggtggcaggatcgtgaacgacgatcagagtttttacgcggatatttacatggaggacggtctgattaagcaaattggggataatctcattgtgcctggcggagtaaaaacaatcgaggctaacggcaagatggtgattcctgggggaattgatgttcatacccattttcaaatgccctacaagggcatgactactgtggatgatttttttcagggcacgaaggccgcactggcaggaggcaccaccatgataatcgatcacgtcgttccggagcctgaaagcagtctgacagaggcctatgaaaaatggagggagtgggctgacgggaaatcatgctgtgactacgcccttcacgtcgacattactcattggaatgatagcgtgaagcaggaagtccagaatcttatcaaggacaaaggcgtcaattcatttatggtgtacatggcgtataaagacctctaccaagtatccaacacagagctatacgagatttttacatgtcttggagagttaggtgccattgcccaagttcatgccgaaaacggagatattattgcccaggagcagaccaggatgctggagatggggatcacaggcccagagggtcacgtgctgtctcgtccagaagaactcgaggccgaggccgtgttccgcgctatcacaatcgctagccagactaattgtcctctctacgtcaccaaggttatgagcaaaagtgcagccgatttgatctctcaggctcggaagaaaggtaacgtagtgtttggcgagccaatcaccgcttcactgggaattgatggcactcactattggagtaaaaattgggccaaagcggcagcgttcgttactagtccccctttgtcccctgaccctacgactcccgattacatcaactcactgctggcgtccggcgacctgcagctgagcgggagcgcccattgtaccttttccacagcccagaaggcaattgggaaggataactttactgccattccagaggggaccaatggcgtggaggagcggatgagcgtgatctgggacaaggctgtggcaactgggaagatggacgagaaccaatttgtggccgttacgagtaccaatgccgcaaagatcttcaacctgtacccccgaaaggggcgaatctccgtggggtcagacagcgacctggtcatctgggaccctgacgctgtgaaaatcgtctcagctaagaaccaccagtctgcagcggagtataacatctttgaggggatggagctgcgcggtgcacccttggtggtcatatgtcagggaaagataatgttggaagacggcaaccttcacgtcacccagggtgcgggacgattcattccttgctcccccttctcagactacgtgtacaaacgcatcaaggctaggcgtaaaatggctgatttacacgcggtgccacggggaatgtatgatggaccagtctttgacctcactaccacaccaaaaggcggaacccccgctggttcagccaggggcagccccactaggccaaatccccctgtcaggaacctgcatcagtccggattctcgctgtcaggtacacaggttgatgagggagtcaggtctgcatctaagcgaatcgtggcgcctcccggtggaaggagcaatatcacctccctcagttag

SEQ ID NO: 220784 - DNA, 279 bp, Artificial Sequence
  Description of Artificial Sequence: Synthetic coding sequence
atgagctatcagggcaagaagaacatacctcgcataacttctgatcggctgttgattaagggcggtcgcatcgttaatgatgatcagtctttttacgccgacatatacatggaagacggcctgattaagcagattggcgacaatctaattgttccgggtggagtgaagacgattgaagcaaacgggaaaatggtgatacctggtggcattgatgtgcatacccactttcaaatgccttacaaaggcatgaccactgtcgatgatttctttcaggggtag

SEQ ID NO: 220785 - DNA, 591 bp, Artificial Sequence
  Description of Artificial Sequence: Synthetic coding sequence
atggacgaaaatcaattcgtggcggtgacctccactaatgccgctaaaatattcaatctgtatcctcggaaaggtaggatttctgtgggaagtgactccgacttggttatttgggacccagacgctgtcaaaatcgtgagcgccaagaatcatcagtctgctgccgaatacaatattttcgaaggaatggagctgcgaggggcaccactggtcgttatctgtcagggaaagattatgctggaggacgggaacctgcatgttacccagggagccggaagatttataccatgttcacctttctccgactatgtgtacaaacgcataaaggccagacgaaagatggccgacctccacgcagtgcccagaggaatgtacgatggccctgtgttcgacctgaccactaccccaaagggaggcacccctgccggttccgctcgcggttcccccacccgtcctaatccccctgtccgaaatctgcaccagtccggatttagtctctctggaacccaggtggatgagggcgtgaggagcgctagcaagcgaattgtagcaccccctggaggtagaagtaacatcacttcactctcatag

SEQ ID NO: 220786 - DNA, 1719 bp, Artificial Sequence
  Description of Artificial Sequence: Synthetic coding sequence
atgtcattccaaggcaagaagagtatccctaggattaccagtgaccggctgctgatacgaggaggccgtatcgtgaacgacgatcagtcattctatgctgacgtgcatgtcgaggatgggctgatcaaacagatcggagagaaccttatcgtccccggaggtattaagacaattgacgcgcacggactcatggtgttgccaggaggggttgacgtgcatacacgtctgcagatgccagtcctgggcatgaccccagccgatgacttttgtcagggaaccaaagctgctctcgccggaggaaccacaatgatactggaccacgtttttccagacacgggagtcagcttgcttgctgcatacgagcagtggagggagagagccgactcagccgcatgttgtgattactctcttcacgtggatatcaccaggtggcacgagtcaattaaggaagaactagaggccctggtcaaggaaaagggcgtgaatagctttctggtgtttatggcctacaaagaccgatgtcagtgcagcgatagccagatgtacgaaatcttctccatcattagggacctcggagcgctggctcaggttcacgccgaaaacggcgatatcgtcgaggaagagcagaaaaggttattggaactgggtattactggacctgagggacacgtgttatctcatcctgaggaagttgaggccgaggcagtatatcgcgctgtgacaatcgccaagcaggctaattgccctctgtacgtgaccaaagttatgtcaaaaggcgctgctgatgctatcgcacaggctaagcgtagaggtgtggtggttttcggcgaaccaattacggcatctctcggcaccgacggatcacactactggagcaaaaattgggccaaggctgccgcatttgtgactagccctccagtgaatcccgatcccaccacggcggaccacctcacatgtttactgagttctggtgacctgcaagtcactggctccgctcattgcaccttcaccacagcacaaaaggcagtcggtaaagacaattttgcactgatacctgaagggaccaatggcatcgaggaacggatgagtatggtgtgggagaagtgcgtggccagtggtaagatggacgaaaacgagtttgtggctgtaaccagcacaaatgcagccaagatttttaacttctacccaaggaagggacgggtggcagttggatccgacgccgatctcgtgatatggaaccccaaggctacaaaaattatctcagcgaagacccataatctcaatgtcgagtataacattttcgagggcgtcgagtgtcgtggtgcgcctgccgtcgtaatttcacaggggagagttgctcttgaagatggaaaaatgtttgtgactcctggcgctggtcgctttgtcccacgaaagaccttcccagactttgtgtacaagcgaatcaaggcaagaaataggttagcggaaatacacggagttccgcgtgggctgtacgacggtccagtgcacgaggtgatggttcctgcaaaacccggtagtggtgcaccagcacgggcatcttgtccaggcaaaatctcagtgcctccagtgcggaatttgcaccagagtggattctccctgtccggctcccaggccgacgaccacatcgcgcgaaggacagcccagaaaattatggccccacctggaggacgtagcaatatcacctctctctcttag

SEQ ID NO: 220787 - DNA, 1239 bp, Artificial Sequence
  Description of Artificial Sequence: Synthetic coding sequence
atgcccgtcctcggcatgacccccgctgacgatttctgccagggcactaaagcagccttggctggaggtacaaccatgatcctcgatcatgtgtttccagacacaggtgtatcgctccttgcagcctacgaacagtggagggaacgagcagactcggccgcatgctgcgattatagtcttcacgtcgatatcacccgctggcacgaatcaataaaagaggaactggaggccctggtgaaggagaagggagtaaattctttcctggtgtttatggcatataaggacagatgccagtgtagcgacagtcagatgtacgagattttttccataatccgcgaccttggagcattagctcaggtccacgcagaaaatggggacatcgtggaggaggtggaggctgaggccgtataccgagctgttaccattgcgaagcaagcaaattgtcccctatacgtcaccaaagtgatgtctaaaggagctgccgatgctatagcccaggccaaacgcaggggcgtggtcgtgttcggcgagcccattactgctagtctcggcaccgatgggtctcactactggtctaaaaattgggctaaggccgctgccttcgtgaccagtcctcctgtgaatcctgatcctacgacagccgaccacctaacctgcctgctctccagtggcgatcttcaggtcacaggaagtgcccattgtaccttcacaacagcccagaaggctgtgggaaaagacaacttcgcgcttatacccgagggcaccaatggaattgaggaaagaatgagtatggtctgggagaagtgtgtggcatccggtaagatggatgaaaacgaatttgtggcagtgacctccacaaacgccgctaagatcttcaacttctaccccaggaagggcagggtggcagtgggtagcgatgctgatctggttatctggaatccgaaggcaaccaaaatcatcagtgccaaaacgcacaacttgcttgccgaaatacatggagtcccaaggggcttgtacgacggcccagtgcatgaggtaatggttccagcgaaacctggatccggggctccagcacgcgcatcctgtcccggtaaaatctctgtaccccctgttagaaatctgcatcagtccgggttttctttaagcggatcccaagccgatgaccatatcgcgaggaggaccgcccagaagatcatggctccacccggaggtcggtcaaacattacctcgctcagctag

SEQ ID NO: 220788 - DNA, 1239 bp, Artificial Sequence
  Description of Artificial Sequence: Synthetic coding sequence
atgccagtcctcggcatgaccccggctgacgacttctgccagggcaccaaggccgctctcgctggcggaaccaccatgatcttggaccacgtgtttcctgacacgggagtgtcgctgctggccgcatacgagcagtggagggaacgcgctgacagtgctgcttgctgcgattactccctgcacgttgacatcacacggtggcacgagagtattaaagaggaactcgaggcgttggtcaaggagaagggggtcaatagttttctggtgttcatggcatacaaagatagatgccagtgcagtgacagtcagatgtacgagatcttctccattatccgcgacctgggtgctctggcccaggtccacgccgaaaacggagatatcgtggaggaagttgaggcagaggcagtctatagggctgtgactatagcaaaacaggctaactgtcctctctatgtgaccaaggttatgtcgaaaggggcagcggacgcaatcgctcaggccaaacggagaggtgtggtcgtctttggcgaacctatcacggccagccttggtaccgacggctcacactattggagcaaaaactgggccaaggccgcagcctttgtgactagtccccctgtgaatcccgatcccaccacagctgatcacctcacatgtttgcttagcagcggagacttgcaggtaacaggttctgctcactgcaccttcaccactgcccaaaaggctgtgggaaaggataacttcgctttgatccctgaaggtaccaatggcatcgaggagcgcatgtccatggtatgggaaaagtgcgtcgccagcggaaagatggacgagaacgaatttgtcgccgtgacctctaccaacgcagcgaagatctttaatttttatcccagaaaaggcagagtagccgtcggcagcgatgctgatctggtcatatggaatccaaaagcaaccaaaatcatcagtgccaaaacacacaacctgctagccgaaatccacggagtacctcggggactctatgatggacccgtgcacgaagtgatggtgcctgctaagccaggaagtggtgccccagcccgtgcctcttgcccaggcaagattagtgtgcccccagttcggaaccttcatcagtccgggttctcactgagcggaagccaggcagacgaccacatcgctagacggactgcccaaaagattatggccccacccggagggaggtccaacattacctcactctcatag

SEQ ID NO: 220789 - DNA, 1695 bp, Artificial Sequence
  Description of Artificial Sequence: Synthetic coding sequence
atgctcgcgaattcagcgagcgttcggatactaattaaaggcggaaaagtggtcaatgacgactgcacccatgaagctgatgtctatattgagaatggcattattcaacaagtgggacgggaactgatgatcccagggggtgccaaagtcatcgacgctactggcaaattggttattcccggtggcatcgacacaagtacgcactttcatcagacctttatgaacgccacatgcgtggatgatttctaccatggaacgaaggctgccttggttggtggcacgaccatgataatagggcatgtgctccctgacaaggagacttcactagtggatgcctatgagaagtgtagaggattggctgaccctaaagtgtgctgcgattacgcactccatgtcgggataacttggtgggcaccgaaagttaaggccgagatggaaaccttggttcgagagaaaggcgtgaactctttccagatgttcatgacgtataaggatctctatatgcttcgcgattccgagctataccaggtgctacatgcctgtaaggatattggggctattgcccgtgtgcacgccgagaatggtgaactggttgcagaaggggcaaaggaagccctcgacctgggaatcaccggtccagagggaattgaaattagccgccctgaagaactggaagcagaagccacacaccgtgtcatcacgatcgcgaacaggacacactgtccaatctatctcgttaatgtatcgtccatttcggccggagatgttatcgccgctgcaaaaatgcagggaaaggtggtgctggcggagaccactaccgcccacgccaccttgaccgggttgcattattatcaccaggattggtcccacgctgccgcatatgtaaccgtgccccctctgagactcgacaccaatacaagtacataccttatgtcccttctagccaatgacaccctgaatatagtagccagtgatcacaggccttttaccacaaagcagaaagccatgggcaaggaggactttactaagattccacatggagtcagtggagtgcaagaccgcatgagtgttatctgggagcgcggagtcgtggggggaaagatggacgaaaaccgatttgtggctgttacgtcgagcaatgcggcaaagctgctgaacctgtacccccgtaagggcagaatcatccctggagcggatgccgacgtggtcgtctgggatcctgaagccacaaagaccataagtgcctctacacaggtccagggaggggatttcaacctctacgaaaacatgcggtgtcacggagtgcctctggtaacaatctctcggggacgcgttgtgtacgaaaatggcgtgtttatgtgcgccgagggcaccggaaagttctgccctctacgttcctttcccgacacagtgtataaaaagctggtgcagcgggagaaaacactgaaggtcagaggtgtggatcgtacaccttacctcggcgatgtggcggtcgtagtgcatccaggcaagaaagagatgggaacacccctggccgataccccaaccagaccagttacccggcacgggggtatgcgcgatctgcacgaatcaagtttctctctgagcggctcacagatcgatgatcatgtgccgaaacgggcatcggcaaggatcctcgctccgcctgggggtagaagcagtggaatttggtag

SEQ ID NO: 220790 - DNA, 1695 bp, Artificial Sequence
  Description of Artificial Sequence: Synthetic coding sequence
atgctcgccaattccgcaagcgtgagaattttgatcaagggcggaaaagtggtgaacgatgattgcactcatgaggccgatgtgtatattgaaaacggcatcatacagcaagtcggcagagaactgatgattcccggtggggcaaaggtgatcgatgccacgggaaaacttgtgatccccggaggaatcgatacctccacccatttccatcagacttttatgaatgctacatgtgtcgacgatttctatcatggaacaaaagctgccctggtgggtggaaccacaatgataataggccacgtgctacctgacaaagagactagcctcgtggatgcatacgaaaaatgtcgtggattggctgacccgaaggtttgctgcgactatgcactgcacgtgggcattacttggtgggcccctaaggtcaaggctgagatggaaactctggtgcgagaaaaaggggtgaactctttccagatgttcatgacttacaaagacctatacatgctccgggatagtgaactgtatcaagtcctgcacgcatgcaaggacatcggggctattgccagagtacatgcagaaaacggcgagctcgtggccgagggtgctaaagaggctcttgatttgggcattacggggcctgagggaatagaaatctcacgacctgaagaactcgaggctgaagcaacacaccgggtgatcactattgctaatagaacacattgtccaatctacctagtgaacgtctccagtatatccgccggagatgtgatagccgctgccaaaatgcagggcaaagtcgtgttggcggagactaccactgcccacgccaccctgactggcctgcattattatcatcaggactggagccatgctgccgcatacgtcacagtgccacccctcagactggacaccaacactagcacttatttaatgagcctactggcaaatgacaccctgaacatcgtagcctctgatcacaggcccttcacgaccaaacagaaagcgatgggtaaagaagattttaccaaaatcccccatggagtgagcggggtacaggaccggatgtcagttatctgggagcggggagtcgtggggggtaagatggatgagaaccgtttcgtggccgtgaccagctctaacgcagcaaaactgctcaatctttatcctaggaaggggaggatcatcccaggcgctgacgcggacgtggttgtatgggatcctgaggctactaaaaccatttctgcctccactcaagtgcagggcggtgactttaacctctacgagaacatgcggtgtcatggagtaccgctggtgactatcagtagggggagggtagtctacgagaatggcgtgttcatgtgtgcagaaggcacaggcaaattctgcccccttcgttcattccccgatactgtttacaaaaagttagtacaacgtgaaaaaacgctgaaggtgaggggcgttgataggaccccctatttgggcgacgttgctgtggtggtgcacccaggcaaaaaggagatgggcacacccttggccgacacgcctactcgacccgtgacccgccatggcggtatgagggatttgcatgagagctccttctcactctctggcagccagattgatgatcacgtgcctaagcgcgctagcgccagaatactcgcgcctccaggcggacgtagcagtggcatctggtag

SEQ ID NO: 220791 - DNA, 573 bp, Artificial Sequence
  Description of Artificial Sequence: Synthetic coding sequence
atgctcgccaactcggcaagcgtgagaatcctcataaaaggcggaaaagtggttaacgacgactgcacccacgaggccgatgtgtacattgagaacggaattatccagcaagtcggccgtgagctaatgatcccagggggtgcaaaggtcatcgacgcaacaggaaagttagtaattccagggggaattgacacaagcacccacttccaccagacattcatgaatgccacctgtgtggatgatttctaccacgggaccaaggctgcgctcgtgggcggaaccacaatgattatcgggcatgtgctcccagacaaggaaacgtccttggtggatgcttacgagaaatgcagaggtctggctgacccgaaagtatgctgtgattacgcactgcatgtcggaattacctggtgggcccctaaagtaaaagccgaaatggagacccttgtgcgtgaaaagggcgttaattcgtttcagatgttcatgacttataaggacctgtacatgctgagagactctgagctgtaccaggtgcttcacgcctgtaaggatataggagctattgcccgtgtctag

SEQ ID NO: 220792 - DNA, 525 bp, Artificial Sequence
  Description of Artificial Sequence: Synthetic coding sequence
atgttggcaaactccgccagtgtgagaatcctgatcaagggcggaaaagtggtcaacgacgattgtactcacgaggccgacgtgtatattgaaaacggaatcatacaacaagtaggccgagagttaatgatccccggtggggctaaagtgattgatgcaacaggaaagctggtgataccagggggaatcgacacttctacccattttcaccagactttcatgaatgccacatgtgtggatgacttttatcatggcactaaggccgcacttgtcggcggaactacgatgattattgggcatgtcctgcctgacaaagagacgtcactggttgacgcctacgagaaatgtcgaggactcgccgatcccaaagtgtgctgtgattatgccctgcacgtagggataacatggtgggcaccaaaagtaaaggccgaaatggaaactctagtccgggagaagggcgtgaatagttttcagatgtttatgacatacaaggatttgtacatgctcagggatagtgagctgtag

SEQ ID NO: 220793 - DNA, 498 bp, Artificial Sequence
  Description of Artificial Sequence: Synthetic coding sequence
atgttagccaactccgctagtgtgaggatcctgataaaagggggaaaggtcgtcaatgatgactgcacacacgaggcagacgtgtatatcgaaaatgggattatccaacaggtggggcgtgagctaatgattcccggaggtgctaaagtgatcgacgctactggtaaactcgtgataccaggcggaattgacacttccacacacttccaccagacctttatgaatgccacctgtgtcgacgatttttaccacggaaccaaggccgcactggtgggaggaacgactatgatcatcgggcacgtcctgcctgacaaggagactagcctggttgatgcctatgaaaagtgtagaggcttagccgatcccaaggtgtgctgtgattacgctctccatgtcggcattacatggtgggccccaaaagtgaaggccgagatggaaactttggtccgggagaagggtgtgaattcttttcagatgttcatgacctataaggactag

SEQ ID NO: 220794 - DNA, 522 bp, Artificial Sequence
  Description of Artificial Sequence: Synthetic coding sequence
atggctccggtcctaagtaaagatagtgctgatattgagtctattctcgcactgaaccctaggacacagacccacgccacccttcgatctactagcgccaagaagctggacaaaaagcactggaaacgcaacccagataaaaactgcttcaactgtgagaagttggaaaacaactttgacgacatcaagcatacaacactcggtgagcgtggcgctttgcgtgaggctatgcggtgtctcaaatgcgccgatgccccatgtcagaaaagttgccccaccaatctcgatattaagagtttcatcacaagtatagctaacaaaaattactacggtgcagcaaagatgatcttttccgacaatcccttgggattgacttgtggcatggtatgtccaacctcagatttatgtgtagggggatgtaacctctacgcaacggaggagggcccaattaacattggcggactgcaacagttcgccactgagacactcatccttgccttttccctgatgaaccacctgtag

SEQ ID NO: 220795 - DNA, 3078 bp, Artificial Sequence
  Description of Artificial Sequence: Synthetic coding sequence
atggctcccgtgttaagcaaggattctgcagatatagagtccattctcgcgctgaatccaaggacacagacccacgcaactctgcgttcaacctctgccaagaaactagacaaaaaacactggaaacggaatccggacaagaattgcttcaactgcgagaaactggagaacaacttcgacgatatcaagcacactacactgggggaacgcggtgcacttcgtgaggcaatgagatgcctcaagtgcgcagatgcaccatgccagaaatcttgccccaccaacctggacataaagagcttcataacctctattgccaataaaaattattatggagccgctaaaatgatattttcagacaatccactgggcttaacgtgtggaatggtttgcccaacttccgatctctgtgtgggagggtgcaatttgtacgccacagaggaagggccaatcaacatcggcggactgcagcaattcgcaacagaagtgttcaaggctatgtcaatcccgcagattcggaaccctagtctcccacctccggagaagatgagtgaagcatattcagcaaagatagccctgttcggcgctggcccagctagtatttcttgcgcctcatttctggcgaggctcgggtacagcgatatcaccatttttgagaaacaagagtatgttggcggtctcagtacgtccgaaatcccccagttccgactaccgtacgatgtggtcaattttgaaatcgagctgatgaaagacctcggagtgaaaataatctgtgggaagagcctatcagtgaacgagatgacgctgagcaccctgaaggaaaaaggatataaagccgctttcatcggcattgggctaccagagcctaacaaggacgcaatcttccaaggcctgactcaggatcaagggttttacactagtaaagattttctgcctcttgtagctaaagggtcaaaagccggaatgtgcgcatgccattcaccattgccctcgattaggggcgtggtgattgtccttggtgccggagacacggccttcgattgcgcgacttcagccctgagatgtggcgcacgtcgtgtgttcattgtcttcagaaaaggatttgtgaatattagggctgtgcctgaagaaatggagctggcaaaagaagagaagtgtgaattcttgcccttcctgtcaccacgtaaagttattgtaaagggcggaaggatcgtcgctatgcagtttgtgagaactgagcaagacgagacaggcaagtggaacgaggacgaggatcagatggtccacctgaaggccgacgtagtgattagcgctttcgggtctgtgctgagcgacccaaaagtgaaggaggccttatcccctattaagttcaatcgctggggcttgcccgaggtcgatcccgaaacgatgcaaaccagcgaggcctgggtgtttgcaggaggcgatgtcgttggcttagctaatacgaccgttgagagtgtcaatgatggtaaacaggctagttggtacattcacaaatatgtacagtcacaatatggggcaagtgtgagcgctaaaccagaactgcccctcttctacacacctatcgacttggtcgacataagcgtagagatggccggtctgaaattcatcaaccccttcggcttagccagcgcaactcccgcaaccagtacatctatgataagacgggcattcgaggcagggtggggcttcgcactaaccaaaaccttttcactagataaagatattgtcacgaatgtttcaccaagaataatccgcggtaccacgtcagggcctatgtatggccctggccagagctcattcttaaacatcgaactcatctctgagaagaccgccgcatattggtgccagagcgtgacagagctgaaggccgatttcccagataacatcgtgattgcttcaattatgtgcagctacaacaagaatgattggaccgagcttgcgaagaagtcagaagattcaggagcggatgcattagagttaaatctctcttgtccacatggtatgggcgagcgcggaatgggtctggcatgcggtcaggaccccgaactggtaaggaacatctgtcgatgggtccgacaggcggtgcagattccctttttcgccaaacttacccccaacgtgacagatatcgtttccattgccagggctgctaaggagggcggagctaatggcgttaccgctacgaacactgtcagcgggctgatggggttgaaatctgatgggacaccttggcccgctgttggtatcgctaagcggacaacgtatggcggtgtgagcgggaccgccatacgcccaatagctctgagagccgtgacttccatcgctagggcccttcctggattcccaatcctggctacagggggaatcgactccgcggagtctggtttacaattcttgcactctggagcttccgttctgcaggtgtgttctgctatccagaaccaggacttcaccgttattgaggactactgtaccggacttaaggccttactgtatctgaagtcaattgaagaactccaggattgggacgggcagtcacctgctactgtatcacaccagaaaggaaagcctgtaccacgaatcgcagagctcatggataaaaagcttcctagcttcgggccttacctcgagcagcgcaagaaaattatagccgagaataagatacgtcttaaagaacagaacgtggcattttctcctttgaagcgcaattgctttattccaaagcgacccatacctaccattaaagatgtcatcggcaaggctctccagtacttaggaacattcggagaattgtcgaacgttgagcaggtggtggcaatgatcgatgaggagatgtgtataaactgcggcaaatgctacatgacctgcaatgactccggctatcaggccatacagtttgatcccgagactcatctgcccacaatcaccgatacatgtacagggtgtactctttgcttatctgtttgtccgatagttgactgtataaaaatggtctcacggaccacaccttatgaaccaaagcgcggagtgcctctgtcggtcaatccggtgtgctag

SEQ ID NO: 220796 - DNA, 471 bp, Artificial Sequence
  Description of Artificial Sequence: Synthetic coding sequence
atggcccctgttctgagcaaggatagcgccgacatcgaaaactgcgaaaaattggagaataacttcgacgatatcaaacacacgacccttggagagcgcggagccctccgtgaagccatgcgctgtttgaagtgtgcagacgccccttgccagaaaagttgcccaacaaaccttgacattaagagcttcattacatcaatagccaataagaactactacggcgctgccaagatgatctttagtgataaccccctggggctgacgtgcggtatggtgtgtcccacatcagatctgtgtgttgggggatgcaatctatatgccaccgaagaaggtcccatcaatattgggggtttacaacaattcgctactgaggttaacgggctgttgcatttccagaactccgtcagtctgtggttccagaaaacagctaatattagcttcctttcctgcggctctctgcaggacgcctag

SEQ ID NO: 220797 - DNA, 1482 bp, Artificial Sequence
  Description of Artificial Sequence: Synthetic coding sequence
atgattctcaattctctgtccttatgttaccacaacaagctgatcctagctccaatggtgcgggttggaaccctgccaatgaggctactcgccctggattacggcgcagacatcgtctactgcgaagagcttatagacctgaagatgattcagtgtaaacgcgttgtgaacgaagtattgagcaccgtggatttcgtggccccagatgaccgcgtcgtgttcagaacttgtgaacgggagcagaaccgagtcgtctttcaaatgggtacttctgatgccgagagagcactcgcagtggccaggctggttgagaatgacgtcgcaggaattgatgttaatatggggtgtcctaaacagtattctactaaaggagggatgggcgcagctctcctgagtgatccagataaaatcgagaagatcctctctaccctcgttaagggcactcgcagacccgtgacctgtaagattaggatcctgcccagcctggaggacacattgtctctcgttaagcggattgaaagaactgggatcgctgccattgccgtccacgggaggaagcgggaggagcgccctcagcaccccgtgtcatgcgaagtaatcaaagcaattgcagacactctctccattccggtaatcgctaacggcggttcccacgatcacattcaacagtactcggatattgaagacttcaggcaggccaccgctgcttcctctgtgatggtcgcacgtgcagccatgtggaatccctctatattcttgaaggaggggctgcgaccactagaggaggttatgcagaagtatatacgatatgcggtgcagtatgacaatcactacaccaataccaagtactgcctgtgccaaatgctgagggaacaactggagagcccacagggaagactgcttcacgcagcgcagagtagcagagagatatgcgaagcatttgggctcggcgctttctatgaagagactacccaggagcttgatgcccagcaagctcgtctgagcgccaagaccagcgagcagaccggggagccagcagaggataccagcggagtgataaagatggcagtcaagtttgaccgtagggcctaccccgctcaaattaccccgaaaatgtgcctgttagaatggtgtagaagagagaaactggcacagcccgtctatgaaacggttcagagacccctcgatcgactcttctcttctatcgtcacagtcgccgaacagaagtaccagtcgaccttgtgggacaaaagcaagaaactcgcggagcaggccgcagcgattgtatgcctgcgaagtcagggactccccgaagggagattgggggaggaatctccctctctgcacaagcggaaaagggaagcccctgatcaggaccccggaggaccccgagctcaggagctcgcccaacccggagacctgtgcaaaaaacctttcgtcgccctgggctcaggagaggagtcccccttggagggctggtag

SEQ ID NO: 220798 - DNA, 1482 bp, Artificial Sequence
  Description of Artificial Sequence: Synthetic coding sequence
atgatcctaaattcactcagtctgtgttaccacaataagctgatcttggcaccaatggtcagggtgggcaccctgcccatgaggctgttggctctggactacggggctgatatcgtctactgtgaggaactcatagatctgaaaatgatccaatgtaagcgagtggtgaacgaggtcctatctacagtagattttgtggccccagacgaccgagtcgtatttcgtacatgcgagagggagcagaaccgggtcgtttttcagatggggacaagcgacgcagagcgtgccctggctgtggcaagattggtcgaaaatgatgtggcaggcatcgatgtgaatatggggtgcccaaaacagtatagcactaaaggcggtatgggggcagcactgctttccgatcccgacaagattgaaaagatcttaagcaccctggtgaaaggaaccaggcggccagttacatgcaagatccgaattctaccaagcctagaagatactctttccctggttaaacggatcgaaagaaccggcatcgccgcaattgcagtacacgggagaaaaagagaggaaagacctcagcatcccgtgtcctgcgaggtgataaaggctatcgctgacaccctcagcatccccgttatcgccaatgggggaagccacgatcatattcagcagtatagcgatatagaggatttcaggcaggctacggcagctagttccgttatggtcgctagagccgcaatgtggaatccatccattttcctgaaggaaggtctgcggccactggaggaagtgatgcagaagtacatccgctacgctgtgcagtatgataaccactacacaaacaccaagtactgtctatgtcaaatgctgagggaacagctggaatctccgcagggacggctcctccatgccgctcagtcttctcgggagatttgcgaggcattcggcctgggagccttctatgaggagacgactcaggaactcgatgcgcagcaggcacgactgtccgcaaaaacctccgagcagacgggcgaacccgctgaggacacgtccggcgtaattaaaatggccgttaagtttgaccggagggcctacccagcacagattacccctaagatgtgtctccttgaatggtgtagaagggaaaaacttgcgcagcccgtatatgagacagttcagaggcctctggatagactgtttagtagtatcgttaccgttgcggaacagaaataccaatcaactctttgggacaagtcaaagaaattagccgagcaagctgccgctatcgtatgcttaaggtctcaaggcttgcctgagggacgattgggagaggagagccccagtctgcataaacggaaacgggaggctcctgatcaagacccaggagggcctcgtgctcaggagttggctcagccaggcgacctgtgcaaaaaaccttttgtggctctcgggtctggggaagaatccccactggagggctggtag

SEQ ID NO: 220799 - DNA, 1377 bp, Artificial Sequence
  Description of Artificial Sequence: Synthetic coding sequence
atgattctcaattctttatctctatgctatcataacaagctgatccttgctcccatggtgagagtgggcactctgcctatgcgccttcttgcccttgactacggagccgatatcgtgtactgcgaggagctgattgacctgaagatgattcagtgcaaacgcgtcgtcaatgaggtcctgagcaccgttgacttcgtggctcccgatgacagggtggtgttcagaacctgtgaacgtgagcagaatcgggtagtgttccagatgggaggcatgggagccgcactgctgtccgacccagacaaaatcgaaaagatcctatccacgctggtgaagggtactaggaggccagtgacctgtaagatcagaatactccctagtttggaagataccttgtcactcgtgaagagaatcgagcgcacgggcattgccgcaattgccgttcacgggagaaagagagaagaaagaccccagcaccctgtgagttgcgaggttataaaggctatcgccgatactttgagcatccccgtaattgccaatggtggaagtcacgatcatatccagcagtacagcgacatcgaagacttccggcaggctacagcagcttcctccgtcatggtcgctcgggcagccatgtggaacccaagtatctttctgaaggagggcttgcgacctttggaggaggtgatgcagaagtatatcagatacgccgttcagtacgacaatcactatacaaataccaagtactgcctgtgtcagatgcttagggaacaactggagtcccctcaggggaggcttcttcacgcggctcagtcttcccgcgagatctgcgaagcttttggcctgggagcattctatgaggaaacaacccaagaactcgacgcccagcaggcccgactaagcgcaaaaacgtccgagcagacaggggaacccgctgaagacacttccggggtgatcaaaatggctgtgaaattcgataggcgggcttatccagcacagatcacgcctaagatgtgcttgctcgagtggtgtcgtcgggaaaagctagcacaacccgtgtacgagacagttcagaggccactggacagactcttctcatccattgtaacagtggctgaacagaagtaccagagtactctctgggataagtctaaaaagctggccgagcaggctgcagccattgtatgtttacgctcacaaggacttcccgagggacgcttgggcgaggagtcgccctcactgcataagcggaagagggaagcaccagatcaagatcctgggggtcctagggcccaggagctggcgcagccgggagacttgtgcaagaagcccttcgtcgctctgggctccggagaagagagcccactggagggctggtag

SEQ ID NO: 220800 - DNA, 858 bp, Artificial Sequence
  Description of Artificial Sequence: Synthetic coding sequence
atggcaggactgggccatcctgccgcattcgggcgtgctacccatgctgtagttagagccttgcccgaaagtctgggccagcatgctctacggtccgcgaagggggaagaggtggatgtggcacgcgcagagaggcagcaccaactttacgtgggagtgcttgggagtaagctgggtcttcaggtggtcgagctgcccgcagatgaaagcctgcctgactgcgttttcgtggaggacgtagcagtcgtctgtgaggaaacagctcttatcacgaggccgggagccccaagcagacgcaaggaagttgatatgatgaaagaagcactggagaaactgcagctgaacatcgtggagatgaaggacgagaacgcaacacttgacggcggagatgttctgtttacagggagggaattctttgttggcctatctaaacggacaaaccagaggggagccgaaatattagcggacactttcaaagattacgcagtttctactgtccctgtagcagatggcctgcatctgaagtcattttgtagcatggccggacccaacctgatcgctatcggttcaagcgagagtgcccagaaagccctcaagatcatgcaacagatgtctgaccaccgttacgacaagttaacggtaccggatgatatagccgcaaattgcatctatctgaatattcccaataaagggcatgtgcttctacaccgcactcccgaagagtaccctgaaagcgctaaagtgtatgagaaactgaaagaccatatgctgattcccgtgtctatgagcgaactggagaaggtggatggtctgctgacttgctgcagcgtactcatcaataagaaggtcgactcttag

SEQ ID NO: 220801 - DNA, 579 bp, Artificial Sequence
  Description of Artificial Sequence: Synthetic coding sequence
atgtggctgtacggcttgggccaggttgatatgatgaaagaagccctggaaaagttgcaactcaacatcgtggagatgaaggacgaaaatgctacattggacggtggagatgtgctctttaccgggagggagttcttcgtcgggctatctaagcgcaccaatcagcggggtgcggagattcttgcggacacctttaaggactacgctgtttcgaccgtgccagtggcagacggcctgcatctgaagtcgttttgctctatggcaggccctaatttgatcgccatcggtagttctgaatcggctcaaaaagccctaaagattatgcagcagatgtcagatcaccggtatgataaactgactgtgccagatgacatcgccgctaattgtatatacctcaatatccccaacaagggccacgttctgttgcataggacccccgaggagtaccccgagtctgcaaaagtttacgagaagttaaaggatcacatgctcatccccgtgagtatgagtgagctggaaaaagttgacggattattgacctgctgctctgtgctgatcaataaaaaggtggattcttag

SEQ ID NO: 220802 - DNA, 549 bp, Artificial Sequence
  Description of Artificial Sequence: Synthetic coding sequence
atgatgaaagaggccctcgaaaagttacaactcaatatcgtggagatgaaagacgagaatgcaaccctggacggcggtgacgtgctgttcacaggcagggaattcttcgtgggactgagtaaacgcacgaaccagcgcggagccgaaattcttgccgatacctttaaagactatgcagtaagcaccgtgccagttgccgatggactccacctaaaatccttctgctcgatggcaggccctaacctgatcgccattggctcctctgaatcagctcaaaaggctctaaaaattatgcaacagatgtctgaccaccggtatgacaagctgacggtgcccgacgacatagcagctaactgtatatatctcaatattcccaacaaaggacatgttctgctgcataggactcccgaagagtacccagagtccgctaaggtgtacgagaagttgaaggatcatatgcttattccagtgtctatgtccgagctggagaaagtggatgggctcctcacatgctgttctgtactcataaataagaaggttgacagctag

SEQ ID NO: 220803 - DNA, 858 bp, Artificial Sequence
  Description of Artificial Sequence: Synthetic coding sequence
atggccggtctagggcatccagccgctttcggtcgcgctacgcatgcggtcgtacgagctctccctgagtccctgggccagcatgcgctcaggagcgcaaagggtgaagaggtggatgtcgctcgcgcagagagacagcatcagctgtacgtgggggtattaggatctaagctgggactgcaggttgttgaactaccagctgacgagagcctgcccgactgcgtgtttgttgaagatgtcgccgtggtctgtgaagagaccgcattgataacacgaccgggagctccatctcgccgaaaagaagttgacatgatgaaggaggctctagaaaagctccagctgaacatcgtggagatgaaagacgagaatgccactctcgatggaggcgacgtgctcttcactggtagagagttctttgtaggcctgtctaaaagaactaatcagagaggagcagaaattctggccgataccttcaaggattacgcagtttcgacagtgccagtcgccgatgggctccacctgaagtccttctgcagcatggccggacccaatctgattgcgatcggatctagtgagagcgcccaaaaggcccttaagattatgcagcagatgagcgaccaccgttacgacaaattaaccgtccccgatgatatagccgcaaactgtatttacctgaatattcccaacaaagggcatgtgctgctgcacaggactccagaggaatatcccgagagtgccaaagtctacgaaaaactgaaggatcacatgctgatcccagtaagcatgagtgagttagagaaagtagacggcctgctgacctgctgctcagttctgataaacaagaaagttgacagttag

SEQ ID NO: 220804 - DNA, 558 bp, Artificial Sequence
  Description of Artificial Sequence: Synthetic coding sequence
atggtggatatgatgaaggaagcactcgagaagttgcagcttaatatcgtggaaatgaaagatgagaacgccactctggacggtggagacgtcttattcacaggcagagagttctttgtcgggctgtctaaacggaccaaccagcgaggcgcagagattctggccgacacatttaaagattatgccgtgtctacggtgcctgtcgccgatggcctccaccttaagtcattttgttcaatggcaggcccaaatcttatcgcgatcggcagctcagaaagcgcccaaaaggcgctgaagatcatgcaacaaatgagcgaccatcgttatgataaactcaccgtcccagacgacatcgctgctaattgcatctatctgaacattcctaacaaaggtcatgtgctgctccacaggacgcccgaagagtatcccgagtccgcaaaggtctatgaaaagttgaaagatcacatgttaatacccgtctcgatgagcgagctcgagaaagtagatggtctgctcacctgctgcagcgtcttgatcaataagaaggtcgactcctag

SEQ ID NO: 220805 - DNA, 858 bp, Artificial Sequence
  Description of Artificial Sequence: Synthetic coding sequence
atgggcacaccaggggagggactgggacgatgttcacacgctctgataaggggagtgccagagagcttggctagcggcgaaggggcaggcgcaggtctgccagccctggatctcgcgaaggcacagagggaacacggagtcttgggtggcaagctgaggcagcggctggggctgcaattgttggagctgccacccgaggagtctctgcccctgggaccactgttgggcgataccgccgtgatccagggcgataccgcccttattactagaccctggtcgccggcaaggcgccctgaagtggatggggtccgcaaggccttgcaggacctgggactccgaatcgtggagattggcgatgagaatgccaccttggatggcacagacgtcctattcaccggaagagagttcttcgtggggctgtcaaaatggacaaatcatagaggcgctgagatcgtcgccgatacattccgggattttgcagtgtcaaccgtccctgtgtccggcccaagtcaccttagaggcttgtgcgggatggggggtcctcgaactgttgtggcaggatcctccgacgctgcacagaaggccgtcagggccatggcggtgctgacagaccatccttatgcctctctgaccctgcctgatgacgcggctgcagactgtctgtttctgcgacctggtctgccgggagttcctcccttcctactccatagaggaggcggagacctaccaaactctcaggaggccctgcagaagttgagcgatgtgactttggtgccagtttcctgttccgaactggaaaaggccggtgctgggctctctagtctctgcctggtgttgtctactagaccccatagctag

SEQ ID NO: 220806 - DNA, 858 bp, Artificial Sequence
  Description of Artificial Sequence: Synthetic coding sequence
atggggacaccaggggagggactcggtcggtgctcccacgccctgatcagaggcgtacctgaaagtctcgctagcggggagggggctggtgccggtctaccagccctggacctggccaaggcccagagggagcatggcgtactgggcggaaagctgcgccagcgtttaggcttacagctgctggaattaccacctgaagagagtcttcctctgggaccgctgctcggcgataccgctgtaatccagggagataccgccttgatcacccgcccatggagtcctgcccgtaggcccgaagtggacggcgtgaggaaagccctgcaggatctgggactccggattgtggaaattggagatgagaacgccaccctggacggcacggatgtactgttcacaggcagagagttctttgtgggcctgtcaaaatggacaaaccacaggggcgctgagatcgtcgccgataccttcagggactttgcagtgagcacggtgcccgtttccggcccatctcacttgagggggctgtgcggcatggggggtcctcgtacggtcgtggccggaagctcagacgccgctcagaaggccgtgagagccatggccgtgctgactgaccacccctacgcctccttgacgctcccggatgatgcagccgctgactgcctatttttacgtcctgggctccccggtgtccccccattcctcctgcacagggggggaggagacctgccaaattcccaggaggcattgcaaaagctgtcggatgtcaccctagtccctgtcagctgctcagagctggagaaggccggtgctggattatcctccctttgtctcgtgctgtcaacacgacctcactcctag

SEQ ID NO: 220807 - DNA, 858 bp, Artificial Sequence
  Description of Artificial Sequence: Synthetic coding sequence
atggggacgcctggggagggattaggcaggtgttcccatgctctcattaggggggtccctgagtcacttgcctccggcgagggtgcgggtgccggtctgcctgccctggatctcgctaaggcgcagagggaacacggtgtgctgggtggcaagctgcggcagagactaggcttgcaacttctggagctcccacctgaggagtccctgcctctcggccctctgcttggtgacactgctgtcatccagggcgacaccgcactcattacccgtccctggtctccagctcgtagaccggaggtggatggtgtgcgcaaagcactgcaggaccttggactgcgtattgtggagataggagacgagaacgcaacgctggacggcacggacgttcttttcaccggtcgggagtttttcgtcggtcttagcaagtggaccaatcaccggggagccgaaattgtggccgacacattccgggatttcgcagtgtcaacagtaccggtttccggtccttcccatcttcggggactgtgtggcatggggggacctcggacagtggtggctggctcctctgacgccgctcagaaagctgtacgtgcgatggccgtgctgacagatcatccatatgcttccttaaccctgcctgacgacgccgcagcagactgcctttttctgcgaccgggtcttccgggagtgccgccatttctactgcatagaggtggcggtgatttgcccaatagccaggaggcgctgcagaaactatccgatgtcaccctcgtgcccgtcagttgtagcgagttggaaaaggcaggagcgggtctgtctagcctttgtttagtgctgagcacacgcccacactcatag

SEQ ID NO: 220808 - DNA, 858 bp, Artificial Sequence
  Description of Artificial Sequence: Synthetic coding sequence
atgggaacccccggagagggactcgggaggtgcagccacgcccttattcgcggtgttcctgagtctctggcatctggtgagggagcgggagcagggcttcctgccctggatctcgccaaggctcagcgagagcacggggtgctaggtgggaaactcaggcagagactgggcctgcaactgttggaactccccccagaagaatctctgcctcttgggccattgctgggggataccgctgtgattcaaggtgacaccgccctgatcactaggccttggtctcctgccaggcggccagaggttgatggtgtgcggaaagctctgcaggatctggggctacggatcgttgaaataggtgacgagaacgcgaccctggacggcacagatgtcctctttacaggcagggaattcttcgtcggactgagcaaatggacaaaccataggggcgcagaaattgtggccgatactttcagggatttcgccgtaagtaccgttcctgtgtcagggccttctcatttgagaggactctgcggaatggggggacccagaactgttgtcgccggaagtagcgacgctgcacagaaagcagtgcgcgctatggctgtcctcaccgatcacccctatgccagtctgacactgcccgacgacgctgccgcagattgcctatttctgcggccaggcctccctggcgtgccaccctttctgctccataggggcggaggggatttgccgaacagtcaggaggcgcttcagaaactgagcgacgtgacactggttcctgtttcctgtagcgagctggagaaggccggagccggactttcctccctctgtttagtgctgtccacccggcctcactcatag

SEQ ID NO: 220809 - DNA, 858 bp, Artificial Sequence
  Description of Artificial Sequence: Synthetic coding sequence
atgggaacacctggcgaagggctgggacgctgtagccacgccttaatccgaggggtgcctgagtcccttgcttccggggagggtgcaggagccggtctgccggcattagatttggcaaaagctcagagggagcatggcgttctgggcggaaaactcaggcagcggctggggctccagctgcttgaactgccccctgaggagtctctgccattgggtcctctgctgggagatactgccgttattcagggcgataccgccctcatcacccggccatggtcacccgctcggagaccagaggttgacggtgtgcgcaaagcgctacaggatctcgggcttaggattgtcgagattggcgatgaaaatgccaccctggacgggaccgacgtgcttttcacgggccgtgagttctttgttgggctctccaagtggactaatcatagaggtgcagaaattgtagctgatacattccgcgacttcgcagtctctaccgtccccgtgtcaggccctagtcatctccgaggtttgtgcggaatgggaggtccgaggactgtcgttgcaggctcctctgacgcggctcaaaaggccgttagagctatggcagtgctcactgaccacccctacgcctctctgacactgccggatgatgccgctgccgattgtttgtttctcaggcctggcttgccaggggtgccacccttcttgctacatcgtggaggcggagacctgcccaactctcaagaagctttacagaaactctccgacgtcactctggttcccgtctcctgtagcgaactcgagaaagctggagcaggactgagcagcctgtgtttagtgctgagtactcgccctcacagctag

SEQ ID NO: 220810 - DNA, 858 bp, Artificial Sequence
  Description of Artificial Sequence: Synthetic coding sequence
atgggtactccaggggagggactggggagatgcagccacgccctgatacggggtgtacctgaaagcctggcaagtggggagggtgcaggggctggactcccggcactggatctggcgaaagctcaaagggaacacggggtgctcggtgggaagctgcggcagaggctaggcttgcaacttctggagcttccacctgaggagtcccttcccctaggccctctcctcggtgacactgccgtaattcagggggataccgccttgatcacgcgcccatggtcacccgctagacgcccagaagtagatggggtgcgaaaggccctgcaggatctgggtttgcgcatcgtagaaattggcgacgagaacgccaccctcgacggaaccgacgtcctcttcactggtcgggaattcttcgtgggactgtccaaatggacaaaccataggggcgcagagatcgtcgccgacactttccgggactttgctgtctcaacagtacccgtgagcggaccatcacacctcagggggctgtgcgggatggggggtcctagaacagtagttgccggtagtagcgacgcggctcagaaggccgtcagagccatggccgtcctgaccgatcatccctatgccagtctaactctgcccgatgatgctgcagccgactgtctgtttttacgacccggactgcctggcgtgccacctttcctactgcatcgcggtgggggagatctgccgaatagtcaggaggctctacaaaagctgtccgatgtgacactggtgccggtttcgtgtagcgagctggaaaaggccggtgccggtctgtcatctctgtgtctcgtcctgagcaccaggccacattcgtag

SEQ ID NO: 220811 - DNA, 858 bp, Artificial Sequence
  Description of Artificial Sequence: Synthetic coding sequence
atggggacccccggagaaggtctggggcgttgctctcacgcactgattcgaggagtgcccgagagcctggcatctggcgagggcgcaggagctggattaccggctctggatctggctaaggcccagcgggagcatggagttcttggaggcaaattacgccagcgcctgggcctgcagcttctcgagctgcccccagaagagtccttacctctgggtcctctgctgggcgatacagccgtgatccagggcgacaccgccctaatcacccggccttggtctcccgctcgccgtcctgaagttgacggagtgcggaaggctctgcaggacctggggctgcgcattgtggaaatcggggacgaaaatgcgacgctggacggcacagacgtgctgtttaccggcagagagttctttgtggggctgtctaagtggacaaatcaccgcggagccgagatcgtcgctgacacctttcgcgacttcgccgtttccactgtgcccgtgtcagggccttcgcacctccgcggactttgcgggatgggcggtcctcggacggtggtggccggttccagtgatgcagcccagaaggcagtgagagcaatggcagttctaactgatcacccctacgctagcctgacactaccggacgacgccgctgcagactgccttttcctccggcctggattgcctggcgtcccaccattcctactacatcgaggaggcggagacctgcctaactctcaggaggccctacaaaaactgagcgatgtgaccttggtccctgtgtcatgttccgagctcgaaaaagccggtgccggtctgtcaagcctatgcctagtgctcagtacccgcccacacagctag

SEQ ID NO: 220812 - DNA, 567 bp, Artificial Sequence
  Description of Artificial Sequence: Synthetic coding sequence
taacggagacccgaggtcgacggcgtaagaaaggccctgcaggatctgggactgcgaatagtagagatcggcgacgagaacgccacattggacggcaccgacgtgctgttcacaggtcgggaattttttgttggattatcaaagtggactaaccacaggggagccgaaatagttgccgacaccttcagagacttcgccgtgtccaccgttcccgttagcggacccagccacctaagaggactttgcggcatggggggaccaagaaccgtcgtggcaggctccagcgatgccgctcagaaagctgtgcgaatgacccagttgctgacagtcagtttctttgtacttggttgtttagtgtgtcccctgtcaagttgcaccgtggaagtcggaatttgtccgactgccagaaggcactgccggagtagcctgatgtctccatggtatttgtgtcccgctcaaaattggagacgtctggcaccagggtcggcaccgtcagcctggtgtagtgcccacgcccctaccgccgagggcctggcactgggatattgctggcctggagtggggtag

SEQ ID NO: 220813 - DNA, 567 bp, Artificial Sequence
  Description of Artificial Sequence: Synthetic coding sequence
tgaaggaggcccgaggtagacggggtgcggaaagccttacaggatctggggctgcgcatcgtcgaaataggcgatgagaacgctactctggacggcaccgatgttttgttcactggcagggaatttttcgtgggactgtccaagtggacaaaccaccggggtgcagagatagtggccgacaccttccgcgacttcgccgtctctaccgtacccgtcagcggcccatctcacctgcgcggactgtgcggaatgggtggacccaggaccgtagtggccggaagctccgacgccgcacagaaggcggtaagaatgacacagctactcaccgtgagcttcttcgtcctcggctgccttgtgtgtcccttatcgagctgcactgtggaagtcgggatctgcccaactgcacgcagacattgtcgaagttccctgatgtcgccatggtatctttgccccgcacaaaattggcggcgtctggccccaggaagcgcgcctagtgcctggtgttcagcccacgctccaacagcggaaggcctggcccttggctattgctggccgggtgttggttag

SEQ ID NO: 220814 - DNA, 858 bp, Artificial Sequence
  Description of Artificial Sequence: Synthetic coding sequence
atgggaacccccggtgaggggctcggcagatgctcacatgctctgatcagaggcgtccccgaatccttggcatcaggagaaggcgctggcgctggccttcctgcattggacttagctaaggcccagagggaacacggcgtccttggaggcaagcttaggcagaggctgggactgcagttgctggagctgcccccagaggaaagtctgccactcggcccactactgggcgatactgcggtgatccaaggggacaccgcgttgatcacaaggccctggtctcccgctcgcaggcctgaggtagacggcgttcgcaaggccctgcaggatctgggtttacgcatcgtggagattggggatgaaaatgccaccctggacggaacagacgtcctgttcacaggccgtgaattctttgtgggactgagcaaatggacaaatcaccgcggagctgaaatcgtagccgatactttcagggactttgcggtgtcaaccgtgcctgttagcggaccatctcacctgagaggcttatgcggtatgggtggacccagaaccgtggtggctggctcaagcgatgccgcacagaaggctgttcgagctatggctgtcctgacagatcacccctatgcttcactgacgctccctgatgacgcagctgcagattgcctgttcctcaggccaggcctgcctggggtccccccattcttgttacatcggggagggggagacctcccaaattcacaggaagcactccagaaactcagcgatgtgacacttgtgcctgtgtcctgctcagagctggagaaggcaggagcgggactgtcctcattgtgcctggtgctttcaacccgccctcattcatag

SEQ ID NO: 220815 - DNA, 858 bp, Artificial Sequence
  Description of Artificial Sequence: Synthetic coding sequence
atggggacacctggggagggactgggaagatgctcccacgccctgatcaggggggttcccgaatcacttgctagcggagagggagctggcgctggcctgcccgcactcgatctcgctaaggctcagcgtgagcacggggtcttgggaggtaaactgcggcaacgcttgggtttgcagcttttagagctccctcccgaggaatctctgccgctgggaccgcttttaggggatacagctgttattcagggagatacagctctcattactagaccttggtcgcctgctagacgcccagaagttgacggagtccgcaaggcgctacaggacctgggcctgaggattgtcgagattggagatgagaacgctacactcgacggaactgatgtgttgttcactggacgtgagttctttgtcggactgagtaagtggaccaatcaccgtggtgctgagatagtcgcagacacatttcgggatttcgcagtgagtaccgtgcctgtctccggcccttcccatcttagagggctttgcggcatggggggtccccgaactgtcgtggccggatctagtgatgctgcacaaaaagctgtgcgcgctatggctgtgctgaccgaccatccatacgcttcactgactctccctgatgatgccgctgccgattgtctctttctccggcctggactgcccggtgttcccccttttttgctgcacagggggggaggagatttaccaaacagccaggaggccctgcagaaactctccgacgtcacactggtacccgttagctgctctgagctagagaaggccggtgcaggcctctctagcctgtgtctggtgctgagcacaagaccacattcatag

SEQ ID NO: 220816 - DNA, 858 bp, Artificial Sequence
  Description of Artificial Sequence: Synthetic coding sequence
atggggaccccaggcgaggggctgggtcgctgtagtcacgcattaattcgcggtgtgcctgaatctctcgccagtggagaaggggcaggcgctggactgccagcgctggaccttgctaaggcacagagagaacacggtgtactgggcggtaaactccgtcaaagactggggctacaactgctggaattgccccctgaggaatctctgccactggggcctctcctgggtgacaccgccgtgatccaaggagatactgccctgatcacacgcccttggagccccgctagacgcccagaggtagacggcgtgcggaaagccctacaggaccttggcttaaggattgttgaaatcggcgacgagaacgcgacactggatgggaccgatgtattatttacgggccgagaattcttcgttggtctctcaaagtggacgaatcataggggggctgaaattgtcgctgacacattcagagacttcgccgtctcaacagtcccggtgagcgggcctagccatcttcggggtctatgtggcatgggcggacctcggaccgttgtggccggatcttccgacgcagcacagaaggccgttcgggcaatggcggtgctaaccgaccacccatatgctagcctaaccttgcctgatgatgccgctgcagactgcctatttctgcgccctggactcccaggagtgccgccatttttgcttcaccgtgggggaggtgacttgccaaattctcaggaggccctgcagaaactctccgacgtgaccctggtgcctgtgtcctgtagtgagctggagaaagcaggagcaggtctttcttccctttgtcttgtcctttctacccggcctcactcatag

SEQ ID NO: 220817 - DNA, 711 bp, Artificial Sequence
  Description of Artificial Sequence: Synthetic coding sequence
atgggaactcccggagaaggcttgggcaggtgcagccacgcgcttatcaggggagtgcccgagagtcttgcctctggtgagggtgcaggagctggcctcccagctctcgatttggccaaagcccagagagagcacggtgtccttggagggaagctcaggcagcgtctcggtctccagctgttagaattgccaccagaggagagcctccctctcggtccactccttggcgacaccgccgttatccaaggagatacagctttgattacacgtccatggtcgcccgcacgcaggcctgaagtcgacggagttcgaaaggctctacaggatcttgggttaaggattgtagaaatcggcgatgagaatgccactctcgacggcacagatgtgctttttactggccgtgagtttttcgtggggctgagcaagtggaccaatcacagaggcgcagaaatcgtggcagatacctttcgggattttgcagtgtcaacagtgccagtgtccggtcccagccacctgcgcggtttatgtggaatgggagggcctcggacggtggttgcgggaagttcggatgcggctcagaaagcggtccgcgcaatggcagtgctgaccgaccacccttacgcctctctcactctacccgatgacgcagctgccgattgtctgttcctgagacccggactgcccggtgtgcccccattcttgctgcactag

SEQ ID NO: 220818 - DNA, 681 bp, Artificial Sequence
  Description of Artificial Sequence: Synthetic coding sequence
atgggtactccgggagaaggcttgggcaggtgctcgcatgcactgatccggggagtgcccgaatcgcttgcatcaggcgagggagcaggggcaggactccccgcactggatttagcaaaggcccaacgagagcatggagtcttgggtggcaagcttagacagaggctgggcctccagctgctggagctgcctccggaagagtcattaccacttggtccactactgggtgatacagctgtgattcaaggagacactgccctgatcacaaggccttggtcacccgctcggcgtcctgaagttgatggagtgcgaaaagcattacaggacctgggcctccgcattgtggaaataggagatgagaatgcaacattggacgggacggatgtgctgtttactggcagagaattctttgtcggcctatccaaatggactaatcataggggcgctgagattgtagcagacactttccgcgacttcgccgtcagcaccgtgcctgtttccgggccaagccaccttaggggcctctgcgggatgggtggacctcgcaccgtggtggcagggtcttcagatgccgcacagaaagcggtcagagccatggccgtcctgacagaccacccctacgcctcactgacattgcccgatgatgccgcagctgattgcctgttcctccgtcctggttag

SEQ ID NO: 220819 - DNA, 711 bp, Artificial Sequence
  Description of Artificial Sequence: Synthetic coding sequence
atgggcaccccaggtgagggattagggagatgttcccatgcactgatccgcggagtgcccgaatccctcgctagtggcgagggggcaggggctgggctcccagccctcgacctggctaaagcccaaagggagcatggcgtcttgggcggaaaactgcggcaacgtctggggttgcagctcctggagcttccaccggaagagagcctgcccctcggaccattgctgggagataccgccgtgatacagggggacactgcgctaattacccgcccatggtcacctgctcggagacctgaagtagacggtgtcagaaaggctctccaggatttaggactcaggatcgtcgagataggcgatgaaaacgcaacccttgatggtacagacgtactgttcactggccgagaattcttcgtcgggctctctaagtggaccaatcaccgtggagctgagattgtagctgacacgttcagggattttgcagttagcaccgttcctgtcagtggtccttctcatttacggggattgtgcggcatgggcggaccaagaaccgtcgtcgccggtagcagcgatgccgcacaaaaagcagttagggctatggccgtactgacagatcacccttatgctagccttactctgccagacgacgccgctgctgattgcctgttcttaaggccaggattacctggagtacccccttttctgctccactag

SEQ ID NO: 220820 - DNA, 858 bp, Artificial Sequence
  Description of Artificial Sequence: Synthetic coding sequence
atgggtacaccaggcgagggacttggcaggtgcagccatgccttgatccggggtgtgccagaaagcctggctagcggagaaggagccggagccggactcccagccttggatcttgccaaggcgcagcgcgagcacggggtgctgggaggcaagttgcgacagcggctggggctgcagctgcttgaattgcccccagaggagtccctgcccctgggtccactgctaggcgacacagcagtcatacagggtgacaccgctctgattacacgcccttggagccctgcaagacgacctgaggtggatggagttcgaaaagcactgcaggacctgggactgcgtatcgtcgagattggtgatgaaaacgctaccttggatgggacagacgtgttatttaccggccgagaattttttgtggggctgtcaaagtggacaaaccatcggggtgcagagattgttgctgacaccttccgcgacttcgccgtatctaccgtccctgtatcaggtcctagtcacctcagaggcctgtgcggtatgggtggccctcggaccgtcgtggctggatcgtcagatgcagcccagaaagccgtgcgtgcaatggctgtcttaacagaccatccgtatgcctcattgaccctgccggacgatgctgccgcagattgcctcttccttcggccaggccttcccggtgtcccccctttcctgctgcatcgagggggtggcgatctccccaattcgcaggaggctttgcagaaattaagtgacgtaaccctggtgccagtgagctgcagtgagcttgaaaaggcaggagcaggtctgtcttctctctgtttggtccttagtacacgtcctcacagctag

SEQ ID NO: 220821 - DNA, 858 bp, Artificial Sequence
  Description of Artificial Sequence: Synthetic coding sequence
atgggtactcctggcgaaggactcggacggtgctctcacgccctgatccgcggtgtcccagaaagtctagcatcaggagaaggggcaggagcgggattacccgcacttgacctagccaaggcccaaagagagcatggcgtgctggggggaaagctgagacagcgactaggccttcagctcctcgagcttcctcctgaagagagtttgcccctgggacctcttctgggagacacagccgtgatccaaggtgacacagccctgattacccgcccatggtcgccagccagacgccctgaggttgacggggtaagaaaggccctgcaggacctcggtctgcgtatcgtcgagattggggacgagaacgctactctcgatgggactgatgttctctttactggcagagaattcttcgtgggtcttagtaaatggacaaatcatagaggggcagagatcgtggctgatacttttagggacttcgctgtcagcacagtgcctgtgtcaggaccctctcacctgcggggtttgtgtggcatgggcggtcctcgaactgtagtggccggatcgtctgatgctgctcagaaagcagttcgagccatggccgtgctcacggaccacccatacgccagcctgacacttccggatgatgcggctgccgattgcctgtttctgagacctggccttcccggtgtgcctccctttctcctccacaggggaggtggcgatcttccgaattcccaggaggcactccagaagctgagcgacgtgacactggtcccagtgagttgctctgaactcgaaaaagccggagccggattatccagcttgtgcctggtcttgagcactagaccccactcctag

SEQ ID NO: 220822 - DNA, 858 bp, Artificial Sequence
  Description of Artificial Sequence: Synthetic coding sequence
atggggacaccgggtgaaggtctgggaagatgtagccacgctctgattcgcggtgtgcccgaaagcctggcctcaggagagggcgcaggggctggcttgccagcactggatttagccaaggcgcaaagagaacacggggttttagggggtaaactgcgacagagactgggcctccaactactggagctccccccagaggagtctttgccactggggcctttgctcggcgacacagcggtgatccagggagacaccgcactgatcacccggccttggtcccctgccaggagacccgaagtggacggcgtgagaaaagcactgcaagacctcggactccgaatcgttgaaatcggcgacgaaaacgccacactcgatggcactgatgtactgttcactggtcgagagttctttgtgggattgagtaaatggaccaatcacagaggcgcagaaattgtcgctgatactttccgggattttgccgttagcacagttcccgtctcaggcccttcccacctccgcggactgtgtgggatggggggacccaggacagtggtcgccggaagtagcgacgcagcccagaaggccgttagagccatggccgtcctgacagatcacccttacgccagtctaactttgccggatgatgccgctgccgactgtctgtttctgcgacccggactgcctggtgtccctccattcctactccatcgagggggaggtgatcttccgaattcccaggaggcacttcaaaagctgagtgatgtaaccttggtgccagtgtcctgctccgagcttgagaaagcaggggcaggtctgagttcgctgtgcctcgtgctgtctacgaggccccactcttag

SEQ ID NO: 220823 - DNA, 681 bp, Artificial Sequence
  Description of Artificial Sequence: Synthetic coding sequence
atggggactcccggagaagggctgggacgatgcagtcacgcgctcataaggggggtgcctgagtcacttgcctcgggagagggtgccggagccggtctccccgcactcgacctcgcaaaagcacaacgcgagcacggagtgctgggaggaaaactgaggcagcggctaggtctccagctgctagagctgcccccagaagaaagtctaccgttagggccattactaggcgacactgccgtcatccaaggggatactgcccttattactcggccatggtcacctgcccgtcgcccagaggtcgatggcgtgcgcaaggcactgcaggacctgggcttgaggatagtagagatcggggacgagaacgccaccttagatggcacagatgtgctgttcactggtagagaattctttgtggggctgtccaagtggactaaccaccgcggagcagaaatcgtagctgacacctttagggattttgcagtatccactgtgccagtatcgggtcccagccacctccggggtttgtgtggcatggggggacctcgcactgtagtagccggttccagcgatgccgctcagaaagctgtgcgcgctatggcagttctgaccgaccacccctatgctagccttactctccctgatgacgcagcagctgattgtctcttcctgcggccaggttag

SEQ ID NO: 220824 - DNA, 858 bp, Artificial Sequence
  Description of Artificial Sequence: Synthetic coding sequence
atgggcacacctggcgaaggcctgggcaggtgcagtcacgccttgatccgcggtgtaccagagtcgctggcttctggcgagggcgctggtgccggacttccagctctcgacttagcgaaagcccagagggagcacggggtcctgggcggtaaattgcgccagaggctagggcttcagttgctggagctgcctccagaggagagcttgccgctgggccctctgctgggggacaccgcagtcatacagggcgataccgccctgataaccaggccttggtccccagccagacgacccgaagtagacggagtgaggaaagctcttcaagacctgggacttagaattgtagagattggcgatgagaacgccactttggatggaacggacgtcctatttactggcagagaatttttcgtggggctcagcaaatggaccaaccatcgaggagccgagatcgtagcagatactttcagggacttcgccgtgtcaacagtgccagttagcgggccttcccatctgagaggcctctgcggaatgggtggcccaagaacggtggtggcaggaagttctgatgccgctcaaaaagcagtgcgagcaatggccgtgctgacagaccatccctacgcatccctgactttgcccgacgatgctgccgcagactgcctttttcttcggccaggcctccccggagtgcctccctttttgctgcataggggcggtggcgaccttccaaacagccaggaagctctccagaaactgtccgacgtcaccctggtgccagtgtcttgtagcgagttagagaaggccggagcaggactcagctccctgtgtctcgtgttaagtactcgaccgcattcatag

SEQ ID NO: 220825 - DNA, 681 bp, Artificial Sequence
  Description of Artificial Sequence: Synthetic coding sequence
atgggaacgcccggagaaggtctcggcaggtgttcacacgcactgatccggggtgtgccggagtctttggcctccggcgagggcgcaggtgctgggctgcctgccttggacctggccaaagcacagcgggagcacggtgtcctgggcggaaagcttagacaacggttaggactgcagctgctagaactgccaccggaggaaagtttgccattgggtcctctgcttggcgacacggccgttattcagggggacacagcactcattacgagaccatggtctcctgctcgacgccctgaagtcgacggggttcggaaagcccttcaagacctcgggcttaggatcgtggagattggagacgaaaacgctaccttggatggcacagacgtgctcttcaccggccgtgaatttttcgtaggtctgagcaaatggactaaccaccgcggagccgagatcgtggccgacacttttagagactttgccgtgtcaactgttcctgtgtccgggccttctcatctgagaggactttgcggcatgggaggccctcggacagtcgtggccggatcctccgatgccgctcagaaagcagtacgcgcaatggcagtgctgactgaccatccatacgcttccctcacattacccgacgatgccgcagccgattgtctgttcttgcgacccggatag

SEQ ID NO: 220826 - DNA, 681 bp, Artificial Sequence
  Description of Artificial Sequence: Synthetic coding sequence
atgggtacgcccggagagggcctgggtagatgtagtcacgctcttatcaggggcgtgccagaatccctcgcatctggagaaggggctggagccggactgcctgccttagacctcgctaaagcacagagagaacacggggtgcttggagggaagcttagacagcgcctgggactgcagcttcttgaactccccccagaagaatccctcccgctaggccctctcctgggcgatactgctgttatccagggagacacggctctgatcacacggccatggtcccccgcaagaagaccggaagtggatggagtgcgtaaggccctgcaggaccttggcctgcggatcgtggagattggcgatgagaatgccactctggacggaaccgacgtgctctttacaggacgcgagtttttcgtgggcctgagcaagtggacaaaccaccgcggtgctgaaatcgtggcggatactttcagagatttcgccgtatctacagtccctgtgtctggtccttcccatcttcgcggactgtgtggcatgggaggcccaaggactgtcgtcgcaggctcgtctgacgctgcacagaaggcggttcgcgctatggcagtgcttaccgaccacccttatgcttccctgacactgccagacgacgccgctgcagactgtttgttcctgagaccaggatag

SEQ ID NO: 220827 - DNA, 858 bp, Artificial Sequence
  Description of Artificial Sequence: Synthetic coding sequence
atgggcaccccgggtgaaggcctaggcagatgttcccatgctctaataagaggagtcccagaatccttggcgagcggcgagggagctggagctgggctcccagctctggatttggctaaagcgcagcgggagcacggcgtcctggggggaaagctgcgccagagattggggctgcaactactcgagttgcctcctgaggaatcactgcctttaggcccactcctgggggacaccgcagtaatccagggcgacactgccctgattacccggccatggtcaccagccagacgcccagaagtggacggggttcggaaggcccttcaggacctgggactccggatagtggaaatcggcgacgagaatgctaccttggacggcactgatgtgctgttcactggtagagaattctttgtgggcctgagcaaatggaccaaccaccgcggagccgagattgtggccgacacatttagggacttcgccgtctcgaccgtgccagtgtccgggccttcccacttgcggggactctgtgggatgggaggccctagaaccgtggtggcaggctctagcgacgccgctcagaaagctgtgcgggcaatggccgtgcttaccgaccacccttacgctagtctgactctcccagatgacgcagcagccgactgtctgtttctgcggccaggcttacctggggtgcccccttttctgctgcaccggggtggcggagatctgccaaactctcaggaagccttgcagaagttatccgacgtaacactggtgcctgtgtcctgcagcgagttagagaaagccggagcagggctgtcctccctttgtcttgtcttatcgacgcgaccacactcatag

SEQ ID NO: 220828 - DNA, 681 bp, Artificial Sequence
  Description of Artificial Sequence: Synthetic coding sequence
atgggtaccccgggagaaggcctggggcgttgttcccatgcgctgattcgtggagtgcctgagtccctggcatccggtgagggtgcgggtgctggtctccctgctttagatctggccaaagcgcagcgggaacatggggtgctcggcggaaagctccgacagagacttgggctgcaattgttggagctgcctccggaggagtcactccccctaggtcctctgctgggcgacacagctgtgatccagggcgacaccgctttgattaccagaccctggagccccgcaagacggccagaagtcgacggcgtacgaaaggcactgcaagatctcggcctccgcattgtggagatcggagacgagaacgctactcttgacggaacggatgtgctgtttactggacgcgagttttttgttgggctcagcaagtggactaatcaccgaggagctgagatcgtcgctgacacatttcgggatttcgcggttagcacagtgcctgtgagcgggccatcacacctaaggggcctctgtgggatggggggtcctagaactgtggtcgcgggttcatctgatgccgcacagaaagctgtgcgcgctatggctgtcctcaccgatcacccttatgcgtcacttactctgccagatgacgcggcagcggattgcctgttccttagaccgggatag

SEQ ID NO: 220829 - DNA, 567 bp, Artificial Sequence
  Description of Artificial Sequence: Synthetic coding sequence
tagcgtaggcctgaagtggacggagtcagaaaggcccttcaggacctggggctcaggattgtggagattggcgatgagaacgctacgctagacggcactgacgtcctattcaccgggagggaatttttcgtggggctctcaaagtggacgaatcataggggtgccgagatcgtggccgatacttttcgcgatttcgccgtgtccaccgtgccagtgagcggaccctcccacctcagagggctgtgtggcatgggcggacctaggactgtagtggctggctcttccgacgctgcacagaaagctgtcaggatgactcagctccttacagtgtcctttttcgtgctgggatgtctggtctgtccactgtcctcttgtacggtggaagtggggatttgcccaactgccaggagacactgcaggtcatcattgatgagcccatggtacctgtgtccagcccagaactggcgacgcctggcaccaggctccgctccgagtgcttggtgtagcgctcacgcgcctacagcggagggtctggcgctcggctactgttggccaggcgttggttag

SEQ ID NO: 220830 - DNA, 567 bp, Artificial Sequence
  Description of Artificial Sequence: Synthetic coding sequence
tagagaaggcctgaggtggatggagttcgcaaggctttacaggatctgggcttgcgaatagttgagatcggcgacgagaacgccacgctggacgggacggatgttctgtttacagggcgagagttttttgtgggattgagtaagtggactaatcaccgcggtgctgagattgtagcggacacctttcgggattttgcagtgtctaccgtgccagtgagcggaccaagtcatctcaggggcctatgtggcatggggggtccgagaaccgtggtggctggctcgtcagacgctgcccagaaagccgtgcgaatgactcagctgctaaccgtgagcttcttcgtcctgggttgtctagtatgccctctaagctcttgcacagtagaggtgggcatttgccctaccgccaggcgccattgcagatcaagcctgatgagcccttggtacttgtgccccgctcagaattggagacgactagcgccaggatcggcgccttccgcgtggtgctccgctcacgcccctacagctgaaggactggccctaggctactgttggcccggagtgggttag

SEQ ID NO: 220831 - DNA, 681 bp, Artificial Sequence
  Description of Artificial Sequence: Synthetic coding sequence
atggggacacccggagaaggcctcggtcggtgtagccatgcgctcatcagaggagtccctgagagcttggcatctggggagggagcgggagctggactgcctgcactggatcttgctaaggcccagagggagcacggggtcctgggcggaaaactgcgccagcgcttgggcctccagttgttggaattaccacctgaggaatccctgccccttggcccactgctgggcgatacagctgttattcagggagacactgcactgattacacgaccctggtcccctgcgcgacgcccagaagtggatggcgtgcgaaaggccctgcaggatctggggcttaggatcgttgaaatcggtgatgagaatgctactctggatggcacagacgtgcttttcaccggcagagagttttttgtcgggctttctaagtggacgaaccataggggcgcagagatcgttgcggataccttcagagattttgctgtatcaacggtccctgtaagtggaccttcccatctgaggggactgtgtgggatgggcggacctagaactgtagtggccggatcaagcgatgctgcccaaaaggctgtgcgggctatggctgtgttgaccgaccacccttatgctagcctgacccttcccgatgacgctgccgcagattgtttgttcctgagacctggatag

SEQ ID NO: 220832 - DNA, 858 bp, Artificial Sequence
  Description of Artificial Sequence: Synthetic coding sequence
atgggcacccctggggaaggcttgggtcggtgcagtcacgccctgatccgaggggtacctgaatccctagcatcaggagagggcgcaggtgcaggcctccctgcactggacctagccaaagctcagcgcgagcacggcgtgttgggagggaaacttcgccaaagacttggacttcaacttctagagctacctcccgaggagtctctgcctctggggccactcctaggggacaccgctgtaatacaaggtgataccgcgctgataactaggccctggagtcctgcaagaagaccagaggtggatggcgtccggaaggctctgcaggatctaggcctgcgcattgtcgagattggcgacgagaatgccacactcgacgggacggacgtgttatttaccggaagagaatttttcgtgggactgagcaaatggactaaccatcgcggagcagagatcgttgcagacaccttcagagatttcgctgtctctacggtacccgtgtcaggcccttcacacctgcggggactttgtggcatggggggtccacgaaccgtagtcgctggtagtagtgacgccgctcaaaaggctgtcagggccatggccgtgctgactgaccacccatacgcttcactaacactccccgatgatgccgctgcagactgcctctttttgcgaccgggactcccgggagtgcccccattcttgctgcatcgcggaggcggtgatctacctaattcccaggaagctttacagaagttgtctgatgtgaccctagtgccagtgagctgcagcgagttagagaaggccggagccggactctcatctctatgtctcgtactaagcaccaggccacactcctag

SEQ ID NO: 220833 - DNA, 711 bp, Artificial Sequence
  Description of Artificial Sequence: Synthetic coding sequence
atggggacccccggtgagggcctaggaagatgttctcacgccctcataagaggggtgcctgaatcattggcttctggcgaaggcgctggggctggcttgccagccttggacctggcaaaagcacaacgggagcacggcgtcctcggaggaaagctgcgtcagagactcgggctccaactgttagaactacctcccgaagaaagtttgccactaggacccctcttaggcgatactgccgttattcagggagacacggctcttatcacaagaccctggagtccagctcgcagaccagaagtggatggagtcagaaaagctctccaggaccttggcctgcgcatcgtggaaatcggcgacgagaatgctactttagacgggacggacgtattgtttacagggagagagttcttcgtggggttatctaaatggacaaaccacaggggtgccgagatcgtcgcagacacattccgggatttcgccgtgtcaacagtaccggtaagtggtccttcacaccttcgaggcttgtgcgggatgggtgggccaagaactgtcgttgcgggatcttcggacgcggcacagaaggcggtccgcgcaatggctgtactgacagaccacccatacgcaagcctgactctccccgatgacgcggctgctgactgccttttcctgcgcccaggattgcctggagtcccaccatttctcttgcattag

SEQ ID NO: 220834 - DNA, 711 bp, Artificial Sequence
  Description of Artificial Sequence: Synthetic coding sequence
atgggcactcccggagagggtctggggaggtgttcccacgctctgatccggggtgtgcctgagagcctggcatcaggcgagggagcaggagctggactgcctgccttggacctggcaaaagctcagcgagagcacggagttctcgggggaaagttaaggcaacgactaggcctccagctcctcgagctcccacccgaagaatcactgccactggggccattgttgggcgacacagctgtgattcagggcgatactgctctgattactcgaccctggagtcccgcacgacggccagaggtagatggagtccgtaaggcactgcaggatctcggtttgcggattgtggagattggcgatgaaaacgctacactggacgggacagatgttctgtttacagggcgagagttcttcgtcggcctttcaaagtggacgaatcatcggggagccgaaatagtcgctgacacctttcgcgactttgctgtctctaccgtcccagtaagcggtccaagtcacctgcgcggtttgtgtgggatgggtggacctagaaccgtggtcgctggcagctccgacgccgctcagaaggccgtcagggccatggctgtgctgacagaccacccatacgcaagtctcacactgccagacgacgcagccgctgactgtctgttcctgcgcccagggttgcctggagtgcctccatttctgttgcactag

SEQ ID NO: 220835 - DNA, 858 bp, Artificial Sequence
  Description of Artificial Sequence: Synthetic coding sequence
atgggcaccccaggagagggactcgggagatgctctcatgccctaatacgcggagtgccagagtctctggctagcggagagggagccggtgccggtctgccagccctggacctggctaaggctcagcgagaacacggggtgctggggggaaagctgcgccagcggctgggtctacaactgctggagctgcccccagaagaaagcttgcccctcgggcctctcctgggagataccgccgtcatccagggtgacaccgccttaattacgcggccatggagccccgcaagacggccagaggtagatggcgtccgtaaggcattacaggacttggggctccgtattgttgagatcggcgatgagaacgccacactagatgggacagatgttctgttcactgggagagaattcttcgtcggcctgagtaaatggaccaaccacaggggcgctgagatagttgcagacacctttcgggattttgctgtatctactgttccagtctctggtccatcacacttgcgcggattgtgcgggatgggtggccctaggaccgtagtggccggaagcagtgatgccgcacaaaaagctgttcgagcgatggcagtcctgacagaccatccatacgcgagtctgaccctccccgacgatgccgctgctgattgtctctttttgcgccctgggctgcctggagtgccccctttcctcttacaccgcggagggggtgacctgccaaactcgcaagaagcacttcaaaaactgagcgacgtcacacttgtgcccgttagctgctccgagctcgaaaaagcaggagccggtctcagctcgctgtgtctggtgctcagcacccgcccacactcttag

SEQ ID NO: 220836 - DNA, 678 bp, Artificial Sequence
  Description of Artificial Sequence: Synthetic coding sequence
atgggcacaccgggtgagggattaggtcggtgttcccacgccctaattagaggcgtacctgagtctctcgctagcggtgagggagcaggggcaggcctgcctgccctggacttagccaaggcccagcgtgagcatggcgttctgggcggaaaactccgccagagactgggcctgcaactattggaattaccacctgaagagtcccttcccctgggccctctgctgggggatacggccgtgatccagggcgacacggcactaatcactcggccatggagcccagcacgcaggccagaagtggacggtgtccgtaaggctctgcaggatctggggttacggattgtagagataggagacgaaaacgcaacacttgacggaacagacgtcctgtttactggacgcgaattttttgtaggattgagcaaatggactaaccaccgcggagctgaaatcgtggccgacacgtttagggattttgctgtttctactgttccagtgagtggcccttcacacttaaggggtttgtgtggaatggggggtccacggacagtggtagccggttctagtgacgcggctcaaaaggctgtgcgcgctatggcagtgttgacagaccacccatacgcttctctgacactccccgacgacgcagcagctgattgcctgtttctgagaccctag

SEQ ID NO: 220837 - DNA, 858 bp, Artificial Sequence
  Description of Artificial Sequence: Synthetic coding sequence
atggggacgccaggtgagggcctcggcagatgtagccatgcgctgattcggggtgtcccagagtcacttgccagtggggagggcgcaggagccggattaccggctctcgatctggccaaagcccagcgggaacacggcgtgctggggggtaaactgcgacagcgtttgggcctacaattactcgaactaccaccagaagagtccctgccgctaggccctttacttggagatactgccgtgattcagggtgatacagccctgatcacaaggccgtggtcaccagcacgccgtccggaggtcgatggagttagaaaggccctgcaggacttaggtcttcgcattgttgagatcggggacgagaatgctaccctggacgggacagatgttctcttcactgggagagaattctttgtgggactaagcaagtggacaaaccataggggcgctgaaatagtggctgacacctttagggattttgctgtgtccaccgttccggtttctggccctagtcatctaagaggattatgtggcatgggcggaccgagaacggtggttgctggcagctctgacgcagcacagaaggctgttcgtgccatggcagttctgaccgaccatccttacgcctcgctaaccttgcctgatgacgctgcggcagattgtcttttcctcagaccagggttacctggcgtgcccccttttctgctgcacaggggcggtggggatttgcctaactcacaggaagccctgcagaagttgagcgacgtcaccctagtgcccgtgtcttgctctgagctagagaaagcgggagccggacttagttccctgtgcctggttcttagcacacggccacactcctag

SEQ ID NO: 220838 - DNA, 567 bp, Artificial Sequence
  Description of Artificial Sequence: Synthetic coding sequence
taaaggagacctgaggtcgacggcgtacggaaagcgcttcaggacctgggcctcagaattgtggagatcggcgacgaaaatgccacattggacggcacagacgtactctttacgggccgtgagtttttcgtcggccttagcaaatggacgaaccaccgtggagcagagatcgtggccgatacgtttagagattttgcagtctccacggttccagtcagtgggccaagtcacttgcgtgggctctgtgggatgggaggacctcgcacggtagtcgcgggtagctctgacgcggctcaaaaggccgtacggatgacacaactcctgacggtgagcttcttcgtcctggggtgtttagtgtgtccgctgagcagctgcacggtggaggtcgggatttgccccactgccagaaggcactgccgttcatcgttgatgagcccctggtatctttgtcctgcacagaattggcgacgcctcgctcccggaagtgccccttcggcctggtgtagtgcacatgcgccaactgcagaaggacttgcactgggatactgctggcccggagttggctag

SEQ ID NO: 220839 - DNA, 567 bp, Artificial Sequence
  Description of Artificial Sequence: Synthetic coding sequence
tagagaagaccagaagtggatggcgtgcgcaaggccctgcaagatctcgggctgagaatcgtggagattggggacgagaatgctacccttgacgggactgacgttttattcactgggcgagagttcttcgtgggactgtccaaatggaccaatcatcggggtgctgagatagtagccgacacttttcgggacttcgcagtctctaccgtgccagtgtccggaccttctcatctgcgcggactgtgtggaatgggcggtccgaggaccgtggtggctgggtctagcgacgctgctcagaaggcagtaaggatgacacagctacttaccgtgtcctttttcgtcctggggtgtctggtgtgcccactgtcatcctgtaccgtcgaagttggcatctgcccaacagctcggcgtcactgcaggtcatcccttatgagtccttggtacttgtgcccggctcagaactggaggaggctggcccctggttcagccccatctgcctggtgtagtgcccatgcccctacagccgagggactggcgctaggttactgctggccaggagtgggatag

SEQ ID NO: 220840 - DNA, 858 bp, Artificial Sequence
  Description of Artificial Sequence: Synthetic coding sequence
atgggaacccccggagaggggctgggccgttgcagccatgcactgatccgtggcgtccccgagtctcttgcttctggcgagggggcaggagccggacttcccgcacttgacctggccaaggctcagagggagcacggcgtattgggaggcaaactgcgccaacggctgggcctgcagctcctggaattacccccagaggaatctctcccgctgggtcccttacttggagatacagcagtgattcagggggacaccgcactgataaccagaccttggagcccagcgaggcgcccagaggttgacggcgtgcgcaaggcgctgcaagacctgggcctacggattgtcgagatcggggacgaaaacgccacgctagatgggactgacgtgttgtttactggcagggagttctttgtgggcctgagcaagtggactaaccatcggggagctgagatagtggccgatacgttccgggattttgccgtaagtaccgtcccggtctccggacccagtcacctaagggggctctgcgggatgggtggaccgaggaccgtggtggcgggatcatccgatgccgctcagaaagctgtgcgtgcaatggctgttctgacagatcacccttacgcctcgctcacactgcctgacgacgccgctgccgattgtctgtttctgagacctggactccccggagtccctccatttttgctgcaccgcggtggcggtgacctgcccaactcgcaagaggccttgcagaagctgtccgatgtgactctggtacccgtctcatgtagtgagctagagaaagctggagcaggattatcctctctctgtctggtactgtctacgcgcccacactcatag

SEQ ID NO: 220841 - DNA, 711 bp, Artificial Sequence
  Description of Artificial Sequence: Synthetic coding sequence
atgggcacaccaggagaagggcttggcaggtgttcacacgcactgattcggggagtgccagagagcctagcctctggcgagggcgcaggggcaggactgcccgctctagacttggcaaaggcccaacgtgaacacggcgttttggggggaaagttgcgccaaaggcttggcttgcagctgctggaattaccgcctgaagaatccctgccccttggtcccctccttggtgataccgccgtgattcagggtgacacagccctgatcacaagaccctggtctcccgctcgcagacccgaggttgacggggtgagaaaggccttacaggatctgggcctgagaattgtggagatcggggacgagaatgcaaccctggacggcaccgatgttctattcactggtcgcgagttcttcgtgggcctcagcaagtggaccaatcatcggggtgctgaaatcgtagcagacactttccgggatttcgccgtcagcactgtcccagtgtctggcccttcgcacctcagaggtttatgtggaatgggcggacctaggaccgtggtggcagggtccagcgatgctgcgcagaaagcggtgcgcgctatggctgtgctgacggatcacccttacgcctcactgacacttcctgacgatgcagcagctgactgcctatttctccgacctggccttcctggcgtccccccatttctgctgcattag

SEQ ID NO: 220842 - DNA, 567 bp, Artificial Sequence
  Description of Artificial Sequence: Synthetic coding sequence
tgaaggcggccagaggtggatggggtccggaaggctttacaagacctaggattgcggatcgtggagataggtgatgagaacgctacactggatggcactgatgtgttatttaccggtcgagagttttttgtaggccttagcaaatggactaaccatcggggagcagagatagtcgccgacacattccgcgattttgccgtcagcacagtaccagtctccggcccaagccacttacgcggtctgtgtggcatggggggtccgcgaacagtggttgccggatcaagtgacgccgcacagaaagctgtcagaatgacccaactgctgaccgtgagcttctttgttctggggtgcctggtgtgcccccttagcagctgcaccgtcgaagttggtatctgccccacggcccgacgccattgtcggtcgtcactaatgagcccttggtatctgtgtccggctcagaattggcggaggctcgcgccaggctccgctccttcagcctggtgtagtgcacacgcaccaactgccgagggtttggcacttggctattgttggccaggcgttgggtag

SEQ ID NO: 220843 - DNA, 858 bp, Artificial Sequence
  Description of Artificial Sequence: Synthetic coding sequence
atgggaacacccggtgagggccttggcaggtgttcccatgctctgatccgaggcgttcctgagtcgttggcatctggtgaaggtgcaggtgcgggactgcccgcactggatcttgcaaaggctcaacgcgagcacggtgtgctaggcggtaagcttcggcaacgattaggtcttcagctgctcgaattgcctccagaggagagtctccccctcggaccactgctgggtgatactgccgtgatacagggcgacacagctctgattacccgaccatggtcccctgctagacgacccgaggtggatggggtgcgcaaagccctgcaggatttgggcctcaggatcgttgaaatcggagacgaaaacgccaccctggacggtactgacgtcctgttcacgggcagagaattctttgttggactgtctaaatggacgaatcaccggggagcggagatcgtggcagacacgttccgcgatttcgcagtctcaactgtccctgtgtccggtccatcacatctgcgcggactctgtgggatgggagggccacggacagtggttgctggatcttctgatgccgcacagaaagccgtgcgcgcaatggccgtgctcacagaccacccctacgcgagcctgaccttgcccgacgatgcagccgctgattgcctcttcttacggcctgggttgccaggtgtacctcccttcctcctccaccgcggagggggtgacttacctaactcacaggaagccctgcagaagctctccgacgtgaccctggtgccggtatcttgctctgagcttgaaaaggcaggggcaggcttgagcagcctgtgtcttgtgctgtcaaccagaccacacagctag

SEQ ID NO: 220844 - DNA, 858 bp, Artificial Sequence
  Description of Artificial Sequence: Synthetic coding sequence
atgggaacaccaggcgaagggttgggccgatgttcacacgccctgattcgcggtgtgcccgagtccttagctagcggagaaggcgcaggggctgggttgcctgctttggacctagccaaagcgcagcgagaacacggagtgcttggcggaaaattacggcagagactggggttacagctcctagagctgcccccagaggagtctctccccttagggcctcttcttggagatacagccgtgatccaaggcgacactgccctgatcaccagaccttggtctcctgccaggcggcctgaggtcgatggggtcagaaaagctttgcaagacctgggcttgcggatcgtagagatcggcgacgagaatgctaccctggatggcaccgatgtgctttttactggacgcgagttctttgtaggcttgtccaagtggaccaatcatcgcggtgctgagatcgtggcagataccttccgagatttcgctgttagtaccgtgcccgtcagcgggcctagccatctccggggactgtgtggcatgggcggtccgaggacggtcgtcgccggatcatctgatgccgctcagaaggccgtgcgagccatggcggtgttgacagaccatccctacgccagcctgacactccccgatgatgcagccgctgattgtctgttcctccggcctggactgcctggtgtacccccattcctgctccatcgcggtggtggcgacttacccaactcccaggaggctctacagaaactgagtgatgtcaccctggtgccggtgtcctgcagtgagttggaaaaagcaggagcaggattgtcaagcctatgtctcgtactatcaacacggccacacagctag

SEQ ID NO: 220845 - DNA, 711 bp, Artificial Sequence
  Description of Artificial Sequence: Synthetic coding sequence
atgggcactcccggagaaggtctgggcaggtgttcgcacgccctaataaggggggtacccgagtccctggcttctggtgagggcgctggcgcagggctcccagcattagatctagccaaggcccagagggagcatggggtcctgggtggcaaactgagacagcgcctaggattgcagctgctggagcttccgcctgaagaatctctgcctcttggtcccctccttggcgacacggcagtcatccaaggagataccgctctcattactcggccatggtccccggctagacgtcccgaagtagacggagtaagaaaagctctgcaggacctgggcctgcgcatcgtggaaataggggacgagaacgccacccttgatggaaccgacgttctctttactgggagagagttcttcgtaggactgagcaaatggactaaccaccgaggcgctgaaattgtggcggacacgtttcgggactttgccgtcagcaccgtccccgtgtcagggccaagccatctgcggggactgtgcggcatggggggacccagaacagtggtcgccggaagctcagatgccgcacagaaggcggttcgcgctatggccgttctgactgatcatccgtatgcctctctgactctgcctgacgacgctgccgcagattgtctttttctgaggcctggtcttccgggagtgcctccatttctcctgcattag

SEQ ID NO: 220846 - DNA, 711 bp, Artificial Sequence
  Description of Artificial Sequence: Synthetic coding sequence
atgggaacgcccggtgaagggctagggagatgtagccacgctctcatcagaggcgtgcctgaaagcctcgcgagcggcgagggcgctggggcaggattacctgctctcgacctggctaaggcacaaagggagcacggtgtgctgggagggaaactcagacagcggttgggtttgcagttattggagctgcctcctgaggagtcacttccactgggtcctctgctgggagatactgcagtaattcaaggagataccgccctgatcacacgtccctggagccctgccaggagaccagaagtggatggggtgagaaaggccctgcaagatctcggcctgcgcatcgtcgagataggcgatgaaaacgcaacactagacggaacagacgttctattcactggccgagaattcttcgtggggctgagtaaatggacaaatcataggggtgccgagatcgtggcagatacattccgggacttcgcagtgagcaccgttccagtgtcaggaccatctcacctgagaggactgtgtggcatgggcggaccaaggactgtcgtggcgggatcgagcgacgctgctcaaaaggctgtgcgggcaatggcagtgctgactgatcacccttatgcttcactcacacttccagatgacgccgcagctgattgcctatttttacgaccagggctgcccggagtgcctccatttctgttacattag

SEQ ID NO: 220847 - DNA, 2601 bp, Artificial Sequence
  Description of Artificial Sequence: Synthetic coding sequence
atgctccggcctggagcacaattgctgcggggactcctgcttcgatcttgccctcttcaagggtctccagggagacccaggtcagtatgcggacgagaaggggaagaaaagcccccactgagtgctgagactcagtggaaagatcgagctgagaccgttatcatcggaggtggctgcgtaggggtatcgctggcctatcacttggccaaggcgggaatgaaggacgttgtgctgctggagaaatctgagttgactgccggaagcacctggcacgctgccggactgactacttatttccatcctggcatcaatcttaaaaaaatccactacgacagtatcaagctgtatgagaaattagaggaagagacgggccaagttgtcggattccaccagccagggagcatccgattggccacaactcctgttagggtcgacgagtttaaatatcaaatgactcgcactggctggcacgcaacagagcagtatctcatcgagccagagaaaattcaggagatgtttcccctcctgaacatgaacaaagtgttggcagggctttacaatcccggagatggacacatcgacccttactcccttaccatggctctggcagccggagctcgtaagtgtggcgcactgttgaagtatcccgcaccagtgacgtccctgaaagccagatccgacggcacttgggacgttgagaccccgcaggggtctatgcgggctaaccggatcgtaaacgctgcgggattttgggctagggaggtgggcaagatgattggcttagagcacccattaatccccgtccagcatcaatacgtggtcacgagtactatatcagaggtgaaggctctgaagcgggaacttcctgtcctccgtgacctggaggggagctactatttacgacaggaacgcgatggcctcctgttcggcccttacgaatctcaggagaagatgaaagtgcaagactcatgggtcactaatggcgtgccacctggatttgggaaggagctgttcgaaagcgatttggacagaattatggagcacattaaggcagccatggaaatggtgcccgtgttgaagaaggccgacatcatcaatgtggtgaacggccctattacctactcgcctgacatcctgccaatggtgggaccccaccagggagtgcgaaattactgggttgcgatcggatttggctacgggatcatccacgccggtggggtgggaaaatacttatccgattggatcctgcatggcgagcccccattcgacttaatcgaactggaccctaatagatatggcaaatggaccacaactcagtatactgaggcaaaggcccgagaaagttatggttttaacaacatcgtcgggtaccccaaggaggagagattcgccggaaggcctacccaaagagtgtctgggttataccagcggcttgagagcaagtgttccatgggcttccatgcaggctgggaacagccccattggttctacaagccaggacaggacacccagtatcgtccttcgttccggcgaacaaattggtttgaaccagtaggttctgaatacaagcaagtaatgcagcgtgttgctgtcacagacttgtcaccatttgggaaattcaatattaaaggtcaagatagtattcgactactggaccacttgttcgccaatgttatccccaaggtaggatttaccaatataagccatatgttgacacctaaaggcagagtgtatgccgaacttaccgtttctcaccaatcacccggtgaattcctgttaataacagggagtggatccgaattacacgacttgagatggatagaggaagaagctgtcaaaggtggatacgacgtcgagatcaagaatatcaccgacgagttaggagtgcttggtgtcgcaggaccccaggcaagaaaggtgctgcagaaactgactagtgaggacttgtccgatgacgtcttcaaattcctccagacgaaatccttaaaggtgtcaaatattcctgtgactgctatccgcatctcctacactggagaactcggttgggagctgtatcataggcgggaagacagtgtcgcgttgtacgacgccataatgaacgccggacaggaggaaggcatagataattttggaacgtatgcaatgaatgctttgcgcttagaaaaagcgttccgtgcatggggactggagatgaattgcgacactaatccattagaagctggtctggagtattttgtgaagttgaataaacctgctgacttcataggaaaacaggctcttaagcagattaaagccaaggggctgaagcgcaggctcgtgtgtctgaccttggccacagacgatgtcgatcctgaagggaatgagtcaatttggtataacggtaaagtcgtgggcaataccacttccggatcttacagttactccattcagaagagtttggcattcgcatacgtcccagtgcagctatctgaggtaggacagcaggtggaagtggagttactggggaaaaattaccccgctgtaattatccaggagccgctggtactgacggaaccaacaaggaacagactgcagaagaaaggtggaaaggacaagacgtag

SEQ ID NO: 220848 - DNA, 1722 bp, Artificial Sequence
  Description of Artificial Sequence: Synthetic coding sequence
atggagcgccaatctcgcaactcagacaattggagatggctgtgctggtgtgagtctggcctttcgcccggacagtctagggacgagagatgcggcccagccggtgagattcgagctcacggttggatttatctggcaagacgattttgggcgagagaagtaggcaagatgataggtctcgagcatccccttattcctgtgcagcatcagtatgtggttaccagcaccatctccgaggtgaaagccctgaagagggagttgccggtgctccgtgatctggagggcagttactaccttagacaagagcgcgatggcctgctgttcggcccttatgaaagtcaggaaaaaatgaaggtgcaggattcttgggtgactaatggcgtcccacctggattcgggaaggagctgttcgagtcagatttggatagaattatggaacacatcaaggccgctatggaaatggtccctgttctcaagaaagccgatatcatcaatgttgttaacggcccaattacctattcacccgacatattgccaatggtgggcccacaccaaggcgtcaggaattactgggtggcgattgggtttggctacgggatcattcatgctggaggcgtcggcaaatatttaagtgactggatcctacatggagaacccccatttgatctgatcgagctggaccctaatcgctacgggaaatggaccaccacacaatacacagaggcgaaggcgagagagagctatgggtttaataatatcgtcggttatccaaaggaagagcgcttcgctggacgacctacacagcgggttagcggcttatatcagaggctggagtccaaatgctccatgggctttcacgccggatgggagcagccgcactggttttacaaacctggacaagacactcaatacagaccttccttcaggcgcactaactggttcgaaccggtcggatctgagtataaacaggtaatgcagcgggtggccgtgacggacctgtcgcctttcggaaaatttaatatcaaagggcaagacagtattaggctgcttgatcaccttttcgcaaatgtgatccccaaggtaggctttaccaatataagtcacatgcttacgcctaaggggagagtgtatgctgaactcaccgtgagccatcaatctcccggtgagtttttgctgattacggggagcggatcagaattgcacgatctgagatggatcgaggaagaggcggtcaaaggtgggtacgacgttgaaatcaagaacattacagacgagctgggcgtacttggggtggcaggccctcaggcccgtaaagtgctgcagaaactgacttctgaggatctgagtgacgacgtgtttaaattcttgcagactaagagcctgaaggttagcaatatcccagttactgccataaggatttcctacaccggggagctaggctgggaactctatcaccgcagagaggacagtgtagcgttgtatgacgcaatcatgaatgccggtcaggaggagggcatcgacaactttggcacctatgctatgaacgctctgcgcctggagaaggccttccgggcatgggggctggaaatgaattgcgatactaatccgctcgaggcgggtctagaatattttgttaaattaaacaaagatcagaactcttgtttcgctcattttaaggaagaaaatggctgggttagcagatgggccatccgcccttattag

SEQ ID NO: 220849 - DNA, 1842 bp, Artificial Sequence
  Description of Artificial Sequence: Synthetic coding sequence
tacctgattgagccagagaaaatccaggaaatgttcccgctgcttaacatgaacaaagttctggccggtctttataatcctggtgatggccacatcgacccgtactccctcaccatggcacttgcagccggtgcaagaaagtgtggcgctctcctcaaataccctgcccctgtcacaagtcttaaggccagatccgacggaacctgggatgtcgagacgcctcagggcagcatgcgtgccaatcgcatcgtgaacgcagccggtttctgggctagggaagtgggtaagatgatcggactggaacaccctctaattcccgtccagcaccagtacgtggttactagcacaatcagcgaagtcaaagcgctgaaacgggaactgccagtgttacgggacttggaagggagctactatctgcggcaggaaagggacggcctattgtttggaccatatgagtctcaggagaagatgaaggtgcaggattcatgggtgacgaacggagtgccccctggatttggaaaagaactgttcgagtccgatctggatagaatcatggaacacattaaggccgcaatggaaatggttccagtccttaagaaagcggatataatcaacgtggtgaatggtcctattacatatagcccagacatcctgccgatggttggtccacatcagggagtcagaaactactgggtcgctataggttttggttatggcatcatccacgcaggaggagtaggtaaatatttatcagattggatcctgcacggagaaccacccttcgacttgatcgaactggatcccaacagatacggtaaatggacaaccacgcaatatacagaagccaaagcaagagagagctacggattcaataacattgtggggtatcccaaggaggagcgcttcgccggtcgcccaacccaaagggtttcgggtctgtatcaaagactcgaaagtaaatgctcaatgggctttcatgctggatgggaacagccccattggttttataagccaggacaggacactcagtaccgtccctcgttccgcagaaccaactggtttgagccggtcggcagcgaatataaacaggtcatgcagagagtcgcagttactgatttgagccctttcggcaagtttaacattaaggggcaagacagcattaggctcctggatcatctgtttgcaaacgttatccccaaagtgggtttcaccaacatttcacacatgctcaccccaaaagggagagtctacgctgagctgactgtatctcatcagagccccggagagtttctgctgattactggttcagggtccgagttacatgacctccgttggattgaggaagaagccgtcaaagggggttacgacgtggaaatcaagaatatcaccgacgaacttggcgttctgggagtcgcgggtccgcaggcacgcaaagtgctccaaaagcttacgtctgaagatctctccgacgacgtcttcaaattcctccagacaaaaagcctgaaggtctctaacatccccgtgaccgctatccgaataagctacacaggggaactgggatgggagttgtaccataggcgggaggatagcgttgctctgtacgatgccattatgaacgccggacaagaggaggggattgataatttcggaacatacgccatgaatgcgttgcgtctcgaaaaggccttcagggcctggggtctcgagatgaattgtgatacaaatcccctggaggctggacttgaatactttgtgaaactcaataaggatcagaactcttgcttcgctcactttaaggaagagaatgggtgggtgtctcgctgggccatccgtccttattag

SEQ ID NO: 220850 - DNA, 1875 bp, Artificial Sequence
  Description of Artificial Sequence: Synthetic coding sequence
atgactcgaacaggatggcacgctacggagcagtacctcatagagcccgagaagattcaggaaatgtttcctctgctaaacatgaataaggtcctcgcaggtctttacaaccctggagacggtcatatcgatccttacagtctcaccatggcccttgccgcaggtgcacggaagtgtggcgctctgctgaagtatccggctccggtgacctccctcaaagcacgatctgacggtacatgggacgtggaaacgcctcaaggatctatgagagccaaccgcatagttaatgctgccggattctgggcgcgagaagtcggcaaaatgataggactggagcatcccctcatccctgtccagcaccagtacgtcgtgacgtcgacaatcagtgaagtgaaggccctgaaaagagagctgcctgtactgagggacctggagggcagctactacctgcggcaggagagggatggactgctgttcggtccttatgaaagccaggaaaaaatgaaagtgcaagacagctgggtgaccaatggtgtgccgcctgggtttggcaaagaactgtttgaatctgatctggataggatcatggaacacattaaggccgcaatggagatggttcccgtgctcaaaaaggctgatatcatcaacgtggtgaatggccctatcacgtacagtccagatatactgcctatggtgggcccacaccagggagtacgcaactactgggtagctatcgggtttgggtatggcataattcacgcagggggagtgggaaagtacctgtcggactggatcctgcacggggagcccccatttgatctcattgagctcgatcctaatagatatggaaagtggaccacaacccagtataccgaagcaaaggcacgcgagtcctacgggttcaataacatcgtgggctatcctaaggaagagcggttcgctggaaggccaacacaaagagtttccggcttgtatcagcggttggaatctaaatgcagcatggggttccatgccggttgggagcagccacattggttctataagccaggacaggatacgcaatatcgtccatcctttcggaggaccaattggttcgaacctgttggctcggagtataaacaggtgatgcaacgcgtcgcagttaccgacttgtctcctttcggaaaattcaatatcaagggacaggatagcattcggctcctggaccatcttttcgcaaacgtgatacccaaagtcgggtttacgaacatctctcacatgcttacacctaaggggagagtgtacgcagagctgactgtctcgcatcagtctccaggggagttcctactcatcactgggagtggctccgagctgcacgacttgcgttggatcgaagaggaagctgtgaagggaggctatgatgtggagataaagaatattacagatgagctgggggtgttgggagtggcgggtccccaggctagaaaggtgttgcagaagctcacctccgaggacctgagcgacgatgtctttaagtttctgcagactaaaagtctgaaagtgtcaaacattcccgtaacagctatacggatcagctacaccggagagctaggatgggaactttaccaccgcagagaggactctgttgccctgtacgatgcaattatgaacgctggccaagaagagggcatagacaatttcggtacctacgcgatgaatgcattgagactggagaaagctttcagggcctgggggttggagatgaattgtgataccaatcctctcgaagccggactcgagtactttgtaaagctcaataaagaccaaaacagttgttttgctcattttaaagaagaaaatgggtgggtcagccgctgggcgatccgtccatactag

SEQ ID NO: 220851 - DNA, 1185 bp, Artificial Sequence
  Description of Artificial Sequence: Synthetic coding sequence
atgtggagctgttggagaaaccagagcagccggttggacctcccaggtacgcagtatggaataattcatgccggtggcgtgggaaaatatttgtcggattggatcttacacggagagccaccgtttgatctaattgagctggatcctaaccgctacggcaagtggacaactacccaatataccgaagccaaggctcgggagagttacggattcaacaacatagtgggctatccgaaggaagagcggttcgctggaaggcctacccagagagtaagtggcttataccagcgacttgaaagcaagtgctcaatgggtttccacgctgggtgggaacagcctcactggttttacaagcccggtcaggatacacagtataggccgtccttccgtcggactaactggttcgaacccgtcggctcagaatacaaacaggtaatgcaacgagtggcagtgaccgaccttagtccattcggtaagttcaatatcaagggccaggatagcatacgtttgctggatcacctatttgcaaatgttattccaaaggtaggctttactaacatcagccatatgctcactcctaaggggagggtctatgcagaactgaccgtgtctcatcaatcgccgggagagttccttctaatcaccggctctggcagtgaactgcacgatctgagatggatcgaagaggaagctgtgaaagggggatacgacgtcgaaattaaaaacatcactgacgaactgggagtcctgggagtggcgggtccccaggccagaaaggttctacaaaaactgacttccgaagacctgtccgatgatgtgtttaagttcctgcaaacgaagtcactgaaagtaagtaacatcccagtgacggccatccgcatcagctacactggggagcttggttgggaactgtaccaccggcgagaagactctgttgccctttatgatgccattatgaacgctggacaagaggaagggattgacaattttggcacgtacgcaatgaacgcccttaggctggagaaggcctttagggcctggggcctagaaatgaattgcgacacaaatccgttggaggcaggactggagtactttgtgaagctgaacaaagaccagaatagttgttttgcacatttcaaggaggagaacgggtgggtgtctagatgggctatacgtccatactag

SEQ ID NO: 220852 - DNA, 4730 bp, Artificial Sequence
  Description of Artificial Sequence: Synthetic coding sequence
atggcggaacgaggcctggagcctagccctgcagccgtcgctgcgcttccacctgaagtccgggcacaactggccgagcttgagctggagctaagtgagggcgacatcacacagaagggatacgagaaaaaacggtccaaattgctttccccttatagtccccagacacaggaaacagacagcgcagtgcagaaagaactaagaaaccagactcctgcgccttcagctgcccaaaccagtgcgccatctaaataccacagaacccgctctgggggagccagggatgagcgctatcgatcagacatccacacagaggccgtacaagctgctttggcgaaacacaaagaacagaaaatggcactgcccatgcccaccaaacgacggtctacgtttgttcagagtcccgctgacgcctgcactccgcctgacacttcctctgcctccgaagatgaaggctcactgcggcgtcaagccgcacttagtgcagcactgcagcagtcactgcagaatgctgaaagttggatcaatcgatctatacaggggtcgagtactagctctagcgcaagtagcacactttctcacggagaggtgaagggcacatccggcagcctagccgacgtcttcgcaaacacgcggatagaaaatttctccgctccaccagacgtgacaacaacgacctcctcttcgagttcatcgagctctatccgccctgccaacatcgatctccctcccagtggcatcgtaaagggaatgcacaaagggtccaaccgaagcagcctgatggatactgccgacggagtgcctgtatcttcccgggtatctactaagatccagcagctgctgaacaccttgaagaggccaaagaggccgcctctgaaggagttctttgtagatgactctgaggaaattgtggaggtcccgcaaccagacccaaatcaacctaagccagagggcaggcagatgacccccgtcaagggggagcccctgggggtgatatgcaactggcctcctgctctggaaagtgcattgcaaagatgggggacaacacaggccaagtgttcttgcctaaccgcgctcgacatgacggggaaacctgtgtacaccttaacttacgggaagttatggagtcgaagcctgaagctggcctacacactgcttaataagctgggcacgaaaaatgagcccgtcctcaaacctggagatagggtggccctggtttatccaaacaatgaccccgtgatgttcatggttgccttttacgggtgtctgcttgcagaagtgattcccgtgccaattgaagtgccattgacccgtaaggatgccggagggcagcagattgggttcctgttggggtcatgtggcatcgctctggccttgacctcagaggtatgcctgaaagggttgcccaagacccaaaacggggagattgtccagtttaagggctggcctcggctgaagtgggttgtgacagacagtaaatatctgagcaagccacctaaggattggcagcctcacatatccccagctggaaccgagcccgcatatatcgagtataagactagtaaggaggggtctgtcatgggtgtcactgtgtctcggctggccatgctgtcgcattgtcaggcgcttagccaagcatgcaactatagtgagggcgagaccatagttaacgttttggatttcaagaaagacgctgggctgtggcatggaatgttcgctaatgttatgaataagatgcacactatttctgttccatacagtgtgatgaaaacgtgtccactgagctgggtgcagagagtccatgctcataaggccaaagttgctcttgtaaaatgtagagaccttcattgggctatgatggcccatcgcgaccagagagacgtttccctgagcagccttagaatgcttattgtaacagacggagcaaacccttggtccgtgagtagctgtgatgcattcttaagcctgttccagtcccacggccttaaacccgaggcaatttgtccctgtgcaacaagcgcagaggccatgactgtcgccataaggaggcccggagttccgggagcacctctgccgggtagggccatccttagtatgaatgggctgtcctacggtgttattcgcgttaatacagaggacaaaaactccgccctgactgtgcaggacgtagggcatgtgatgcccggtggcatgatgtgcattgtcaagcctgacggtcctccgcaactctgcaaaacagacgaaatcggtgagatttgtgtgagtagtaggacaggcggtatgatgtactttggactcgctggagtgactaagaacaccttcgaggtgattccagtcaattctgctgggtctcccgtcggcgacgtcccgtttattaggtctgggctgctggggttcgtggggcctgggtccctggtcttcgtggtcggaaagatggatggtctgctaatggtgagcgggcgacggcacaacgccgacgacatcgtggcaacgggactggccgtggagtccatcaagaccgtgtaccggggtcggatagctgtgtttagtgtgtctgttttctacgatgaacgcatcgtggtggtggcggagcaacgccctgacgcaagcgaggaggacagtttccaatggatgagcagagtactccaggctatagacagtattcaccaggtgggcgtctactgtctggccttggtgcccgctaacaccctgccaaaaactccgctgggcggtattcacatctcccaaaccaaacaactatttctcgaaggatccctgcacccttgtaacattctgatgtgccctcatacgtgtgtcaccaatttgcctaagcctaggcagaagcagcctggcgtaggccctgcaagtgtgatggtaggaaaccttgtcgcgggaaagcgtattgcccaggcagctggtagagatctgggtcagattgaagaaaacgatctcgtcaggaagcaccagtttttagccgagatcctccagtggcgcgctcaggcaactcccgatcatgtgctctttatgctcctcaacgctaagggtaccacggtgtgtactgcgtcctgcctccagctgcacaagcgggcagagcgaattgcgtcggtcttaggagacaagggccatctgaacgccggagataacgtggttttactgtacccacccggaattgagctgatagccgcattctatgggtgcctgtacgctgggtgcatacccgtcacggtgcggcctccacatgcccagaatctcacagccactctgcctaccgtaaggatgatagtcgacgtgtctaaggcagcatgtatattaacctctcagactctgatgcggctcctgcgcagccgagaagccgctgcagccgtggatgttaagacgtggccgacaatcattgatactgacgatctccctaggaagaggctgcctcagttgtacaaacctcctacccctgaaatgttagcctacctggactttagtgtttccactactggaatgctcactggcgtgaagatgtctcactctgctgtgaatgccctgtgtagagcaattaagttacagtgcgaactgtatagttctcgtcagattgcaatttgtttggatccatactgtggccttgggtttgctctgtggtgtttgtgctctgtctattccggccatcagtcggtgctgatcccgccaatggagctggagaacaacctgtttttgtggctgagtacagtgaatcagtacaaaataagggataccttttgctcatactcagtcatggagctgtgtactaagggactcggcaatcaggttgaagtgctgaagacgagaggcataaacctttcttgtgttaggacgtgcgtagtcgtggccgaggagcggcctcgggtcgcactgcaacagagtttcagtaagctgtttaaggacattggactaagccccagagccgtcagtactactttcggctcgagggtaaacgtcgccatttgcttgcagggcacctcaggtccagatccaactactgtgtatgttgatctgaagagtctgcggcacgaccgagtgaggctcgtagagaggggtgcaccccagagtcttctgcttagcgagagcggcaaaatattacctggggtcaaagtagtcatcgttaatccagagaccaaagggcctgttggcgacagccacctgggcgaaatctgggtgaatagcccacacacagcatccggctactataccatctatgattccgaaaccttgcaggccgaccacttcaacacccgcctcagctttggcgacgcggctcaaactctgtgggccaggacaggctacctgggctttgtacgcaggacagaactgacagccgctacaggggaacggcacgacgcattgtatgtggtcggggctctggacgagaccctggagctgcgtgggctgcgttatcaccctatcgacatcgaaacctcagtcagcaggattcacagaagcattgccgagtgcgccgtattcacttggaccaatttactggtggttgtggtcgagctctgcggttcagagcaggaagccctggacttggtccccctagtaactaacgtcgtccttgaggagcattatctcatcgtcggagtagtagttgtggtggaccctggcgtgattccaatcaactctcgtggcgagaaacagaggatgcatcttcgcgatagttttctggccgaccagctggaccctatctatgttgcctataacatgta

SEQ ID NO: 220853 - DNA, 1179 bp, Artificial Sequence
  Description of Artificial Sequence: Synthetic coding sequence
atggccgagcgtggattggaacccagcccagctgcggtggcagctctgccgcctgaggttagggcgcagctggccgagctggagctcgagctgtctgaaggggacatcactcagaaaggttacgaaaagaagagatctaagctactgtctccatattccccacaaactcaggagacggactcggctgtgcagaaagaactcaggaaccagacacctgctccttcagcggctcagacatcagctccctctaaatatcaccgtacaaggtctggtggagcacgggatgaacgctaccgaagtgagttcagtcttgtccgtatctattctgaagatattcataccgaagccgttcaggccgcattggccaagcacaaagagcaaaaaatggccttaccaatgcccacaaaaaggagatccaccttcgtgcagtcccccgctgacgcatgtacgccccctgacacaagcagcgcctctgaagacgagggctcccttaggagacaggctgcgctttcagcggctctgcagcagtccctgcaaaatgctgaatcatggatcaatcggagcatccagggctcatctacatcaagtagcgcgtccagcacgttatcccacggggaagtcaaaggtacctcagggagcctggcagatgtgtttgcaaatactcgaatagagaactttagcgctccccctgatgtcactaccaccactagctcctcctcttctagcagctccatccgccctgctaacatcgacctcccaccttctggtatcgttaaggggatgcataaaggatcaaatcgctcctccttgatggatacagccgacggcgtgcccgtgtcatctcgagtgtccactaagatacagcaactcctcaacacgctgaagcgccctaagcgccctcccctgaaggagttttttgttgatgattcagaggagattgttgaagtgccccaacccgaccctaatcagccgaagcccgaaggacggcagatgaccccggtgaaaggggagcctttaggcgttatttgtaattggccgccagccttggagtccgcactccagagatggggcaccacgcaggctaagtgttcatgcttaacggctttggacatgacggggaagcccgtgtatactctgacatatggcgaatcagcacggttccagattctgctgtcctag

SEQ ID NO: 220854 - DNA, 4671 bp, Artificial Sequence
  Description of Artificial Sequence: Synthetic coding sequence
atggccgacagatcactagaaggaatggctctccctctagaagtcagggcacggttagccgagcttgaactcgaactctctgaaggggatataactcagaaaggctatgaaaagaaacggtccaaacttatcggggcatacctcccgcagcctcctcgggtggatcaggctctgccccaggaacgtcgcgcacccgtcactccaagctcggccagcagatatcatagacggaggagtagtggatctagggacgaaaggtacagaagcgatgttcatacagaagccgtgcaggctgctctcgcgaagcataaggagaggaaaatggccgtgccaatgccctccaagcggcgatcactggtggtgcagacatccatggacgcttacacacccccagatacaagctccggcagcgaggacgaaggttccgtgcagggagatagccaggggactcctacatcatcgcagggaagcattaacatggagcactggataagtcaagctattcatggcagcactacgtcgaccacaagttcttcctcgacacagtccgggggaagtggggctgcccacagactcgccgacgtgatggctcagacacacattgaaaatcacagcgctccgcctgatgtaaccacttacacctccgagcacagcatacaggtggagcggccacagggatccaccggctccagaaccgcaccaaagtacggtaacgccgagttgatggaaacgggagacggggtgcctgtgtcttctcgtgttagcgctaagatacagcagctcgtgaataccctgaaacgtccaaaacgccctccattaagggaattctttgtggacgatttcgaggaactgctcgaggtgcagcagccagatcctaatcagcccaagcctgaaggcgctcagatgctggccatgagaggagaacagctgggcgtggtcaccaactggcccccaagcctcgaggccgctctgcaacgctggggcaccatctcccctaaggcaccatgtctgaccacaatggacacaaacggaaagcctctgtacattctgacgtatggcaaactctggactcgctccatgaaagtggcatattccatcctgcataagttgggcaccaagcaggagccgatggtacggcctggagaccgggttgccctggtatttcccaacaacgacccggcagcctttatggctgctttctacgggtgtctgttagccgaagttgtgcctgtacccattgaggtcccactgacacggaaagacgcaggttctcagcagatcgggttccttcttggttcctgcggcgtaacagttgccctgactagcgacgcttgccacaagggtctgccaaagtcccccaccggcgaaattccccagttcaagggctggcctaagctgctctggtttgtgacagaatcgaagcacttgagtaagcctcccagagactggttcccgcatatcaaggatgcaaataacgataccgcctatattgagtacaagacctgcaaggacggcagcgtgctcggagtgacagtgacaaggacagcactgttaactcattgccaggcgctcactcaggcctgtggatacaccgaggctgagacaatcgtgaacgtattggatttcaaaaaggacgttggactgtggcacggaattctcacgtcagtgatgaatatgatgcatgtcattagcatcccgtactccttaatgaaggtgaaccccctgtcttggattcagaaggtgtgtcaatataaagccaaggtcgcatgtgtgaagagtcgggacatgcattgggcgctggttgctcacagagaccagcgcgacatcaacctcagtagtctccggatgctaatcgtggccgatggcgctaatccatggagtataagcagctgcgacgcatttctaaatgtttttcagtctaaaggcctgcggcaggaagtgatctgcccatgcgcctccagccctgaggcattgaccgtggccataagaagacctaccgacgattcaaatcagcccccaggacgtggcgtgctaagtatgcacggattgacatatggggtaatccgggttgactcagaggagaaactctcagtgttgaccgtccaagatgtgggattagtaatgcccggtgcaatcatgtgttcagtcaaaccagacggggttccccagctctgtaggactgatgagatcggcgagctgtgcgtttgcgctgtcgctacaggaacctcctattacggcttgagtggcatgactaaaaacaccttcgaggttttccccatgacctcttcaggcgcacctatctctgagtatccttttattagaacagggctcctcggatttgttggtccaggagggctggtgttcgtggtagggaagatggacggattgatggttgtaagtgggaggagacataatgctgacgacattgtggctaccgcactggccgtggagcctatgaagttcgtctatcgtggcaggattgccgtgttcagtgtgacagtgttacatgatgagcgtatcgttattgtcgccgagcagcggccagactcaaccgaggaggattcgttccagtggatgtccagggtcctgcaagccattgactcaattcatcaggtcggagtgtattgtctggcattggtgcccgcaaacacacttccaaagactccgttaggcggtatccacctgtccgagaccaaacagctctttctagaagggagcctgcacccatgtaatgtcctcatgtgtccacacacttgcgtgaccaaccttcccaagccaaggcagaaacagccagaaatcggccctgcgagtgtgatggtcgggaacctggttagtggcaagaggattgcacaggcaagcgggcgagacctgggtcagattgaagataatgatcaggcccgtaaattcctctttctgtcggaggtcctccagtggagggctcaaacgacccccgatcacatactgtacaccctgctgaattgccggggtgcaattgctaattccttgacatgtgttcagctacataagcgggcagagaaaatcgctgtgatgttaatggaaaggggccatctccaggatggagaccacgttgccctcgtctaccctcctggcattgatctgatcgccgcattctacggctgtttatacgccggatgcgttcccatcactgtgcgccctcctcacccacagaacatcgcaaccacattaccgaccgtgaaaatgattgtggaggtgagtagaagtgcctgtttgatgaccacgcagctaatttgtaaactgctgaggagtcgcgaggctgctgccgctgtcgacgttcgcacttggcccctgatcttggatacggatgatctgcccaagaaacgtcctgcccagatttgtaaaccatgtaaccccgatactttagcatatctggacttctccgtaagcacaaccgggatgctcgccggagtaaagatgtcccacgccgcaacatctgccttctgcaggagtataaagctccagtgtgagttgtacccctcccgtgaggttgccatatgcctcgacccatattgtggcttgggattcgtgctgtggtgtctctgctctgtgtatagtggtcaccagagtattctgattccgccaagcgagctcgaaacaaaccctgccctctggctattggccgtgagtcagtataaggtgcgcgacacattttgtagctacagtgtgatggaattgtgcaccaagggtctgggttcccagaccgaaagtcttaaggcccgtgggctggatctcagtcgcgttcgcacctgcgtcgtcgtggcggaggaaaggccaaggattgcccttacacagagctttagcaagttgtttaaggacttaggactgcacccaagggctgtgtccacatccttcggatgtagggttaaccttgctatctgcctccagggaacttccgggcctgaccctaccaccgtttatgtggacatgcgggcattacgacacgatcgcgtgcggctggtggagaggggatctccgcatagtctgcctctcatggagtctggtaagattctgcccggtgtccggatcattatcgccaacccagagaccaaaggccctctcggcgactctcacctcggagaaatctgggtacactcagcacacaacgcaagtgggtactttacaatttacggcgacgagtcattacagtcggatcatttcaacagccgtttgtcattcggggatacacagactatctgggcgaggacaggatacttgggatttctcagaaggacagaacttaccgacgcaaatggggagagacacgatgctctatacgtagtgggtgctttagatgaggccatggaactccgcggaatgaggtaccaccccatcgacatagaaacttccgtgatccgggcacacaagtccgtcaccgaatgtgctgtcttcacgtggacaaatttgctcgtggtggtggttgagcttgacggcagtgagcaggaggccctcgacttggttcctctggttaccaatgtggtacttgaggagcactatctgattgttggggtggttgtcgttgttgatattggcgttatccctattaattctaggggtgaaaagcaacgaatgcacctgcgagatggattcctcgcagaccagctagatcccatctacgtagcctataacatgtag

SEQ ID NO: 220855 - DNA, 1971 bp, Artificial Sequence
  Description of Artificial Sequence: Synthetic coding sequence
atggctgtgcctatgcccagcaagagaaggagtctcgtagtgcagacatctatggatgcctacacgccccctgatacctcttcaggcagtgaggatgaagggagtgtacaaggcgatagccaggggacacccacaagcagtcaaggctccatcaacatggagcattggatttcccaagccatccacggcagcacaacttctacgacgtcctctagcagtactcagtctggtggaagtggtgccgcacacaggttggccgatgttatggctcagacccatattgagaaccactcggccccacctgacgtgaccacttacactagcgagcactcgattcaagtggaacgcccacaaggctcgaccggttctcggaccgcccctaaatacggaaacgccgaattgatggagacaggcgatggagtgcctgtgtcctctcgggttagtgcaaaaattcagcaactggttaatactttgaagaggccaaagcggcctccactgagagagtttttcgtcgacgatttcgaggaactgctggaagttcagcagccagaccctaaccaacccaagcctgagggggcacagatgcttgccatgagaggggaacagctgggagtcgttacaaattggccaccctcactggaggccgctctgcagagatggggaaccattagtcctaaggccccatgtctgaccaccatggacaccaatggcaaacctctgtatatcctgacatacggaaagctgtggacgcggtcgatgaaggtcgcttactccatcctccacaaactgggaaccaagcaggagccgatggttaggcctggagatagagtcgcattggtctttccaaacaacgaccctgccgcttttatggcagcgttctacggctgtctgctagcagaggtcgtgcccgtgccgattgaagttccactcaccaggaaggacgcaggcagccagcagattgggttcttgctgggatcctgtggggtgaccgtcgcactgaccagtgatgcatgccacaagggcctgccaaagagccctacgggggagatccctcaattcaagggttggcctaagctgctatggtttgtgactgaatctaaacacttaagtaaacctcccagagactggtttcctcacattaaggacgccaataacgacacagcatatatagaatataagacgtgcaaggatgggagtgtattgggcgtgacagtgacaagaacagcgctcctgacccattgtcaagctttgacacaggcttgtggatacacagaggcggaaaccattgtgaacgtgctagacttcaaaaaagatgtgggactttggcacggaatcttaacttctgtcatgaatatgatgcatgtaatcagtatcccttactccctgatgaaagtgaacccactgtcctggatccagaaggtatgccaatacaaggcgaaggtggcatgcgtgaagtcacgagatatgcactgggcgctcgtcgcacatcgagaccagcgggacattaatctctcaagcctccgaatgctgattgtggccgatggggcaaatccttggtccatatccagttgtgatgccttcttaaatgtgttccagagcaaggggctccggcaggaagtcatctgcccatgtgcatccagcccggaggctctcaccgtggccatacggcgtcccacggatgactctaatcaacccccaggacggggagttctctccatgcatggccttacctacggggtcattagggtcgatagtgaggaaaagctgtcagtccttaccgttcaggacgtgggactcgttatgcctggagccatcatgtgctccgtgaaacctgacggtgtaccccagttgtgcagaacagacgaaattggagagctttgtgtttgtgctgtagcaactggaacatcttactacgggctgtcaggcatgactaagaacacttttgagcatacgtctaacaaggggaaatag

SEQ ID NO: 220856 - DNA, 597 bp, Artificial Sequence
  Description of Artificial Sequence: Synthetic coding sequence
atgtcccatgccgcaacctcagctttttgtcgcagcattaagctgcagtgcgaactttaccctagccgggaggtggctatctgcctagatccttactgtgggctgggcttcgtgctgtggtgcctgtgtagtgtgtatagcggtcaccagtctattttgatcccaccatctgagctcgaaactaatccagccctgtggctgctcgctgtctcacaatacaaggtacgggataccttttgcagctacagcgttatggaattgtgtacaaaggggttaggctcccagaccgaatcactgaaggccagaggtctggatctttcgagagtgcggacgtgcgttgtagttgccgaggagcggccaagaatagcactgacccagtctttcagcaaactgtttaaggacctgggcctgcaccctagagccgtaagcactagtttcgggtgcagggttaacctcgcgatttgtctgcaatgttgggattacagacacgagcccccacgccctgcccctaaatgtttcaaaatggtgtataaggaaggagttagatctgtaggcgaagataagattcgcgagaaaaggaccaagacctggcggtag

SEQ ID NO: 220857 - DNA, 696 bp, Artificial Sequence
  Description of Artificial Sequence: Synthetic coding sequence
taggaaactatcgtgaacgtcctcgattttaagaaagacgtggggttatggcacggcattctaacctcggtcatgaacatgatgcacgtaatttcaattccttattccctaatgaaagtcaatcccctctcctggatacagaaagtatgtcaatataaagcaaaagtggcctgtgtgaaatcgagggacatgcactgggcgctggtggcacaccgagatcagcgggacataaatttatcttctctgcgcatgctgatcgtagccgatggggctaacccttggtcgatcagcagttgcgacgccttcctgaatgtgttccagagtaaaggccttaggcaggaggtgatttgtccctgtgcctccagcccagaggctctgaccgttgcaattaggcggccaaccgatgatagtaatcagcctcccggaaggggggttttgtccatgcatggcttgacatacggcgtaatcagggtcgactccgaagaaaagctgtccgtgctgactgtgcaggatgtcggcctcgtcatgccaggcgctatcatgtgttctgttaaacctgacggggttccgcagctctgcagaacagacgagataggagagttatgcgtgtgcgctgttgcaaccggcactagctactacggtttgagtggcatgaccaagaatacctttgaacacactagcaataagggaaaatag

SEQ ID NO: 220858 - DNA, 564 bp, Artificial Sequence
  Description of Artificial Sequence: Synthetic coding sequence
atggcagacagatctttggaggggatggccctgcccctagaggtccgcgctaggctggccgaactggagctcgagctcagtgaaggggacattacacagaagggatacgagaagaaaagaagtaagctaatcggagcatatcttcctcagccaccaacagccaatggcgctgccgtggtgcgatgtagactgcaacactccgaaggggctccacgaagaacatttagatccgcacacataggagtgtgtgacgttcgggaggctgccgcacgtgaaagagtggcctccactgcagggaatcggcctctgttctacttccgcttcggggtggaccaagcactccctcaggagaggagagccccagtgactccaagctcggcttctaggtatcacaggaggcggagctccggatcccgggatgagcgatatagatctgacgtccacaccgaggccgttcaagccgcattggcaaaacacaaggagaggaagatggctgtgccgatgcccagtaagcgccgatctttggtagtgcagacttcaatggacgcctatacgcctccttag

SEQ ID NO: 220859 - DNA, 468 bp, Artificial Sequence
  Description of Artificial Sequence: Synthetic coding sequence
taagtgtactctggtcaccaaagtatacttatccccccaagtgaactggaaacaaatccagctctttggctcttagccgtgagtcaatacaaggtgagggatactttttgctcatattctgtcatggagctgtgcactaaagggctgggatcccaaaccgagtcactcaaggcgcgagggctggatctgtcgagggtgcggacttgtgtcgtggttgcagaggaaaggccacggattgccctgactcagagctttagtaaattgttcaaagacctgggacttcatcccagagccgtgtctacatccttcggttgtagggttaacttggccatatgccttcagtgctgggactataggcatgaacctccgcgacccgctcctaaatgcttcaaaatggtatacaaggaaggtgtccggagcgttggggaggacaaaattcgtgaaaagagaaccaagacctggcgttag

SEQ ID NO: 220860 - DNA, 1446 bp, Artificial Sequence
  Description of Artificial Sequence: Synthetic coding sequence
atctgggtgagtcggtccgcttgtcttatgacgactcaattgatctgtaagcttctgcggtcacgggaggcggctgctgccgtcgacgtcaggacttggcccctcatcctggacacagatgatctgccgaagaagcgacctgcccaaatatgtaaaccttgcaacccggacactctcgcatacctggatttcagtgtatcgaccaccggaatgctggccggagtgaagatgtcacatgctgcaacatctgctttctgtagaagtattaaactgcaatgtgagttgtatccttctagagaagtggccatctgcctggatccctattgtggtctgggctttgtcctatggtgcctatgttctgtatacagcgggcatcagtccattctaatccccccatctgagctggagaccaatcctgccctgtggttgttggctgtaagtcaatataaagttagggataccttctgcagctattccgtgatggaactgtgcacaaaaggacttgggtctcagactgagtctctgaaggcgcgaggtttggatctgagtcgtgttaggacatgtgtagtggtagccgaggaaaggccacgaatcgccctgacccagtcattctccaagcttttcaaggacctgggactgcaccccagagcggttagcacttcattcgggtgtcgagttaaccttgccatctgcctacaggggacgagcggcccagacccaaccactgtgtacgtagacatgcgtgcactacgccatgatcgggtgagactggttgaacgcggtagtccgcatagtctgccactgatggaatcaggcaagatccttccaggcgtgcgaattataatcgccaatcccgagactaaagggccacttggggacagccatctcggcgagatttgggtgcactccgcccacaatgcttctgggtactttacaatctatggagatgagagtttgcagagcgatcactttaactctcgcctgagcttcggcgatacacagactatatgggccagaaccgggtacctcggattcctacggcgtacagaactgactgacgccaatggagaaaggcacgatgccctgtacgtcgtgggtgccctcgatgaggccatggagctgagaggcatgcgataccaccccatcgacattgagacctctgtgattcgggctcataaatctgttaccgagtgcgctgtgtttacctggacgaacctgcttgtcgtggtggtggaacttgacgggtctgaacaggaagcgcttgacctggtgccccttgtgacaaacgttgttctggaggagcactacctgatcgttggggtggtagtcgtcgttgatataggggttatccccattaactcgcgaggagaaaaacagcggatgcatctccgcgatggcttccttgcagatcagttagaccccatctacgttgcctacaacatgtag

SEQ ID NO: 220861 - DNA, 1116 bp, Artificial Sequence
  Description of Artificial Sequence: Synthetic coding sequence
atgcatggcctcacatatggggtcatccgagtggattcagaggaaaagctgagcgtgctgaccgtacaggatgtgggtctcgtcatgccgggagcaattatgtgcagcgtgaaacctgatggggtgcctcagctctgccgcacagacgagatcggagaactctgcgtttgtgcagtcgcaaccggaaccagctattatggactgtccggaatgaccaagaacacatttgaggtattccctatgacaagttcaggagcccctatcagcgagtacccttttatccgcaccggcctgctggggttcgtgggtccgggaggactggtctttgttgttggtaaaatggacgggctcatggtggtgagcggacggcgacacaacgccgacgacatcgtggcaacggctctcgcagtcgagccaatgaaatttgtctatcggggtagaatagccgtttttagcgtcaccgtgctgcacgacgagcggatagtgatcgtcgctgaacagcgccctgattctaccgaggaggactccttccaatggatgtcccgagtgctgcaagctatcgactccatccaccaggttggagtgtactgcctggctctggtgccagcaaacaccctgcctaagacaccactgggcggaatacacttatccgaaactaaacaactgtttctagagggaagcctacatccttgtaacgtccttatgtgtccacacacctgcgtaacaaacttgcctaagccacgacagaagcaaccagagatcggccctgcctcagtgatggtgggcaatcttgtctcaggtaagagaattgctcaagcttctgggcgtgatctcggccagatcgaggacaatgaccaggccaggaaatttctgttcctgtctgaggtgttacaatggcgggcacaaacaacgcccgaccacatcctatacaccctacttaattgccgagtgcgcagaggagcgggactcccgtggttactggcaagcagagggttagcttggtttctcggagccctgctccttctcagcctcaacccatttgcctctgtactttgggaattcttcctgtgctttgcaattttgaccgagacattcgttccacgtgattgcttctag

SEQ ID NO: 220862 - DNA, 1236 bp, Artificial Sequence
  Description of Artificial Sequence: Synthetic coding sequence
atgtggtcaggctggtggctgtggcccctcgtggcagtttgtaccgccgacttcttccgtgatgaggcagaacgcattatgagagattcccccgtgattgacggccacaacgatctgccttggcaattgctcgacatgtttaacaaccgtttacaagatgagagagcgaatctcactactctcgccggaacccatacaaatataccgaaactgagagccggtttcgtgggtggccagttttggagcgtgtatactccctgcgatacacagaataaggatgctgtgcgtcggacattagagcaaatggatgtggtacataggatgtgccgcatgtacccagagacgttcctgtatgtcacttcaagcgccggaattaggcaggcctttagagaggggaaggttgcttcactgatcggagtcgaagggggacactcaatcgatagctccctaggcgtgctgcgcgcactgtaccagctcggcatgcgatacctcacgctgacccactcctgcaacaccccctgggcggataattggctggtggacacgggagatagtgaacctcagagccagggcctgtcgccattcggacaaagagttgtcaaagagctgaaccgcctaggtgtgttgatcgacctggctcacgtttctgttgccaccatgaaggctactttgcaactctctcgggctccagtaatattctcacactcaagtgcctactccgtctgtgcctctcgtaggaatgttccagacgatgttcttaggctggtcaaacagacagattctctggtgatggtcaatttctacaataactacatttcctgtactaataaggccaatctctcacaggtggctgaccatcttgaccacatcaaggaggttgctggtgcccgtgccgtgggcttcggaggcgatttcgatggggtaccgcgagtgcccgagggactggaggacgtaagtaagtaccctgacttgatagctgagctgctgaggaggaactggacggaagccgaagtcaagggggctctcgcagataatctcctgcgtgtatttgaggcagttgagcaggcgtctaacttgacgcaggcccctgaagaggaacctatacctctcgaccagctcggagggtcctgcagaacccactacgggtactcctcgggagcatcttctcttcatcgccattgggggctgctactcgccagcctggcgccacttgtgctgtgcttgtccttgctctag

SEQ ID NO: 220863 - DNA, 1236 bp, Artificial Sequence
  Description of Artificial Sequence: Synthetic coding sequence
atgtggtcgggctggtggctctggcccctagtggccgtctgtaccgctgatttcttcagggacgaggccgagagaatcatgagggattctcctgtgatcgatgggcacaatgatcttccatggcagctgctggacatgttcaacaatcgactgcaggacgagagggccaacctcacaacactggcaggcacccacaccaacattcccaaactgagagcgggttttgtgggagggcagttctggtcagtgtatactccatgtgatactcaaaataaagatgcagtgcggagaacgctggagcagatggatgtcgtgcatcggatgtgtcggatgtatccagagacgttcctttatgttaccagctccgccggtatccgtcaagcttttcgcgaaggaaaggtggcctctctcatcggcgtcgaagggggacattcaatcgacagctctttgggggttctgagggccctctatcaactaggaatgcggtacctgacattgactcacagttgcaacacaccttgggctgacaactggttagtggacactggcgattcagagccacagtcacaaggtctgtcccccttcggacagagggtagtcaaggaactgaaccggctgggggtgctgattgacttggctcacgtttccgtggctacaatgaaagcgacactccagctgtccagagctcctgtgattttctctcatagctctgcatactccgtgtgcgcttcaagacgcaacgtacctgatgacgtcctgagactggtcaagcaaacggattcattggtcatggtgaatttttacaataactatatttcatgtaccaataaggcaaatctgtcacaggtggccgatcacctggatcacataaaggaggtagcgggagccagggccgtaggttttgggggagatttcgacggggtgcctcgggttcccgaagggcttgaagatgtgtctaaataccctgacctgatcgccgaacttctgagacgaaactggactgaggctgaggtcaaaggcgctctggccgacaacctgctccgtgtgtttgaggctgtcgaacaggcaagtaacctcactcaggcgcctgaggaggaacccatcccccttgaccagttgggcggaagttgcaggacacattacgggtacagtagcggggcatcttctctgcaccgccattggggactgttgttggcctctctggcaccgctggtgctttgcctctcactactctag

SEQ ID NO: 220864 - DNA, 1236 bp, Artificial Sequence
  Description of Artificial Sequence: Synthetic coding sequence
atgtggagcggatggtggttatggcctttggtcgctgtgtgtacagccgacttctttcgcgatgaggccgagcgcattatgagagactccccagtgatagatggtcataacgacctgccttggcagctgctcgatatgttcaataatagactgcaggatgagcgggctaatctgactactctggcgggtacccacactaacatccccaaattaagggccggtttcgtgggcggtcagttctggtctgtgtacactccatgtgacactcaaaacaaggacgcggttcgcaggacactcgaacagatggatgtcgttcacaggatgtgtcgcatgtaccccgagacctttctgtatgtcacatcatctgccggtattaggcaggctttccgggaaggcaaggtggctagtctgataggagttgaaggcggacacagtatcgattcctccctgggcgtcctccgcgcactgtaccaactggggatgcgttacctcaccctgactcactcctgcaataccccgtgggccgataactggctggttgacactggcgactccgagccgcagtcccaaggactgagcccctttgggcaacgcgtcgtcaaggagctgaaccggttgggcgttctgatcgatctggcccatgtcagcgtagctactatgaaggctaccttacaactttccagggccccagtgattttctctcatagttcagcctactcagtgtgcgcttctcgcaggaatgtgccagatgatgtcctgaggctagtcaagcagacagacagcctcgtgatggtgaacttctataataactatatttcctgcacaaataaagccaacctcagccaggtcgcagatcacctcgaccatatcaaggaagtggctggggcaagggccgtcggattcggcggtgactttgatggtgtgcctcgcgtgcctgaaggcttagaggacgtatcaaaataccctgatcttatagccgagctgttgcgaagaaactggaccgaggccgaggtgaagggcgctttggccgacaatctattgagagttttcgaagctgttgagcaagcaagtaacctaacacaggccccagaggaggagccaatccccctggaccaattaggaggctcctgccggactcattacggatatagctcaggggcttcctcgcttcatagacattggggattgctgctggccagcttagccccattggtgttgtgccttagtctgctctag

SEQ ID NO: 220865 - DNA, 381 bp, Artificial Sequence
  Description of Artificial Sequence: Synthetic coding sequence
atgcagccttccggcttggagggcccaggcacattcggccgttggcctttactgtcactattgttgctgctgcttttgcttcagcccgtgacatgcgcctatactaccccagggcctccaagggcgctcacgactttgggagccccaagagcacacacaatgccagggacctacgcccctagcactacactgtcttctccaagcacacagggcctccaggagcaggctagagcattgatgagagacttcccactggtcgatgggtctggccaacccatgtgccacgcacgccctcgaacggggatgccttgtgcctcaccatggagtaggctaaccagttatgccgcttgtgtgcccccaatcctgtcctggtcactatag

SEQ ID NO: 220866 - DNA, 1200 bp, Artificial Sequence
  Description of Artificial Sequence: Synthetic coding sequence
atgcaaccttcaggattggaaggacctggaacgtttggcaggtggcccttgctaagcttgctgctgctgctgcttctcctccagcctgttacctgtgcttacacaacaccgggtccgcctcgagccctcttttggtctgcctacgtcccttgccagacacaggatagggatgcccttaggctgactctggagcagatcgatttgatccgaaggatgtgcgcgtcctattctgaactggagctggtaacgagcgccaaggcactaaacgacacacagaaacttgcatgtctgattggtgtggaaggaggccacagcctcgataacagcctatcgattctgcctactttctatatgctgggtgtgcggtatttaaccctaacacacacttgcaacacaccctgggcggaatcaagtgccaagggtgtgcacagtttttacaacaatatttccggactgaccgactttggtgagaaggtcgttgctgagatgaatcgcctgggaatgatggttgatctcagccacgtttcagatgcagtggctcgcagagctttggaggtctctcaggcgcctgttatcttctcacatagcgccgctcgtggagtgtgtaatagcgcaagaaatgtgcctgatgacatactgcaactcctgaagaaaaatggcggagtcgtgatggtgtccctcagtatgggcgtaatccagtgtaatccatcggccaacgtgtcaaccgtggctgaccacttcgatcacataaaggccgtcattggttctaagtttatcggcatcggtggggactatgacggagcgggaaagttccctcagggactggaggatgtgtctacatacccagtgctgattgaggagctattgtcgcgcggttggagtgaagaagaactccagggggtgttgaggggaaacctgctgcgggtgttccgtcaggtggaaaaggtccaggaggaaaataaatggcagtcacctctagaagataaattcccagacgaacagctgagctctagctgtcactctgacctgagcaggttacggcagagacagtctctgacctcaggccaggaactcacagagatacccatccactggactgccaagctcccagccaagtggagcgtgagcgaaagcagtccgcatatggctccagtgttggctgtggtcgctacctttccggttctgattttgtggctgtag

SEQ ID NO: 220867 - DNA, 1461 bp, Artificial Sequence
  Description of Artificial Sequence: Synthetic coding sequence
atgcagcctagcggactcgaaggtcctggaacctttggcagatggccacttctgagcctgctcctgctcctcctgctcttgcagccggtgacttgcgcctacaccacacctggacctcccagggccctaactacgctcggcgcacctcgggcacacacaatgcccggaacttatgctccttctacaactctctcctcgccctccacacagggcttacaggagcaagccagagcccttatgcgcgattttccactagtggacggccacaatgacctgccacttgtccttcgccaggtgtatcagaagggtctgcaggatgtgaacctgaggaacttcagttacgggcagacatctctcgatagattgcgcgacggcctagttggggcacaattctggagcgcttatgttccatgtcaaacccaggatcgggatgcccttcgtttaacactcgaacagatagatttaatcaggaggatgtgtgcttcctactctgaactggaactcgtcacctcggcaaaagccctcaatgacacccagaagctcgcctgcctgatcggggttgaaggcggacactcactcgacaatagcctgagcattctccctaccttttacatgttgggagtgcgatatctcactctgacccacacctgcaacacgccctgggccgagtcttccgcgaagggcgtgcactccttctataacaacataagtggcctcaccgactttggggagaaagtcgttgccgagatgaacaggttagggatgatggttgacctgtcccacgtcagcgacgctgtcgctcggagagctctggaggtatcacaagcccctgtcattttcagccactctgcagcccgaggagtctgtaatagcgccaggaacgtgcccgacgacatcctgcagctgctcaagaagaatgggggtgtggtgatggtgtcactcagcatgggcgtgatccagtgcaatcccagcgccaacgtcagtaccgtggccgatcactttgatcatattaaggctgtcataggttctaagttcatcggcattgggggagactatgacggggctggcaaattccctcaagggcttgaggacgtctccacatacccggtgttgattgaggaattgctctctcggggatggtccgaagaggaactccaaggggtcttgagaggcaatcttctgagagtgttccgccaggtggaaaaggtacaggaggaaaataagtggcagtcccctctagaggataagttcccggacgagcagctctcatcctcttgtcattctgacctgagccgactcaggcaacggcaatccttgactagcggccaggagttaactgagatccctatccattggaccgccaaactcccggctaagtggagtgtgtcggagagttctcctcatatggcacccgtcttggcagtcgttgcaacattcccagtgctcatactctggctgtag

SEQ ID NO: 220868 - DNA, 1461 bp, Artificial Sequence
  Description of Artificial Sequence: Synthetic coding sequence
atgcagccctcaggacttgagggtccaggcacgtttggtcggtggccactgttgtccctccttttgctgttgctcctcctgcagcccgtaacatgcgcttacactaccccaggacctccgagggcactgacgaccctgggggctccaagggcacataccatgcctgggacatatgccccatcaaccacactgagctccccctcaacacagggcctccaggaacaagctagggccctaatgcgtgacttcccactcgtcgacggccacaatgatcttccgctggtcctgcgtcaggtgtaccagaagggcctgcaggacgtgaacctgagaaacttctcgtacggacagacgtctctcgacaggcttagggacggactggtgggtgcccagttctggtctgcctatgtaccttgccagacccaagaccgcgacgctctgaggcttacacttgagcaaatcgacctgatccgaaggatgtgtgccagctatagcgagctggaattggtgacatctgctaaggccctgaatgatacccagaagctcgcatgcctaattggcgtggaggggggacattccctggacaactccctgagcatcctgcccactttctacatgctcggagtcagatacctaacactcacgcacacctgcaatactccatgggccgaatcctcagcgaagggggtgcattctttctacaacaatattagtggccttactgactttggcgagaaagttgtagcggagatgaaccggctggggatgatggtcgacctgtcccatgtttctgatgccgtcgctcgtagagccttggaggtgagccaggccccagtcatattctcacatagcgcagcacgcggagtgtgcaattccgcaagaaacgtgcccgatgatatccttcaactcctcaaaaagaatggcggagtcgtgatggtgagtctcagtatgggtgtcatccagtgtaacccctctgctaatgtttctactgtggccgatcactttgaccatattaaagccgtgataggctcgaagtttattggcataggcggagactatgatggagccggtaaatttcctcaggggctggaagacgtctcgacctatccagtgcttatagaggaactgctctctcgcggttggtctgaggaagagctacagggagtgcttaggggcaaccttctgagagtgtttagacaagttgagaaggttcaggaggaaaacaaatggcaaagcccattagaggataaatttccagacgaacagctgagttcaagttgtcactcagatctgtccaggcttaggcaaaggcagtctctcacctcaggccaggaactgactgaaattcctattcattggactgccaaacttccggcaaagtggtccgtctctgagagttcaccacacatggccccagtattagccgttgtggctacgtttccagttctcatcctttggctgtag

SEQ ID NO: 220869 - DNA, 1542 bp, Artificial Sequence
  Description of Artificial Sequence: Synthetic coding sequence
atgattcgtaccccgctctcagcctcagcccatcggctcttactacctggatccagaggcagaccgccacgcaatatgcagccgacagggcgagagggaagcagggcgctcagccgaagatatttgagacgcctcctgctgcttttgctcctgctcctcctaaggcagcctgtaaccagggcggagactactccaggagcgcctcgtgcactgagcacgcttggaagtccaagcctgttcacgacccctggcgtcccaagcgcgcttactacaccagggttaaccacacccggtacacctaagacgttggatctgcggggtcgggcacaggctttaatgcggtccttcccattggtggacggacataatgatctcccccaagtgttacgccagcgctacaagaacgtgctgcaggatgttaacctgaggaactttagtcacggtcagaccagtcttgatagactgcgagacggacttgttggagctcagttctggagtgccagcgtgtcatgtcagtcacaggaccagaccgccgtgcggctcgccctagagcagatcgacctcatccatcggatgtgcgcctcctactctgagctggaattagtgacatccgctgagggcctgaacagctcccagaagttggcttgccttattggcgtggagggaggtcactcattggacagcagtctgagcgtgctgcgctccttctatgtcctgggggtgagatatctcacactcacatttacctgctcaacaccgtgggcagagagctccacgaaattcaggcatcatatgtacaccaacgtgagtggtttgaccagcttcggggaaaaggtggttgaagagctgaaccgtctgggcatgatgatcgacttgagctacgcatccgacaccttaattcgccgtgtgctggaagtgtcacaggcgcctgttattttttctcactctgccgcacgggcagtctgtgataacctgctgaatgtacccgacgatatactgcagttgttgaaaaagaatggcggaatagtaatggtgactctatcaatgggagtgctccaatgtaacttgttagctaatgtgagtacagtggcagaccactttgatcatattcgcgctgtaattggtagtgaatttatcggaattggcggaaattacgatggtaccgggaggtttccgcagggactggaagacgtgtcaacctaccctgtcctcattgaagagctgctatcgcggtcatggtccgaggaagagcttcagggggtgctccgcggaaatctactaagggtcttcaggcaggttgagaaagtccgggaggagtcaagagcacagtccccagtggaggccgagttcccttatggccagctgagtacttcctgccactctcacttggtcccccaaaatgggcatcaagccacacaccttgaagtgaccaaacagcctaccaacagagtgccatggcggagtagcaatgccagcccttatcttgtcccgggactggtggctgcagcgactattccaacattcacgcagtggctgtgctag

SEQ ID NO: 220870 - DNA, 2370 bp, Artificial Sequence
  Description of Artificial Sequence: Synthetic coding sequence
atgaggaaagtggagagtaggggagaaggcggacgagaggagctgggctcaaatagtcctcctcagcgcaattggaagggtatcgccattgctctgctcgtcatactggtcgtctgcagcctgattacaatgagtgtgatactgttgactcctgacgagctgaccaattcatccgagacacgtctgtcacttgaggacctgtttaggaaggactttgtgttgcacgaccctgaggccaggtggatcaacgatactgacgtggtatacaagtccgagaatggacatgtgataaagctaaacatagaaacaaatgctactaccctgctgcttgagaacactactttcgtcacattcaaggcaagccgtcattctgtgtctccagacctgaaatacgttctgttggcatatgatgtgaaacaaatattccactattcatatacagccagctatgtgatctacaatatacatacacgagaggtatgggagctcaaccctcctgaagttgaggactccgtgctccagtatgcagcatggggtgtccaaggtcagcaattgatctacattttcgaaaataacatctactaccagcctgatatcaagagctcctcccttcggctgacatcaagcggtaaggaagagatcatctttaacgggatcgccgattggttgtacgaggaggaactgctgcacagccacatcgcgcactggtggagccccgacggcgagcgcctggcatttctcatgatcaacgactctttagtgccgacgatggtaatccccagatttaccggagctctttacccaaagggtaaacagtatccttaccctaaggccggacaggtgaatcctaccatcaagctgtacgtcgtcaacctctatggacccacccacacacttgagctcatgcctcccgactccttcaaaagccgcgaatactacattactatggtgaaatgggtcagtaatacaaaaacagtggtccgttggttgaatcgggcacagaacatttctattctgacagtttgtgaaacaacaaccggggcatgttctaaaaagtacgaaatgactagtgacacctggttaagccagcagaatgaggaacccgtttttagccgagatgggagtaaattcttcatgacagtccctgtgaagcagggcggaaggggcgagttccaccacgtggctatgtttttgattcagagcaagtcagagcagatcactgtccggcatttgaccagcgggaattgggaggttatcaaaatcttggcttacgacgagacgactcagaaaatatatttcctgtctacagagagctccccaaggggcaggcagttgtacagcgcgagtacagagggcttgctcaaccgccagtgcatcagttgtaattttatgaaggaacagtgcacctacttcgatgcaagcttctccccaatgaaccagcatttcctgctcttctgtgagggacccagagtgcctgtcgtgagcctgcacagcactgataatcccgctaagtacttcatactcgagtcaaacagcatgttaaaggaagccatccttaagaagaaaattgggaagcccgagatcaaaatcctccacatcgatgattacgaactccccctgcagttgagtctgccgaaggatttcatggatagaaatcagtatgccctgttactcatcatggatgaagaacctggcggtcaactggtgacagataagtttcacatcgattgggattccgtcctgatcgatatggacaatgtaatcgttgcacggtttgatggccgtggttccgggtttcaaggactgaagattttacaggaaatacatcgccgactggggagtgtcgaagtgaaagaccagatcactgcggtaaagttcctgttgaagcttccatacatagattcaaaaagactcagtatctttggtaaggggtatgggggatacattgcgagcatgattttgaagagtgatgaaaaattgtttaagtgtgggagcgttgtggccccaatcactgatcttaaactctatgctagtgccttttctgagcgatatctgggcatgcctagcaaggaggaatcaacataccaggctgctagtgtgttacacaatgtccatgggttgaaagaagagaatatcctaatcatccacggcacggcggacaccaaggtgcacttccagcactcagctgaacttatcaagcacctcataaaggccggagtcaattataccatgcaggtgtatcctgacgaagggcacaacgtgtccgagaagagtaagtatcatttgtattcaacaatccttaagtttttctctgactgtttgaaggaggagatttctgttctgcctcaggagccggaggaagatgagtag

SEQ ID NO: 220871 - DNA, 2403 bp, Artificial Sequence
  Description of Artificial Sequence: Synthetic coding sequence
atgacagctgccaagcaagagccccagcctacacctggagccagggcaagccaggcccagcctgccgaccaagaattaggctccaattctcctccgcagaggaactggaaggggattgctatagccctattagtgatactggttgtttgcagcctcattaccatgagtgtcatcctccttacacctgacgagctgactaattccagtgaaacccggctatccctggaagacctgttcagaaaggacttcgtactgcacgacccagaagccaggtggattaacgatacagacgttgtgtataagtctgagaatgggcacgtcattaagctgaatattgaaacgaatgcaaccacgttattgcttgaaaacacaacattcgtcacgtttaaggcgtcaagacattctgtgagccccgacctcaagtacgtgctgttagcttacgacgttaaacagatcttccactattcctacactgcgagctatgtcatttacaatatccacacacgggaggtttgggagctgaaccctcctgaagtcgaagatagtgtcctgcagtatgccgcatggggagttcagggacagcagcttatctacatctttgagaataacatctactatcagccggacattaagtccagttcactgcgtctgacttccagcggcaaggaagaaataatttttaatggaatagccgattggctgtacgaagaggagctgctgcacagccatatcgcccattggtggtcgccagatggcgagcgactcgcattcctgatgattaacgacagcttagtgccaaccatggtgatcccacgcttcactggcgcactctatcctaagggaaagcagtacccttaccccaaggccggtcaagtgaatccaactatcaaactttacgtggttaacctgtacggcccaactcacacgctcgagctgatgccacctgattcatttaaatctcgggagtattatattacaatggtgaagtgggtgtctaacaccaaaaccgtggttcggtggctgaaccgcgcacagaacatctccatcctgacagtgtgtgagactactaccggcgcatgttcaaaaaagtacgagatgacctccgatacatggctcagccagcaaaacgaggaacctgtattcagccgcgatggcagcaagttttttatgacagtgccagttaaacaggggggacggggtgagttccaccacgtagccatgtttctaatacagagcaagagtgagcagataacagtgaggcacttaacttccggcaactgggaagtgattaaaatactcgcatatgacgaaaccacacaaaagatctatttcctgtccacggaaagctccccacggggtcggcaactgtactctgcctctacagaagggttattaaaccgtcaatgcatatcatgcaattttatgaaagaacagtgcacctatttcgatgctagcttctcccccatgaatcagcactttctcctgttttgcgaaggcccaagggtccccgtggtctctctccacagcacggacaatccagcgaagtattttatactggaatctaacagcatgctgaaagaggcaatcctgaagaagaaaattggtaaaccggagattaagattcttcacatagatgattatgagttgccgcttcagctgtcactcccaaaagattttatggacagaaatcagtacgcactgctcctgataatggacgaagagcctggcggacagttggtcaccgacaaattccatattgattgggacagcgttctcatagatatggataatgtcattgtcgccaggtttgacggaagagggtccggttttcaagggctaaagattttacaggaaatccataggcgactcgggtctgtggaagttaaagaccagatcacggccgtgaaattcctcttgaaactgccgtatatcgattccaagaggttgtcaatctttggcaagggttacggtggatatatagctagcatgattttgaagtcagacgaaaaactgtttaagtgcggttccgtcgtggccccaatcactgacctgaaactgtacgctagtgcattctcagagcgctatctgggaatgccgagtaaagaggaatctacttaccaggctgctagcgtcctgcataatgtacacggactcaaggaggaaaatatcctgatcatccacgggaccgccgatactaaggttcatttccaacattctgcggaacttattaaacacctcatcaaagccggagtaaactatactatgcaagtttatcccgacgagggccacaatgtctcagagaagagtaaatatcacctgtacagcactatcctaaagttcttttctgattgtctgaaggaagagatttccgtgctgccacaggagcccgaagaagacgaatag

SEQ ID NO: 220872 - DNA, 2391 bp, Artificial Sequence
  Description of Artificial Sequence: Synthetic coding sequence
atgaatcagacagcctccgtgtcacaccatatcaagtgtcagccgtcgaagaccatcaaggaactcggatctaatagcccccctcagcggaactggaaaggaattgccatcgctctgctagtgatccttgtcgtgtgcagccttataacaatgtccgtgatactgctgactcctgacgaactgaccaatagctcagagactcggctgagcttagaagatctgttcagaaaagacttcgtgctccatgatcctgaggccagatggattaacgacacagacgtggtctataaatccgaaaacggccatgtgatcaagttaaatatcgagacaaatgcaactacattactgttagagaatactacgttcgtgactttcaaggccagccgtcatagtgtgtcgcctgatttaaagtacgttctgctggcttacgacgtgaagcagatcttccattacagctatacagcctcttacgtcatttacaatatccacacccgcgaagtgtgggaactgaacccgcctgaggtcgaagattccgtgctgcagtatgcagcttggggagtgcaggggcaacaactgatctatatcttcgaaaataatatttactatcagcccgatatcaagtcctccagcctccgactgacgtcctcaggcaaggaagaaatcatatttaacggaatagcggattggctatacgaggaagagttgctgcacagccacatcgctcactggtggtcccctgacggcgagcggctggccttcctcatgattaacgactctctggttccaacaatggttataccgaggtttaccggtgcactgtatcccaaaggtaagcaatatccatatcctaaggccggacaggtcaatcctacgatcaagctgtatgtggtcaatctatatggaccaacacacaccctcgaactcatgcctcccgactcttttaagtcacgggaatactacattaccatggtaaagtgggtgtccaatactaaaacagttgttcgctggctcaacagggctcaaaacatctccatattgactgtgtgtgaaaccacgaccggggcttgtagtaaaaaatacgagatgactagcgatacatggctctctcaacagaacgaagagccagtcttcagccgggacgggagtaagtttttcatgactgtgcctgtgaaacaggggggtcggggagaattccatcatgtcgctatgtttctcatacagagtaagagcgagcagatcacagtgaggcatctcacttccggcaactgggaggtgattaaaattcttgcatacgacgagacaacccaaaaaatctactttctttccacggaatcaagtccaaggggcaggcagttgtacagcgcctccacagagggtctgttgaacagacaatgtatctcctgtaacttcatgaaggagcagtgtacttacttcgacgcatcctttagtcctatgaaccagcattttctgctcttctgcgaagggcctcgggtcccagttgtaagtctacattccaccgacaacccagctaagtacttcatcctcgagtccaatagcatgctgaaagaagctatcctcaaaaagaagataggaaagcccgagattaaaatcttgcatattgacgactatgaactgccattgcagttgagcctgccaaaagactttatggacaggaatcaatatgccttgctgctgattatggacgaggagccagggggacagctggttaccgataagttccacatcgattgggacagtgttctgatcgatatggacaacgtcattgtggcacgcttcgatggacgtgggagcgggttccagggcctgaaaattctgcaggaaatccaccgtcgcctgggctccgtggaggttaaagatcagatcacagcagtaaagttcttgctgaagctgccctacatcgactccaagcgactgagtatttttggcaaaggatatggagggtacatcgcatctatgattctgaagagcgacgagaaactgtttaagtgcgggagcgtggtggcaccaataaccgatctgaaattgtatgctagcgcattctccgagcgatacttaggtatgccgtctaaggaagaaagtacctatcaagctgccagcgtgttgcacaatgtgcacgggctgaaagaagaaaatattctgatcattcatgggaccgcagacactaaagtacatttccagcactctgcggaactcatcaaacacttgatcaaggctggcgtgaattacactatgcaggtctaccctgacgaaggccataacgtgtcagagaagagtaagtaccacctttactccaccatactcaagttctttagtgattgcttaaaggaagaaatatctgtgctcccgcaggaaccagaagaggacgaatag

SEQ ID NO: 220873 - DNA, 294 bp, Artificial Sequence
  Description of Artificial Sequence: Synthetic coding sequence
atgtctgtcattctgctgacaccagacgagctgaccaacagctccgaaaccaggctgagtctagaagatctgttcaggaaggatttcgtcttgcatgatcccgaagctcgctggatcaatgataccgacgtggtttataagtctgagaatggccacgttatcaagctgaatatcgaaacgaacgcgaccacactgttgttagaaaataccacgttcgtcacctttaaagcctctcgtcattcagtgtcgccagacttgaagtatgtgctgctggcttatgacgttaagcaatag

SEQ ID NO: 220874 - DNA, 1803 bp, Artificial Sequence
  Description of Artificial Sequence: Synthetic coding sequence
ctgtcaatccttatcctgaccagcaacgaactgactaatagctccgaaacccggttgtcgcttgaggatctttttcgcaaagatttcgttctccatgaccccgaggctagatggatcaacgacacagatgtggtgtacaagtctgaaaacggacacgtaattaagctgaatatcgagaccaatgccaccacacttctgctggagaataccaccttcgttacttttaaggcctccaggcactccgtctctccagatttgaaatacgtgcttttggcatatgacgtgaaacaaatcttccactatagttatacagctagctacgttatttataacatccacactcgcgaagtatgggagctaaatcctccagaggtggaggactctgtgctgcagtatgcagcttggggtgtgcaaggtcagcaactgatatacatattcgagaataatatttactatcagcccgatatcaagtcatcttcactgaggctgacatcgtccggaaaggaagaaatcattttcaatgggattgctgattggctgtacgaagaagagctgctgcatagtcacattgctcactggtggtctcccgatggggagagacttgcatttttaatgatcaatgattcactggtgcctactatggtcatcccacgcttcacaggagccctgtacccaaagggtaaacagtacccctatcctaaggccggtcaggtgaatcctactattaaactatacgtggttaacctgtacggtcccacccacacattggaactgatgccacctgactcattcaagtcccgcgaatactatattactatggtgaaatgggtgtccaatacaaaaaccgtcgttcggtggctaaatcgagcccaaaacatttctattctgactgtatgcgaaaccactaccggagcctgcagtaagaagtatgagatgacatctgatacatggctcagccagcagaatgaagagcctgttttctctagggatggaagtaagttctttatgaccgtgcccgtcaaacagggcggacggggagaattccatcacgtggccatgtttctgatccagagcaaatctgaacaaatcacagtccgccacctgacatctggtaactgggaggtgatcaagattctggcgtacgatgagacaacccagaagatctatttcctttcaactgagagcagccctcggggaagacagctctactccgccagcacagaaggtctcctgaataggcagtgtatctcgtgtaactttatgaaagaacaatgtacttactttgacgcctctttctcgcctatgaaccagcacttcctacttttctgtgaaggcccaagggttcctgtggtctcgttgcactcaaccgacaacccagctaaatactttatcctagagtctaattccatgctgaaggaggcgatcctgaaaaaaaagatcggtaaaccggaaataaagatcctgcacatcgacgattacgaactcccactccaattaagtttgccaaaggatttcatggatcgaaaccaatacgccctactgctcataatggatgaggagcccggaggccagttggtcaccgacaaatttcacatcgactgggattctgtgcttatcgatatggacaacgtgatcgtggcacggttcgacgggcgtgggagcggttttcagggactcaaaatcttgcaagagatccacagacggctcggctccgtggaggtaaaggaccaaatcaccgcggtcaagttcctgctaaagttgccttatattgacagcaagcgcttaagcattttcggtaaatag

SEQ ID NO: 220875 - DNA, 2241 bp, Artificial Sequence
  Description of Artificial Sequence: Synthetic coding sequence
atgtccgtgatcctcctcacgcccgatgagctgactaattcttctgaaacaagactctctctggaggatttatttagaaaagactttgtgctccatgaccccgaagccaggtggattaatgacactgacgtggtctacaagagcgagaacggccatgtgatcaagctcaacatcgaaaccaatgctacaactctgctcctagaaaacaccactttcgttacatttaaagcttccagacacagcgtcagcccagacctgaaatatgttcttctggcctatgacgtgaaacagatctttcactacagctacactgcttcttacgtcatctataatatccacacaagggaggtttgggagttaaaccctcccgaggtcgaagatagcgtcctgcaatacgccgcttggggagtgcaaggccagcagcttatctatatattcgagaacaacatttattatcaacctgacataaaatcaagttccctgcggctcacctccagcggcaaagaggagatcatcttcaacggaatcgccgactggttgtacgaggaggaactattacacagtcacattgcacattggtggtcacccgatggagaaaggctcgcattccttatgattaacgacagcctggttccaacgatggtaataccccgattcacaggcgcactgtacccaaagggaaagcagtacccatatcctaaggctggccaagttaaccctactatcaaactctatgtggttaatctctatggcccaacccatactttggagctcatgccaccagatagttttaagagccgggaatattatatcacgatggtgaaatgggtttcgaacacaaaaactgtggtgagatggttaaacagggcccagaacatctcaatcctgaccgtgtgcgaaacaactaccggagcatgctccaagaagtacgaaatgacctctgacacatggttgtcacagcagaacgaggagcctgtgttctccagggacgggtccaagttctttatgacagttcccgtgaagcagggaggtaggggagagtttcaccacgttgcaatgtttctcattcaaagcaagagtgagcagataacggttcggcacttgacaagtggtaactgggaagtcatcaagatactggcatatgacgagactacccagaaaatatactttctgtctaccgagagctcccccaggggtaggcagttgtactccgcctcgacagaggggttattgaatagacagtgcatctcctgcaactttatgaaagagcagtgtacatacttcgatgcctctttcagccctatgaaccagcatttcctgttgttttgtgaggggcctcgtgtccccgtggtatctctgcacagcacagataacccagcaaagtatttcatccttgaatcgaatagtatgctgaaggaagccattttaaagaaaaaaataggcaaaccagagatcaaaatactacacatcgatgactacgaactgcccctacagctcagtctgccgaaggacttcatggatcgaaaccagtacgcccttctgctgattatggacgaggaacctggaggccaactggtgacagacaagttccacatcgattgggactctgtgttgatagatatggataatgtgattgtcgccagatttgacggtcgaggtagcgggttccagggactgaagatcctgcaggagatccatagacggctcggctccgttgaggtaaaagaccagatcacggcagtgaaatttcttctgaaactgccatacatcgactccaagcgcctctcaatttttggaaaaggctacgggggttacattgccagcatgatcctgaaaagtgatgaaaagttgttcaaatgtgggagtgtggtcgcaccaatcacagatctaaaattatatgctagtgctttctccgagaggtatctcggcatgccctctaaagaagaatcgacataccaggccgcttcagtacttcacaacgtgcatggacttaaagaggaaaatatcctcatcatccatggcactgccgatacgaaagtccacttccaacacagcgctgagttgattaagcaccttattaaggccggtgtcaactacacaatgcaggtttaccctgatgaagggcacaacgtgtccgagaagagcaaatatcacctttactctactattctgaaattcttctcagattgtctgaaagaggagatttcagtgctgccccaggagccagaggaagacgagtag

SEQ ID NO: 220876 - DNA, 954 bp, Artificial Sequence
  Description of Artificial Sequence: Synthetic coding sequence
atggccgacacccagtatattctcccgaacgacattggtgtttcaagcctggactgcagggaagcctttagactcttaagtccaacggagcgtttgtacgcgtatcatttgtcgcgggctgcatggtacgggggactggcagtcctcctgcaaacctcaccggaggctccatatatctatgcactgctgtctcggctgtttagagctcaagatcctgaccaattgcggcagcatgccctcgcggagggcttaactgaggaagagtatcaagctttcctggtatatgccgctggggtatactctaatatgggcaactataagtcgtttggagatactaaatttgtacctaacctccctaaggaaaagcttgaaagggttatcctggggagtgaagccgcacagcagcaccccgaggaggttcggggtttgtggcaaacctgtggggaacttatgttcagcctggagcctagacttcggcacctgggcctagggaaggaaggcattacaacctactttagtggaaattgcactatggaagacgcacgcgtccgacttgatagaagcaaaatcagatccgtgggcaagccggctctggaaagattcctgcggagactccaagttctgaagtccacaggagacgtggccggtggccgtgcactttacgagggctacgccacagtcactgacgcaccccctgagtgctttctgacactgagggacacagtacttcttcgtaaagaatctcgtaagctgatcgtgcagcctaacacacgacttgagggatctgatgtgcaactcctcgagtacgaggcaagcgctgccggactcatcaggagcttcagcgaaagatttcctgaggacggtcccgaactggaggaaattctcacccaattagccactgctgatgccaggttttggaaagggccttccgaggctccctctgggcaggcctag

SEQ ID NO: 220877 - DNA, 2214 bp, Artificial Sequence
  Description of Artificial Sequence: Synthetic coding sequence
atggccgacacacagtatattcttccgaacgatatcggtgtgtccagcctagactgtagagaggcattcagattgcttagtccaaccgagcgcctatacgcataccatctcagccgggcagcatggtatggtggactggcagtgctactgcagacgtctcctgaggccccttatatctacgctcttctcagcaggctgtttagagcccaggaccctgatcagcttcgccagcacgccttagctgaggggctgacggaggaagagtaccaggccttccttgtttatgccgctggtgtgtacagcaatatggggaactacaagtcctttggtgatactaaatttgttcccaatctgccaaaagagaaactagagagggttattcttggttccgaagccgcacagcagcatcctgaagaagtccgaggcttgtggcagacatgtggagaactgatgttttctctcgaacccaggctgcgccaccttgggctgggcaaggagggcatcaccacatacttttcaggcaattgtacgatggaagacgccaaactggctcaagactttctcgactcgcagaacctgagtgcctacaatacaagactgttcaaagaggtagatggtgagggcaagccctactatgaagtacggcttgcctccgtgctgggcagtgaaccaagtctggactctgaggttacgagcaaactgaagtcctatgagttccgcggttcaccttttcaggtgactaggggcgactacgcccctatcctgcagaaggtggtggaacagctggaaaaagctaaggcgtatgccgctaacagtcatcagggacagatgctcgcccaatatatcgaatctttcacccaagggagtatagaggcacataaacgtggatccaggttctggatacaggacaaaggaccaatagtcgaaagctacattggcttcatagagtcttaccgagatccctttggatctcggggagaatttgaagggttcgttgctgttgtgaataaggcaatgagcgccaaattcgaacgactggttgcctctgcggagcagctgctcaaggaacttccatggcctccgaccttcgagaaggacaagttcttgaccccagactttacttccctcgacgtgctaacttttgcaggcagtggaattcccgcaggaataaacattccaaactacgacgacctaaggcagactgaggggttcaagaacgtctctcttggcaacgtgcttgctgtagcttacgctacacagagggaaaaacttacatttttggaggaggacgataaggacctgtatatcctgtggaagggtccttcctttgacgtccaagtcgggctgcatgaactacttggccatgggtcaggaaaactctttgttcaagatgagaagggtgccttcaattttgaccaagaaactgtcatcaacccagagacaggcgaacaaattcagtcctggtaccgctccggggagacctgggacagtaagttttctacaatcgcctcctcctatgaggagtgtcgggcagagtcagtaggattgtacctgtgtctccatccacaggtattagaaatctttggctttgaaggtgccgatgcagaagacgtgatctatgtcaactggctgaacatggtaagggctggactcttggcacttgagttctatacacccgaagctttcaattggcgtcaagcccatatgcaggctaggtttgtgattcttagggtgttgttggaagccggagaaggtttagtcacgataactccaacaactggaagtgatggacgcccagacgccagagtcagactggaccgcagtaagatccgcagcgtaggcaagcccgctctggagcgattcttgcggaggctgcaggttctcaagtcgaccggcgacgtcgctggcggaagggctctatacgagggttatgctacagtcactgatgcacctcccgaatgcttcctaacgctacgcgacaccgtcctcctgaggaaggaatcaaggaagttaatagtccagcctaacactagactggagggatccgacgtgcagctgttggaatacgaagccagcgcagccggtctgattagaagcttttctgaaagattccccgaggacggccctgagttagaagagatccttactcagctggccaccgccgatgccaggttttggaaaggcccatctgaggcaccctccggtcaggcttag

SEQ ID NO: 220878 - DNA, 2214 bp, Artificial Sequence
  Description of Artificial Sequence: Synthetic coding sequence
atggccgacacacaatacatcttgcccaatgatattggagtgtcgtctctcgactgccgcgaggccttcaggttactgtctcccaccgagagactttacgcctaccacctgtctagagctgcgtggtacgggggactggcagtcttgctccaaacgtcccccgaagcaccttatatctatgccttacttagtcgcttgttcagagcccaagatccagatcagttgaggcagcatgccctggcggaaggcctgaccgaggaagagtaccaggccttcttggtgtatgcagccggagtgtatagcaatatgggcaattataagagctttggagatacaaagttcgtccccaacctgccgaaagagaagcttgagagagttatccttggaagcgaggctgcacagcagcacccagaagaggtccggggactttggcagacttgcggggagctgatgttctccctggagccacgactgcgtcatcttggcctgggcaaagaaggtatcactacgtactttagcggcaactgcacaatggaggacgcaaaactggcacaggatttcctcgacagccagaatctgtcagcgtacaacacacgactttttaaggaggtggatggtgagggaaaaccctactacgaggtgcgcctcgctagcgttctcggaagcgagccctccctcgatagtgaggtgacctccaagctgaagtcctacgaatttcgcggaagcccatttcaggtgaccaggggcgattacgcgcctattctgcaaaaggttgttgagcagctggagaaggctaaggcatacgcagcaaatagccatcagggtcagatgctcgcgcaatacattgaatcatttacccagggatctatcgaagctcacaaaagggggagccgcttctggatccaagacaaaggacctattgtggaatcttatattggattcattgagagctacagagaccctttcggaagccgcggagaatttgaaggattcgtggcggtggtcaacaaggcaatgtcggctaaatttgaacgccttgtggcctctgcagagcaactcttaaaggagctaccttggcccccaaccttcgagaaagacaaattcctgacgcctgactttacgtcacttgacgtccttacgtttgctggctcggggatccctgcaggaattaatataccgaactacgatgacctgcgtcagaccgaaggctttaagaatgtgtctctcggtaacgttttggcggtagcttacgcaacgcagagagagaagctaactttcctggaagaagacgataaggacctatatattctgtggaaggggcctagttttgatgtccaagttgggctccatgagctgctaggccatggctcaggtaaattgttcgtgcaagacgaaaaaggagcttttaattttgaccaggagacagtgattaatcccgaaacaggcgaacagattcaaagttggtatcggtcgggggaaacatgggactccaagttttctactatagccagcagttatgaggaatgtagagcagagtctgtgggcctatacctttgcctgcatcctcaagtcctcgaaattttcggcttcgaaggagctgacgcagaagatgtaatctacgtgaactggctgaacatggtcagggcgggactgctggcattggagttttatacacctgaagccttcaactggcgccaggcccacatgcaggctcgatttgtgatcctgagggtcctgttggaggccggagaaggtctcgtcactatcaccccgacgacgggtagtgatggacgcccagatgcccgagttagactggaccggagtaaaattcgtagcgtagggaaacctgctctcgagcggtttctcagacggctacaagtcctgaaaagcacgggagatgtggcgggaggcagggccctttacgagggttacgccactgtgacagacgctccccctgagtgcttcctgacgcttcgagataccgtgttgctcagaaaggaatctcggaaactaatagtgcagccaaacacacggctggaagggtccgacgtgcaacttctggagtacgaagcctctgcagctggactgattcgatctttctcggaacgttttcccgaggacggcccagaacttgaggagatcctgacccagctagccactgcagatgccagattctggaagggtccctctgaggcacccagcgggcaggcctag

SEQ ID NO: 220879 - DNA, 273 bp, Artificial Sequence
  Description of Artificial Sequence: Synthetic coding sequence
atggcggacactcaatacatcttgcccaacgacatcggagttagcagcctggattgtagggaggcgttccgcctcttaagccctaccgaacggctttacgcctaccatctgtcacgtgcagcctggtatgggggactggcagttttattacagacatctcccgaggccccttatatctacgcactacttagcaggcttttcagggcacaggaccctgaccaactgcgacagcatgctttggcagagggcctgacagaggaagaatatcagtag

SEQ ID NO: 220880 - DNA, 606 bp, Artificial Sequence
  Description of Artificial Sequence: Synthetic coding sequence
atggccgacacccagtatattttacccaacgatattggggtgagttcactagactgccgggaggcatttaggctcctctccccaaccgagcggttatacgcttatcatctaagcagagcagcttggtacggtggtttggctgtgctgttgcagacaagtcccgaggccccttatatatatgccctgctgagtagactattccgagcccaggaccccgaccagctaagacagcacgccttggccgaggggcttacggaggaagaataccaagcattcctggtttatgccgcaggcgtctactccaatatgggcaactacaaaagttttggggatacgaaattcgtgccaaacctgcctaaagagaagttagagcgggtaatccttggatctgaagcggcacagcagcatcccgaagaagtccgtggtctctggcagacctgcggcgagctgatgttctctctggagcccagactgcgtcacctcggccttgggaaagaggggatcacaacatacttctccggcaactgcaccatggaagatgcaaaattagcccaagatttcctcgattcccaaaatctctcagcttataatacccggcttttctag

SEQ ID NO: 220881 - DNA, 2274 bp, Artificial Sequence
  Description of Artificial Sequence: Synthetic coding sequence
atgggggaacctgaggcagggtctgaattcgcgaacggggcagccgcagcagccggtcccatggccgatacccagtacatactgccgaatgacataggagtgagttcgctggattgccgggaggcatttcgtctgctgtctcctacagagcggttatacgcttatcacctgagccgcgctgcctggtacggcggattggccgtactgctccagacctcccccgaggccccttacatctatgcactcctgtcgcgactgtttagagctcaggatcccgaccagttgcgccagcacgccttggccgagggattgaccgaggaagagtatcaggcgttcctggtctatgctgcaggggtgtactctaacatgggaaactataagagtttcggcgacactaagttcgttcccaatctgcccaaggagaaacttgaaagggttatcctcgggagcgaagccgcacagcagcaccctgaggaggttagaggcctttggcaaacctgtggagaactgatgttttccctggagcctcgcctgaggcacctgggcctcgggaaggagggaattaccacatatttttctggcaactgcacgatggaggacgctaagctggcccaggactttttggatagtcagaatctgagcgcttataacactcggctcttcaaggaggttgacggggaaggcaagccatattatgaggtcaggcttgcaagtgtgctagggtcagagccgagcctggactctgaagtgacctcaaaactcaagtcatacgagtttcggggaagcccatttcaggtaacaaggggggactatgccccaatcctgcagaaagtggtcgagcagcttgaaaaggctaaagcttacgcagctaattcccatcagggacagatgctcgcgcagtatatagagagctttactcagggcagcattgaagcgcacaagagaggtagcaggttttggattcaagacaaaggacctattgtggagtcgtatatcggcttcattgagtcttatcgcgaccccttcggatcccggggagagttcgaaggcttcgtggctgtggttaacaaggcgatgagcgccaagttcgaacgtcttgtcgcaagcgctgaacaactcttgaaggaactcccctggccacctacattcgaaaaagataagttcttgacaccagacttcacatctttggacgtgctcactttcgccggatccggaatcccagccggtatcaacattccgaactatgacgacctgaggcagactgagggattcaaaaatgtcagcctgggaaacgttctggccgttgcatatgccacccaacgagagaaactgaccttccttgaggaagatgacaaggacctgtatattctctggaagggtccttcctttgacgtccaggttggcttacatgaattactagggcacggatccggtaagttgttcgtgcaggacgagaaaggtgcattcaattttgatcaagagacggttatcaaccccgagaccggggagcaaatccaaagctggtatcgttcaggcgagacctgggattcaaaatttagtactatagcttccagctacgaagagtgccgcgcagagtctgttggactttatttgtgtcttcacccccaggtgctcgagatttttgggttcgagggtgctgacgctgaggacgtgatctatgtgaactggctgaacatggtgcgggctggcttactggccttggaattctatacacccgaggcttttaactggcgacaggcccacatgcaggccagatttgtaatcctccgagtgttactggaagcgggagagggacttgtgaccatcactccaacaacaggatcagatggaagaccagatgctcgtgtgaggttagatcggtccaaaatcaggagcgtgggcaagccagccttggaacggttcttgcgcaggctgcaggtgctaaaaagtaccggggatgtggctggcggtagagctctgtacgagggatacgcaaccgtaacggacgcgcctcctgaatgttttctgactctccgggacactgttctactgagaaaggagagtcgcaaactcatcgtgcagcctaacacccggcttgagggttctgacgtccagctactcgaatatgaagcttcagccgctggcctaataagatctttctcagagagatttcctgaagatggccctgagctggaggagattttaactcagctggctaccgcagacgcgagattctggaagggtccatcagaagcacctagcgggcaggcttag

SEQ ID NO: 220882 - DNA, 2271 bp, Artificial Sequence
  Description of Artificial Sequence: Synthetic coding sequence
atgggggaacctgaagccggatccgaattcgccaatggtgcggctgccgcagggccaatggcagatactcagtatatcttgcctaatgacataggagtctcatccctggattgtagggaggcctttagattgctgtcacccacagagaggctctacgcctatcacttatcaagagccgcatggtacgggggtctcgctgtgctgctgcaaacgtcccccgaagctccgtacatctatgccctcctgtcccgtctgttcagagctcaggacccggatcagttaaggcaacatgcgcttgctgaaggcctaactgaggaggaataccaagcctttctggtgtatgctgctggggtctacagtaatatgggcaactacaagtcattcggagacaccaaattcgtccccaatctgccaaaagagaagctggaacgggttatattgggatcagaagcagctcagcaacatcccgaagaggtgcgcggactctggcagacctgcggtgaattgatgttttcgctggagcccaggctgaggcatctgggtctgggcaaggagggaataaccacttatttctctggtaactgtacaatggaggatgcaaaactggctcaggatttcctagacagtcaaaacctgtccgcatacaatacgcgccttttcaaggaggttgacggcgaaggcaagccttactacgaggtaagactcgccagtgtcctcggtagcgaaccttccctggacagcgaggttaccagcaagcttaaaagctacgagtttagagggtcgccctttcaggtcacccggggtgattacgcacccatcctccagaaagtggtggaacagttggagaaggcgaaggcctacgcagcaaatagtcatcaggggcagatgcttgcccaatacatagaatcattcactcagggcagtatagaggctcataagcggggatctagattctggattcaggacaaaggacctatagtggaatcctatattggctttattgaatcatatagagatcccttcggctctcgcggtgagttcgagggatttgtggccgtggttaacaaagccatgtccgctaaattcgaaaggctggtggctagtgctgaacagctgttaaaggaattaccctggccgcctacttttgagaaagacaaatttttgactccagatttcactagcttggacgtgcttacctttgccggttctggcattcccgcaggaattaacattccaaactacgacgatctccgacagacggagggctttaaaaatgtctctctgggcaatgtgttggcagtggcctacgccactcagcgtgagaaactcacattccttgaggaagatgacaaagacctttatatcctttggaaggggcctagctttgatgttcaggttggactgcacgagctcctcggacacggatccggcaagctgttcgtccaagatgagaaaggggcatttaattttgatcaagagactgttatcaacccagagactggggagcagattcaatcatggtatcgttctggcgagacatgggattcgaaatttagtacaatcgcaagtagttatgaggaatgccgcgcagagtctgtgggcctgtatctttgcttgcatccacaggtgttagagatttttgggtttgagggtgcggacgccgaggatgtgatatacgtaaactggttaaacatggtcagagctgggcttctggccctggagttttatacgccggaggcttttaattggcggcaagcccatatgcaggccagattcgtgatcctgcgggtgctgttggaggccggagaaggacttgtgacaatcacacccactactggctcagatgggagacccgacgctagagtccgcctggatagatccaagattcgttcagtgggaaaacctgccctggagcgatttttgcgcagactacaagtcctgaagtccacaggggacgtagccggaggaagggccctctatgagggctatgcaaccgtaaccgacgctccacccgagtgcttcttgactctaagggacacagtgctgcttcgtaaggagtcccggaaactgatcgtgcaacccaacaccaggctcgaaggctctgacgtgcagcttctagaatatgaagctagcgccgcaggattgatccgcagttttagcgagcggtttccagaggacgggccagagcttgaggagatccttacccagctcgccacagcggacgcgaggttctggaaggggccatccgaggccccatccggccaggcctag

SEQ ID NO: 220883 - DNA, 2214 bp, Artificial Sequence
  Description of Artificial Sequence: Synthetic coding sequence
atggcggacacccaatacatccttcctaacgacatcggtgtgagcagtctggactgcagagaggccttcagactgctgagcccgaccgaacgcctctatgcttatcatctttcccgggctgcctggtacggaggccttgcagttttactgcagaccagtcctgaggctccctacatttacgctttactgtcccgcctttttagggcccaagatccagatcagcttaggcaacatgccctggcagaggggctcactgaggaagaatatcaggcctttctagtctatgcagccggagtgtattccaatatggggaactataagagcttcggagataccaaatttgtcccgaaccttcccaaggaaaagttggagcgggtcatcctgggtagcgaggccgctcagcagcaccccgaggaggttaggggactttggcagacctgcggcgagcttatgttctccctagagccccgattaaggcatttgggcctcggaaaggagggaattacaacctatttttccggtaattgcacaatggaggacgctaagctggctcaggacttcctggacagtcagaaccttagcgcctataatacccgcctgttcaaggaagtggatggcgaaggaaaaccttactatgaggtccgtctcgccagtgtccttgggtccgagccaagtctcgactctgaagtaacatcaaaattgaagtcttacgagttccggggaagtccatttcaggtaacacgcggtgattatgcaccaatactgcagaaggtggttgagcagctggaaaaagctaaagcctatgccgctaattcccaccaggggcaaatgcttgcccaatatatcgagagcttcactcaaggctcaattgaagcacataagcggggttcaagattctggatccaggataaaggacccatcgttgagagttatatcggctttattgagtcctacagggaccctttcgggtcacggggagaatttgagggattcgttgctgtagtcaataaggcaatgtcggctaaatttgagcgcctggtcgccagtgcagaacaactgttaaaggagctcccgtggcctccaacattcgagaaagacaagttcctaacaccagactttaccagcctcgatgttttgacgtttgctggctctggaattcctgctggcatcaacatcccaaactatgatgacctgcgccaaactgaaggatttaagaacgtgtccctgggtaatgtgctggcagtagcatatgctacgcagcgagagaaactgactttcctggaagaagatgacaaagacctgtacattctatggaagggtccttcattcgacgtgcaggtggggctgcacgagctactagggcacgggtctggtaaactgtttgtccaagatgagaaaggggctttcaatttcgaccaggagacagtaataaaccccgaaaccggcgagcagattcaaagttggtatcgttcaggcgagacctgggattcgaagttttccaccattgctagcagctacgaggagtgtcgggcagagtctgtcggcctctacttatgccttcacccccaagtgcttgagatatttggctttgagggggctgatgctgaagatgtaatttatgtaaactggctaaacatggtcagggctggcctactggccctggagttctatactcccgaagccttcaattggcgacaggcccacatgcaagcgcgattcgtgattctgcgggtgctgttagaggctggagaaggcttggtcacaatcacacctaccactggatctgacggtcggcctgatgctagggtccggcttgacaggtcaaagatcagaagcgtgggaaaaccagcactggagaggtttctccgacgactccaggtcctgaaatccactggagacgtggccggaggaagggctttatacgagggctacgctacggtgacagacgcaccccctgagtgttttctgactttgcgcgataccgttctgctgcgtaaggagagcaggaagttgatagtccagcctaacacgcggctcgagggtagcgatgttcagctgctcgagtacgaggctagcgccgctggactcattcgaagtttctccgagagatttcccgaagacggaccagagctggaagaaatcctaacccagcttgctacggcagatgcacgattttggaaggggcctagcgaggctccaagtgggcaggcctag

SEQ ID NO: 220884 - DNA, 1908 bp, Artificial Sequence
  Description of Artificial Sequence: Synthetic coding sequence
atgggaaactacaagtccttcggagataccaagtttgtgcctaatctccctaaagagaaattggaacgcgtaatcctaggttccgaggccgcacagcagcatcccgaagaagtgcgaggactgtggcagacatgtggtgagctgatgttttccctggagccgaggctcagacatctggggctcgggaaagaggggatcactacatacttcagcggtaattgtacaatggaagatgcaaaattggcccaggacttccttgatagccaaaacttatctgcttataacaccaggctgtttaaagaggtggacggagagggtaagccttattacgaagtgagactggccagtgtccttggatccgaaccctctctcgatagcgaggtaacaagtaaactgaaaagctacgagttccggggatcaccgttccaagtgacccgtggagattacgctcctattctccagaaggtcgtggagcaattagaaaaggctaaggcatacgcagctaactcccaccaggggcagatgttggctcagtatatcgaaagttttacccaaggctcaatcgaagcacacaagagggggagtagattctggatccaagacaaaggccctatcgtggaatcctatattggatttatagagagctatcgcgatcccttcggatcccggggtgaatttgaggggtttgtcgcagtcgtgaacaaggctatgtctgcaaagtttgagaggctcgtggcgagcgcagagcagctccttaaggaactgccatggcccccaacatttgagaaggacaaatttcttactcccgacttcacttccttagatgttctgacgttcgcaggctccggcattccagccggtataaacattcctaattacgatgatctgcgccaaaccgaagggttcaaaaatgtgtcgttggggaacgtgctggccgtggcatatgctacccagagagagaagctgacctttttagaagaggatgataaagacttatacatcttatggaaaggcccaagcttcgatgtccaggtgggcctgcacgaactcctggggcatggctcaggcaagctgtttgtgcaggacgagaagggtgccttcaactttgatcaggagacagtgattaacccggagactggagagcagatccagtcatggtaccgaagcggtgaaacctgggactctaaatttagcacaattgctagcagctatgaagaatgtcgcgctgagtctgtgggtctgtacctgtgcctccatccccaggtactggagatattcggctttgaaggtgccgacgccgaggacgttatttacgtcaactggttaaatatggtgcgggctggattgctggcgctggagttctacactcctgaagctttcaactggcgccaggcccacatgcaggcgaggtttgtaatcctgcgcgtgcttttagaagcgggtgaagggcttgtaaccatcactccgaccactgggtccgacggaagaccagacgctcgggtgagactagacagatcgaaaatccgtagtgtgggcaagccggcactggaacgtttcctgcggagactccaagtgttgaaaagcactggagacgtcgccggagggcgtgcgctgtacgagggttacgccaccgtgacagacgcgccacccgagtgcttcctcactctccgcgacaccgtgctgctgcggaaggaaagtcgaaagctgattgtccagccaaacacaaggctggaaggcagcgatgttcaactgcttgagtacgaagccagcgcggctggactaattcggagtttcagcgaaaggtttcccgaggatgggccagaactggaggaaattttgacccagttagcgaccgccgacgccaggttttggaaaggtccttctgaggctcccagcggacaggcctag

SEQ ID NO: 220885 - DNA, 2412 bp, Artificial Sequence
  Description of Artificial Sequence: Synthetic coding sequence
atgactacagccaaggaacccagcgccagcggcaaatcagttcagcaacaggagcaggagctggtaggaagcaaccctccccagcgcaattggaaaggaattgccatcgctctcctggtgatactcgtgatttgtagcttgattgtgacatccgtcatactcctcacacctgcagaagataatagcctctcccaaaaaaagaaagtaaccgtcgaagacctctttagcgaagacttcaagattcacgacccagaggctaagtggatcagcgacaccgagttcatttatagagaacagaaaggcactgtccggctctggaacgtagaaacgaatactagtacagtgttgatcgagggaaaaaaaattgaatcactgcgagcaatcaggtacgaaatcagtcccgatagagagtatgccctgttctcctataatgtcgaaccgatttaccagcattcctatacgggatattacgtactgtcaaaaatcccgcacggggacccacagtccctcgacccccctgaggtttccaacgcaaaactgcagtacgccggttggggcccaaagggccagcaactgatcttcattttcgaaaacaatatctactattgtgcacatgtgggtaaacaagccattcgcgtagtttctacaggcaaggagggtgtcatttataacgggctcagtgactggctgtacgaggaggaaattcttaaaacccatatcgctcattggtggagccccgatggaacgcgtctggcatacgcagctattaatgattctcgcgttcctattatggaactgccaacatacaccggatcgatctaccctacagtcaaaccttatcactatccgaaggccggaagtgagaatccatccatctcccttcacgttatcggtctgaacggtccaactcatgacctggagatgatgcccccagacgatccacggatgcgagaatactacatcacgatggttaaatgggccaccagcacaaaagtagcagttacgtggctcaacagagcgcagaacgtgtcaatccttacgctgtgcgatgcaactacaggagtttgcacaaaaaaacatgaggatgaaagtgaggcgtggctgcatagacaaaacgaggagccggtgttcagtaaggatggcagaaaattcttctttattagagcaatccctcagggcggtcgcggtaagttttatcacatcaccgtgtccagctcacagcccaattcctccaatgacaacattcagtctataacatctggagattgggatgttacaaagatcctggcatatgacgagaagggtaataagatatacttcctcagcactgaggaccttccccgtaggaggcagctatattccgccaacactgtaggcaattttaacagacagtgtctgtcctgcgaccttgtcgaaaattgtacctatttctctgccagttttagccatagcatggacttcttcctgctgaagtgcgagggtcctggggtcccaatggtgacggtgcataacaccaccgacaaaaagaaaatgttcgatctagaaacaaatgagcatgtgaagaaagctatcaacgataggcagatgccaaaggtagagtatcgcgatattgagatcgacgactacaatctgccaatgcagattctgaagcccgcaacatttaccgacacgacgcattatcctctcctgcttgtcgtagatgggaccccaggctctcagtctgtcgctgagaagtttgaggtgagttgggagaccgtgatggtgtcaagccacggggctgtcgttgtgaagtgcgatggccgtggtagcgggttccagggaaccaaattgcttcatgaggtgaggaggaggctaggattattagaggagaaggatcagatggaagccgtgagaactatgttgaaagaacagtatatcgataggaccagggtcgccgtattcggtaaggattacggtggatacctctctacgtacattctacccgcaaaaggcgagaatcagggacaaacttttacctgcggatcagctctgtcacccattactgatttcaagttatacgcctcagccttctcagaaaggtacctcggactgcatgggctggacaaccgagcgtacgagatgacaaaggtggcccaccgagtgagtgccctggaggaacagcagttcctcattattcatcccacggcggacgaaaaaattcactttcagcacacagctgagctgataacccagctgattcgaggcaaagccaactactctctccagatttatccagacgagtcccattattttacatcaagttcgttaaagcagcatctatataggagtatcatcaacttcttcgtcgaatgctttcgaatccaggacaagctgctgacagtgacagccaaagaagacgaggaggaggattag

SEQ ID NO: 220886 - DNA, 2598 bp, Artificial Sequence
  Description of Artificial Sequence: Synthetic coding sequence
atggctagcctgtatcagcgctttacagggaagattaatacaagtcggtcttttccagctccacccgaagcaagccatctactcggagggcagggaccagaagaagatggcggagctggggctaagcccctggggcctcgagcccaggctgcagcacccagagaacggggtggaggcggaggaggggcagggggacgcccaaggttccaatatcaagcacggtcagacggcgatgaggaggacgaacttgttggatccaacccacctcagcgcaattggaagggaattgcgatcgctctgctggtgatattagtcatttgttccctgattgtgaccagtgtgatcttactgactcctgctgaagacaacagtctgtcccagaagaaaaaggtcacagttgaggacctattttcagaagacttcaagatccacgaccctgaggccaaatggatctccgacaccgagtttatctacagagaacagaaaggcacagtgcgattatggaacgtcgaaacaaacacctccaccgttctcatcgaagggaagaaaatagaatcccttcgcgctattcgctatgagattagccccgacagggaatacgccctgttctcttataacgtggagccgatttaccaacactcctataccggatactacgtgttgtccaagatcccccacggggacccacaatctctagacccccctgaggttagcaacgcgaaactgcagtacgccggatggggacctaaaggtcagcagctcatcttcattttcgagaacaacatatactattgcgcccatgtgggaaagcaagccatcagagtggtcagtacgggcaaagaaggagtgatttataatgggctcagcgactggctgtatgaagaggaaatcctaaaaacgcacatagcgcattggtggtcacccgatggtacacgactggcctatgcagctatcaacgattctcgcgtgcctatcatggagctgcccacgtacactggttcgatctacccaacagttaagccctaccattacccgaaggctggctctgagaatccatcaattagcttgcatgtgatcgggttgaatggccctactcacgacctggaaatgatgcctcccgacgatcccagaatgcgggaatattacatcacaatggtgaaatgggccacttccacaaaagtggccgttacctggttaaatcgtgctcagaacgtctctatcctgaccttgtgtgacgccaccacaggagtgtgtacaaagaagcatgaagacgagtcagaagcctggctacacaggcaaaatgaagaaccggtatttagcaaggatggtcgtaagttcttcttcatccgcgctataccccaaggcggacgaggtaagttttatcacatcaccgtaagttccagccagcctaactctagtaatgataatatccaatctattacctccggtgattgggatgttaccaagatattagcctacgacgagaagggtaacaagatttactttctctccacggaggatttaccgaggagacggcagctgtatagcgccaatactgtgggcaactttaacagacaatgcctcagctgcgacctcgtcgagaattgcacttatttcagcgcatccttctctcattcaatggacttttttctactaaagtgtgaaggccctggtgtgcctatggttaccgtgcataataccaccgacaaaaaaaagatgttcgacctggaaaccaacgaacacgtgaagaaagccatcaatgaccggcagatgccaaaagtggaatacagagatatcgagatcgatgactataacctccctatgcagatcctgaagcctgccacatttacagacacaactcattatccactgttactcgtagtagatggcaccccaggctcccaatctgttgccgagaagtttgaagttagctgggaaacggtgatggtatcttctcacggtgccgttgtggtgaagtgcgatggcagaggcagcggctttcagggcacaaagttgctgcacgaggtgcgccgtagattgggcctgctcgaggagaaagatcaaatggaagcagtcaggactatgctgaaagagcagtatatcgataggacacgggtggcagtctttggtaaggactacggtggatacctttctacttacatccttcctgcaaagggggagaatcaaggacagacctttacttgtggcagcgctctgagccctataactgactttaaattgtacgcttcagcattttcagagagatacttgggtctgcacgggctcgacaacagggcctacgagatgacaaaggtcgcccacagagtgtccgctctcgaggagcaacagttccttattatccaccccactgcagatgagaagattcatttccagcatacagccgagttgattactcagctcatcagaggtaaggccaactattcgctgcagatctatcctgacgaatcccactacttcacttctagttccttgaagcagcatctgtacaggtcaatcattaacttttttgtggagtgttttcgtattcaggacaaacttctcaccgttacagccaaagaggacgaggaggaggattag

SEQ ID NO: 220887 - DNA, 2406 bp, Artificial Sequence
  Description of Artificial Sequence: Synthetic coding sequence
atgaaggagaaggcaatgatcaagaccgctaaaatgcaggggaacgtgatggagctggtaggctccaaccctcctcaacgtaactggaagggtatcgctatagccttattagtcattctggttatttgtagcttaattgtcacttcagtcattcttctgacccccgctgaggataacagtctgagccagaaaaagaaggtgaccgtggaagatttattctcagaggactttaagatacacgaccctgaggccaagtggatatccgacaccgagttcatataccgagagcagaagggcacagtgcggctatggaacgtggaaacgaacacttctacagtgctcattgagggaaagaaaattgaatcgctccgggcaattcgctacgagatttctcccgatcgagagtatgccctcttctcttacaacgttgaaccaatctaccagcacagttacacaggctattacgtcttgagcaagataccccacggggacccacagtcactcgacccacctgaggtttctaatgccaagctgcagtatgcaggatggggccctaagggccagcagctgatattcatttttgagaataacatttactattgcgctcacgtcgggaaacaggccatcagagtggtcagcaccggtaaggagggcgtaatctataacggactgtctgactggctgtacgaagaggagatattgaagacccacattgctcactggtggagtccggatggaacacgtctagcctacgcagctatcaacgacagtagggtcccaattatggagctgcccacctatacaggctccatctacccgactgtaaagccataccactatcccaaggcaggctctgaaaatccctctatctcactccacgtgatcggcctcaacggcccaacgcatgatctggaaatgatgccccctgacgacccccgaatgagagagtattatataacaatggtaaaatgggccacctccacaaaagtagccgtgacctggcttaatcgtgcacagaacgtctcaatactgactctgtgtgacgctaccactggtgtctgtacaaagaagcacgaggacgaatctgaagcatggctgcataggcagaacgaggagccggtgttttcaaaagatggtaggaagttctttttcattcgcgctattccccagggagggaggggaaaattctatcacatcaccgtttcttccagtcagcctaactcaagcaacgacaacatacaatccatcacctccggagattgggatgtaaccaagattctcgcgtatgacgaaaagggtaacaagatctattttctttctaccgaagatctgccacgcaggcggcaactgtactccgctaacactgtaggtaattttaaccgccaatgcctgtcatgcgacctggttgaaaattgcacctattttagtgcttcttttagtcatagtatggatttctttctgcttaagtgtgaaggaccaggggtccccatggttacggtacataatactacggataagaaaaagatgttcgatctcgaaacgaacgagcacgtgaagaaggcaattaacgacagacagatgcctaaagtcgaatatagagatatcgagatagacgattacaatctgcctatgcaaattctgaagccagcaacatttactgataccacccattaccccctgcttctcgtggtagacggaactcccggttcacaatctgtagccgagaaatttgaagttagttgggaaaccgtaatggtgtcatcccatggagccgtcgtcgtcaagtgcgacggacggggtagtggattccaggggacaaagctgctgcatgaagtgcggagacggctaggcctcctggaagaaaaagatcaaatggaggccgtgcggacgatgctgaaagagcagtacatcgaccgcacccgtgtcgccgttttcggaaaagactatgggggttatctcagcacctatattctgcccgctaaaggggaaaaccaggggcagacatttacctgcggtagcgccctgtccccaattactgattttaagctgtacgccagcgcgttctctgagcgatatctgggtctccacgggctcgacaatagggcatacgagatgacgaaagtggcccatagagtgagcgctcttgaagagcagcagttcctcattatccaccccaccgcagacgaaaaaatccattttcagcacacggcagagcttatcactcaattgataagaggcaaggcaaactattcgctgcaaatctatccagatgagtcccactatttcaccagttcatcccttaagcagcacctgtaccgctccatcattaacttcttcgtcgagtgcttcagaattcaggacaagcttcttaccgtcacagcgaaagaggacgaagaggaggactag

SEQ ID NO: 220888 - DNA, 2277 bp, Artificial Sequence
  Description of Artificial Sequence: Synthetic coding sequence
atgactaccgcgaaggagccatcagcctctgggaaaagcgtccagcaacaagaacaggaactcgttgggagcaatccacctcagaggaattggaagggaatcgctattgcactgctggtgatccttgttatctgctcgcttatagttactagcgtgatcctgctgacccccgctgaagataactccctctcacagaaaaaaaaggtcacagtagaggacctctttagcgaggattttaaaattcatgaccctgaggccaagtggataagcgacactgagtttatctaccgcgaacagaagggcacggtccgcctctggaatgtggaaacaaacacgagtacagtgcttatcgaggggaaaaaaatagaatctctgagagccatccgctatgagatttctcctgaccgtgaatatgccctgttttcctataatgtggagccgatatttatctttgagaataatatctattactgcgcccatgttggtaagcaggcaattcgagtggtttctaccggtaaggaaggggtaatttataatgggttgtcggattggctctacgaggaggagatcttaaagacacatatcgcccattggtggtctccagatggaactcgtctggcctacgctgctattaatgatagccgggtgccaattatggaactccctacttacaccgggtcgatttatcctaccgtgaagccttaccactatccaaaagctggttctgagaacccgtctatttctttacatgtgatcggccttaatggcccaacccacgacttggaaatgatgcctcctgacgacccccgaatgagggaatactacatcaccatggttaaatgggccacaagtacgaaagtggcagtgacttggctgaatagggcacagaacgtttccatcctgaccctgtgtgatgcaacaacgggagtatgcactaaaaaacacgaggatgagtcggaagcctggctacataggcagaatgaagaacccgtgttctcaaaggatggcaggaagttcttttttatccgcgcaattccccaagggggaagggggaaattctaccacataacagtgtcctctagccagcccaacagctcaaatgacaacattcagagtataacctctggcgattgggatgttaccaagattctagcctacgacgaaaaagggaacaagatttactttctctcgactgaagacctacctagaagaaggcagctgtacagcgctaacacagtgggcaattttaatcgccagtgcctctcttgtgacctagttgaaaattgcacatatttcagcgcttcattttctcattctatggattttttccttctcaagtgtgaagggcctggcgtgccaatggttacagtccacaacaccacggacaaaaagaagatgtttgacctggagaccaacgagcacgtgaaaaaggcaattaacgacagacagatgcctaaggtagagtacagagatatagagatcgatgattacaatttgcccatgcagatcctgaagccagcaacgtttacggatacgactcactatcccctcttacttgttgtcgatggaacaccgggaagccaaagtgtggcagagaagttcgaggtctcctgggagacagtcatggtgtcttcgcatggggctgtggtggtcaagtgcgatggacggggatcaggcttccagggcacgaagctgctccacgaggtcaggcgacggctcggtttactagaagagaaggaccaaatggaggccgttcgcacaatgctcaaggaacagtacatcgacagaacacgcgtggcagtgttcgggaaagactacgggggttacctgtccacatacattctgcctgctaagggcgaaaaccaggggcaaacattcacatgtgggtcagctctcagcccaataacagacttcaagctatatgcctccgccttcagcgaacggtatctgggcctgcacgggctcgacaacagggcttatgaaatgactaaggtcgcacacagggtgtccgctctggaagaacaacagtttcttatcattcaccctacagcagacgaaaagatacattttcagcatactgccgagctgatcactcaactgatccgcggaaaagccaattactccctgcagatctaccccgatgagtcacattatttcactagctcaagcctgaagcagcacctgtaccggtctatcattaacttctttgtcgagtgtttccgaattcaagacaagctgcttaccgtgaccgctaaggaagatgaagaggaggactag

SEQ ID NO: 220889 - DNA, 2649 bp, Artificial Sequence
  Description of Artificial Sequence: Synthetic coding sequence
atggccgctgctatggagaccgagcaactcggcgtagaaattttcgagacagccgactgcgaggaaaacattgagagccaagatcgacctaagttagagcctttttacgttgagagatactcttggagtcaactgaagaagctgctggcagatacaagaaaataccatggctacatgatggccaaggcaccccatgactttatgttcgtgaaaagaaacgaccctgatggacctcattccgaccgaatttattatttggccatgagcggggagaatcgggagaatacgcttttctattcggagattcccaaaacgattaacagggccgctgttcttatgttgtcttggaagcctctgctggatctgtttcaggccacattagattatggcatgtacagcagggaggaggagctgctgcgggagagaaagcgtatcggaaccgtaggcatagcctcctatgattatcatcaaggcagcggaactttcctgtttcaggccggttccggaatctatcacgtcaaggatggcggaccacaggggttcacccagcaacccctgaggcccaacctcgtagaaaccagttgccccaatatccggatggatcccaaactctgcccagctgacccagattggatcgcattcatccattccaatgacatttggatctccaatatagtgacacgggaggaacgcaggttgacatacgttcataatgaactggctaacatggaggaggacgcccgatctgcaggagtcgccacattcgtcctccaggaagagtttgacaggtatagtggatactggtggtgtccaaaggctgaaacaaccccatcgggcggtaaaattcttaggatactgtacgaggagaatgatgagtcggaggttgaaattattcacgtgacctcaccaatgcttgagacgcggcgagccgattctttccggtatcccaaaaccggcactgcgaatccgaaagtgacatttaagatgagcgaaattatgattgatgcagaggggaggattatcgacgtgatcgataaagagttaatccaaccctttgagatcttatttgaaggcgtcgagtatatagctcgggcaggatggacccctgaggggaaatatgcatggagcatcctgctagatcgaagccaaacccgactgcaaattgtgctgatctctcctgaactgttcatcccggtggaagacgatgtgatggaacggcagaggctcattgagtcggtccccgattcagttaccccgttgatcatatatgaagagacaactgacatctggattaatatccacgatatctttcatgtgttcccccagagccacgaggaggagatcgagtttatctttgcttctgagtgcaaaactgggttcaggcatttatataaaatcaccagcattctgaaagaaagtaaatacaaaagatctagcggcggtttaccagccccatccgatttcaagtgtcccatcaaagaagaaattgctattacaagtggcgaatgggaggtgttaggccgacatgggtccaacattcaagttgatgaagttagacggctggtttattttgagggtacaaaggactcccccctggaacaccacctgtacgtggtctcatatgtgaaccctggagaggtaaccagacttacagatcggggatacagtcacagctgttgtattagccagcattgcgatttcttcattagcaagtacagtaatcagaaaaacccgcactgcgtttctctgtataaactttcatccccagaggatgatcctacctgcaagaccaaagagttttgggcgaccatactggacagcgctggtccgctaccggattacaccccccctgaaatattctcctttgagtcaactacaggattcacgctttatggaatgttgtataaaccacatgatctgcagcctggaaaaaagtatcctaccgtgctctttatctacggtggcccacaggtgcagctcgtgaataatagattcaagggtgtgaaatactttcggctgaacaccctagctagcctgggatatgtggtcgtagtcattgacaatcggggatcttgccaccggggacttaaattcgagggggcttttaagtataagatgggacagattgagattgacgatcaggtagaggggctacagtatctggcttctcggtacgactttatagacttagatagggtgggtattcacggttggagctatggaggttatctctccctcatggctttgatgcagcggagcgatatctttcgagttgcaattgccggtgcacccgtaacactgtggatcttctacgacaccggatacacagagcgctatatggggcaccctgaccagaacgagcaggggtattacctcggttctgtggccatgcaagcagagaaatttccctccgagccaaaccggttactgctactgcacggattcctggacgaaaacgtgcatttcgcacatacctctatccttctgagctttcttgtgcgggcaggaaaaccttacgacctgcaaatctatccccaagagcgacactctatccgcgttccagagtctggcgaacactatgaattgcatcttctgcattacctgcaggaaaacttaggctcccgtatagcggcactgaaggtgatctag

SEQ ID NO: 220890 - DNA, 2550 bp, Artificial Sequence
  Description of Artificial Sequence: Synthetic coding sequence
atgtggaaacggtcagaacagatgaaaataaaaagtggtaagtgcaatatggctgcagctatggagacggaacagttaggggtggaaatatttgagaccgcagattgtgaggaaaatatcgagtctcaggaccgccctaagttagagcccttttacgtggaacgctattcttggtctcaactgaagaagctgctagccgatactaggaaatatcacggatacatgatggccaaggcccctcacgacttcatgtttgtcaaacgaaacgatcccgacgggcctcattccgatcgaatttactacctcgccatgagcggggaaaaccgcgagaacacccttttttatagcgagatcccaaagaccatcaacagggccgcagtgcttatgttatcttggaagccattactcgacctgtttcaggccactctggattatgggatgtactcacgggaggaagaactcctccgggaacggaaaaggatcggaacagtggggatcgccagctacgactaccaccagggaagcggcacattcctcttccaagcaggctcaggaatttaccacgtgaaagatggcggtccccagggtttcacccagcagccattacggccaaatctcgtggaaacatcctgtcccaacatcaggatggaccctaagctgtgccccgctgacccagattggatagcgtttatccactcaaatgatatttggatctctaacatcgtgacccgggaagagcgtcggctcacctatgtgcacaatgagttagccaacatggaggaagacgcaaggtctgctggtgtggccacatttgtcctgcaggaggagttcgatagatactcaggatattggtggtgtccgaaggccgagactacacctagcggaggaaagatcttaagaatcctatacgaggaaaacgacgagtctgaggtggagataattcatgtcacttcacctatgctggaaacccgaagagcagactccttcaggtaccctaagacaggcaccgctaaccctaaggtcacatttaaaatgagcgagataatgatagatgctgaaggccgtattatcgatgtgattgataaagagttaatacaaccctttgagatcctgttcgaaggggtggaatacattgccagagcaggctggacacctgagggtaagtacgcatggtctattttgctggaccgatcccagacccgattacagattgtccttattagcccagaattattcatccccgtcgaagacgatgttatggaaaggcagagattaatcgagtctgtccccgactcagtgaccccactcataatatacgaggagaccacagacatttggatcaatatccatgatatcttccacgtttttccgcagagccatgaagaagagatcgagtttatcttcgcctccgaatgcaaaactggatttcgtcacttgtataagataactagtatcctgaaagaatcaaagtacaagaggtcatccggaggccttccagccccatccgactttaaatgccctattaaagaagagatcgctatcacctccggagagtgggaagtgctgggcagacatggctctaacatccaggtagacgaggtccgtcggctcgtgtactttgaggggacaaaggacagccccctcgaacaccatctgtacgtcgtgagctatgtcaaccctggggaggtaaccagattgactgatcgtggctactctcactcttgctgcatcagccagcactgtgactttttcatcagcaagtacagtaaccaaaagaacccacattgcgttagtttatacaagcttagcagccccgaagatgatcctacctgcaagacaaaagagttctgggcaaccattctggactcggccggtcctttgccagactacacaccaccagaaatcttttcatttgaaagcaccaccggattcactctgtacgggatgctttacaaacctcatgaccttcagcctgggaagaaatatcctaccgtgctctttatttacggcggtcctcagggccaaattgaaatcgatgaccaggtggaaggtctacagtatctggcctcgcgatatgacttcatagacctcgacagagtggggatccatggctggagctacggcggatatctttctctaatggctcttatgcagagaagcgatatatttagggtggctatcgccggagctccagtcacgctgtggatcttctacgatacaggttataccgaacgatacatgggacacccggatcaaaacgagcagggctattacctcggatcggttgccatgcaggcggaaaaatttccctctgagcccaataggctgctcctcctacacggcttccttgatgaaaatgtacacttcgcacacacctctattctcttaagctttctggtgagggccggaaaaccctacgatttacagatataccctcaggaaagacactccattcgggtccctgaaagcggggagcattacgaattacatttgttgcactaccttcaggaaaatctgggaagccgtatcgcggctctgaaggtgatctag

SEQ ID NO: 220891 - DNA, 2544 bp, Artificial Sequence
  Description of Artificial Sequence: Synthetic coding sequence
atgtggaagcgatctgagcagatgaaaattaagtccggcaagtgtaatatggctgcggctatggaaaccgaacaactgggagtagagattttcgaaacagccgattgcgaagaaaatattgagtcccaggatcggccaaaactggagcctttttatgttgaacgttactcttggagccaactaaagaagcttcttgcagacacgcggaaatatcatggttacatgatggccaaggcccctcatgatttcatgttcgtaaagcgcaacgacccggatggccctcattccgacaggatttattacctggccatgagtggcgagaacagggaaaatacactgttctattcagagattcccaaaaccatcaatcgggctgcagtactgatgttaagctggaagccccttctagacctttttcaggctaccctggactatgggatgtactcaagagaggaggagctgctgcgcgagaggaagcgcatcgggacggtagggatcgcctcctatgactaccaccaggggagcgggactttcctgtttcaggccggatcagggatctatcacgtcaaagacggaggcccacaaggcttcacgcagcaacccctgaggccgaatctcgtagagacgtcctgccccaatatcaggatggacccaaaactgtgtcctgcagatccagattggattgcgttcatacacagtaatgacatctggatctccaatattgttacacgagaggaaagaagactcacctatgtccataacgagttggctaacatggaagaagacgctaggtccgctggcgttgccacatttgtactgcaggaggagtttgatcgctacagcggctactggtggtgcccaaaagccgaaacaactccgtccgggggaaaaattctccgcattctttacgaggagaacgacgaaagcgaagttgaaataatacacgtgacttcacctatgctggagaccagacgggcagattctttcaggtaccctaaaaccgggactgctaatcccaaagtgacttttaagatgagcgagattatgatcgacgcggagggacgtatcatagacgtgatcgacaaggagctgattcagccatttgaaattctctttgaaggagtcgagtatattgccagggccggatggacccctgaaggaaagtatgcctggtctattctgctcgatcggagccagacacgtctgcaaattgttctgatctcaccagaactgttcattcccgtggaagatgatgtaatggagagacagagattaattgaaagcgttccagattcagtcaccccactcataatttacgaggagacaacggacatctggatcaatatccacgatatctttcatgtgtttccccagagccacgaagaggaaattgaattcatcttcgctagcgaatgtaaaacagggttcaggcatctttataagatcacctccattctgaaggaaagcaaatacaaacgctcctctggcggattgccagcaccatctgatttcaaatgccctattaaagaggaaattgccattacctcaggggagtgggaggtcttgggccgacacggatctaacattcaggttgatgaggttcgaaggttagtttactttgaggggacaaaggatagtcccttagagcaccatctttatgtcgtctcctacgttaacccgggtgaagtgaccaggctgaccgatcggggatacagccatagctgttgcatctcccaacactgcgacttcttcatcagcaagtatagcaaccagaagaaccctcactgcgttagcctgtataagctctcctcgccggaagacgatccgacctgtaaaaccaaggagttttgggccacaattttagacagcgcaggcccactgccagattacacaccacccgagatttttagtttcgaatccacaacagggtttacgctctatggcatgttgtacaagcctcatgacctgcagcctgggaagaaatatcccacggtactgttcatttacggtggacctcaagtgcaactggtgaacaaccggttcaagggagtaaaatattttcggctcaacacgttagccagcctcggatatgtggtcgtggtgatagataacaggggcagctgccaccgaggtctgaaattcgagggtgcatttaaatacaaaatggtagcaatcgccggagctcctgtgacattgtggatcttctatgatacaggctacacagagcggtacatgggacatccagaccaaaatgagcaggggtactacctgggatcagttgcaatgcaggctgagaagttcccttccgagccaaaccgtctgcttctacttcatggcttcctcgatgagaatgtacactttgcacacacctccatcctactcagcttcctggtcagagcgggaaaaccctatgatctgcaaatctatccccaggaacgccatagtataagagtcccggagtcaggagagcattacgagcttcacctcctccactatttacaggaaaacctgggctcccgcatcgcagctttgaaggtcatctag

SEQ ID NO: 220892 - DNA, 2178 bp, Artificial Sequence
  Description of Artificial Sequence: Synthetic coding sequence
atgtggaagaggtctgagcaaatgaaaataaagagcggtaagtgtaatatggccgcagccatggaaactgagcagctgggcgttgagattttcgagactgctgactgtgaagaaaatatcgaatcgcaagacagaccaaagctcgagccattttatgtagagcgatacagctggtcccagcttaaaaagctcctcgcggatactagaaagtatcacggttacatgatggcaaaagcccctcatgactttatgttcgtgaagcgcaacgatcccgacgggcctcactcagatcgcatctattacctggccatgagcggagagaacagggagaacaccctattttatagcgaaatccctaaaactattaacagggcagccgtgctgatgctctcctggaagccgcttctcgacctgtttcaagcgacgctggattacggaatgtactctagggaggaagagttattgagggagaggaagcgaataggtacggtgggcattgctagttacgactaccaccagggttcaggtacatttctgtttcaggccggatctggaatatatcacgtgaaggacggagggccacaaggattcacccagcaaccactaagacccaacctggttgagacatcctgtccaaatatccggatggaccccaagctttgtcccgcagaccccgattggatagcctttattcactccaatgacatatggataagtaacatcgtgactcgagaagagcgtcgcctgacgtacgtgcacaacgagctcgcgaacatggaagaggatgcgagaagcgctggcgtcgccacctttgtgttacaggaagagtttgatcgctactccggatattggtggtgccccaaggctgagacaacaccatcagggggtaagattctgaggatcctttacgaggaaaacgacgagagcgaggtagaaataatccacgtgactagcccgatgttggagacccggcgagctgattcgtttagatatcctaagacaggaacggctaatccaaaggtgacattcaaaatgagcgagatcatgattgacgccgaggggagaatccaagtggatgaagtgcgcagactggtctattttgaagggacaaaggactctcctcttgagcaccacctgtatgtcgtgtcctacgttaacccaggggaagtgactcgattaacagacagggggtattcacactcctgctgtatatcccagcattgtgacttctttattagtaaatattccaaccaaaaaaatcctcattgtgtaagtttatacaagctatcaagcccggaagatgacccgacttgcaagactaaagaattttgggcgacaatcttagactccgcagggcctctgcccgattatacacctccagaaattttcagcttcgaatccacaacaggatttacgctgtacgggatgctctacaagccacatgacttacagcccggaaaaaagtatcccactgtcttgttcatctatgggggaccacaggttcagttagtaaacaaccgatttaaaggcgtgaagtactttcgtctgaatacgttggcctctctgggctacgtcgtcgtggtaattgacaatagaggcagttgccaccgtggactgaaatttgagggggcattcaagtacaaaatggggcaaattgagattgacgaccaggtagagggattgcagtacctcgcaagccgctacgattttattgacctggaccgggtgggaatccatgggtggagctatggaggctatttatctctgatggccttaatgcagcggtctgacatattccgcgtggccatcgcaggtgcccctgttactctttggatcttttacgacactgggtatactgagcgatatatgggacatcccgaccagaatgaacagggatattatctggggtccgtggcaatgcaggcagagaaatttccgagcgaaccaaacagactgctgctcctccatggctttttggacgaaaacgtccattttgcacacacatcaattcttctctctttcttagtgagggccggaaagccttacgacctgcagatttacccacaggagaggcacagcataagagtgcctgaaagcggtgaacactacgagctgcacctcctgcactacctgcaggagaacctgggctcccggattgccgctttaaaggtcatttag

SEQ ID NO: 220893 - DNA, 2697 bp, Artificial Sequence
  Description of Artificial Sequence: Synthetic coding sequence
atgtggaaacgctcggagcagatgaaaatcaaaagcgggaagtgcaacatggcggctgccatggagaccgagcagctgggcgtggaaatctttgaaactgccgactgtgaggaaaacatcgaaagccaagaccgaccgaagctagagcctttttacgtggaaagatatagctggtcacagttgaagaagctgctggccgatacgaggaagtaccatggttatatgatggccaaagcgcctcatgactttatgttcgtcaaacggaacgatcctgacgggcctcactctgacagaatctattatctggcaatgagtggcgagaaccgcgaaaacaccctcttttattctgaaataccgaagaccattaatagagctgccgtgctgatgctcagttggaaaccacttctggatctgttccaggctactttggactacggtatgtactctcgggaagaagagcttctgagggagagaaagcgaattggaactgttggaatcgccagttacgattaccaccagggctctggcacctttctcttccaggcaggtagtgggatttatcacgtgaaagacggaggtccacagggcttcacccaacagcccttgcgtcctaatctggtggaaacttcctgccccaatatcagaatggacccgaagctctgtccagcggacccagattggattgcgttcatccattctaacgatatttggatctccaacatagtgaccagagaggaaaggcggctgacatatgtgcacaatgagctagctaatatggaagaggacgccaggtctgccggagtggcaactttcgtgcttcaggaggagtttgatagatactccgggtactggtggtgccccaaggccgagaccacaccgtctggcggaaaaattctccgtatcctgtacgaggagaacgatgaatccgaggtagagatcattcacgtgacctctcctatgcttgaaacaaggagggccgactcattcagataccccaaaacgggaaccgctaaccctaaggtgaccttcaagatgagcgaaataatgatcgacgctgagggacgaatcatcgatgttatagataaggagctcattcaaccctttgagatattattcgaaggggtggagtatatagcccgtgccggatggactcccgaagggaaatacgcctggtcgattctcttagaccgaagccagactcgactgcaaatagtacttatttcccccgagctgttcattccagtggaggacgacgtgatggagagacaacgtttgatcgaatctgtgccagacagtgtgaccccattaatcatttacgaagagacaacagacatctggatcaatattcatgatatcttccatgtcttcccccaatctcatgaggaagaaatcgaattcatttttgcaagcgagtgtaagaccggatttcgacacctctacaaaatcaccagcattctcaaagagtcgaaatataaacggtcatccgggggtctacccgctccatctgactttaagtgccctattaaagaagagattgccattacgtcaggagagtgggaggttctggggcgacacggcagcaacattcaggtcgacgaggttagacgactcgtttatttcgaggggacaaaggattcacccttggagcaccatttatacgtcgtgtcctatgtgaaccctggagaagtgactcgactcacagaccgcggatattctcatagctgctgtatttcccaacactgtgactttttcattagtaagtattctaaccagaaaaacccccactgcgtgagcctctacaagctgtcttctccagaagatgacccaacttgtaagacaaaagagttctgggccacgattttggactctgctggccctcttcccgactacacacctcccgagatattctccttcgagtcaactacgggcttcacactctacggaatgctgtataaacctcatgacttgcagccagggaagaagtatcccaccgtcctcttcatttacggtgggccacaggtccagctggtgaacaacagattcaaaggagtcaagtattttagacttaatacccttgcgtccctcggctatgtggtagtggtcattgacaaccgaggctcgtgtcatagaggcctgaaatttgagggggcattcaagtacaaaatggggcaaattgaaatcgacgatcaggttgaaggcctgcagtacttagcctcaagatatgattttatcgatctggatcgggtgggtattcacggttggtcatatggcggttatctgtctctcatggccctgatgcagcgctccgacatctttcgagttgcgatcgccggagcccctgtgacgctctggatcttctacgataccggctacacagagcgctacatgggtcatcccgaccagaatgaacagggatattatctggggagcgtggccatgcaggccgagaaatttccgtctgagcccaacaggttactgctcctacacggttttctcgatgagaatgtacattttgcccacactagtattctcctgtctttccttgtacgggcaggaaaaccatacgacttacagatttaccctcaggaacggcacagcatccgggtgcctgagagcggcgagcattacgagctgcacctcctgcactacctccaagaaaacttgggttcacgtatcgcggcactcaaagtgatttag

SEQ ID NO: 220894 - DNA, 2349 bp, Artificial Sequence
  Description of Artificial Sequence: Synthetic coding sequence
atggcggcagcaatggaaaccgagcagctgggtgtcgaaatctttgaaacagcagactgtgaagaaaatatcgagagtcaggataggccaaagctggagcccttctatgtagagcggtacagttggtcccaactgaagaaactcctcgccgatacacgtaaatatcatggctacatgatggcaaaggcccctcacgacttcatgttcgtgaagcgcaatgatccggacggtccacatagtgaccggatctattaccttgccatgtcgggggagaacagagaaaacactctgttttattcagaaatacccaaaacaatcaatcgagctgcggtcctgatgctgagttggaaacctctgcttgacctctttcaggctacattagattatgggatgtattcacgggaggaggagctgctgcgggagcgcaagaggattggaaccgtgggtattgccagttatgattaccatcagggcagtgggactttcctgttccaggccggaagtggaatttaccacgtgaaggatgggggaccacagggatttacacaacagcctcttcggccaaacctggtcgaaacctcttgtcccaatatccgaatggaccccaagctctgcccagccgatcctgactggattgcgttcatccatagcaacgacatctggatttctaatatcgtgactcgcgaagaacgcaggcttacttatgtgcataatgagctggccaatatggaagaagatgccagaagtgcaggtgtcgccacgttcgttttacaggaagaatttgacaggtatagcggctattggtggtgtccgaaagctgaaacaactccatccggaggcaaaattctgcgtatactctacgaggagaacgacgagagcgaggtggaaattatacacgtcacttcccccatgctggaaacgaggagagctgattctttcaggtaccccaagactggaacggcaaaccccaaggtgacattcaagatgtctgaaattatgatcgacgcagaggggagaatcattgacgtgatagataaggagctaatacaaccttttgaaatcttattcgagggtgtagagtacatcgcacgcgctgggtggactcctgagggcaagtacgcctggagtatactgctcgacaggtcgcaaacaagactgcaaatagtgctcatctcaccagagttatttatccctgtcgaagatgacgtgatggagcgacaacggttgattgaatcggttcctgattcagtcacccctctcatcatctatgaagaaacaactgatatctggattaacattcatgatatcttccacgtgttccctcagtcccatgaggaggagatcgaatttatctttgcctctgaatgtaagaccggctttcgccacttgtataagatcacttcgatactcaaggagagcaagtacaagagaagttccgggggtctccccgcaccaagtgacttcaaatgtccaattaaggaagaaatcgctatcacgagcggagaatgggaggttctgggacggcacggctctaatattcaggtggatgaggtgaggagattggtctatttcgagggtaccaaggactctccactggaacatcacctgtatgttgtctcttacgtgaatcccggagaagtcacccgcctcacggatcgtgggtactcccactcttgttgcatctctcagcactgtgatttctttatatcaaaatattcaaaccagaagaatcctcattgcgtatccctctacaaactgtcctcacccgaggatgaccccacctgcaagactaaggaattctgggccacaattttagattcggccggacctttgcccgattacacacccccagaaattttcagcttcgagagcacaaccggctttactctatatggcatgctttataaaccacacgatcttcagcccggaaagaaatatccaactgtcctgtttatttatgggggaccgcaggttgctatcgcaggggctccagtgacgctgtggattttttatgatacaggatacactgagcgatatatgggacacccggaccagaacgagcagggctactacttggggtccgtcgctatgcaagccgaaaagttcccatccgaacccaatcgtctgctgctcctgcatggctttctggatgagaatgttcatttcgctcacacttcgatacttctgtcattcttggtgcgcgcaggtaagccctacgacctgcaaatctatcctcaggagaggcactcaattcgagtacccgagagcggcgagcactatgagctccaccttcttcactatctccaagaaaatctgggatctcgcattgcagcactcaaggtaatttag

SEQ ID NO: 220895 - DNA, 2697 bp, Artificial Sequence
  Description of Artificial Sequence: Synthetic coding sequence
atgtggaagaggagcgaacagatgaagataaaaagcggtaagtgcaatatggccgctgccatggagacggaacagcttggcgtggagatctttgaaactgcggactgcgaagaaaacattgaaagccaggaccggccaaaattagaacccttttacgtggaaagatattcatggagccagctgaagaaattgctggcagacacccgaaagtaccacggatatatgatggctaaggcacctcatgatttcatgtttgtaaaacgtaatgatcctgacggtcctcatagtgatcgaatctattacctggccatgtctggggaaaaccgcgaaaacaccctgttctactccgagatccctaaaaccataaaccgcgcagcagtattgatgctgtcttggaagcccctactcgatctgttccaggccactctcgactacgggatgtattcccgtgaagaagaactgctgcgggagcggaaaaggattggaacagtcggcatagctagctacgactatcaccagggctctggaacctttctctttcaagcgggaagcggcatctaccatgtcaaagatggcggacctcaaggctttacccagcagcccctgcgcccaaatctggtggaaacctcttgcccgaatattcggatggatccaaagttgtgccccgctgaccctgactggatagcctttatacattcaaatgacatttggatcagtaatatcgtcacacgggaggagcgaaggctcacttatgttcacaacgaactggcaaatatggaagaggacgcaaggagtgcgggagttgcaacgttcgtgttacaggaggaattcgataggtacagtgggtactggtggtgccctaaagctgaaaccacacctagcggaggcaagatcttgagaatcctctacgaggaaaacgatgaaagcgaagtggagatcatccatgtaacctcacctatgctggaaaccaggagagccgactcatttagatatccaaaaacagggaccgccaaccccaaagtcacttttaagatgtcagagattatgattgacgcagaaggccgaataattgatgtgatcgataaggagctaatacagcccttcgagatcttatttgagggagtcgagtatatagcccgagccggatggacacccgaaggtaaatatgcgtggagcattctgctggatagatctcagacacggctgcagatagttttgatcagcccagagctctttatacctgtagaagacgatgtcatggaacgccaacggctaatcgagagcgtcccagattccgtgacacctctgattatctacgaagagacaaccgatatatggatcaatatccatgacatcttccatgtcttcccgcagagccacgaagaggagattgaatttatttttgccagcgagtgcaaaactgggtttcgccacctctacaaaattacgagtatcctgaaggagagcaagtataaacgctcaagcggaggtctcccagccccaagcgacttcaagtgccccataaaggaggaaatcgcaattacctctggcgaatgggaggtactggggcgacacggtagtaatatccaggtggacgaggtgagacggctggtatactttgaaggtacaaaagattcccccctggaacaccacctgtatgtcgttagttatgttaatcccggagaggtgacaagactcactgacagaggctacagccacagctgttgcatttcacaacactgtgatttcttcatttctaagtattctaatcagaagaatccccactgcgtaagcctgtacaaactgagttctcctgaggacgatcctacgtgtaaaaccaaagagttttgggccacaattttggacagtgcaggcccactgcccgactacacgcctccagagattttttcattcgaatctactaccggcttcacgctctacggcatgctatacaaacctcatgacctgcagccgggtaaaaaatatccaacagtcctcttcatttatggcggaccccaggtccagctcgttaataatagatttaaaggcgtcaaatacttccgtttgaacactctcgccagcctcgggtacgtggtggtcgttattgataaccggggaagctgccacagaggcctcaaattcgaaggagccttcaaatacaagatggggcagatcgaaatcgatgaccaggttgaagggctccaatacctagcctctcgttatgacttcatagatctggacagggttggcatccacggatggtcatatggtggatatctcagtcttatggcactgatgcaaagaagcgacatattccgcgtggccatcgctggcgctcctgttaccctgtggatcttctacgacacagggtacaccgagcgctatatgggacatccagaccagaatgagcaaggttattacctcggctcagtggcaatgcaggctgaaaaattcccttctgaacccaacaggctgctgctcctgcacggtttcctggacgaaaacgtgcattttgctcacacatcaatattattgtcctttcttgtgcgagcaggcaagccctacgacttgcagatatatccacaggagcgccactctatccgcgtgcctgagtcaggcgagcactatgaactgcacttactgcactatctccaggaaaacttggggtccaggattgccgctctgaaggtcatttag

SEQ ID NO: 220896 - DNA, 3669 bp, Artificial Sequence
  Description of Artificial Sequence: Synthetic coding sequence
atgtccgaagcccctcggtttttcgtcggtcctgaggatacagagatcaatcccggtaattaccgccactttttccatcacgcggacgaggacgacgaggaggaagatgatagcccacccgagcgccagatcgtggtaggtatctgtagcatggcaaagaagagcaagtctaaaccaatgaaggagattctggaacgcatttccttatttaagtatattacagtggtggtcttcgaggaggaggttatcttaaatgagcccgtggaaaactggcctctttgcgattgcttaattagctttcactcaaagggctttcccctggacaaggccgtggcatatgcgaagcttcgtaatcccttcgtgattaacgatctgaacatgcagtaccttatacaggataggcgtgaagtgtattcaattctgcaagctgagggaatacttcttccacgctatgcaattctgaacagagatcctaataatcccaaagagtgcaacctgatcgagggtgaagatcacgtggaagtgaatggtgaagttttccaaaagcctttcgtggagaagcccgtttctgctgaggatcacaatgtgtacatttattacccgaccagtgcgggaggcggaagccagcgattattccgaaagatcgggagccgtagctcagtgtactcgcctgagagtaatgtcagaaagaccggaagctacatttacgaagagtttatgcccacagacggcaccgatgttaaggtgtatactgtggggccagattacgctcacgccgaggcgagaaagtctccggctctcgatggaaaggtggagagggactcagaggggaaggaggtgcggtaccctgtcatcctcaacgccagagaaaagctgattgcttggaaggtctgcctggcctttaagcaaactgtctgtggctttgacctcctgcgggctaatggccaatcctacgtgtgcgatgtaaacggtttctctttcgtgaaaaattctatgaagtactatgatgactgtgctaaaattcttggcaatatcgtgatgcgtgaactggccccacagttccacatcccgtggagcatacccctggaggccgaagatattcctatcgttccaactaccagcgggacaatgatggagttacgctgtgtcatcgctgtgatccgccacggagaccggacccctaagcagaagatgaagatggaggtgcgccatcagaaattcttcgacctcttcgagaagtgcgacgggtataagagtggaaagttgaaactaaaaaagccaaagcagctccaagaggtgctcgatatcgctaggcaacttttgatggagctcggccagaataatgatagtgaaattgaggaaaataaaccgaagctggagcagcttaaaaccgtgctggagatgtatggacatttctccggaattaatcgaaaggtccagctcacctatctgcctcacggatgcccaaaaacctcatccgaggaagaggacagtagacgcgaggaacctagcctgttactggtcctgaaatggggaggagagctcacacctgcagggcgagtgcaagccgaggagctcggcagagcttttaggtgtatgtatcctggtggccaaggcgactacgccggatttcccggttgtggactgctgcgactacacagcacctataggcatgatctcaagatatacgcgagcgacgagggaagggtgcaaatgacggccgcagcattcgccaaggggcttctggccctggagggagaacttactcccattctggtacaaatggtcaagtctgcgaatatgaatggactgctcgacagtgatagcgactcactgtcatcttgtcagcagcgcgtgaaggcgcgacttcatgagatcctccagaaggaccgagactttacagcagaggactacgagaagttgacccccagtggatccatttctctgattaagagcatgcatttgatcaagaatccagttaaaacatgtgacaaagtgtactcactcatccaatcgcttacttcacaaatccgccaccggatggaagaccccaaatcctcagacattcagctgtatcatagtgaaacacttgaactgatgttaagaagatggagcaagcttgaaaaggacttcaagacaaagaacgggagatatgacatctccaaaataccggatatctacgattgtatcaaatacgacgttcagcacaatggctctctgaaactggagaatacaatggaattgtatcgactgtccaaggctctggctgatatcgtgatccctcaggaatacgggatcacaaaggctgagaagctggaaattgccaaggggtactgcacaccactagtcaggaagatcagatccgatttgcagagaacccaagatgacgatactgttaataaacttcatcctgtctacagcaggggcgtgctctctcccgagcgccatgtgcgtacacgcctgtatttcacctctgaaagtcatgtacattcactgctatccatcctgagatacggcgctttgtgcaacgagtctaaagacgagcagtggaagcgggctatggattatctgaatgttgtgaatgaactaaactacatgacgcagattgtgatcatgctgtatgaagaccccaacaaggatttaagttccgaagaaagatttcacgtcgaactgcactttagccccggagccaaggggtgtgaggaggataagaacctgccatcaggttacggttaccgccctgctagtcgggaaaacgaggggaggcgcccatttaaaatcgataatgatgatgagccacacacctctaagagagatgaggtcgatagagccgtgattctgtttaagccaatggtttccgagcccatacatattcatcggaagtcaccactgcccaggtctaggaagactgccactaacgatgaggagtcacccctgagcgtgtcatcaccagaaggaaccgggacctggctgcactacaccagcggtgtgggtactgggagaagacgccgtaggtccggagagcagatcacgtccagccctgtaagccccaaatccttggcattcacctcctctatcttcggttcctggcagcaggttgtgtccgaaaacgctaattatctcaggactcccagaaccctagtggaacagaagcagaacccaactgtcggatctcattgtgcagggctgttctctacatcagtgctggggggatccagcagcgctccaaatctgcaggattatgccagaacacatcggaagaagctgacaagctctggttgcatagacggattcgaactgtactccatggtgccctccatctgtcccctcgagacacttcacaacgctctctcgctgaaacaggtggacgaatttctcgcatctatcgcctcacccagttccgatgtgccgagaaaaaccgctgagataagcagtaccgccctcaggtctagtccaatcatgaggaaaaaggtaagtctaaacacctatactcccgctaaaatcttgccaactccacctgccaccctgaagtctaccaaggcctcatcaaagcctgccacgtctggtccaagctcagccgtagtccctaacacgagtagcaggaaaaaaaatatcacatccaagaccgagacccacgaacataaaaagaatacagggaaaaaaaaatag

SEQ ID NO: 220897 - DNA, 3732 bp, Artificial Sequence
  Description of Artificial Sequence: Synthetic coding sequence
atgagtgaagcaccgagattcttcgttggccctgaggatactgagattaatccaggtaactaccggcacttcttccaccatgcagacgaagacgatgaggaggaggacgattcccccccagagcgccaaatagtagtaggtatttgttccatggcaaagaaatctaagagcaagccaatgaaggaaatcctcgagagaatatccctgtttaaatatattaccgtggttgtgttcgaggaggaagtgattttgaacgaacccgtggagaattggccgctctgcgattgcctgatctctttccacagtaaagggtttccactggacaaagccgtggcatacgcgaagttacggaatccctttgtgatcaatgatttgaacatgcaatatcttatccaggacaggcgggaggtctatagcatcttgcaggctgaaggcatccttttgccgagatatgccattctgaaccgggaccctaataatccaaaggagtgcaatctcatcgagggcgaggaccacgtcgaagtcaacggagaggtgttccaaaaaccatttgttgagaaacctgtcagtgcagaggatcataacgtgtacatttattaccctaccagtgcagggggagggagccaaagactcttccgcaaaattggctcacggtcttcagtgtattccccagaatccaatgtgcgcaagaccggctcttacatttatgaagagttcatgcctactgacggaaccgatgtcaaagtatacacagtgggtcccgattatgctcacgctgaggcacgcaagtcccccgctctcgatggaaaggtggaacgcgacagtgaagggaaggaggtcaggtacccagtaattctgaacgcaagggagaagctgatcgcttggaaagtatgcttagcattcaagcagaccgtatgtggcttcgatctattgagggccaatgggcagagctatgtctgcgacgtcaacggattctctttcgttaaaaacagcatgaagtactacgatgattgtgctaaaatcctcgggaacatcgtaatgagagagctggctccacaatttcacatcccctggtcgatacccctggaggctgaggacatccccattgttccgacaacctctggcaccatgatggagctacgctgcgtaatagccgtgataaggcacggtgatagaacacccaagcaaaagatgaagatggaagttcggcatcagaagttctttgatctgtttgaaaaatgcgatgggtataagtccggaaaattaaagctgaaaaaaccaaagcaactccaggaagtactcgatatagcaagacagctgctgatggaactggggcaaaataacgattcagaaatagaagagaataagcctaaactcgagcaactaaagactgttcttgaaatgtatggacatttctctggaatcaatcggaaggttcaattaacgtacctgccacacggctgccctaagactagttctgaggaagaagatagcagaagggaggaaccatccctcctgctggtgcttaagtggggtggcgaactgacgcccgcaggtcgagtgcaagctgaggagttaggacgcgcttttcgatgcatgtacccgggtggccagggtgactacgccggattcccaggatgcggactgctgcgccttcatagcacataccggcatgacctgaaaatctacgctagtgatgagggtcgagtccagatgacagcggcagcatttgctaagggattactggccctggaaggtgaactcacgcccattcttgtgcaaatggtgaagagcgctaatatgaacgggttgctggattccgatagtgactccctttcaagttgccagcagagggtgaaggcgagactgcacgagatcttgcaaaaggaccgagacttcactgctgaagattacgagaaactcactcccagcggatcaatcagtctgattaaaagcatgcatttgatcaaaaacccggtaaaaacctgtgataaggtgtacagcctcatccagtctttaaccagtcagattcggcaccggatggaggaccccaaatctagtgatatacagctgtatcattccgagactctagagctgatgctgcgcaggtggtctaagctggaaaaggactttaaaactaaaaacgggaggtacgacatctcaaagataccagacatctacgattgcattaagtatgatgtgcaacataacgggagcctgaagcttgagaacacaatggaactgtatagactctcaaaagctctggcggacatcgtcatccctcaagagtacgggatcaccaaagccgaaaagctggaaatcgctaagggctactgtacccctcttgtgagaaaaatccgctctgacttacagagaacacaagacgacgatacagtgaacaagctgcaccctgtctactccagaggggtgctttcgcctgagcggcatgtaagaactagactatactttaccagtgagagccatgtgcactccctcttgtcaattctgcgatacggcgcactgtgcaatgagagcaaggacgaacaatggaagagagccatggattacctcaacgtcgtgaacgagctgaattatatgacacagatagttataatgctctacgaggatccgaacaaggaccttagttccgaggagcgtttccacgtggagctccactttagcccaggagctaagggctgcgaggaagacaaaaatctgcctagcggatacgggtatcgccctgcttctagagaaaacgagggccgtaggccctttaagattgacaatgatgatgagccccatacatccaaacgggatgaggtggacagggcagttattctatttaagcccatggtctctgagccaatacatatccacaggaagagccccctgcccagaagcaggaagacagctacaaatgatgaagagtccccactttcagtctctagtccagaaggcacaggtacctggctgcactacactagcggggtggggacggggaggagacgacgcagaagtggcgaacagataacatctagccccgtgtctcctaagtcactggcatttacgagcagtatctttggctcctggcagcaggtcgtgtccgagaacgctaactacttgaggactccacggacacttgtcgagcagaagcagaaccctacagtcggaagccattgcgccggactgttttcgacctctgtcctcggtggttcgagttcagcacccaatctgcaagactacgctcgcacgcatcggaagaagctcacatccagtggctgtattgatgatgccacccgaggctctgcagtgaaacggttctcgattagtttcgctagacacccgaccaacggcttcgagctatacagcatggtcccatctatctgccccctggagaccctgcacaatgctctctccttaaaacaagttgacgaattcctggcctcaatcgcttctccaagtagcgacgtgcccaggaaaaccgctgagatttcttcgacagctctaaggagctcacccatcatgagaaaaaaggtgagcctgaacacttacacaccggcaaaaatacttccaacaccgccagccacgcttaaatcaaccaaagcgtcctcaaaaccagccacctccggtccatcttccgcagtagttcccaacaccagcagccggaagaaaaacattacctccaaaaccgagacccacgagcataagaaaaatacagggaaaaagaagtag

SEQ ID NO: 220898 - DNA, 3669 bp, Artificial Sequence
  Description of Artificial Sequence: Synthetic coding sequence
atgagcgaggcgcctcgattttttgtcgggcctgaagatacagagatcaatcccggtaattaccggcacttttttcaccacgcagatgaagatgacgaagaagaggatgattctccgccagaacgccagatagtggtgggcatctgttcaatggcaaaaaagtctaagagtaagcctatgaaggagattctggagagaattagtctgtttaagtatattacggtcgtcgtcttcgaggaagaggtgatcctgaacgagcccgtcgaaaactggcccctctgtgattgcctgatttcctttcacagtaagggattcccgctggataaggcagtcgcctacgctaagctgaggaacccttttgtaataaatgatctcaatatgcaatatctgatccaggacagacgggaagtgtactctatcctgcaggccgaaggcatccttttaccacgttacgccatcctgaatcgcgatcctaacaacccaaaagaatgcaacctcatagagggagaggaccacgtggaggtgaatggcgaagtcttccaaaaaccatttgtcgaaaagccagtgtccgcagaggaccacaacgtatacatatattaccctaccagtgcagggggagggtcccagaggctgtttcggaaaatagggtcgcggtctagcgtgtacagcccggagagcaacgtgaggaagacaggaagctacatatacgaagaattcatgcccaccgacggcacagacgtgaaagtgtataccgtaggacctgactatgcacatgctgaggcccgaaaatcacccgcactggacggcaaggtagagcgagatagcgaggggaaggaggtgcgctaccctgtcattcttaacgcacgggaaaagcttatcgcctggaaagtgtgtctggccttcaagcaaaccgtctgcgggtttgacctgctccgagctaacggccagagttacgtttgcgacgtgaacggattcagcttcgtgaaaaattcaatgaaatattacgacgattgcgccaaaattctgggcaatatagtaatgagggagctggctcctcagttccatattccctggagtataccgctcgaggctgaagatattcccatcgtcccaactaccagcgggacaatgatggaactccggtgcgtcattgctgttatccggcacggagaccgcacacccaagcaaaagatgaaaatggaagtacgtcaccaaaagttctttgatctcttcgagaagtgcgacggttacaaatcagggaagctcaagctcaaaaaacccaaacagctgcaggaggtgcttgacatcgctcgccagctgctcatggagttgggccagaataacgatagcgagattgaagagaataagccaaagctagaacagctgaagacagttctggaaatgtacggccattttagtggcattaataggaaggtgcagctaacctatctgcctcacggctgtcctaagaccagctccgaggaagaggactcacgacgagaagagccctctctgctcctggttttgaaatgggggggtgaacttacccccgcagggagagttcaggctgaagaactcggtagggcgtttcgctgcatgtaccccggaggacagggcgattacgcaggtttcccgggatgtggacttcttcggctgcatagcacctaccgccacgacttgaagatctacgccagcgatgaggggcgagttcagatgaccgctgccgcttttgctaagggtcttttggccctagaaggcgagctgactcccattctcgtccagatggtgaagagcgctaatatgaacggactgctggattctgactctgactccctctcctcctgccaacaacgcgtcaaagcccgattgcacgaaatcttgcaaaaagaccgggactttactgctgaagactatgaaaagctgacaccctcagggtctattagcctaattaagtcgatgcacctcattaagaatccggtgaagacatgcgataaggtctattctttaattcagagcctgacgagccagatcaggcacagaatggaagatcctaaatcttccgacatccagctttaccactccgaaacgctcgaacttatgttacgtcggtggtctaaactggagaaggatttcaagaccaaaaatggcagatatgatataagtaaaattccagacatctacgattgcatcaaatacgacgtacagcataatggctcactgaaactggaaaacaccatggagctgtacagactctcaaaggctcttgccgacatcgttatcccccaggagtatgggatcaccaaagctgagaagctcgagattgccaaaggttactgtacgccacttgtccggaagattcgctcagatttacagcgaactcaggatgacgatacggtgaataagctgcaccctgtgtattctcgtggggtcctgagcccggagaggcacgtgcgaacccgcctgtacttcacgtcagaaagtcatgtccactccctcctctcgatactgagatacggagcattatgcaacgaatccaaagatgagcagtggaagagagctatggattatcttaatgtcgttaatgagctgaattatatgacacagatcgtcatcatgctctatgaggaccctaataaggatctgtctagcgaggagcggttccatgtggagttgcatttctcccccggtgctaaagggtgtgaagaagataaaaacctgccttcaggatacggttataggcccgcttccagagaaaacgagggtaggcgacccttcaaaattgacaatgacgatgagccacatacatcaaagcgcgacgaagtcgatcgagctgtgatcttgttcaagcccatggttagcgagcccatacacatacatcggaaaagcccactgccacgctcccgcaaaacagccaccaacgacgaagagtcgccactttccgttagtagtcccgagggaacaggcacgtggctgcattataccagcggagtaggaacagggaggagacggaggcgttctggtgagcagattaccagttctccagtatcccctaagtcactcgctttcacctctagtatctttggttcttggcagcaggttgtttccgagaacgccaactacctcaggactcccaggaccttagtggaacagaagcagaatccaaccgtgggtagccactgcgcaggcctcttctctacaagtgtactgggcggaagcagcagcgcccctaatcttcaggattacgcccgtacccatcggaagaaactgacatcctcgggctgcatcgatggcttcgagctttactccatggtgcccagcatctgtcctctggagaccctccataacgctttatcacttaaacaggtggacgaattcctggcctcaatcgcgtcccccagcagtgatgtgccacgcaaaactgcagaaatctcatcgacagcactgcgctcctcaccaattatgagaaaaaaggtgagccttaatacatatacgccagctaaaattctgcctaccccacccgcaaccctgaaatccacaaaggcatcgtcaaaacccgcaacgtctgggccaagttcggccgttgtcccgaatacaagttctagaaaaaagaacatcactagtaagactgaaacacacgagcacaagaaaaacacaggtaaaaagaaatag

SEQ ID NO: 220899 - DNA, 3837 bp, Artificial Sequence
  Description of Artificial Sequence: Synthetic coding sequence
atgtctgaggctccacgtttttttgttggacctgaagatacggagataaatccaggtaattatcggcacttctttcatcacgcagatgaagacgatgaggaagaagacgatagcccccctgagcggcagatagttgtgggaatctgcagtatggctaagaagtctaagagcaaacctatgaaggagatcctggaacgaatctctttgtttaagtacatcaccgttgtcgtgtttgaggaagaggtaattttgaacgaaccagtcgagaattggcctttgtgcgattgcctcatctcatttcattctaagggttttccactggataaggccgtggcctatgcaaagctgcgcaacccattcgtgattaatgacctcaatatgcagtacctgattcaggaccggagggaggtgtattctatcctgcaggccgagggtatcctgttaccacgctacgccattctcaatcgggatcccaacaatccaaaagagtgtaatttgatagagggggaggatcacgtagaggtcaatggtgaggttttccagaaaccatttgtcgagaagcccgtttcagccgaggaccataacgtgtatatctattacccaacatccgccggaggaggcagccagaggcttttcagaaaaatcggtagcaggagcagtgtctacagccccgagtcaaacgtgcgcaagacaggaagctatatctacgaggaatttatgcctaccgatggaactgatgtgaaggtctacaccgtgggacccgactatgcccacgcggaggccaggaaaagtccagcactggacgggaaggtggaaagggacagtgagggtaaggaggttcgctatcccgtgatcttgaatgccagggagaagctgatagcttggaaggtgtgtctcgcttttaagcagactgtttgcggcttcgaccttctgagggccaatggacagtcctacgtatgcgacgtaaacggcttctctttcgtgaagaatagcatgaagtattacgacgattgcgccaagattctggggaatatcgtgatgcgggaactagctccacagtttcatatcccctggtccataccgctagaggcagaagatatccctattgtccccaccaccagtggcactatgatggagctcaggtgtgtcatagcagtgattcgacacggagacagaacacccaagcagaagatgaagatggaagtgagacaccagaaattctttgacttgttcgaaaagtgcgatggctacaagtctgggaagctaaagttaaagaagcctaaacagctgcaagaagtgttggacattgccaggcaacttctgatggagttgggtcagaataatgattcagagattgaagagaacaaaccgaaactcgagcaactgaaaacagtactggagatgtatggacacttctctggcatcaataggaaagtgcagctgacgtatcttccccacgggtgtccaaagactagttccgaggaggaagactcccgccgagaggaaccctcactgctgttggtgttgaagtggggcggtgagctgacacctgcagggcgagtccaagccgaggagctagggagggcgttcaggtgtatgtaccccggtgggcagggtgattacgctgggtttcctggttgtggcttactgagattgcactctacgtataggcatgatttaaagatttatgctagtgacgaaggacgtgtacagatgaccgccgcagcattcgccaagggattgttagccctcgagggggagctcacccccatcttagtccaaatggtcaagtcagcaaatatgaacggcctcctggattccgatagcgattccctgagtagttgtcagcaaagagtgaaagccaggctgcacgaaatcctccagaaggatcgggacttcacagcagaggactacgagaagttgaccccaagcggttctatctcgcttatcaaatctatgcatctgatcaagaatccagtgaagacatgcgataaggtgtattcgttaatacagagcttaacatcccagatccgccaccgaatggaagaccccaagtctagcgacatacagctctaccatagcgagaccctggaactgatgcttcgcagatggagtaaattggaaaaagattttaaaacaaagaacggcagatatgatatatctaagatcccagacatttacgactgcattaaatacgatgtgcagcataacggctccctgaaactcgaaaacacgatggaactttacaggttaagtaaagctctcgctgatatcgtgattccacaggagtatggcattacaaaggccgaaaaactggagatcgccaagggctattgcacccccctcgtgcgaaaaataaggagtgatctccaaaggacccaagacgatgatacagtgaataagctccacccagtatactcacgcggagtgctatccccagaacggcatgtgagaactaggctttatttcacgtccgagagccatgtccattcacttctttctatcctgcgttatggcgcactgtgtaacgaccatgactctcagaacgaagacggagggatggtaaaggaaatggagtcaaaagatgaacaatggaagcgggctatggactatctcaacgttgtaaacgagctgaattacatgacacagatcgtcatcatgctctacgaagaccctaataaggatttgtcttccgaggagcgcttccatgtcgaactccacttttcccctggagccaaaggatgcgaggaagataagaacctgccatctggctacggctaccgccctgcaagcagggagaacgagggccgaaggcctttcaagattgataatgatgatgagccccacacctctaagagggacgaggtggatcgcgctgtcattttgttcaagccaatggtgagcgaacccatccacatccacagaaaatccccattaccacgctcccgcaagacagctacaaatgacgaagaatcccctctcagtgtgagtagcccggagggaaccggtacctggctccattatacatctggagtgggcaccggaagaagaagaaggaggagtggggaacagatcaccagttctccagttagcccaaagagcttggcttttacatcatcaattttcggcagctggcagcaggttgtaagcgaaaatgcaaactatttgcgcactcctcgcacacttgtggagcaaaaacaaaaccccaccgtaggatctcattgtgccggactgttttctaccagcgtgttgggcggatccagtagcgctcctaatctccaggactacgccaggactcacagaaagaagctcaccagcagcgggtgcatcgatgacgcaacacggggatccgctgtcaagagattctctatatccttcgctaggcaccccacgaatgagcatctgcacctctaccgatgctggtccgtgtcgagcgtagagttcctcggatcctccggcttcgaactctacagcatggtgccatccatttgtcctctagaaacccttcataatgccctgtcgttgaagcaagtggacgagttccttgcctcaatcgcaagcccatcttctgacgtgccacgaaaaacagcagaaattagttcgaccgccctgcgcagctcacctatcatgcggaagaaagtgagtttgaacacatacacccctgcaaaaattctccccactccgccagcaaccttgaaaagcacaaaagccagttctaagcctgctacttcaggcccatcgtccgcagttgtccccaacacgagctcacgcaaaaagaacataacttctaagactgagactcacgaacataaaaagaacacaggcaagaaaaaatag

SEQ ID NO: 220900 - DNA, 177 bp, Artificial Sequence
  Description of Artificial Sequence: Synthetic coding sequence
atgtccgaagcccctagattcttcgttggtcccgaagataccgagataaatccaggaaactaccggcacttctttcatcatgccgacgaggacgacgaggaggaggatgattctcccccagagagacaaattgtcgtgggcatttgctccatggcaaaaaaaagcaagtccaaatag

SEQ ID NO: 220901 - DNA, 2877 bp, Artificial Sequence
  Description of Artificial Sequence: Synthetic coding sequence
atgctcaagtccaaaaccttcctgaaaaaaacgcgtgcaggtggggtgatgaaaatcgtccgggagcattacctcagggacgacatcggatgcggcgcacccggatgcgcggcatgcggtggagcccacgaaggccctgccttggaaccccagccccaggacccggcaagcagtgtgtgccctcagccacactatcttctgccagatacaaacgtgttgcttcaccagattgatgtgttggaagatcctgccattcgcaacgtgatcgtacttcaaaccgttttgcaagaggtccgaaatagatctgcacccgtttataagagaatacgggatgttaccaataaccaggaaaagcacttctacacatttactaatgagcaccatcgggaaacctacgttgaacaggagcagggggaaaatgccaacgaccgtaatgatagggcgatcagagtggcagcaaagtggtataacgagcacctgaagaagatgagtgcagataaccagcttcaagtaattttcatcacaaatgaccggcgaaacaaagagaaggccatcgaagaagggattccggcattcacctgtgaagaatacgtgaagtcgcttaccgccaatcccgaactgattgatcgtctggcttgtctgtccgaagaaggtaatgaaattgaaagtggaaagataatcttttcagaacatttacctcttagtaagctgcagcaaggaattaagtccggtacctatctccagggcacatttcgagcgtccagagaaaactaccttgaggctacagtttggatccatggtgacaatgaggagaacaaggagattattttgcaaggactgaaacacctcaacagggcagtgcacgaggatattgtggcggtcgagctgctaccaaagtcccaatgggttgccccaagctcggtggtgctccatgatgagggccagaacgaagaggatgtggagaaagaggaagagacagaaagaatgctgaaaaccgccgtgtcagagaagatgctcaaacccacggggcgtgttgttgggatcattaaacgcaattggcggccttattgcggcatgttgagcaagagtgatattaaggagagccgcagacatctctttactccggctgacaagcgaattcccagaataagaatcgaaaccagacaggcttccactcttgagggtcgaaggataatcgtggctattgacggttggccccgaaattcaagatatcccaacggccattttgtcagaaacctgggcgatgtcggggaaaaagagactgagaccgaggtgctcctgcttgagcacgatgtgccacaccagcccttttctcaggccgtgttaagcttccttcccaaaatgccatggagtatcaccgagaaggacatgaaaaacagagaggatctgaggcacctttgtatttgctcagtggaccctcccggatgtactgacatcgatgacgcactgcactgtagagagctagagaatggtaacctggaagtgggggtccacattgccgacgtatcgcattttatcaggcccggaaacgctctcgatcaggagtcagctaggagaggcactactgtatatctatgtgagaaacgtatcgacatggtacctgagctgcttagcagcaacctgtgttcccttaaatgtgacgtggataggctcgcattctcctgtatttgggaaatgaaccacaatgccgagattctgaaaacgaagttcacaaaatcggtcatcaactccaaggcttcattgacctatgcggaggcacagctgcggatcgactccgccaacatgaatgacgacatcaccacatcgctacgagggttgaataagctggccaagattctaaagaagcgacggatagagaaaggagccctcaccctgtcaagtccggaggtgcgattccacatggacagtgaaactcatgatcctatcgacctacagacaaaggaattgcgagaaactaattctatggtggaagaattcatgctgctcgctaatataagtgtcgccaagaagatacatgaggaattcagcgagcacgccctcttgcgcaaacacccagcgcctccaccatctaattacgaaattctcgtgaaagcagcaaggagtcgcaacctggaaatcaaaaccgatacagctaaatccctggcggagtccttagaccaggccgaaagccccacatttccttatctgaataccctgctgcgaatcttagctaccaggtgtatgatgcaggccgtgtacttttgctcgggaatggataacgactttcaccattacggcctggcctcccctatctatacacattttacgtctcctatccggcgatatgctgatgtaattgtccatcggctgctcgcggtggcaattggcgctgactgtacataccccgaacttaccgataaacacaaactcgctgacatttgcaagaatctgaacttcagacacaagatggcacagtatgctcagcgagcatctgtggcattccatactcagctgttttttaagtctaaaggaattgtgagtgaggaggcctatatactgttcgtccggaaaaatgctattgtagtgttgatacctaaatatggactagaagggaccgtctttttcgaggaaaaagacaagccgaacccgcagctcatctacgatgacgaaattccaagcctcaaaattgaggatacagtgtttcatgtgtttgataaggttaaggtgaagattatgcttgattcatcgaatctgcagcaccagaagattaggatgagccttgtcgagcctcaaattcctggtataagcatcccgactgacacttcaaatatggaccttaatgggcctaagaagaaaaagatgaaactagggaagtag

SEQ ID NO: 220902 - DNA, 2391 bp, Artificial Sequence
  Description of Artificial Sequence: Synthetic coding sequence
atgagtgcagataatcagttgcaagtcatctttatcacgaacgatcgcaggaataaggagaaggctatcgaggaaggaataccggctttcacatgcgaagagtatgtaaagtcattaacagcaaacccggagcttatagataggttggcttgcctatcagaggagggtaatgaaattgagagcgggaaaattatttttagcgagcatcttcccctatccaaactacagcaaggcatcaagtccgggacatatcttcagggaacctttagggccagtagagagaactacctggaggctactgtgtggattcacggcgacaatgaggaaaataaggagatcatcctgcaggggttaaagcacctgaaccgggcagtgcacgaggacatagttgccgtcgagctgttgcccaaatcacaatgggtcgccccaagcagcgtcgttctccatgacgagggccagaacgaggaagacgtggaaaaagaggaggagaccgagcgaatgctgaagactgctgtgtcagaaaagatgttgaaaccgacaggacgagtggtcggcattatcaaaaggaactggcgcccatactgtggtatgctgtcgaaatctgatataaaggagagccgaaggcatttgttcacccctgccgacaaaagaataccgcgaattcggattgagactcgacaggcatcaacgttagaggggaggcgaatcattgtggctatcgatgggtggcctcgtaattcacgctatcccaatgggcattttgtaagaaaccttggcgacgtcggagaaaaagaaactgagaccgaggtgctgctgctagagcatgacgttccccatcagcccttcagccaggccgtgctttctttcctccccaagatgccatggtccatcacagaaaaagatatgaagaatcgtgaggatttgaggcacttgtgtatatgctccgtagacccaccaggctgtactgacatagacgacgccttgcattgcagagaacttgagaacggcaatctagaggtgggcgtgcacatagctgatgtgagccacttcattagacctggtaacgccctggatcaagagtccgccagaagggggacgactgtttacttgtgtgaaaaaagaatcgacatggtgccagaactcctgtcgtctaacctgtgcagtctgaagtgtgatgtagatcgcctggccttctcctgcatctgggaaatgaatcacaacgccgagatactgaaaactaaattcacaaaatcggttatcaactctaaggcaagtctgacctacgccgaggcccagcttaggatcgattctgcaaacatgaacgacgacattactacatctctgagaggactgaataaactcgccaaaattctgaagaaacgacgaattgagaagggagccctgaccctttcttctcctgaggtgcgatttcacatggattcagagacgcatgaccccattgatctccaaactaaagaactgcgggagacaaatagcatggtcgaagaatttatgttgttggctaatatctccgtcgccaaaaaaattcatgaggagttcagcgaacacgcgctgctgcgcaaacatcctgccccaccaccttcaaattacgagatattagtaaaagctgccaggagccgcaacttagagatcaaaactgatacagcaaaaagtctcgccgaatcgttagatcaggccgagtcccccaccttcccctatcttaatacacttctgaggattctggcaacccggtgcatgatgcaagcagtgtatttctgcagcggaatggacaacgactttcatcactacggtctagctagtcccatctatactcattttacctcacctatccgtcggtatgccgatgtgatcgtgcatcgactgctcgctgttgctatcggtgccgattgtacgtaccctgaactgacagataagcataaactggccgatatctgcaaaaatctcaatttcagacacaaaatggcacagtatgcgcagagggcatccgtagccttccacacacaattattctttaagtcaaagggaattgtttctgaggaggcttatatcctatttgtgaggaagaacgctattgtggtgctgatccccaaatatgggctggaaggtacagttttcttcgaggaaaaggacaaacccaatccgcaactgatctatgacgacgagatcccgagcttgaaaatcgaggacacagtgtttcacgtcttcgataaagtcaaagtgaagattatgcttgacagctctaatctgcagcatcaaaaaattagaatgtcgctggtggaacctcagattcccggaatcagcatacccaccgatacaagcaacatggatctcaatggccctaagaagaaaaagatgaagcttggcaaatag

SEQ ID NO: 220903 - DNA, 2787 bp, Artificial Sequence
  Description of Artificial Sequence: Synthetic coding sequence
atgctcaagtctaagacttttctaaagaagacaagagcgggtggggtcatgaagatagtacgggagcattacctgagggacgatatcgggtgtggggctccaggatgcgctgcatgcggaggagctcacgaaggaccggcactagagccacagccccaggatcccgcaagtagtgtatgcccgcagccacactatctgctgccagacactaatgtgcttcttcaccagatagtctctgcgtggcggcctggcacttgggcttcggtggcctctagtctccggttacccggaagcttagagacatacgtggaacaggaacagggagaaaatgctaacgaccggaatgatagagcaatccgcgtcgcagccaagtggtacaacgaacaccttaaaaagatgtccgccgacaaccagttgcaggttatatttatcactaatgaccggaggaataaggaaaaggcaatcgaggagggaatccctgctttcacttgtgaagaatatgttaagtcgcttaccgcaaatcctgaactaattgatcgcctggcttgccttagtgaggagggaaatgaaatcgagtctggaaagatcatcttttcagaacatcttcctctgtccaagcttcagcaaggcattaaaagcggcacctaccttcagggaacctttcgcgctagccgggaaaactatcttgaagccaccgtgtggatacacggggacaatgaagaaaacaaggagataatcctgcagggactgaaacacctgaacagagcggtgcatgaggatatcgtggctgtggagcttttaccaaagagtcagtgggttgccccaagctccgttgttctgcatgacgagggacagaacgaagaagatgttgagaaggaggaggagaccgagaggatgttgaaaacagcggtgagcgaaaaaatgctgaaaccaacaggccgagttgttggtattatcaaacggaattggaggccttactgcggaatgcttagtaagtcagacattaaagagagtagaagacacttgtttacccctgccgacaagcggatcccacgcataagaatcgagacacgccaggctagtaccctcgaaggacgcagaatcatcgtggctatcgacgggtggcccaggaacagtaggtatcccaatggacatttcgtgcgcaatctgggcgatgttggagaaaaagagaccgaaaccgaggtcctgctgcttgaacacgatgtgccccaccagccgttctcacaggccgttctgagctttctcccaaagatgccctggtctataaccgaaaaagatatgaaaaatcgagaggatcttaggcacctgtgcatttgtagcgttgacccccctggatgtactgatatcgacgacgctctacattgccgcgaactggagaatggaaacctcgaggttggcgttcatatcgctgacgtttcccactttattcgtccaggcaatgcccttgaccaggaatctgccaggcggggaaccactgtgtatctctgtgagaaacggatagacatggtaccggaactgctgagctctaatctatgctccctgaagtgtgacgtagatcgcctggctttcagctgtatttgggaaatgaaccacaacgctgagatcctgaaaactaagtttactaaatccgtgataaattccaaagcatctctcacatacgcagaggcccaactgcgcatcgattccgcgaatatgaacgacgacatcacaacatccctgagaggactgaataagttagccaagattctgaagaagagaaggatcgagaaaggtgctctgacactgtcaagccctgaggtgaggtttcacatggactccgaaactcatgatcctatcgacctgcagaccaaagagctccgggagacaaacagtatggtggaagaattcatgctgctggctaatatttccgtggctaaaaagatccatgaggagttttcagagcacgccctactgagaaagcacccagcaccgccaccttcaaattacgaaatccttgtgaaggctgcccgtagcagaaacctcgagataaagacagacaccgcaaagagtctggcagagtcccttgaccaggccgagagtccgactttcccctacctgaacacccttctgaggattctggccactagatgtatgatgcaggcagtgtacttctgtagcggaatggacaatgactttcatcactatggactggcctcgccgatttatacccacttcacctcccctattagacggtatgcagatgttatcgttcatagactgctagctgtagccattggggctgattgtacttacccagaactcacggacaagcataaactcgcagacatctgtaagaatctcaacttccggcacaaaatggcccagtacgctcagcgcgcttccgtggcattccacacgcagctatttttcaagtcgaaagggattgtgagcgaggaagcctacatattatttgttagaaaaaacgccatagtggtgttgatccctaaatacggtctagaagggacggtttttttcgaggagaaagataaacccaatccacagctgatttacgatgacgagattccatccctgaaaattgaggacaccgtattccacgtattcgacaaggtgaaagtgaaaatcatgttagattcctccaatctgcaacatcagaagataagaatgagccttgtcgagcctcaaatccccggaatatcaatacctaccgatacgtctaatatggatctgaacgggcctaagaagaagaagatgaagctgggaaaatag

SEQ ID NO: 220904 - DNA, 2916 bp, Artificial Sequence
  Description of Artificial Sequence: Synthetic coding sequence
atgcagaccgcctgtcaggcggtacagcatcagcggggaaggcgccagtacaataagcttcgtaacttgctcaaggatgcacggcacgactgtatcctgttcgcaaacgagtttcaacagtgctgctatctgcctagagagagaggcgagtctatggagaaatggcagactagaagcatttacaatgcagcagtttggtattaccaccactgtcaggatcgtatgccaattgtaatggtgacggaagatgaggaggcaatccagcaatacgggtctgaaacagagggggtattcgtgattacttttaagaattatctggataacttctggcccgatctaaaggccgcacacgagctctgtgactccatactgcagagccgccgtgaacgggagaatgaaagtcaagaatctcacgggaaggagtatcctgaacatctacctttggaggtgcttgaggccggaatcaaatccggtcggtatatacagggaattctgaacgtgaataaacacagagctcaaatcgaggcgttcgtgcggcttcaaggggcatcatccaaggacagcgatctggtcagcgacatactgatccatggaatgaaggccaggaacaggtcgatccacggcgatgttgtggttgtggagcttcttccaaaaaacgagtggaagggcagaaccgtggcgctgtgtgagaatgattgtgatgacaaggcgtccggtgaaagtccctctgagcccatgccaactggacgagtcgttggtatccttcaaaagaactggcgcgactacgtggtgacctttccctccaaggaggaggtgcagtctcagggcaaaaatgcgcagaagatcttagtaacaccctgggattataggatccctaaaatccgcatcagcacacaacaggccgagactctgcaggatttccgagtcgtggtcaggattgattcgtgggagtccacctctgtataccccaacggccacttcgtaagagtgctcgggcgaataggagaccttgaaggggaaatcgctacaatcctcgtcgaaaactctatctctgtaatacccttctcggaagcacagatgtgcgagatgccagtgaacacacctgaatctccttggaaggtctcacctgaagaggaacagaagcggaaagatctcagaaagagtcatctggtgtttagtattgatcccaaaggctgtgaggatgttgatgacaccctctccgttcgtaccctgaataatggaaatctggaactcggtgtacatattgctgatgtgacccactttgttgcacccaattcctacatcgatatagaggcgagaacacgggctacgacatattatctggctgatagacgctacgacatgttgccctcagtgctgagtgcagatttgtgctcactcctcgggggagttgaccgttacgccgtgtctataatgtgggagctagataaagcatcttacgagataaaaaaggtgtggtatggacggaccatcatccggagtgcatacaagctattttacgaggctgcccaggagttgctcgacggaaatctgtccgttgtcgatgacatccccgagttcaaggatttagatgagaagagtagacaagccaaattagaggagctggtgtgggccatcggaaagttaaccgacattgccagacatgtccgcgctaaacgggacgggtgcggagctctcgaactggagggggtggaggtgtgcgtgcagcttgatgataagaaaaacatccacgacctgattcctaagcagccactcgaggtgcacgagaccgtggctgaatgcatgatcctggctaaccattgggttgctaaaaagatctgggaatcttttccacatcaggccttattgcggcaacacccccctccccaccaagaatttttttcagagttaagagagtgtgccaaggcaaagggtttctttatagatacccggtctaataagacactggccgatagcctggataatgcaaatgacccgcatgaccccatcgttaataggttgcttcgcagtatggccacccaggctatgtcgaatgctctgtatttttccactgggtcgtgcgctgaggaggagttccaccactatggcttggcccttgataaatacactcattttaccagccctatacgacgctatagcgatatcgtggtgcatcggttgttgatggctgctattagtaaggataaaaagatggagatcaagggtaatcttttttccaacaaagatctcgaagagctatgtagacatattaataatcggaatcaggctgctcagcactcacagaagcagtccacagagttgtttcaatgcatgtatttcaaggacaaggacccagccacagaggaaaggtgcatttccgatggagtgatttatagtatcagaaccaatggagtgctcctattcattccccgattcggcatcaagggggcagcatatctgaaaaataaagacggcttggtcatttcctgcggaccagacagctgttctgagtggaagcccggtagcttacagaggtttcagaataaaattacctccactacaacagatggagagtctgtcacctttcacctcttcgaccacgtgaccgtgagaatcagcatacaggcatcccgctgtcacagcgataccatccgactggagatcatctcaaataagccatacaagatcccaaacactgagttgatccatcagtcctctccactcctcaaaagcgagctggtaaaagaggtcacaaagtcagtcgaagaggcgcagctggctcaagaggtaaaggtcaatattatccaggaagaataccaggagtaccgccagacaaagggaagaagtctctacacactgttagaagagatcagagacctggcattgttggatgtgtccaacaattacggcatctag

SEQ ID NO: 220905 - DNA, 3165 bp, Artificial Sequence
  Description of Artificial Sequence: Synthetic coding sequence
atgctgcagaagcgcgagaaagtgctgctcctgagaacatttcaaggtcgtactctgaggatcgtgagagaacactacctgcggccatgtgtgccgtgccacagccccctatgcccgcaacctgctgcgtgttctcacgacggaaagctcctgagctccgacgtgacccattacgtaattcccgactggaaggttgtgcaagactaccttgagatcctggaattccccgagctgaaaggcatcatcttcatgcaaacggcctgccaggcagtgcagcaccagcgaggcaggagacaatacaacaagctgcgtaacctgttaaaggatgctcgccacgattgcatcttatttgccaatgagtttcagcagtgctgctacttacccagagagagaggcgagagtatggaaaagtggcaaacccgttccatctacaacgcagcagtgtggtactatcatcactgccaggatcgcatgccaatcgtgatggtgactgaggacgaagaagcaattcagcagtacggttctgaaacagaaggagtgttcgtaattaccttcaaaaattatttggataacttttggcccgacctgaaagccgctcatgaactctgtgactccatcctacagtcgagaagggagcgcgagaatgagtcacaggaatcacatggcaaggaataccccgagcatcttcccctggaggtccttgaagcagggattaaaagcggccgttacattcagggaattctgaatgtgaacaagcacagggcccagattgaagcctttgttcggctccaaggagctagctcgaaggacagcgatctggtatcggacatcctgatacatgggatgaaggccagaaaccgcagcattcatggtgacgtagtggtggtcgaactcctgcccaagaatgaatggaaaggcaggactgtagccttatgcgagaatgactgcgacgataaggcctcgggagagagccccagcgagcccatgcccactgggagggtagtcggtatcctgcaaaagaattggagggattatgttgtgactttccccagtaaggaagaagtgcagtcccagggcaagaacgctcagaaaatcctggtcactccttgggactaccgtataccaaaaataagaatttccactcaacaagccgagactctgcaggatttcagagtggtcgtgaggatcgactcgtgggaaagcactagcgtttatcctaatggtcactttgtcagagtcctaggaaggatcggagatctggagggagaaatagcgaccattctagttgaaaattctatatcagttatcccatttagcgaggctcagatgtgtgaaatgccggttaataccccggagtcgccctggaaggtgtccccggaggaggagcagaaaagaaaggacctgagaaagagccacttggtattcagcattgaccccaaaggctgtgaagacgtggatgatactctgtctgtgcgtactttaaataatggtaacttggagttgggcgtacatattgcggatgtgacacacttcgtggctccaaactcttacatagacatcgaagcccgaactagggcgacaacatactaccttgctgatcgccgatatgatatgctcccctccgtgctgtccgcagatctatgttccctgttgggtggagttgatcggtacgcggtgtcaattatgtgggagttagacaaagcctcatatgaaataaaaaaggtgtggtatggtcggacgatcatcagaagtgcctacaagttgttttatgaagctgctcaagaactcctcgatggaaatctgtccgtggtcgatgacatcccggagttcaaagacctcgacgaaaaaagcaggcaggccaagctggaagagcttgtgtgggcgattggcaagcttaccgacattgccaggcacgtgcgagctaagagggatgggtgcggcgctctcgagctcgaaggcgttgaggtgtgcgtgcagctggacgataagaaaaacattcacgaccttatccctaaacagcctctggaggtgcatgagacagtggcggaatgcatgatcttagccaatcactgggtggccaaaaagatttgggaatcatttccccaccaggccctgctgcggcagcatcccccacctcaccaggaattttttagtgagttaagggagtgcgccaaggctaagggtttcttcattgacacacgcagcaacaaaaccttagctgactccttagacaatgccaacgatccccatgaccccatcgtgaatagacttctgcgcagtatggccacccaggcaatgtccaatgcgctctacttctccaccgggagctgtgccgaagaggaattccaccactatggtctggcactggataagtatacccacttcacatccccgattcgccgttactctgatatcgtggtgcatcggcttctcatggcggcaatcagtaaggataagaagatggaaattaagggcaaccttttcagtaataaagacctcgaggaactgtgccggcatattaacaatagaaaccaagccgctcagcacagtcagaaacagtctacagagctctttcaatgcatgtatttcaaagataaggacccggctaccgaagaaaggtgtatctcagacggagttatctatagtatcagaaccaacggtgtgctcctgttcatcccaagattcggcatcaagggcgctgcttatctcaaaaacaaggatggtttggtcatatcatgtgggccagactcctgcagcgagtggaagcccggatccttacagcgctttcaaaataagatcacatcgactaccaccgatggcgagagcgtgacttttcatctgttcgatcacgtaactgttcgcatttctatccaagcatcccggtgtcactcagataccattcgcctggaaataatcagcaacaaaccatataaaatcccaaatacagagctgattcaccagagcagccctctgctgaagagcgagttggttaaagaagtgacgaagtctgttgaggaagctcagttggcccaggaggtgaaagttaacattatccaagaggagtaccaggaatatagacagaccaaaggaaggtctttgtacacactgctcgaggagatacgggatcttgctcttcttgacgtgtccaacaactacgggatatag

SEQ ID NO: 220906 - DNA, 762 bp, Artificial Sequence
  Description of Artificial Sequence: Synthetic coding sequence
atggagaaatggcagactcgcagcatttacaacgcagccgtgtggtactaccatcactgtcaggataggatgcccatagtgatggtcaccgaggacgaggaggcgatccaacaatacggttctgaaacagaaggagtcttcgtgataacctttaagaattatctggacaatttctggcccgacttgaaggccgctcacgagctgtgtgactcgatcctgcagtctcgacgagagcgggaaaatgaaagtcaggaaagccacggaaaagagtatcctgaacacctacccctggaggttctcgaagcaggcattaaaagtggtagatacatccagggcattttgaacgtgaacaagcacagggcacagatcgaggcttttgtgcgactgcaaggagcctcatctaaagactcagacctggtgtccgacatactcatccacggaatgaaggcaaggaaccgaagcatccacggtgatgtggttgtggtggagctcctgcccaagaacgaatggaaggggagaaccgttgccctctgcgaaaatgattgtgatgataaggctagcggagagtcaccatccgaaccaatgccaacgggtcttcaaggcggtcgcgctcacaggtttttgggcgtgaatatctgtgtttccaagtggaccttctgcgcctgctttagaaagaacaggcggtcaggcagagggaattgcaaccatccaggaggcaagcagtatttctcctatagctttttacgctcatcagatgtgtag

SEQ ID NO: 220907 - DNA, 453 bp, Artificial Sequence
  Description of Artificial Sequence: Synthetic coding sequence
atggaaaagtggcagactcgctccatctataacgccgctgtctggtactaccatcactgtcaggatagaatgccaattgttatggtgacagaggacgaagaggcaatccagcagtacggatcagaaacagagggggtgttcgtaatcacatttaagaattacttggataatttctggcccgacctcaaggccgctcacgaattgtgcgacagtattctgcagtctagacgcgaacgggagaatgagagtcaggaatcccacggcaaagaatatcccgaacacctgccccttgaggtgcttgaggctggaattaaatccggaagatatattcagggtatcctgaatgtgaataagcatcgggcacaaatcgaggctttcgtgagactgcagggcgcttcttccaaagatagtgacctggtctctgatattctgatccacggcatgaaagcttag

SEQ ID NO: 220908 - DNA, 174 bp, Artificial Sequence
  Description of Artificial Sequence: Synthetic coding sequence
atgcagacagcttgtcaggctgttcagcatcaaagaggcaggaggcagtataacaagctacgcaatttgcttaaggacgctagacatgactgtatcctgttcgcgaacgaattccagcagtgttgttacctgcctcgagagagaggggaaagcatggaaaaatggcagacatag

SEQ ID NO: 220909 - DNA, 294 bp, Artificial Sequence
  Description of Artificial Sequence: Synthetic coding sequence
atgcagacagcttgtcaggcagtccagcaccaacgcggtaggagacagtataacaagctgcgcaatttgctcaaagacgctcgccacgactgtatcctttttgccaacgaatttcaacaatgttgctatttaccccgagagcggggagaaagcatggaaaaatggcaaaccagaagcatatacaatgccgctgtctggtactaccatcactgccaggatagaatgcctatcgtgatggtgacagaagatgaagaggcaattcaacaatatggctccgagaccgaaggggtgtag

SEQ ID NO: 220910 - DNA, 312 bp, Artificial Sequence
  Description of Artificial Sequence: Synthetic coding sequence
atgcagacagcctgccaggccgtgcagcatcagcgcggacgacgtcagtataacaagttacggaatcttcttaaagatgccagacacgactgtatactgttcgctaatgagttccaacaatgctgctacctcccaagagagcgaggggagtccatggaaaagtggcagacccggagcatctacaacgcggcagtatggtactatcatcactgtcaggataggatgccgattgtgatggttaccgaggatgaggaagcaatccagcagtatggcagtgagaccgaaggggtctttgtgattaccttcaagtag

SEQ ID NO: 220911 - DNA, 1812 bp, Artificial Sequence
  Description of Artificial Sequence: Synthetic coding sequence
atgagccatcctgactatcggatgaacctgagacctttgggaactcctaggggcgtgtccgccgttgcgggtccccacgatatcggagcctccccaggagataagaaaagcaaaaacagaagcacgcgaggaaaaaaaaagtccatcttcgaaacctatatgagcaaggaggacgtgtctgagggtctgaagcgcggaacgttaattcaaggcgtgctgcgaataaacccaaagaaattccacgaggcttttatccctagccccgatggcgacagggatattttcatcgatggcgtggtcgcaagaaatcgagctctgaacggtgatcttgtggtcgtcaagttgctcccagaggagcattggaaagtcgttaaacccgagagcaatgacaaggaaacggaggccgcttatgagagtgacatccccgaggagctttgtgggcaccacctaccgcaacaaagcctgaaatcttacaatgacagtccagatgtgatagtagaagcacaattcgatggctctgacagcgaagacggacacgggatcacacagaacgtgcttgtggatggcgtgaagaagttatccgtctgtgtgagcgaaaaagggagagaagatggggatgcaccggttactaaggatgagacaacatgtatctctcaagataccagggcgttgagcgaaaagtccctgcagcgcagcgctaaggtggtttacatattagagaaaaagcactctagggccgcaaccggatttctgaaactcttagctgataagaattcggaactgttccgaaaatatgctctgttctcgccgtccgatcaccgcgttcccagaatctatgtacccctaaaggattgtcctcaggacttcgtcgcccgtcccaaggattatgcaaacactttatttatctgtaggatcgtcgattggaaagaggattgtaactttgctctggggcagctggcaaagtctttgggccaggctggggagattgaaccagaaaccgaaggtatcctgaccgagtatggggtcgattttagcgatttctcttctgaggtgctggaatgcctgccccaaggcctgccatggactatcccgcctgaggaattttcaaaacggcgagacctgaggaaggattgtatcttcacaattgatccttcaactgccagagatctggacgacgctttgtcatgtaagccactagctgatggcaactttaaagtcggggtacatatcgccgacgtgtcttactttgtacctgaggggtctgatctggacaaggtcgcagccgaacgggcaacgagtgtctacctggtgcagaaggtggtgccaatgctccctaggctgctgtgcgaggaactgtgcagcctgaatcctatgtctgataagttaactttctccgtgatctggacgctgaccccagaaggtaagatcttagacgaatggttcggccgaaccatcattagaagttgtacaaaactgtcctacgagcatgcccagtctatgatcgaatctcccacagaaaaaatccccgctaaggagctccctccaatctcaccagagcattcctccgaagaggtacaccaacagaatgcagataaagacggcgcagctcacctgcaggcatctcacagcccatctgctgaggacgcggaagcccagccatctactgaggaacggttaccggaaacacgcggaatctgcgacagggaccctgatactaggctgttttttttacagcagcaatctcgagttctggaggctaaaccccaaaacacgatcagagtcgaagaacagacaacccagctccagatctag

SEQ ID NO: 220912 - DNA, 2658 bp, Artificial Sequence
  Description of Artificial Sequence: Synthetic coding sequence
atgtctcacccagattacagaatgaacctgcggcctctgggaacacctcgaggcgtatccgcagtcgccggaccacacgatatcggggctagtccaggggacaagaaatcaaaaaaccgctccactcgcggaaaaaaaaagtctatctttgaaacctacatgtcaaaggaagacgtcagtgagggcctaaaaaggggcaccctcatccagggggttctgcggattaacccgaagaagttccatgaggcctttatcccgtctccagatggcgaccgagacatcttcatcgacggtgtggtggcgagaaacagggctttgaacggagacctggtggtagtcaaattgctaccagaagagcattggaaggtggtcaaacccgagtccaatgataaggagactgaggccgcttatgaatccgacattcctgaagagctttgcggacaccacctaccacagcagtcgctcaaatcgtataatgactctcctgacgtgatcgtggaagcgcaatttgatggctccgactccgaggacggacacggaattacccagaatgtgctggtcgacggcgttaaaaaattgagtgtctgtgtgagcgaaaagggtcgtgaggacggagacgccccagtcacaaaagacgagaccacctgtatatctcaggacacccgggctttgtctgaaaagtccctgcagcgaagtgccaaggtggtgtatatactggagaaaaaacattccagagctgcaacaggtttcctcaagctgttagcagataagaattccgagctgttccgcaaatatgcgctcttttctccttccgatcatcgagtgcctcggatttatgtcccccttaaagactgtcctcaagattttgtcgctcgcccaaaagattacgccaataccctgttcatctgtcggatagtggactggaaggaggattgcaacttcgccctggggcagctggctaaatctttgggtcaggccggtgagatcgagcctgaaacagagggcattctgactgagtacggcgtggatttttccgatttttcgtctgaagtgttagaatgccttccccaggggctgccctggaccataccgccagaggaattctcgaaaaggcgggaccttcgcaaagattgtatatttaccatagatccttccacagccagggatctggatgacgctctttcatgtaagcccctggcagacggaaattttaaggtgggcgtgcacatcgccgacgtgtcctattttgtacccgaaggatctgacctggacaaagttgccgctgagcgggctacatctgtgtatttggtgcaaaaggtggtgcctatgctcccacggctcctttgcgaggaactctgctctcttaatcccatgtccgacaagttgaccttcagcgtgatctggacactaacacccgagggcaagatcctggacgaatggttcgggagaactatcattcggagctgcactaagctgagctacgaacacgcccagtccatgattgaaagcccgacagaaaagatccccgcaaaagaactaccaccgatttccccagaacattcatccgaggaggtgcaccaggcagttctgaacttacacggcatcgccaaacagcttcgccagcaaaggttcgtcgacggggctctgcgcctggaccagctgaagctggctttcacactggatcatgagaccggccttccccaaggttgtcacatctacgagtatcgcgagagcaacaagcttgttgaagagttcatgcttctggctaatatggcggtggcacataaaattcacagggctttcccggaacaggcattgcttaggagacaccccccaccacagactagaatgctctcagacctggtggagttctgcgaccagatgggactgcctgttgacttttccagcgccggagccctgaacaaaagtctcacacagaccttcggtgacgacaaatactccctggccagaaaggaggtattgacaaacatgtgtagtaggccaatgcagatggctctatatttttgcagcggcctgctccaggatccggcacaatttcggcactacgccctgaatgtgcccttatacacccattttaccagcccaattcgcagatttgccgacgtccttgtccaccgattactggctgcagccctggggtacagagaacgcctcgatatggcccctgacaccctgcagaaacaagctgatcattgtaacgataggcgcatggcctcaaagcgtgtgcaggagctgtccacctcgctgttctttgccgtcctcgttaaagagtctggccctttggagtcagaggccatggtgatgggaattcttaaacaagctttcgacgtccttgtactccgatatggcgtgcagaaaaggatctattgcaatgctcttgcactacggtcacaccatttccagaaagtcggcaagaagccagagctcacactggtttgggagcctgaggatatggagcaagaaccagctcaacaggtcatcacaattttcagcctggttgaagtggtgctccaggccgagtctactgcacttaaatactctgctatcctcaagcggccaggcacccaaggccatctgggccctgaaaaagaagaggaagagtctgacggcgaacccgaagatagttcaaccagctag

SEQ ID NO: 220913 - DNA, 1071 bp, Artificial Sequence
  Description of Artificial Sequence: Synthetic coding sequence
atgagtcacccggattaccggatgaacttgaggcccctgggaacccctcgaggcgtgagcgccgttgctgggcctcacgacatcggtgcatcccccggagacaagaagtcaaagaatcgcagcactaggggcaagaagaagtcgatctttgagacctatatgtccaaagaagacgtgtccgaggggttaaaaaggggcacgctgattcaaggcgttctgcggatcaacccaaagaaattccatgaagccttcattccaagtcctgatggcgacagagatattttcatagatggcgttgtagctcggaacagggcgttgaacggggacttggttgtagtcaaactgctaccggaagagcattggaaggtggtcaagcctgaaagcaacgataaagaaactgaagctgcttatgaaagcgacataccagaagaattatgcgggcaccatctgccccagcagtccctgaagagctataacgatagccctgacgtgatagtcgaagctcagttcgacgggtctgatagcgaagatggccatgggatcacccagaacgttctagtggacggcgtgaaaaagctatccgtgtgcgtcagtgaaaaagataacgagattgaggcccagcgatctagttgggcctatcccgtgagtcaccggaaatctgaagagcgcatggtgatgcacagactgcaaaaaatgcggccacctgcgtttcacaagactcaggaactttatcgcaggaatccgtgtaaagatcagcagcgatggtttacctcatggcggaaaaatatacttgaacaacaaccggcttcatcaaattcctggctcattcggactgcaaattgtttgggaaatactccctgcttcctgccccagacaacagagtgtctggagttcatgtgcttgtccagaactgttcccaggacactgtggcacgggctgaagattatgccaactcactgctcatccgccgcactgtggaccggacggcgtacagccatcttaccctgggggtcgtggctgagggtcttgggaagactggtgaaactgtccttgaagcagaaggaatattag

SEQ ID NO: 220914 - DNA, 2658 bp, Artificial Sequence
  Description of Artificial Sequence: Synthetic coding sequence
atgagccatccagattatcgcatgaacctcaggcccctgggaaccccccgtggcgtaagtgcagtggccggaccccatgacataggcgctagtcccggagataaaaaatccaagaaccggagtacaagaggtaaaaagaagagtatcttcgaaacctacatgtctaaagaagacgttagtgaggggcttaagcgcggtacattgatccagggcgtgctgcggatcaaccctaagaagtttcatgaagccttcatccccagcccggatggagaccgggatatcttcatcgacggggtcgtggcgaggaatcgcgctctgaacggagacctcgtggtggtgaagctcctacctgaggagcattggaaggtagttaaacccgaatctaacgataaagaaacagaagcagcctacgagtctgatatacctgaggagctatgcggccatcacctgccccagcagagcctgaaaagttacaacgactcccccgacgtgattgttgaggcacagtttgacgggtctgactccgaagatggccatgggatcacgcagaacgtgcttgtggatggcgtcaaaaagctgtctgtctgcgtgtccgagaagggcagggaggacggagatgccccagtcacaaaggatgagacgacatgcatatctcaggatacccgtgcccttagtgaaaagtcgctgcagaggtccgccaaggtggtgtacatactagaaaagaaacactctagggccgcaactgggttcctgaagctgctggctgataaaaattccgagctgtttcggaagtacgcactgttctccccctccgatcacagggtgccccgaatttacgttcccctcaaggactgtcctcaagatttcgtggcaaggccaaaggattacgctaacacattgttcatttgtcgtatcgtggattggaaagaggactgtaactttgccctaggccagcttgccaaatcccttggtcaggcaggcgaaattgagcccgaaacagagggcattctcactgaatacggggtagacttctctgacttttcaagcgaggtgctagaatgtctcccccaggggttgccttggactatcccacccgaggagttctctaagaggagagatctgagaaaagactgcatctttaccatcgacccaagtactgctagggacctggatgacgctctgagctgcaaacctctggctgacggcaactttaaagtgggcgtgcatattgctgacgtgagttactttgtccctgagggaagtgacctcgacaaagttgcagctgaaagggcaacttcagtgtacctcgtgcagaaagtggtaccgatgctccctcggctgctctgcgaggagctctgttcacttaaccccatgtcagataagcttacgtttagtgttatctggaccttgaccccagaaggcaagatcttggatgaatggttcggcagaaccatcatccggagttgtactaagctgtcatacgagcatgctcagagcatgattgaaagccccaccgagaaaatccctgccaaggagctgcccccaatatcaccagaacatagctctgaggaggtgcaccaggccgtacttaaccttcacggcatcgcgaaacagctaagacaacagcggttcgtggatggagccctgcgattagatcaactgaaactcgcctttacactggaccacgaaacaggtctcccccaagggtgccacatatatgaatacagagaatccaacaagcttgtcgaagagttcatgctgctggccaatatggcggtcgcacataaaattcatcgcgcatttccggagcaggctctgttgcggaggcaccctccccctcagacccgcatgctgtctgacctcgtggaattctgcgaccagatgggcctgcccgttgacttttcctctgctggcgctctgaataagagcttgacgcagacattcggtgatgataagtattccctggcaaggaaagaggtgcttacgaatatgtgttcaagacctatgcagatggcgctctatttctgtagcggattgctgcaggatccagctcagttcagacattacgctttgaacgtacccttgtacacacatttcacctcgcctattaggcggttcgccgacgtattagtgcatcggctactggctgccgcactcggatatcgagagcgcttggacatggctcccgataccctccagaagcaggccgaccactgcaatgataggaggatggcaagcaaacgggtccaggaactgtccacaagcctgttttttgctgttctagtaaaggagtctgggcctttagaatccgaagctatggtgatgggcatactgaaacaggccttcgacgtgcttgtgctaagatatggggtgcagaagagaatctattgtaatgctctggctctaaggagccatcactttcagaaagtcgggaaaaagccagaactgactttagtctgggagcctgaggatatggagcaggagcctgctcaacaggtcattacaattttctcccttgtggaggtcgtgcttcaggcggaaagcaccgcgcttaagtacagtgccatcctgaagcggcctggaactcagggccacctgggaccagagaaggaggaggaggaatctgacggcgaacctgaagatagctccacatcatag

SEQ ID NO: 220915 - DNA, 750 bp, Artificial Sequence
  Description of Artificial Sequence: Synthetic coding sequence
atgtcacacccagactataggatgaatttacggccactggggaccccgcgaggcgtgagtgctgtggccggtccacatgacattggcgctagcccaggagacaagaagtcaaaaaacaggagtacacgcggtaaaaaaaaaagcatctttgagacatatatgtctaaggaggatgtgagtgaggggttgaagcggggaacgcttatccagggagtgctcaggatcaatccaaaaaaatttcatgaggcctttatcccatctcccgacggagatcgggacatcttcatcgatggtgtcgtagccaggaatcgggctttgaacggcgacctcgtggtggtcaaattactccccgaagaacactggaaagtggtgaagccagagagcaacgataaagagactgaggctgcctatgaatcggatatccccgaagaactttgcgggcatcacctgcctcagcagtccctcaaatcctacaatgacagcccggacgtgattgtagaagctcagttcgatggcagcgattcggaggacggccacggcataactcaaaacgtcctggtcgatggggtgaaaaagctgtcagtgtgcgtgagcgaaaagggtagagaggatggtgatgctcccgtgactaaggatgagaccacctgcatttcacaagatacacgggcactctccgagaagtctttgcaacggtctgccaaagtaatcgcataccgctttagtcctcgagtacagatggcctttacttag

SEQ ID NO: 220916 - DNA, 2028 bp, Artificial Sequence
  Description of Artificial Sequence: Synthetic coding sequence
atgtcccatccagattataggatgaacctaagacctctgggtactcctagaggtgtctccgccgtggctgggccacatgacataggtgcaagccccggagataaaaagtctaaaaaccgtagcactcggggaaaaaagaagagcatcttcgagacatacatgtctaaggaggatgtcagcgaaggcctgaaacggggtactctgatacagggagtcttgcgtataaatcctaaaaaattccatgaggccttcataccctctcccgacggggatagagacatctttatcgatggggtggtggcccgtaaccgggcattgaacggcgatctagtggtggtaaaactcttacccgaagagcactggaaagtcgttaagccagagagtaacgacaaagagaccgaagccgcatacgaatcggacatcccagaggaactttgcggacatcatcttccccaacaatccttgaaatcatacaacgattccccggatgtaatcgttgaggcgcaatttgacggctccgatagtgaggacgggcacggtatcacacagaatgtgcttgtcgatggagtaaagaagctgtccgtctgcgtatcagaaaaggggcgtgaggacggcgacgccccagtaaccaaagatgaaacaacttgtatatcacaggacacccgcgcactgagtgagaaaagtctgcagcggtctgctaaggtggtgtatatcctcgagaagaaacattcccgcgcagcgacaggctttttgaagctgctggccgataagaatagcgagcttttccggaaatatgctttgttttctccatccgaccatcgtgtgccaaggatatacgttccactgaaagattgtccgcaggactttgtcgcgaggcccaaggactacgccaacaccctgtttatttgcagaattgttgactggaaagaggactgtaattttgccctgggccaattagccaagagtttggggcaggccggagagattgagccagagacagagggaatcctgacagaatatggcgtcgactttagtgacttctcttctgaagtgctagagtgtctacctcagggcctgccctggaccattcctccagaggaattcagcaaacgccgtgatctcaggaaggactgtatattcactatcgatcctagtaccgccagggatctggatgacgccctttcctgcaagccattggctgacggaaactttaaggtcggggtgcatattgctgacgtgagctacttcgttcccgaggggtctgatctggataaggtcgctgctgagagagccacatccgtctatctagtccagaaagtggttcctatgctgccacggctgctttgcgaggagctctgcagcctcaaccctatgagcgataaattgacgttctccgttatttggacgctcacaccagagggtaaaattctcgacgaatggttcggcaggacaataatcagaagctgcactaagttgtcctacgaacatgcccagtccatgatcgaatccccgaccgagaagatccctgccaaagagctgccgcctatcagcccagaacatagtagtgaggaggtccaccaggccgtgctgaatctccatggtatcgcaaaacagctgcgacagcagagatttgtagacggggcattgcggctcgaccaactaaagctagcctttaccctggaccatgagacaggactacctcaggggtgtcacatctacgagtacagggagtctaacaagctagtcgaagaattcatgttattagcgaatatggccgttgcacacaaaatacatcgcgcattcccagaacaagccttgctccgcaggcaccccccacctcaaactcgaatgttaagtgacttagtcgagttttgcgaccaaatggggctgcccgtcgacttttcctccgcaggtgcgttgaataaatcacttacccagaccttcggcgatgacaagtactctctagctcgcaaggaagtgcttaccaacatgtgttctcgcttaccagtcccaccgcattggctttag

SEQ ID NO: 220917 - DNA, 435 bp, Artificial Sequence
  Description of Artificial Sequence: Synthetic coding sequence
atgagccatcctgattacaggatgaacctgcggccactgggtactccccgtggagtgtcggctgtggcaggaccgcacgacataggcgcttctcccggagacaagaagtctaaaaatcggagcaccaggggcaagaagaagtcaatctttgaaacttatatgtctaaggaagacgtaagcgagggattgaaacgcggtaccttaatccagggcgttttacgaattaacccaaagaaattccatgaagcatttatacctagccccgacggtgatcgcgatatattcatcgatggggtcgtcgcacgcaatcgcgcactgaacggcgatctcgttgtagtgaagctgctgcccgaggagcactggaaagtggtcaaacctgaatccaacgataaggagaccgaggccgcttacgagtctgacattccggaagagtag

SEQ ID NO: 220918 - DNA, 1860 bp, Artificial Sequence
  Description of Artificial Sequence: Synthetic coding sequence
atgtcacacccggactaccgaatgaatctacgtccattaggtaccccccgaggcgtgtcagcagtcgccggaccccacgatataggcgcttctcccggagacaaaaaaagtaagaaccgctccacaagaggcaagaaaaaatctattttcgagacatacatgagcaaggaggacgtgtcggaaggcctgaagaggggcaccctgattcagggagttcttcggattaatccaaagaagttccacgaggcgttcattccgagccctgatggcgaccgggatatttttatcgacggagtggttgccaggaacagggccctgaatggggatcttgtggttgtgaaactgcttcctgaggagcattggaaggtggttaagcccgagtctaatgacaaggaaactgaagcagcatatgaatctgatattccagaagaactgtgcggccatcacctaccacagcagtctcttaagagctataacgactctcccgacgtcatcgttgaagcccaatttgacggaagtgactcggaagatggtcacggcatcactcaaaacgttctagtggacggggttaaaaagctgtctgtctgcgtgtccgagaaaggaagagaagacggagacgctccggtcacaaaggatgagactacgtgtatcagtcaagatacgcgggctctttccgagaagtcgttacaacggtccgccaaggtggtctacatcttagagaagaagcatagccgggctgcaactggcttcctcaagctcctggctgacaagaattctgagctgtttcgcaagtacgccctcttctctccatccgatcatcgcgtccccaggatctacgtgcctttgaaagactgcccccaggatttcgtcgctcgcccaaaggactacgctaataccctgttcatttgtcgtatcgtcgattggaaggaggactgtaacttcgccctggggcaactggctaagagcttaggacaggctggcgagattgagcccgaaacagagggcatcctgacggaatacggggtagatttttctgattttagctctgaggttttagagtgtctgccccagggtctgccttggacaatccctcctgaggaattttcaaagaggcgggacctgagaaaagattgtatttttaccattgacccttccactgcacgggatctggatgatgctctttcatgcaagccgctggccgacggcaatttcaaagtcggcgtgcacattgccgacgtctcttactttgtgccagaggggtcagatctcgacaaagtagccgcagaacgggcaacgagtgtttatttggtccagaaagtggtacccatgctgccgaggttgctgtgcgaagagctttgctcactgaatccgatgtccgacaagttaactttctctgtgatttggactctgacacccgaaggtaaaatcctcgacgaatggttcggccgaacaattatacgctcttgcacgaagctctcctatgagcacgcacagagtatgattgaaagccctacggagaagatccccgctaaggaattacctcccatctccccagaacatagctccgaggaggtgcatcaggccgtgctgaacctccatggaattgcaaaacagttaagacagcagagattcgtggatggggctctaaggctggaccagctgaaactcgcattcaccctcgaccacgagaccgggttgccccagggctgccacatatatgaatacagagagagcaataagccttgctgtgctggcaccccaaggcccaaacaaggctgctcagtgacctggtggaactcggccacccgctggggctgtccctggacgtcagcgcctcaggagccatcaatgaaggcttag

SEQ ID NO: 220919 - DNA, 615 bp, Artificial Sequence
  Description of Artificial Sequence: Synthetic coding sequence
atgagcaccgagacggagttacaggtagctgtaaagaccagtgcaaaaaaggattctcggaagaaggggcaggaccggagcgaggcaacattgataaagcgatttaaaggcgagggtgttagatataaggccaaactgataggcattgatgaggtttccgccgcacggggagataagctatgccaggattccatgatgaagctcaagggcgtcgtggcgggtgcaaggtcgaaaggagagcacaaacagaaaatcttcctcactatctctttcggcggaattaagattttcgacgaaaaaaccggcgcactgcagcaccatcacgctgtgcacgaaatcagttatattgcaaaggatatcaccgaccaccgggcattcggatacgtatgcggcaaagaagggaaccacagatttgtggctattaaaactgcccaagccgcagagccagtaatcctggacctgcgggacttgtttcaactcatttatgaattgaagcagcgcgaggaactcgaaaagaaggctcaaaaggataagcaatgtgagcaggctgtctaccaggttccaacctctcagaagaaggagggagtttatgacgtcccgaagtcccagccctag

SEQ ID NO: 220920 - DNA, 642 bp, Artificial Sequence
  Description of Artificial Sequence: Synthetic coding sequence
atgtccactgagactgagctgcaggttgccgttaagacctcggccaaaaaagactctcgaaagaaaggacaggatcggtcagaagccactctgatcaagcggtttaaaggggaaggagttaggtacaaagccaagctcatcggcatcgacgaagtgtctgccgctagaggggataaactctgccaggatagcatgatgaagctaaaaggcgtagtggctggggcaagatctaagggcgaacataagcaaaaaatctttctgaccatctccttcggtggtatcaagatattcgacgagaagacaggagcccttcagcaccatcatgccgttcatgagattagctatatagccaaggacattacagaccacagggcttttggctacgtctgtggcaaggaggggaatcacagattcgttgccataaagactgcacaagccgcagaacctgtcattttagatctgagggacttatttcaacttatttacgagctaaaacagagagaggagctggagaaaaaggctcagaaggacaagcaatgcgagcaggccgtataccagaccatcctagaggaggatgttgaggaccccgtttatcaagtcattagtgagactagtcgaggattccggttcaagagtgactag

SEQ ID NO: 220921 - DNA, 1767 bp, Artificial Sequence
  Description of Artificial Sequence: Synthetic coding sequence
atgtctaccgaaacagaactgcaggtagcagttaaaacatcggcaaagaaggattcaagaaagaagggacaggaccgctcagaggcaaccctgatcaaaaggtttaagggcgaaggcgtgaggtataaagctaaattgatcggtatcgacgaagtcagcgccgctcgcggagacaaattatgccaggacagcatgatgaagttgaagggggtggttgcaggtgcccgttcaaaaggcgagcacaagcagaagatctttctgaccatatccttcggcggtattaaaatttttgacgagaaaaccggtgcacttcagcaccaccatgccgtccatgagattagctacatcgccaaggatatcacagaccacagggcctttgggtatgtgtgcggcaaggagggcaaccacaggtttgtagctattaagaccgctcaggctgctgagccagtgatcctggacctgcgggatctgttccagttgatttatgaattgaagcagcgggaggagctcgaaaaaaaagcacagaaggacaagcagtgtgaacaggccgtgtatcagacaatcctggaagaggacgtggaggaccccgtttaccagtacattgtttttgaggcgggacatgagcccatccgagatcccgagacagaagaaaacatctaccaagtgccaacgagccaaaagaaagaaggggtgtatgacgttccaaagtcgcagcctgtgtccaatggctactctttcgaagacttcgaagagcgattcgcagcggcaacaccaaaccggaacctgccaacggactttgatgaaatttttgaagccactaaagctgtcacccagctggagctttttggcgacatgagcaccccccctgacattacttcccccccaacaccggctacgcccggtgatgcttttattccatcttcgagccagacactgccagcatccgccgacgtgttcagctcagtgccgttcggtaccgcagccgttccatctggatatgtggcaatgggggctgtactaccttcgttttggggccagcaaccactggtccagcaacaaatggtcatgggagcccaaccacctgttgcacaggtgatgcctggggctcagcccatcgcttggggccagccaggtctatttccagccactcagcagccttggccaaccgttgccggacagtttccacccgctgctttcatgccaacacaaaccgttatgccactcccagctgctatgttccagggccctttaacacccttggccactgtgccaggcactagcgatagcacccgctcctcacctcagacagataagcctcgtcagaagatggggaaggagacctttaaagacttccagatggcacagccacctccagttccatcccgtaaacccgaccaaccgagtctaacatgtacctctgaggcttttagcagctactttaataaggtaggagtcgcacaggatacagacgactgtgatgacttcgatattagccagcttaatctgactcctgtgacctcaacaacaccttccactaactcacccccaactccagcaccacgacagtcgagtccatccaaaagtagcgcctcccatgctagcgatccgactacagacgacatttttgaggagggcttcgagtccccgagcaaaagcgaagaacaggaggccccagatggatctcaggccagttcaaatagtgaccctttcggagaaccctccggcgaaccttcaggcgacaacatctccccacaggccggatcgtag

SEQ ID NO: 220922 - DNA, 720 bp, Artificial Sequence
  Description of Artificial Sequence: Synthetic coding sequence
atgtctaccgagactgagctacaggtagcagtaaaaacctctgctaaaaaggactcgcggaagaaagggcaagatcggtctgaggccacactcattaaacgattcaagggcgaaggggtacgttacaaagcgaaacttattggcatcgatgaggtcagcgccgctcggggagacaaattgtgccaagactccatgatgaagctgaaaggggtggtcgcaggggcacggagcaagggtgagcacaaacagaaaatctttctaaccatatcattcggcggtatcaagattttcgacgaaaaaaccggagtgcctacctctcagaaaaaggaaggcgtgtatgacgtgccaaaatctcagccagtcagcaatggctactcgtttgaggattttgaagaaaggtttgctgcagcaaccccaaatagaaacctcccaacagacttcgacgagatctttgaggctaccaaggcagtaacacagttagaattgttcggtgacatgagcactccacctgatattacaagtccgcctactcccgcaacgcccggtgatgctttcatacccagctcctcacagaccttgcctgcttcggcagatgttttctcaagtgtcccgttcggtaccgccgcagtgccatcggggtatgtagccatgggagccgtgctaccatcattttggggccagcagccgctggtgcagcagcagatggtcatgggagcctag

SEQ ID NO: 220923 - DNA, 1668 bp, Artificial Sequence
  Description of Artificial Sequence: Synthetic coding sequence
atgtcaaccgagaccgaactgcaggtggcagtcaaaacttctgcaaagaaggattcccgaaaaaaagggcaagacaggtctgaagccactctcattaagagattcaaaggcgaaggagtgaggtataaggcaaaactcattggaatagacgaggtgagtgcagctagaggggataagctgtgtcaagatagcatgatgaaactaaaaggggtcgttgcaggggctcgctctaagggtgagcacaaacagaaaatcttcctgacgatcagcttcggcggaataaagatcttcgacgaaaagacgggagccctccagcaccaccatgccgtgcatgaaataagttacattgccaaagatataactgatcatcgagcatttggctacgtgtgcggcaaggaggggaatcatcgttttgtggcaatcaagaccgctcaggccgctgagcccgtgattcttgatctgcgcgatctgttccagctcatctatgaacttaagcagcgggaagaactggagaaaaaggctcagaaagataagcagtgtgagcaggctgtgtaccagacgattctggaggaggacgtggaggaccccgtttatcagtacatagtatttgaagcgggtcatgaacccatccgggaccccgagaccgaagagaacatatatcaggtgcccaccagtcagaagaaagagggcgtctacgatgtccctaaatctcaacctgtttcagctgtgacccagctcgagttgttcggggacatgagcacacctcctgacataactagcccccctacacccgctacgcctggtgacgctttcatcccctctagttctcagacactgcccgcatcagcggacgtcttctcgtcggtcccattcggcactgcagcagtcccaagcgggtatgtcgcaatgggcgctgtcctaccttctttctggggtcaacagccactggtgcaacagcagatggtcatgggagcccagcctccggtcgctcaggttatgcccggagcccaaccgattgcctggggacagcccggtctgttcccagcaacacagcagccgtggccaaccgtagctggccagttcccccctgccgcattcatgcctacccaaactgtgatgcccctccctgctgcaatgtttcagggccctttaacgccgttggctactgtgccagggacaagcgatagtactcgtagtagtccccagaccgataagcctcggcaaaagatgggcaaagaaaccttcaaggattttcagatggctcagccaccccctgtcccgagtagaaagccagatcagccaagtctgacgtgtacatccgaagcttttagttcttattttaacaaagtcggcgtggctcaggatactgacgactgtgatgacttcgacatatcccagctgaacctgacacccgtgacgtctacgaccccttccaccaacagtccacccactcctgcccctcgtcagtccagcccttccaaaagctctgcatcacatgcttcagacccgaccactgatgacatcttcgaagaagggttcgaatctccaagtaagagcgaggagcaagaggcaccagatggcagtcaggcgtcatctaattcagaccccttcggcgagccttctggggagccctcaggcgacaatatttccccacaagctggatcctag

SEQ ID NO: 220924 - DNA, 1668 bp, Artificial Sequence
  Description of Artificial Sequence: Synthetic coding sequence
atgagcaccgagacagagttgcaagtggcagtgaagacctccgccaagaaagactcaagaaagaagggtcaggatagaagtgaggccacactcatcaaacgtttcaagggagagggggtccgatacaaggccaaacttatcggcattgacgaagtgagtgcagctcggggtgataaactgtgccaagacagtatgatgaagttgaaaggggtggtcgccggtgctcggtccaaaggagaacataaacaaaaaattttcctgacaatctcattcgggggtataaaaatcttcgacgagaaaactggtgcacttcaacatcatcatgcagtgcatgagatatcgtacatcgccaaggacatcaccgaccatagagcgttcggatacgtgtgtggaaaagagggaaaccataggtttgttgctatcaagactgcccaagcagcggagcccgtgatactcgatctgagagatcttttccagttgatctatgaattaaagcagcgggaggagctagagaagaaggcacagaaggacaaacagtgcgagcaggctgtttatcagactattctagaggaggacgtggaggatccggtataccagtacatagttttcgaagcgggacatgagcctattcgcgatcccgagacggaggagaacatctaccaggtgcctacctcacagaaaaaggaaggagtgtatgatgtgcctaagagccagcccgtgagcgccgtgacacagctcgagttgtttggcgacatgtcaacacctcccgatatcacaagcccaccgacacccgctaccccaggggacgcttttattccctctagctcacaaacactcccagcatccgcagacgtcttctcttccgtaccattcgggaccgccgctgtcccttccggctacgtagccatgggcgcagtactgccttcgttttggggacaacagcccctagtccagcagcagatggtgatgggtgcccaacctcccgtcgcacaggtcatgccaggggctcagcctatcgcctgggggcagcctgggctgtttcctgctacacagcaaccttggcctacagtcgcagggcagtttcctcctgcagccttcatgccaacccagaccgttatgcctctgccagccgcaatgttccagggtcccctgacacccctagctactgtgccaggaaccagcgactccacccgttcatcccctcagaccgacaagcccagacagaaaatggggaaggagacattcaaggactttcaaatggctcagcctccccctgtgccctctcgtaagcccgatcaaccttctttgacatgtacctccgaggcgttctccagctactttaacaaagttggtgtggcacaggataccgacgactgcgatgatttcgatatttcgcagctcaacttaacaccagtgacgagtacaacacctagcacaaacagccctccaactcctgctccgaggcagagttccccttcaaaatcctccgctagtcatgcttctgaccccactaccgacgacatctttgaggaaggcttcgaaagtccttcaaagtcagaggagcaggaagcccctgacggcagccaggcatcaagtaattcagatccatttggtgaacctagtggggagccttctggcgataacatctccccccaagcaggatcttag

SEQ ID NO: 220925 - DNA, 1668 bp, Artificial Sequence
  Description of Artificial Sequence: Synthetic coding sequence
atgtcaaccgaaacagaactacaggttgccgtcaagacatctgccaagaaggactctcgcaaaaagggacaggataggtcagaagctacattaatcaaaaggttcaagggcgagggcgtaaggtacaaggcgaaactcattggtatcgatgaggtatctgctgcgcgtggagacaaactgtgccaggattcaatgatgaagttgaagggggtggttgccggtgctaggtctaagggtgaacacaaacaaaaaatctttctgaccatctcatttggcggtatcaagatctttgatgagaagacaggcgcactccagcatcaccatgcggtgcacgaaattagttatatcgccaaggacattacagaccaccgcgctttcggatatgtgtgcgggaaggaaggcaatcaccgatttgtcgcaattaagactgcccaggcagcagagcctgtgattctggacctgagggatctattccagctgatttatgaacttaagcagagggaggaattggaaaagaaagcacaaaaggataagcagtgcgagcaggctgtataccagactatcttggaagaggacgtcgaggatcccgtataccagtacatcgtttttgaggccggtcacgaacctatccgagacccggaaaccgaggagaacatttatcaggtccccacaagtcagaagaaggagggagtgtacgatgtgcctaagtctcaaccagtctccgcagtcacccagctggagttgtttggggacatgtcgactcccccagacattacctcaccacccacacccgcaactcctggcgacgccttcatccccagtagctcgcagacactgcccgcttctgctgacgtctttagttccgtcccctttggcacggcagccgttccgtctgggtatgttgccatgggggcagtgctcccttcattttggggccagcagcctttagttcagcagcaaatggtaatgggtgcccagccacccgtcgcacaggtcatgcccggtgcgcagcccatcgcatggggccagcccggtctcttccccgctacacagcagccctggcccactgtggctggacagttccctcctgcagcctttatgcccacacaaactgttatgccactgccggcagccatgttccaggggcctcttacccccctggcaaccgtgcccggtaccagtgattccacacgatccagcccgcaaacggacaagccacgccagaaaatgggcaaagaaacgtttaaggacttccagatggcgcaaccccctccagttcccagtagaaagcccgaccagccctctctaacgtgcacttcagaggccttctcttcttacttcaataaggttggggtcgcgcaggacaccgacgattgcgatgactttgacatctctcagctgaacctgacgccagtaacttctactacaccgtccactaattctcctcctactccagccccacggcagagctctccatccaagtctagtgcctcacatgccagtgacccaacgacagatgatatatttgaggaagggttcgaatctccttcaaagagcgaagagcaagaggccccagacggctcacaggcatcaagtaactcagatccttttggcgagccttctggggagccctccggagataacatatccccacaggccggttcctag

SEQ ID NO: 220926 - DNA, 1614 bp, Artificial Sequence
  Description of Artificial Sequence: Synthetic coding sequence
atgagcaccgaaactgaattacaagtagcggtcaaaacctctgcaaagaaggacagcaggaagaagggccaggaccgaagtgaagccactctgataaaaagatttaaaggcgaaggcgtccgctataaagctaaactaatcggcattgacgaggtcagtgctgcgcgaggcgataagttgtgccaagattctatgatgaaactcaagggcgtcgttgcaggagccagaagtaagggggaacacaagcagaagatcttcctgactatctcttttggtggtataaaaatctttgatgagaaaaccggcgctctacagcaccaccatgccgtgcacgagattagctacatcgccaaggacattaccgaccacagagcctttggatatgtttgtggaaaagaaggtaatcacagatttgttgccatcaagactgcacaggccgcagagcctgttattctggatctgcgcgacctttttcagctgatatacgagctaaagcagagagaggaactggaaaagaaggcccagaaggataaacagtgtgaacaggccgtctaccaggttcctactagccagaaaaaggagggggtctatgatgtgcccaagtcacagcccgtgtccaatggttactcttttgaggactttgaggagagattcgccgcagctactcctgcagtgactcagctcgaactgtttggtgacatgtctactcctccagacatcacttccccccctacgcctgccacacctggggacgcattcattcctagctccagtcagactttgccggcttcagctgacgtgttttcctccgtgccgttcggtaccgcggctgtgccctctgggtatgtggccatgggtgccgttcttccctccttctgggggcagcagccactggtgcaacagcagatggtcatgggagcccaaccccctgtggcacaggttatgcctggcgcacagcctatagcctggggacagccgggtctgttcccagcaacccagcaaccctggcctactgtggccggacagtttcctcctgctgcctttatgccgacccagaccgtgatgcccctgccagctgccatgttccagggaccactgacacctctcgcgaccgtaccaggaactagtgacagtacgcggtccagtccacagacagacaagcctcggcagaagatgggtaaagaaacatttaaagatttccagatggctcagcctcctcccgtgccttcaaggaagcccgaccagcctagtctgacgtgcacctctgaagccttctcctcatacttcaataaagtcggggtcgctcaggataccgacgattgcgatgattttgacatcagtcagttgaacctgacaccggtgacaagcacgaccccatccactaacagcccgcctacacccgctcctaggcagagcagcccatccaagtcctccgcgagccacgcctctgaccccacaaccgatgacatcttcgaggaagggtttgagtccccatctaaaagcgaagagcaagaagctcccgatgggtctcaggctagctctaattcagacccttttggagagccgagcggagagccaagcggcgataacatatccccgcaggccggatcctag

SEQ ID NO: 220927 - DNA, 1662 bp, Artificial Sequence
  Description of Artificial Sequence: Synthetic coding sequence
atgagcaccgagacagaattgcaggttgccgtgaaaacctccgcgaaaaaggactccaggaaaaaggggcaggatcggtccgaggccacacttatcaagcgatttaagggcgagggggtacgctataaagccaaacttatcggaattgacgaagtatcagcagccagaggggacaaattgtgccaggattccatgatgaaattgaagggcgtggtggcaggcgctagaagcaaaggagagcacaagcagaagatattcctgactatttcattcggaggaatcaaaatctttgacgagaagaccggggctctccagcatcatcacgccgtgcacgaaatcagctacattgctaaggacatcaccgaccatagggcatttggttacgtctgtgggaaggagggaaaccacagattcgtggccatcaagaccgctcaggctgcggagccagttatcctggatctgagggatttgtttcagctgatctatgaattgaaacagcgcgaggagctagaaaaaaaggctcagaaagataagcagtgtgagcaggccgtgtaccaagttccgacttctcagaagaaagagggtgtgtacgacgtgcctaaaagtcagcctgtgagtaatggctattcctttgaggactttgaggagcggtttgccgcagcaacccctaatagaaatctgcctacagatttcgatgagatttttgaggcaacaaaggcagtgacgcaacttgagctctttggcgacatgtcaacacccccagacataactagtccacccacgccagctacgccgggagatgccttcatcccatcatcctctcagactctgccagcaagcgccgatgtattctcctctgtgccctttggcactgcagccgtgccctcaggctatgtggccatgggcgctgttcttccaagtttctggggtcagcagcctctcgtgcagcagcagatggtgatgggcgcacaaccaccagtcgcccaggttatgccaggtgcacaacccatcgcctgggggcagccaggtctcttccctgccactcagcagccatggcccacagtcgcgggacagttccccccagcggctttcatgcccacccagacagtgatgccgctacccgcagccatgtttcagggcccactgactcccttagctaccgtgcccggaacctcagattccacccggtcatcccctcaaacggacaaacctaggcagaagatggggaaagagacattcaaggatttccaaatggcacaaccccctcctgtgccaagccgcaagccagaccagccatccctgacctgcactagcgaagcattcagttcatacttcaataaagtgggggttgcccaggacactgacgattgcgacgactttgatatcagtcagttgaatctgacacctgtgaccagtacaactccttctactaacagccctcccaccccggcacccagacaatcctctccaagcaaatcaagtgcatctcacgcttctgaccccactacggacgatattttcgaggagggttttgagagcccttctaagtcagaggagcaggaggctcctgacggatctcaggccagttcaaactccgacccctttggggaaccctcaggtgaacccagcggtgacaatataagcccacaggccggttcatag

SEQ ID NO: 220928 - DNA, 1410 bp, Artificial Sequence
  Description of Artificial Sequence: Synthetic coding sequence
atgagcactgaaacagagcttcaggttgctgttaagacatccgctaagaaggatagtagaaagaagggacaggaccgctctgaggctaccctaattaagcgctttaaaggtgagggggttcggtacaaggccaagctcatcggaatcgacgaagtgtctgccgctagaggcgacaagctgtgtcaggacagcatgatgaagctgaagggtgtcgtggccggagctcgctcaaagggagagcataagcagaagattttcttgactatttccttcgggggtattaaaattttcgacgaaaagacaggagtgccaacaagccagaagaaagagggcgtttacgatgtacccaaatctcagccagtgtccaatggatatagcttcgaggattttgaagagagatttgccgctgccaccccaaatcgcaaccttcccaccgacttcgacgagatattcgaggcaacgaaagcagtcacgcagttagaactgttcggggatatgagcacaccaccagatattacctctccccctacccccgctacgccaggcgatgctttcatcccttcttctagtcagacattacctgcatctgctgacgtgttttccagtgtgccttttgggactgccgctgttccctcagggtatgtggcaatgggggctgtgctgccttcattttggggccagcagccgctggtgcagcagcagatggtgatgggcgcacaacctcctgtcgcccaggttatgccaggcgctcagccaattgcttgggggcagcccggattgtttccggcaactcagcagccgtggcctacagttgcaggacagttccctcctgccgcattcatgcccacccagacagttatgcctctcccggctgccatgttccagggacccctgacccccctcgccacagtgcctggtacctctgatagtacacgctcttccccacagacggacaaaccaaggcagaagatgggtaaagagacctttaaggattttcagatggctcagcccccacccgtgccctcccgcaaacccgatcaaccctctttgacatgcacctcggaggccttctcttcctactttaataaggttggcgtggcacaagacaccgacgattgcgatgactttgacatctcccagctcaacttgactccagtaacctcgacaaccccctccacaaattcacctccaacacccgctcctaggcaaagctctccttctaaatccagcgcctcccacgcatcggacccaacgacagatgacatcttcgaggagggattcgagagtccaagcaagtccgaggagcaggaagcaccggatggaagccaggcaagctctaactcggacccttttggcgagcccagtggtgaaccgagtggcgacaatatttcacctcaggccggttcttag

SEQ ID NO: 220929 - DNA, 2313 bp, Artificial Sequence
  Description of Artificial Sequence: Synthetic coding sequence
atgtcgaatgaagtcgagaccagcgcaaccaacggacaacccgatcagcaggctgcacccaaggccccatccaagaaagaaaagaaaaagggcccagaaaagacggacgagtacctactcgccagatttaaaggagacggcgtaaaatataaagctaaacttatcggcattgacgatgtcccggatgcacggggtgataagatgtcccaggacagcatgatgaaactgaaaggcatggctgctgctggcagaagccagggacagcataaacagagaatttgggtaaacatttctcttagcggcataaagataatcgatgagaaaactggcgttattgaacacgaacatccagtgaacaaaatctcctttatcgcgcgagacgtgactgacaacagggccttcggctatgtctgcggcggagaggggcagcaccagtttttcgccattaaaaccggacaacaagcagaaccccttgtcgtcgatctcaaagacctgttccaggtcatatacaacgtgaagaaaaaggaggaggagaaaaagaaaattgaggaagcatctaaggcggtggaaaatggatcagaagctctgatgattctagacgaccagaccaataagttaaaaagcggcgtagaccagatggatctttttggagacatgtccacaccacccgacctgaacagtccaacggaatctaaggatatcctgctggtagacctgaacagtgaaatcgatacaaaccaaaactccctgagagagaatccttttctgaccaacggtatcacgtcctgctcactgcccagaccaacaccccaggccagttttctacccgaaaatgcattttcggcaaacctcaacttcttcccgacccctaacccggacccatttcgcgacgatccttttacacagccagatcaaagcacaccctcctctttcgatagcctcaagagccctgaccagaaaaaggagaattccagcagttccagcacacccctgtcaaatgggccactgaatggtgacgtagactactttggccagcagtttgaccagatatcaaacagaaccgggaagcaggaagcacaagccggaccttggcctttctcaagctctcagacccagcccgctgtcagaacgcagaacggagtcagcgagcgcgagcaaaacggcttcagcgtgaagtccagtccaaatccttttgttggcagcccgccaaagggcctctccatacagaatggagtgaagcaggacttagagtccagcgtgcaatccagtcctcatgactcaattgccatcattcctcccccacagtccacaaagcccggacgcggaagaagaacagccaagtcttccgccaacgatttgttggcctcagacatcttcgcccctccagtgtctgagccgagcgggcaagcttctccaacaggacagccaaccgcgctccaacccaaccctctggacctgttcaagacatccgcccctgccccagtggggcctctggtgggcctgggcggagttaccgtgaccttgccccaggcaggcccttggaatacagcttcattggtcttcaatcagtcccccagcatggccccaggagcgatgatgggcggacagccctctggcttcagccaaccggtgattttcggaacctccccggcagtctctgggtggaatcaaccgtctcctttcgcagcctcaacccctcctcccgtgcctgtggtgtgggggccatccgcctccgtggcccctaatgcttggtccacaaccagtccattgggcaaccccttccagagtaatatcttccctgctccggcagtgagtacgcagccaccatccatgcactcaagcctgctggtcaccccaccccagcccccacccagagccggacccccaaaggatatttctagcgatgcctttaccgcgctggaccctctcggtgacaaagaaataaaagacgtgaaggaaatgttcaaggattttcaactaaggcaaccgccagctgtgcccgctagaaaaggtgaacaaacttcttctggcacactgagcgcttttgccagctacttcaactctaaagtaggaattccgcaagaaaacgctgatcacgacgactttgacgccaaccagctgctcaacaaaatcaacgagcccccaaaacccgctccccgtcaagtgtctttgccagtgacaaaatccaccgacaacgcttttgaaaatccatttttcaaagactcctttgggtcatcgcaggcaagcgtggctagttcccagcccgtcagcagcgaaatgtacagggacccttttggaaatccattcgcctag

SEQ ID NO: 220930 - DNA, 1659 bp, Artificial Sequence
  Description of Artificial Sequence: Synthetic coding sequence
atgagtaatgaggtggaaacgagtgccaccaatggccagcctgaccagcaggctgcccctaaggccccaagcaaaaaggagaaaaaaaaaggcccagagaaaactgacgaatacttgttggctcgattcaagggggatggagtgaagtataaagctaagttaataggcattgatgatgtgcctgacgcacggggagacaaaatgtcacaggactccatgatgaagctgaaagggatggccgcagcagggaggtctcagggccagcacaagcagaggatctgggtaaatatttctctgtctggaattaagatcatagatgaaaagacaggtgtgattgaacatgagcaccctgtgaataaaatctcctttattgctcgggacgtgactgacaaccgggctttcggatacgtctgtggcggagaaggacagcaccagttctttgccattaagacaggccagcaggccgagcccttggtggtggacctcaaggatctatttcaagtcatctataatgtcaagaagaaggaggaggagaagaagaaaatagaggaggctagcaaggccgtggagaacggctccgaggctctgatgattcttgacgaccagaccaacaaattgaagagtggggtggaccagatggacctgtttggtgacatgtctacacccccagacctgaactcccccacctctagcgccaatgatctcttagcaagcgatattttcgcccctcccgtgtctgaaccttccggacaggcatctccgaccgggcagcctactgcgctgcagccaaatccgctggacctttttaagactagcgctcccgctccagtcggccctctcgtcggcttaggcggagttaccgtgactctgccccaggccggaccatggaacaccgcctccctcgtgttcaaccaatcaccttctatggctccgggtgccatgatgggtggccagccgtcagggtttagtcaacccgtgattttcgggacgagccctgccgtaagtggctggaatcagccctccccattcgctgcctctactccccctccagtccccgtcgtgtggggccctagtgcatcggtggctccaaatgcttggagcactacatccccgcttggtaatccttttcagagtaatatcttccccgctccagcagtgagcactcagcctcccagtatgcactcatccctgttagttacaccccctcagccacctccacgagccggaccccctaaggacatctcttctgatgccttcactgcccttgatccacttggcgataaagaaattaaagacgtgaaggaaatgttcaaggattttcagctgcgtcagccccctgccgtgcctgcccgtaagggggagcaaactagcagcggaacgctgagtgcatttgcctcctattttaatagcaaggtggggataccacaggaaaacgccgaccacgatgacttcgatgctaatcagctgctgaacaagatcaacgaacctcccaagccagcacccagacaagttagcctccctgtgactaaaagtaccgataacgcttttgagaacccattcttcaaggattcattcggatcttcacaggcaagcgtggccagctctcagcccgtatcctctgaaatgtatagggatcccttcgggaacccttttgcctag

SEQ ID NO: 220931 - DNA, 204 bp, Artificial Sequence
  Description of Artificial Sequence: Synthetic coding sequence
atgagcaacgaagtagaaacaagtgccacaaatggccaacctgaccaacaagctgccccaaaggccccttctaaaaaagaaaaaaaaaaggggcctgagaagacagatgagtacttacttgcccgtttcaagggggacggggtcaaatataaggccaaactgattggaattgacgacgtgcccgacgccagaggcgataagtag

SEQ ID NO: 220932 - DNA, 231 bp, Artificial Sequence
  Description of Artificial Sequence: Synthetic coding sequence
atgtccaacgaagtggagacatctgccacgaacggacaaccagatcagcaggcggctcccaaagccccttcaaagaaagagaaaaaaaagggcccagagaagaccgacgaatacctgctggcccgtttcaaaggcgacggcgtcaaatacaaagcaaagcttatcggcatcgacgatgtccccgacgcgcgaggcgacaaaatgtcgcaggactccatgatgaaattatag

SEQ ID NO: 220933 - DNA, 120 bp, Artificial Sequence
  Description of Artificial Sequence: Synthetic coding sequence
atgtcaaatgaggtcgagacctccgctacaaacggccaacctgaccagcaggccgcacccaaggctccaagtaagaaagaaaaaaaaaaaggtcctgaaaaaaccgacgagtacctgtag

SEQ ID NO: 220934 - DNA, 2250 bp, Artificial Sequence
  Description of Artificial Sequence: Synthetic coding sequence
atgtcgaacgaagttgaaacctcagccacaaacgggcagcccgaccaacaggcggcaccaaaggcacctagtaagaaagagaagaagaaaggccctgaaaaaacagatgaatacctgctagcaaggtttaaaggcgatggcgttaaatataaggccaagttaatcggcatagacgacgttccggacgcccgaggcgataaaatgtcccaggacagcatgatgaagctaaaggggatggctgccgcaggccgtagccagggccagcacaagcagagaatttgggttaatatctccttatctgggatcaagatcatagacgagaaaaccggagtgattgagcacgagcatcccgtgaataaaatttcatttattgcgagagatgtgacagacaatcgggcattcgggtacgtttgcggtggtgagggtcaacatcagttcttcgctattaagaccggtcagcaggccgagcccctcgtggttgacctgaaggatctttttcaggtaatatacaacgtcaagaagaaggaagaggagaaaaagaaaatcgaggaagcctcaaaagcagtcgagaatgggtcagaagcgctaatgattctagacgatcaaacgaacaagttaaagagcgagtccaaggatattcttctggttgacttgaactccgagattgacacaaaccaaaactcgctgcgagagaacccgtttcttactaatggcattacgagctgcagtctccctcgaccaacgccgcaggcgagtttcttgccagaaaacgcctttagcgccaatttgaatttctttccaacacccaatccagacccttttcgggacgacccatttactcaacctgaccaatccacgccatcctcctttgactctctgaaatctcccgatcaaaagaaggagaactcaagctctagctctacacctctttccaatggcccattgaatggagacgtggattatttcgggcaacagtttgatcagatcagcaataggaccggaaagcaagaggcacaagctgggccttggccctttagctccagccagactcagcccgcagttaggactcagaacggcgttagcgagcgggagcagaatggcttctctgttaaaagctctcctaatccattcgttggatcaccaccaaagggactttccattcaaaacggtgtaaagcaggacctcgagtcttcggtgcagtcctctccccacgattccattgcaattatccccccaccgcagagtacaaaacccggacgaggtagacgcacagctaaatcatccgctaacgatctcctggctagcgacatttttgctccccctgtgagcgagcccagcggccaagcgtctcccaccggacagcccaccgccctgcaaccaaaccctctcgatctgttcaaaacatccgctcctgcgccagtcggcccacttgtgggactcggtggagtcactgtgacactaccacaggctggcccatggaatactgcatccttggtttttaatcagagtccttctatggcgcctggggcaatgatggggggacaaccttcaggttttagtcaacccgttatatttggaacttctcccgcagtttctggatggaaccagccatcgccgtttgccgcatccactccaccacccgttcccgtagtttggggtccaagcgcctcggtggctcctaatgcttggagtaccacatctccactgggaaaccccttccagagcaatatctttcctgcacccgctgtgtctactcagccaccatctatgcacagtagtttgcttgtgacgccacctcagccccctcctcgcgctggcccaccaaaggatatctcaagtgatgcatttaccgccttggatcccctaggcgataaggaaatcaaggacgtcaaggagatgtttaaggactttcagttaagacagcctccagctgtgcctgcccgtaaaggggagcagacatcgagtggcaccctgagtgcattcgcctcctacttcaactctaaggtgggaattccgcaggagaatgctgaccatgatgacttcgacgccaatcagctgctgaacaagattaacgagccccctaaacccgctccgcgtcaggtctcacttccagtgaccaagtctaccgataacgcattcgaaaatccgttttttaaagatagcttcggcagcagtcaggcaagtgtagcctcctctcaaccggttagctccgagatgtacagggaccccttcgggaatcctttcgcttag

SEQ ID NO: 220935 - DNA, 2568 bp, Artificial Sequence
  Description of Artificial Sequence: Synthetic coding sequence
atgatcctgattcctcgaatgctgttggtgctgttcttgctcttaccaatcttatcctcagctaaggcacaggtcaaccccgcaatatgtcggtacccgctcggcatgtcaggtgggcaaattccagatgaggatatcactgcatcttcacagtggtcagagtccactgcggcaaaatatgggagactagatagtgaagaaggcgatggagcttggtgtcctgaaatcccagtagaaccagatgatctgaaggaattcctccagatcgacctccataccctacactttataacgctggtggggacacagggacggcacgccggagggcacggtattgagtttgctccaatgtataagataaactactcccgcgacgggaccagatggatatcgtggcgcaaccggcatggcaaacaggttcttgacgggaactcgaatccttacgacatttttcttaaggatttggagcctccaatcgttgcccgttttgtgagatttattcctgtcacagaccattcgatgaacgtctgtatgcgagtggagctgtatggctgcgtttggttagatggactggtttcctacaacgcacctgccggacagcagttcgttttacccggtggaagcatcatctatcttaacgattcagtgtatgacggcgcagtggggtactcaatgacggaaggcctgggacagctgaccgacggagtgagtggactagacgacttcacacagacacatgagtaccatgtgtggccgggatatgactacgtgggctggcggaatgagagtgccacgaacggctacatcgagatcatgtttgagttcgaccggattcggaacttcacaacgatgaaagtgcactgcaacaacatgttcgccaaaggcgtcaaaatcttcaaggaagtccaatgctacttcaggtccgaggcctctgagtgggagcccaatgcaatatcttttccccttgtcctggatgacgtgaaccctagcgcgaggtttgtgaccgtcccactgcatcataggatggccagcgccattaaatgccagtaccactttgcggatacgtggatgatgttttctgagatcacatttcagagcgacgctgcaatgtataataattccgaggcattacccacaagccctatggctcctactacctacgatcccatgctcaaagtcgatgacagtaacacgcgcatcctcatcggctgcctcgtggctatcatttttattctcctcgcaattatcgtgatcatactttggcggcagttctggcagaaaatgctagagaaagcatcacgacgcatgcttgacgatgagatgacagtgtcattatccctcccttcagatagtagcatgtttaacaacaaccgcagtagctcaccgagcgaacagggcagcaattctacatatgacagaattttccctctgaggccagactaccaggaaccatcgcgactgatccgcaagttgcccgaatttgcacctggagaggaggagtcaggatgttccggcgttgttaagccagttcagccatctggccctgagggcgtccctcactatgcggaggccgacatcgtgaatcttcagggagtcaccgggggaaacacatacagcgtgccagcagtcaccatggatctattgagcggaaaagatgtggctgtcgaagaatttcccaggaagcttctgactttcaaggaaaagctgggggaaggccagtttggagaagttcacttatgtgaagtcgagggcatggaaaaattcaaggataaggatttcgcattggatgtgtccgctaatcagcccgtgcttgtagccgttaagatgctccgcgctgatgccaacaagaacgctaggaatgactttcttaaggagatcaagatcatgagccgcctgaaagaccctaacataatccatctgttagcggtgtgcatcacagacgaccctctatgcatgatcaccgaatatatggagaacggggacctcaaccagtttctaagccgccatgaacctccaaattccagctcctccgatgtacgtacagtgtcctataccaatctgaagtttatggcaacacaaatagcctccggcatgaagtacctgagcagtttgaatttcgtccatagggacctcgcgacacgtaattgcctggtaggaaaaaactatactattaaaattgctgactttgggatgtctaggaacctgtacagtggggactattaccgaatacagggcagagccgtactccccattcgctggatgagctgggagagcattctgctgggaaagtttacaacggcgtctgatgtgtgggcgtttggcgtgactctctgggagacctttaccttttgtcaggagcaaccatactcacagctaagtgatgagcaggtgattgaaaacaccggggaattctttagagatcagggtaggcagacatatctgccccaacccgctatctgcccagacagcgtatacaaactgatgctttcgtgttggcggagagacaccaagaacagaccttcattccaagagatccatctcctattacttcagcagggggacgaatag

SEQ ID NO: 220936 - DNA, 2568 bp, Artificial Sequence
  Description of Artificial Sequence: Synthetic coding sequence
atgattctgattcctaggatgcttctcgttctcttcttgttactgccgatactgtccagcgctaaagcccaagttaaccctgccatctgtaggtatcctctgggcatgtctggcggtcagatcccggacgaagacattactgcttctagccagtggagcgagtcgaccgcggcaaaatacggccgtttagatagtgaagagggagatggcgcatggtgtcctgagatacctgtcgaaccagacgaccttaaggaattcctgcaaattgacctgcatactctacactttatcacgttagtagggacccagggcagacacgcaggcggacatgggatagaattcgcacctatgtacaaaatcaactatagcagggatggaacacgctggatctcctggagaaatcggcatggcaaacaggtgcttgacggaaacagtaatccttacgatatatttcttaaggacctggagcctcctatcgtagcgagatttgtgagattcataccggtcacggatcatagtatgaatgtgtgcatgcgggtggagctgtatggatgcgtgtggctcgatggattagtgagctacaacgcacccgctgggcagcagtttgtgttgcccggtggaagtataatttacctgaacgactctgtgtacgatggagctgtgggatactctatgaccgagggacttggacaattgactgacggggtctcagggctcgacgatttcacgcagactcacgagtaccatgtgtggccgggttatgactatgtcggttggaggaacgagtcggctactaatggctacatcgagatcatgtttgagtttgaccggatacggaactttacaacaatgaaagtgcattgcaacaacatgtttgccaaaggcgtaaaaatctttaaggaggtccaatgctattttaggtccgaggctagcgagtgggagccaaacgcaatttcgttccccctggtcctggacgatgtcaacccctcagctaggtttgtgaccgtcccattgcaccaccgtatggcatccgcaattaaatgtcagtatcacttcgccgacacttggatgatgttcagcgaaattaccttccaaagtgatgccgcaatgtacaataactctgaggctcttcctacaagccctatggcacccactacatacgacccaatgctcaaggttgacgatagtaacaccaggattctgattggatgcctggtcgccattattttcatcctgctcgccataatcgtaatcatcttgtggagacagttctggcagaagatgctggaaaaggcttcccggagaatgcttgacgatgagatgactgtctctctcagtctgcctagtgattccagtatgttcaataacaatcgttcctcctccccaagcgaacaaggatctaactccacctacgatcgaatcttccccttgaggcctgattatcaggaaccttccaggctgatccgcaagctacctgagtttgctcccggtgaggaagagagtggttgctccggggtggtgaaacccgtccagccttccggaccagagggagttccacactacgccgaggccgacatcgttaaccttcagggcgttactggtggcaatacttactctgtccctgccgtcaccatggacttgctgagcgggaaggatgtggctgtcgaggaatttcctcggaagctcctgacatttaaggagaagctgggagaagggcaatttggagaggtccacctttgcgaggtggaaggcatggaaaaattcaaagataaggatttcgctttggacgtgtcagcaaaccagcctgtgctggtggctgtaaaaatgctcagggctgatgccaataagaacgcccgaaacgattttctaaaagagataaaaatcatgtctcgactaaaagatccgaatatcatccaccttttggctgtgtgcattacagacgatcccctttgcatgattactgagtatatggagaatggggatctgaatcagttcctttctcggcacgagccacccaacagctcctcctctgatgtcagaacagtctcttatacaaatctgaaattcatggctacccagatcgcttctggaatgaagtacctgagttcactgaatttcgtccaccgggatctggctactagaaattgcctggttgggaagaattatactataaaaatcgccgactttggcatgtcacgaaatttatactctggcgattactacaggattcagggtcgagcagttctaccaataaggtggatgtcatgggagtctatcctgctgggaaaatttacaacagcttccgatgtctgggcctttggtgtgactttgtgggagacctttactttctgtcaggagcagccatattcccagctttcagatgaacaggtcattgaaaatacgggggaattcttccgcgaccaggggaggcagacatacctgcctcaacctgctatttgtcccgactccgtctataagctgatgttgagctgctggcgcagggatacaaagaatagacctagtttccaagagatccacttgctgctactgcagcaaggtgatgagtag

SEQ ID NO: 220937 - DNA, 447 bp, Artificial Sequence
  Description of Artificial Sequence: Synthetic coding sequence
atgattttgatcccgagaatgttgttggtgctgtttctgctgctcccaatattgtcctctgccaaggcccaggtcaatcctgctatttgtcgatatcctctaggtatgagcggtgggcagatccctgacgaagatatcacagcatcctcccaatggagtgagtctacggccgcaaagtacggcagattggattccgaagaaggggacggagcttggtgcccagagatccccgttgagcccgacgacttgaaggagttcctgcagattgacctccacacactgcacttcattaccctggtcggaacccagggacggcatgccggtggacatggcatagagttcgcacccatgtataagataaattactcccgggacggtactagatggatctcctggcggaatcgacatggcaagcaggtactggacgggaattccaacccttactag

SEQ ID NO: 220938 - DNA, 516 bp, Artificial Sequence
  Description of Artificial Sequence: Synthetic coding sequence
tgaatcttcatcctactggccatcattgttatcatcctgtggaggcaattctggcagaagatgctcgagaaagcttctcgtagaatgcttgacgatgagatgaccgtgagcctgtcactccctagtgactcatctatgtttaataataaccggtcttctagcccatccgagcagggatcgaactccacttacgatagaatcttccctttaagaccggactaccaggagccctcgagactgatcagaaagttgccggagttcgccccaggcgaggaggagtctggctgctcaggagtggtaaagccagtccaaccttcgggacctgagggagtgccccactacgcagaggccgatatcgtgaaccttcagggtgttactggtgggaatacatactctgtgccggcagtaaccatggacctcctgtccgggaaggatgtagccgtggaggaatttcctcgcaaactgttgacattcaaagaaaagttgggtgagggccaatttggagaagtgtcctag

SEQ ID NO: 220939 - DNA, 393 bp, Artificial Sequence
  Description of Artificial Sequence: Synthetic coding sequence
atgattctcatcccccgaatgttgctagtactgttcctccttttgcccatcctctcttctgccaaggcccaggttaatcctgccatctgccgataccctctgggaatgagcggaggccagattccagacgaggatatcaccgcaagcagtcagtggtcagagtcaacagcggctaagtatggccgacttgactccgaagaaggtgacggggcatggtgtcccgaaattccagtggaacctgatgatcttaaggagttcctgcagatcgacttacacacattgcacttcatcacgctagtcggtactcagggcaggcacgctggtggacatggcatcgaattcgctcctatgtataagatcaactactcacgggacgggacccgatggatttag

SEQ ID NO: 220940 - DNA, 501 bp, Artificial Sequence
  Description of Artificial Sequence: Synthetic coding sequence
ctcaaagtggatgattctaatacacggattctaattggttgtctggtagccattattttcatcttgctcgctatcatcgtgatcattctgtggaggcaattctggcagaagatgctggagaaggcctcccggcgaatgctggacgacgagatgacagtgtctctttccctcccttctgactcctctatgtttaataataataggagctcttctccctcagagcaaggatctaattcaacctacgatcgcatattcccacttcgccctgactaccaggagcccagtagactaattagaaagctgcccgaatttgcacccggagaggaggagtctggcgaagatgacgtagttggacgcgtttccagagagaaacctcagcaggcgagcggcaggtacgacacccccgctccgtcttcgctgcacctattcttggtcagcgcaaatcttctgcggtccccccactcgctctcccggttcgggttgcccctcctcctcgcctag

SEQ ID NO: 220941 - DNA, 447 bp, Artificial Sequence
  Description of Artificial Sequence: Synthetic coding sequence
atgatactcattcctcgcatgcttttggtcctgttcctcctgctacccatccttagtagcgccaaggctcaagtcaatccagccatttgcaggtatccactgggcatgtctggtggccagatcccagatgaggatattacagcatcaagccagtggagcgagagcactgcggctaaatacggacgactggacagtgaagaaggcgatggcgcttggtgcccagagatccccgtggaaccagatgacctaaaggagttccttcaaattgatctgcacaccctgcatttcattactttagttgggacccaggggaggcacgccggtggacacggcattgagtttgcacccatgtacaagattaactacagccgcgacggaaccagatggatctcatggaggaaccgccatggaaagcaggttctagacgggaatagcaatccctattag

SEQ ID NO: 220942 - DNA, 2403 bp, Artificial Sequence
  Description of Artificial Sequence: Synthetic coding sequence
atgaactacatattcgggaacaacacactgctgtacagtcgcggttcacggggtggtaacacgtcttcctcccatggctccgccggacctaaacaaaaacactgggcaaaaaaggggagttctgatgagctccaagccgaacctgagcccagtcgctggcaacagattgtcgccttctttactcgcagacattcatttattgactgcattagcgttgccacatccagcacacaggctaatccaccccctgtgttggtgaacactgattccctggaaacccctacatatgtgaatggtactgacgccgattatgaatacgaggagatcacgctcgagagggggaatagtgggctcgggtttagcatcgctggcggtactgacaatccgcatattggagacgactcctccatctttataaccaagattattacaggaggggctgctgcccaagacggtcgactgcgggtcaatgactgtatcttacgcgtgaacgaagttgatgtgcgcgatgtcacccactcaaaggccgtcgaagccttaaaagaagctggtagcatcgtgcgcctctatgttaaacgacgaaagccagtgagcgagaagatcatggagatcaaactgattaaggggccaaaaggcctcggattcagcattgctggtggtgtgggtaaccagcacatccccggagacaatagcatctacgttaccaaaatcatcgagggcggtgctgcccacaaagacggtaaactgcagatcggtgacaaattactggctgtaaacaatgtttgcctggaggaagtgacccatgaggaagcagttaccgctctgaagaacacaagcgatttcgtgtatctcaaagtcgcaaaaccgacaagcatgtatatgaatgatggatacgcccctccggacattaccaattcttccagccagccggttgataaccatgtgtcgccctctagctttctcggccaaactcccgcatccccagcaagatacagccctgtaagtaaggctgtgttgggtgatgatgagatcaccagagaacctaggaaggtggttcttcacagaggttctacaggactggggttcaacatagttggcggagaggacggcgagggaatcttcatttccttcattttggccggtggacccgcagatttgtctggtgagttgcgcaagggtgacaggataatctccgtgaattcagtcgacttgagagcggcatcccacgaacaggcagccgcagctttgaagaacgcagggcaggccgtgactattgtggctcaatacaggccagaggaatattccagattcgaggcaaaaattcatgacctgagagaacagatgatgaattcctcaatctccagcgggtccggatctctgcggaccagccagaaacgttcgctttacgtcagggccctttttgactatgacaagactaaggattccggactgccgagccagggcctgaacttcaagttcggtgacattctgcatgtgattaacgccagtgacgacgaatggtggcaggcccgacaggtgacccccgatggcgagtctgacgaggtgggggtcatacccagcaaacgtcgggtcgaaaaaaaggaacgagctagactcaagacagtcaagttcaatagcaagactagagacaagggtgagatccctgacgatatgggctctaaaggtttaaagcatgtcacatccaacgcgtcagacagcgagagttcttacttgatcctgatcacagacgagtacggctgttccaaaggtgggcaagaagagtacgtcctaagctatgagcctgttaaccaacaggaagtgaactacactcggcctgtcattatcctagggccaatgaaggacaggatcaatgatgacctgatctcagaattccccgacaaattcggatcctgcgttccccatacgacaaggccaaaaagggattatgaagtggatggcagagattatcacttcgtgacgtctcgcgagcagatggaaaaagacattcaggaacacaaattcattgaagccggtcagtataataatcacctctacggcacgtcagtacagtctgttcgggaggtggccgaaaaagggaagcattgcatcctcgatgtcagcggaaacgcgatcaagagactgcagatagctcagctctatcccattagcatcttcatcaagcccaagtcgatggaaaatattatggaaatgaataaaaggctcaccgaagagcaagccaggaagacctttgaacgcgcaatgaaactggaacaggagttcactgaacactttactgcaatagtacagggagacaccctggaagacatctataatcaggtgaaacaaataattgaggagcaatcgggctcctatatttgggtccccgcaaaagagaaactctag

SEQ ID NO: 220943 - DNA, 2367 bp, Artificial Sequence
  Description of Artificial Sequence: Synthetic coding sequence
atgaattatatattcggaaacaatactctgctgtactctcggggatctagaggcggtaacactagttcctctcatgggagtgccggtccaaaacagaagcactgggccaaaaaaggaagttcagatgagttgcaggccgagccagagcctagtcgctggcaacagattgtcgcctttttcaccaggcgacactcattcatcgattgtatcagcgtggcaacatctagcactcaagctaatcctcctcccgtattggtgaacacagactctttggaaaccccaacttacgtgaacggcaccgatgccgactatgagtacgaagaaataacacttgaaagagggaattcaggtcttggcttctcgatcgccggtgggacagataacccccacattggagacgattccagtatatttattacaaaaatcattaccggcggagctgccgcacaggatgggagacttcgagtcaacgattgtatccttcgggtgaacgaagttgacgtccgcgacgtgacacatagtaaggcagttgaggccctgaaggaggccggatcaatagtgcggctctacgtaaagaggaggaagcccgtgtcagaaaaaatcatggaaattaaactgatcaaaggtcccaagggcctgggcttcagtatcgcgggtggagtcggaaatcaacatatccccggagataactcaatatatgtcaccaaaatcatcgaaggtggtgctgcacacaaagacggcaaactgcagatcggcgataagctcctcgccgtgaacaatgtgtgtttggaggaggtgacccacgaagaagcagtaaccgctctcaagaatacatcggatttcgtgtaccttaaagtcgccaaacctacatcaatgtacatgaacgacggatacgcccctccagatattaccaattcctccagtcaacccgttgacaaccacgtgagtcccagctcgttcctgggacagacccccgcaagccctgctcgctactcacctgtatctaaggccgttttaggtgacgatgagatcacacgggagccacggaaggttgtgctccaccggggttccaccgggcttgggtttaatatagtgggaggagaggatggtgagggaatcttcatctccttcatccttgcagggggaccggcagacctgagtggagaactgcgcaagggcgatcggatcatcagcgttaactctgtggatttaagggcggcttctcatgagcaggcggcagctgcactcaagaatgccggacaagcggtgactattgtggcacagtaccggccagaggagtactctcgattcgaggcgaagatccatgaccttcgggaacagatgatgaatagttccatctccagcgggagtggatctttgagaacttctcagaaacgatccctgtacgttagagctctgttcgattatgataagacaaaggattcaggactcccaagtcagggcctgaactttaagtttggtgacattctgcacgtgattaacgcctctgacgacgagtggtggcaggctcgccaagtaaccccggatggtgagagtgacgaggtgggagtgatcccctcaaaacggagagtggaaaaaaaggagcgcgcacggctcaaaaccgtgaaatttaacagtaagacacgcgacaaaggcgagattccggatgacatggggagtaaggggctgaagcacgtgaccagcaacgcttccgactccgaaagcagctatagaggccaggaggagtatgtgctgtcttacgaacccgtaaaccaacaagaggtgaattatacacgcccagttatcatcctggggccaatgaaagatagaatcaacgacgatttgattagcgaattcccagataagttcggcagttgcgtaccacataccacacgaccaaagagggactatgaggtcgatggacgtgactatcacttcgtcacctctagggagcaaatggaaaaagacatccaggagcacaagtttatcgaagcaggtcaatataacaatcatctctacggtacttctgtgcaaagcgttagggaggtcgctgaaaaggggaagcactgcatcctggacgttagcggtaatgccataaagagactgcaaatcgctcagttgtatccaattagcattttcatcaagcccaaatccatggaaaatattatggaaatgaacaagcgtctaaccgaagagcaagctcggaaaacctttgagcgcgctatgaagttagaacaggagttcacagaacacttcactgcaattgttcagggtgatacgctggaggatatatataatcaggtgaagcagattatcgaagaacaatccggctcttatatctgggtgccggctaaggagaagctgtag

SEQ ID NO: 220944 - DNA, 1539 bp, Artificial Sequence
  Description of Artificial Sequence: Synthetic coding sequence
atggaaagagccaggaaattttccggcagtggactggcaatgggtcttgggtcagcttcggcatcagcttggcggagggcctctcagcggtgggcctggcctctcaggagtcttcgacctggcggtgacgctcgtgagcctcgcaagatcattctgcacaaggggagcacaggtctgggcttcaatattgttggaggtgaagatggcgaaggcatcttcgtgagctttattttggcgggaggtccagccgacctctctggggaactccgcagaggggaccggatcctgagtgtaaatggagtgaacctcaggaacgccacacacgagcaggccgctgccgctctcaagagggccggacagtctgtcactatagtcgctcagtatcgtcccgaggaatatagtagatttgaatctaagatccatgacttaagggagcagatgatgaatagttcgatgtcaagcgggtctggctccctgcgaacctccgaaaagcggagtctatatgtccgtgctttatttgactacgatcggactcgcgatagttgcttgccgtcacaaggcctgagcttttcatacggggacattctacatgtaattaatgcttccgatgacgagtggtggcaggcccgtctagttacaccccatggggaatcagagcagatcggggtgatcccttctaagaagcgggtcgagaaaaaagagcgtgctcggctgaaaacagtcaagttccatgcacgaaccggaatgatcgaatctaacagatcaatcaaaaccaagcggaaaaaatcttttagactctctaggaaattcccgttctacaagagcaaggagaacatggctcaggaatcctcaatccaagaacaaggcgttacttccaatacttcggactccgagagctcttcaaagggacaagaagacgccatcctatcatatgaacctgtgactcggcaggagatccattatgcacgtcctgtgatcattttgggtccaatgaaggacagggtgaatgacgatttaatcagcgaatttccccataaattcggaagctgtgtcccccacaccacgcggcctcgtcgcgacaatgaggtcgacgggcaggattaccacttcgtggtatcaagggaacagatggagaaggatatccaagataataagtttatcgaagccggtcagtttaatgacaatttgtatggcacgagtattcagtccgtgcgcgcagtcgcagagcgtggcaaacattgcattctggatgtgtccggaaatgcaatcaaacgcttgcaacaggcacagctgtacccaatcgccattttcataaagccaaagagtattgaggccctgatggagatgaatcggagacagacctatgaacaggccaacaaaatttatgacaaggccatgaagctcgagcaggagtttggtgagtacttcaccgccatcgtgcagggcgactccctcgaagagatttataataagatcaaacagatcattgaagaccagtccggacattatatttgggttccttcaccagagaaattatag

SEQ ID NO: 220945 - DNA, 3021 bp, Artificial Sequence
  Description of Artificial Sequence: Synthetic coding sequence
gaggaggaggccggagacctggtgcagcctggcatctcgttccccggacccgctgaggaggacctggacccccagtactcttggagtccgacccaacattttaatgaggaaaggtacagccccgctccccgaagcatgaagggcctctctgggtctagaacccagcctccactgtgtagcgggcacacctgcgggctcgcaccacccgaggactgcgaacatctccaccacggtccggatgcccgaccaccttatctgctcagtcctgccgatagttgtccgggaggcaggcataggtgcagcccgaggtccagtgtgcatagtgaatgtgtgatgatgcccgttgtgcttggggaccacgtatctagctcaacattccccagaatgcattactcttcacattacgacacccgagatgattgtgctgtggctcatgccggagccaagatcaaccggataccagccaaccttctggaccagtttgagaaacagctgccgttgcaccgtgacggcttccacacgctccagtaccaacgcacttctgcggcagcagaacagcgctctgaaagccccggtaggatccgtcaccttgtgcattctgtgcaaaagctgtttacaaagtcccactcgttagagggttcctctaagagcaatgcaaacggaacaaaagcagacggtagggcagatgaccaccatcacgcacaccatgcaaagcactcaaaacgtagcaaatcaaaagaacggaaaccagagggaaagccgcgtcccggaatgagctcctggtggagttctgacgacaatcttgattctgactcgacttaccggactcccagtgttctgaatcgccatcacctgggaccggtggcccactgctaccccgatgctctccagtctccattcggggatctgtctttaaaaacatcgaagtctaacaatgatgttaagtgctccgcctgcgaggggttagccctgacccccgatgccaaatacttaaagcgaagttcctggtccacacttacagtgtctcaagccaaggaagcctataggaagagcagtcttaacctagacaagcccctgctgcatcaggatgccaaacctgccctccgcccttgtcattacctccaggttccccaagatgagtggggtggttaccccacaggaggtaaagatgaggagattccgtgtcggaggatgaggtccgggtcttatattaaggctatgggcgacgaggaaagcggagagagtgattccagtcccaaaacttcccccaagtctgccattctacccgaacccctcttgaagtccattgggcagcggcctttgggcgaacatcaaacacaaacgtacctacaagcggcatctgatgtgccagtgggccacagtctggatcccgctgctaactataatagcccaaaatttaggagtcggaatcaatcttatatgcgcgcagtttcaacattgtcacaggcatcctgtgtaagccaggtcagcgaggccgaaatcaacggtcagttcgagtctgtctgtgaatccgtgttctccgaggtggaaagtcaggccatggacgccctggacttaccaggatgtttccggacaagaagtcactcctacctccgggctattcaagccggttacagccaggatgatgagtgcatccctatgatgacccccagtgacattacctctaccataagatcaacagccgctgtgagttacaccaattacaagaagacccccccaccagtcccaccaagaaccaccagcaagccgctcatatcagtgacagcacagtccagcactgagagcacacaggacgcctatcaggattccagagctcagagaatgtccccctggccgcaagatagccgcggtctgtacaattccacagacagtctcgattcaaataaagcgatgaacctggccttggagacagccgcagcccagcggcacctgccggagagccagtcctctagcgtgaggacatccgataaggcaattctcgtctcaaaggccgaagaactgttgaaatcacgctgcagctctataggaatccaggtcgagactgccaccgactccgataccgaatctagggggctgagagagtatcacagtgtaggtgttcaggtggaggacgagaagaggcacggtcggtttaagagaagcaacagcgtaacagccgcagtgcaggctgacctggaacttgagggctttccgggacacatcactactgaagacaaagggctccagtttggaagctcctttcaacgccacagcgagccttctactcccactcagtacagcgctgtgcgaacggttcggacgcaaggcctgttctcctaccgggaggattataggactcaggtggacacttcaaccctgccgccacctgacccatggttagagcccgctattgataccgtggagactgggagaatgtctccatgtagacgtgacgggtcctggttcctgaaactactgcatgccgaaacaaagagaatggaggggtggtgtaaagagatggaacgagaagcggaggagaacgacctctccgaggaaatcctaggtaagatcagatctgccgtgggatcggcccagctcctgatgagtcagaagtttcaacagttttactggttatgtcaacaaaatatggatccctctgctatgccccgtccgacatcccaggaccttgctgggtattgggacatgctgcagctgtcaatagaagacgttagcatgaaattcgacgagctccagcggctacggttgaacgattggaaaatgatggagagtcccgaaagaaaagaggagcggaaggttccccctccgattccaaagaaacctccaaaggggaaatttccaatcacgcgcgagaaatcccttgatctgcctgacaggcagcggcaggaggcccgtcgcagactcatggctgcaaagagagcggcttcattccgtcagaactccgcctcagaaagggcagacagcattgagatatatatccccgaagcccagacacggctgtag

SEQ ID NO: 220946 - DNA, 2928 bp, Artificial Sequence
  Description of Artificial Sequence: Synthetic coding sequence
atgaaggggctttcaggcagtagaacacagccacctctttgcagcggacacacctgcggactggcaccacctgaagattgcgaacaccttcaccatggtccagacgcgagacctccctatctgctcagccctgccgacagctgcccgggtggtaggcacagatgcagccctagaagtagtgtgcacagtgaatgcgtaatgatgcctgttgtgctgggggaccatgtgtcttcaagcactttcccgagaatgcattactcgtcccactatgatactagagacgattgtgctgtggcacatgccggtgccaaaattaatcgaattcccgctaaccttttggatcaatttgaaaaacagctccccctccatagagacgggtttcacacattacagtaccagagaacttctgccgctgcagaacagaggagcgagagcccgggacgtattaggcacctcgtgcactctgtgcagaagctctttacgaagtctcattccctcgaaggctcttctaagtcaaatgcaaacggtaccaaagccgacggacgggctgacgatcaccatcacgcacaccacgctaagcatagcaaaaggtccaagtccaaggaacgtaagcccgaggggaagcccagacccggtatgtcctcttggtggagttcggatgataatctcgactccgacagtacatatcggaccccatccgtcctgaaccgccatcacctgggcccagtggctcactgctaccctgatgccctgcagtccccctttggcgacctcagcctcaaaacttccaaatccaacaacgatgtgaagtgctcagcctgcgaaggattagcactgacgccagatgctaagtacctgaagaggagctcatggagtacactcacggtgagccaagctaaagaggcctaccgcaaatcatcgttaaatttggataaacccctcttacaccaggacgccaagcctgccctgcgaccctgccattacctgcaagtcccgcaggacgagtgggggggatacccaacaggcggaaaagacgaggaaatcccttgtcgcagaatgcgctccggatcctacattaaagcaatgggcgatgaggagagcggtgagagcgactcaagccctaaaacctctcctaaaagtgccattctgccggaacctctcttgaaaagtataggccagcgccctctcggagagcaccaaacacagacctacctgcaagctgcttccgatgtccccgtggggcattctctcgaccccgctgcaaattacaactcccctaaatttaggtctcgcaaccaaagctacatgagggcggtgtccactctatcccaagcatcttgcgtgtcccaggttagtgaggccgaaataaatgggcagttcgaaagtgtgtgtgaatctgtgttcagcgaggtggagagccaggccatggatgctctggatctccctggctgtttcaggaccagaagccacagttacttacgtgctatccaggccggatactcccaagatgatgaatgcatccctatgatgaccccctctgacatcacctccaccatccggtccacagccgctgtgtcatacacaaattataagaagaccccacccccagtcccccctcgcactacgagcaagcctctgatttccgtgacggctcagtcttccaccgaatccacgcaggatgcgtaccaagacagtcgagcgcagcggatgtcaccatggccgcaggactccagaggcctgtataattccactgattcactggacagtaataaagctatgaacctggctctggaaacggcagcagcccaaaggcacctccccgagagccaatcctcttcagtcaggacttccgataaggcaattcttgtgtccaaagctgaggagctgctgaagtcgcgttgctcttccattggaattcaggactccgagttcccagaacaccaaccctatcccagaagtgatgtagagacagccaccgacagcgataccgagagccggggactcagggagtatcactccgttggggtccaagtcgaggacgagaagagacacggcagatttaagcgttcaaactcggtgacggccgcagtgcaggctgatttagaactcgaggggtttcctggacatattacaactgaggataaaggtctccagttcgggtcctccttccagcgccatagtgagccctcgacacccacacagtactctgcagtgaggacagtgcggactcagggcctgttctcatacagggaggattacaggacccaagttgatacttctacccttccgcctcccgatccatggttggagcccgcaattgacaccgtcgaaaccggacgaatgtccccctgtcgacgggatggaagctggttcttgaagctgcttcacgccgaaacgaaaaggatggaaggatggtgcaaagaaatggagagagaagccgaggaaaacgacctcagtgaagagatcctcggcaagattcggtcggcagtggggtctgcccagctgcttatgtcgcagaagttccagcaattttattggttatgccagcagaacatggacccaagtgctatgccaagaccgacatcgcaggatctcgccggatattgggacatgctgcaactaagcatcgaagacgtgtccatgaagtttgacgagctgcaaaggttgagattgaacgattggaagatgatggaatctcccgagcggaaagaagaaaggaaagtgccgccacccattccaaagaaaccgccaaaggggaaattcccgatcacacgcgaaaaatccctagaccttccagaccgacagcgacaggaggcacgcaggcggctcatggctgccaagagggctgctagcttccgtcagaacagtgctagtgaacgggcagattccatcgagatctatattccagaagctcagacaaggctgtag

SEQ ID NO: 220947 - DNA, 2937 bp, Artificial Sequence
  Description of Artificial Sequence: Synthetic coding sequence
tgacccactcaacacttcaacgaagagagatatagtcccgctcctcggagcatgaagggcctgtcaggaagtaggactcagcctccactgtgttcgggccacacttgcggcttggcaccccctgaagactgcgaacacctacatcatgggccagacgccagaccgccatatctgctgtcccccgctgacagctgccccggaggaaggcaccgctgctcccctcggtctagcgttcacagcgagtgcgtgatgatgcctgtggtactcggcgatcatgtaagttcatccaccttcccacggatgcactacagctctcattacgacactagagatgattgtgctgtggcccatgcaggagcaaagataaatcggatccccgcaaacctgcttgaccaatttgagaagcagctaccccttcaccgcgatggctttcacacacttcagtaccagcgtactagcgcggctgccgaacagagatcagagtcacccggtcgaatccgccacctagtccactccgtgcaaaagttgtttacaaaaagccacagtcttgagggatcctccaaatctaacgctaacggcactaaagctgacggccgagcagacgatcatcaccatgctcaccacgccaagcatagcaagcggtcaaaaagtaaagagcgtaagccagagggaaaaccacgccctggtatgagtagctggtggtcatccgacgataacctcgattccgactccacttacagaaccccatccgtcctgaatagacaccacctgggaccagttgcacactgttatccggacgcactacagtcacccttcggagacctctccctgaagacaagcaagtctaacaatgatgtgaagtgctctgcctgtgagggcttagccctcactccagacgcaaagtacctaaaacgaagctcatggagcacccttacagtctctcaggccaaagaggcttaccggaagagtagcctgaacctcgacaagcctcttctgcaccaggacgctaagcccgctctgaggccttgccactatctgcaggtcccacaggatgaatgggggggttatccaactggcggtaaagatgaagagatcccatgtagacgcatgaggtccggatcatatattaaggccatgggagatgaggaatcgggagagagcgattctagccccaaaaccagtcccaaatccgctattctgcccgagcctctgctgaagtcgataggacaaagacccctcggagaacaccagacccagacatacctgcaggcagcgagtgatgtcccagtggggcactcccttgaccctgccgcaaactataactcgcccaagttcagaagccgcaaccagagctacatgcgcgctgtcagtacgttgagccaggcctcgtgcgtctcccaggtgtctgaggctgagatcaacggacagtttgagagcgtctgtgaaagtgtgttttccgaggtggagagtcaggccatggacgccttggatctgcccggttgctttagaaccaggagccactcttacctgcgggctatccaagctggttatagccaagacgatgagtgtatccctatgatgaccccaagcgacattaccagtacgattaggtcgacggctgccgtgtcctacaccaattataagaaaaccccgccacccgtcccaccgagaactacatcaaagcccctaatctctgtcacagcccagagctccaccgaatccacccaggatgcataccaggattcccgtgcccagcggatgtctccgtggccgcaggacagtagaggtctctataactccaccgattccctcgactctaataaagcaatgaacctggccttagaaacagccgctgcccagagacatctcccagaatcacagtctagttctgtccgcacatccgacaaggctattctggtgtcaaaggcagaggagctcctgaagagcagatgttcctccatcgggatccaggtggaaaccgctacagacagcgatacagaaagccggggtttgcgggagtaccattctgtcggagtgcaggtcgaggatgagaaacgccacggcaggttcaagcggtccaattccgttacggctgccgttcaggccgacctcgagctggaaggctttcctggccacatcacaacagaagataagggactacagttcggctcatccttccagaggcactccgagcccagcacacctacccagtacagcgccgtccgcactgtgcgaactcagggcttgttttcctaccgggaagattacagaacacaggtggataccagcacacttccaccccctgacccgtggctggagccagccatagatacggtcgagaccggccgtatgagcccctgcagaagggatggttcttggtttctgaagctactccatgcggagaccaagagaatggagggttggtgcaaggaaatggaacgagaggctgaagagaatgacctgtctgaagaaattttggggaaaatccgaagcgcagttggaagcgctcagttgctaatgtcacagaaatttcaacaattttactggctgtgccagcagaacatggacccgtccgccatgcccaggccgacatcgcaggatctggccggatactgggatatgctgcagctgagcattgaggatgtgagtatgaaatttgacgagctgcagagactgcgactgaatgactggaagatgatggaatctcccgagcgcaaagaggagaggaaggtgccccctcccatccccaaaaagcctccaaagggaaaattccccatcactcgggagaagtccctggatctccccgatagacagcgacaggaggctaggcgcagactcatggcagcaaaacgcgcagcctcttttcgccaaaacagcgcttcagaaagggcggatagcatcgagatctatatcccggaggctcagacaaggctttag

SEQ ID NO: 220948 - DNA, 2562 bp, Artificial Sequence
  Description of Artificial Sequence: Synthetic coding sequence
atgccagttcgcaaacaagatacccagagagcgctgcacctgctggaggagtacaggtccaaactgagccagacggaggacaggcagttgagaagctccatagaacgagttataaatatatttcagtcaaacctgttccaggctctcattgatatacaggagttctatgaggtcaccctgctggacaatcctaaatgcattgatcggtccaaaccaagtgaaccgatacagcctgtcaacacttgggaaatatccagcttaccatcatctactgtgaccagcgaaaccctccctagctctctgagcccgagcgtggagaagtacagatatcaggacgaagatactccccctcaagaacatatctcaccgcagattacaaatgaagtgatcgggcctgaactggtgcatgtttctgaaaagaacctttccgaaattgagaacgtgcatggatttgtatcccatagccacatctccccaatcaaagtgaacggcaccgacgccgactatgagtatgaggagattacactggagcgtggtaattctggcttaggcttctccatagcgggtgggaccgacaacccccacatcggtgacgactcctcgatattcatcaccaagattattaccggaggggcagcggctcaagatgggagactcagggtcaacgattgtatcctgcgggtcaatgaagttgatgttagggacgtcacacattctaaagctgtggaagctctgaaagaagccggttccatcgtgagactttacgttaagaggaggaaaccagtgagcgagaaaatcatggaaatcaagttaattaaaggacctaaaggattgggattcagtattgcagggggtgtgggcaatcagcatattcctggagacaacagtatctacgtaactaaaatcatagaaggcggtgctgcgcataaggacggaaagctccagattggcgacaaactgttggcagttaacaatgtatgtctggaggaggtgacccatgaggaggctgttactgccttaaaaaacacttccgactttgtgtatttgaaagtcgcaaagccaacctccatgtatatgaatgatggatatgcgcctccagacatcacaaacagttcttcccaacctgtagacaatcacgtttccccctcatctttcttgggccagacacccgcttcccccgctcgatatagtcctgtctccaaagcagtgctcggagacgacgagataaccagggagccaagaaaggtggtgctccacagaggatccacaggtctggggttcaatattgttggcggagaagatggggagggcatcttcatcagcttcattcttgctggcggtcccgctgatctgtctggggagctgagaaagggcgatcgaattattagtgtgaattctgtggatcttagagctgccagccacgaacaggccgcagcggcactcaagaacgcaggccaggccgtcacaattgttgcccagtacagacccgaagaatactcccgatttgaggcaaagatccacgacctcagggagcagatgatgaatagcagcatttcaagtggctctggtagtcttcggacctctcagaaaagatccctttacgtacgggctctgttcgattacgacaagaccaaggactcagggctgccctcgcaggggctcaattttaaatttggcgatattctgcatgtgattaacgccagtgacgacgaatggtggcaggctaggcaggttactccagatggggagagcgacgaggtcggagtgatcccctcgaaaagaagggtggaaaagaaagaacgggcaaggcttaagacagtgaaattcaattctaagacgagagacaagggagagatccccgatgatatgggtagcaaaggcctgaagcacgtgacttctaatgccagcgattccgagtcgagctaccgaggacaggaagagtacgttttgtcttacgaacccgtgaaccagcaggaggtgaactatacacgccctgtgattatcctgggcccaatgaaggacaggataaatgacgacctaatttccgagttcccggacaagtttggatcctgcgtcccacacactactaggcccaaaagggattacgaagtcgacggacgggattatcattttgtgacatcacgggagcaaatggagaaggacattcaggagcataaatttattgaggcgggtcaatataataatcatttatacggaactagtgtacagtctgtccgtgaagtggctgaaaaaggcaaacattgtatactagatgtgagtggcaacgcgattaagcggttacaaatagcacagctgtatcctataagcatctttataaaaccgaagagcatggagaatatcatggaaatgaacaagcgactgaccgaagaacaggccaggaaaacatttgagcgtgccatgaaactggaacaggagttcaccgaacactttacagccattgtgcagggtgacaccttggaagatatctacaaccaggtcaaacagatcattgaggagcaaagtggcagctacatctgggtgccggcaaaagagaagctgtag

SEQ ID NO: 220949 - DNA, 2781 bp, Artificial Sequence
  Description of Artificial Sequence: Synthetic coding sequence
atgcctgttcgtaagcaggacacccagagagccctgcacctgctggaagagtataggtccaaactcagccagacagaggacagacagctcaggagctccatcgagcgagtgattaatatcttccaaagtaatctgttccaggccctaattgatattcaggaattttatgaggtaaccctgctcgacaatcctaaatgcatcgaccgctctaaaccaagtgagccgattcaacctgtgaacacctgggagatctcgtcgctccccagctcaaccgtcacctccgagacactgccaagcagtctgtcgccctctgtagagaagtaccggtatcaggacgaggatacaccaccacaagagcatatttcgccacagatcaccaatgaagtgataggcccagagctggtgcacgtgtccgaaaagaatctatccgaaatagaaaatgttcacggcttcgtgtctcattcgcacatctctcctatcaaacccacggaagcggtccttccaagcccgccaactgtaccagtcatcccagttttacccgtgccggctgagaatacagttatcctccccactataccccaggccaatccacctcccgtcctggtcaacactgatagtctagagaccccgacatatgttaacggcacagatgccgactacgaatatgaagaaattacgttagaaaggggcaattccggactcggattctcaatcgctggcggaacagataaccctcacatcggagacgactcatctatttttattacaaaaatcattaccggcggtgccgctgcccaggatggcaggctacgggtgaatgactgcatactcagggttaacgaggtcgatgtgagagacgtgacccactccaaagccgtggaggcactgaaggaggcaggttcaattgtgaggctgtatgtaaagcggagaaagcccgtctcggagaagatcatggagattaaactgattaaaggccctaagggcctgggcttttcgatagcgggtggtgttgggaatcaacatatccccggtgacaacagcatctatgttacgaagataatcgagggaggcgctgcccataaggacggaaaattgcagattggagacaaattactcgccgtgaacaatgtgtgtttagaggaagtcacacacgaggaagctgtgacagccctgaagaacacttccgactttgtttacctcaaggtggctaagcccaccagtatgtatatgaacgacggatacgcccctccagatataaccaactcttcttctcaacctgtcgacaaccatgtcagtcctagttctttcctggggcagacccctgcatccccggctagatactccccggtatctaaagcggtcctgggcgacgacgaaattaccagagagcctcggaaagtcgtattgcacagaggcagtaccggcctcggattcaacatcgtgggcggtgaggacggggagggcatctttatcagtttcatacttgcaggcggtccggcagatctgagtggagaacttcgaaagggcgaccgaatcatctctgtgaactctgtggatttaagggccgctagtcacgaacaggcagccgcagccctcaagaacgccggacaggcagtgaccatcgtggcacaataccgcccagaggagtattcccgcttcgaagccaaaatacacgatctgagagagcagatgatgaacagtagcatctcaagtggcagcggctccctacgaactagtcagaagcgtagcctgtatgtccgcgctctgttcgattatgacaagaccaaagactcaggcctgccaagtcagggactgaatttcaagtttggtgacatcctgcacgtgattaacgcttcagatgacgaatggtggcaggccaggcaggtgacccctgatggcgagagcgatgaggtcggcgtcattccatccaaaaggcgcgtggagaagaaagaacgagcaaggcttaagacggtaaagtttaattctaaaacgagggacaaagggcagtctttcaatgacaagaggaagaaaaacctgttcagtcggaagtttcctttttataagaataaggatcagagtgaacaggagacctcagatgctgaccaacacgttacttctaacgcgagcgactccgagtccagctataggggccaggaagagtatgtcttgtcatatgaacctgttaatcaacaggaagtgaattatacgcgacctgtgatcattctcggccctatgaaggaccgcatcaacgacgacctgatctccgagttccccgacaagttcggctcttgtgtgccccacaccactagacccaaaagagactacgaagtcgacggtagagactaccatttcgtgacttcgcgcgagcagatggaaaaggatatccaagagcataagttcatcgaagccggacagtacaacaaccacctctatgggacatccgtgcagagcgttagggaagtggccgaaaagggcaagcactgcatcctggacgtaagtgggaacgctatcaagcgactgcagattgcacagctatacccaatctctatctttatcaagcccaagagtatggaaaatatcatggaaatgaacaagagactgactgaggaacaggcccgtaagacattcgaacgtgctatgaagcttgagcaagagttcaccgaacacttcaccgcaattgtgcagggggacacactagaagatatctacaatcaggtgaagcagattatcgaagaacaaagtggctcttacatctgggtgcccgcaaaagaaaagctctag

SEQ ID NO: 220950 - DNA, 2682 bp, Artificial Sequence
  Description of Artificial Sequence: Synthetic coding sequence
atgcccgtacggaagcaggacacacagcgggctctacacctcttggaggaataccgctcgaagctgtctcaaacagaggatagacagctgagatcctcaattgaaagggttattaacatcttccagagcaatctgttccaggcgctgatcgatattcaagaattctacgaggttactttgcttgataatcccaaatgtattgacaggagcaagccaagtgaacctatacagcctgtgaacacatgggaaattagcagcctcccgtcgtccactgtaactagtgaaaccctcccaagtagtcttagcccctcagtggagaagtaccgctatcaggacgaagacacccccccacaggagcacatttccccacaaatcaccaatgaagttattggacctgaactcgtccatgtgagcgaaaaaaacctctccgagattgaaaacgttcatggcttcgtcagccatagccacatctcacccatcaaggctaaccctcctcccgtgctggtcaataccgattcactcgaaacgcccacatacgttaacggtaccgatgccgactatgaatacgaggaaattacattggagagaggaaactctggcttaggtttcagcattgccggaggtaccgataatccccacataggtgatgactcctctatctttatcactaagattatcaccggaggtgccgctgcacaagacggcagactgcgagttaacgactgcatactgagagtgaatgaggtggatgtgcgggacgtgacccattccaaggcggtcgaggcgctgaaagaagcaggttctatcgtcagactgtatgtgaaaagaaggaagcctgtttctgagaagattatggagatcaaactgatcaaggggccaaaaggtcttgggtttagcatagcaggcggtgtcggcaaccagcacatccccggagacaattcaatctacgtaactaagatcatcgagggcggtgccgctcacaaggatggcaagttgcagattggagacaagttactggctgtgaataatgtttgcctggaggaggtcacgcacgaagaggcagtcacagccctgaaaaacaccagcgattttgtttatcttaaagttgcaaagcccacaagcatgtatatgaatgatgggtacgccccacctgatatcaccaactctagctcacaacctgtggataaccacgtgagcccatcttcatttttaggtcagacccctgcttcccctgcaaggtactcacccgtgagtaaagccgttctcggagatgatgagatcacccgagagccgaggaaagtcgtgctgcacagaggatcaaccgggctgggatttaacattgtcggtggagaggacggagaaggaatcttcatctccttcattcttgcgggtggaccagccgatctgagtggagagctacgcaagggggaccgaattatctctgttaactctgtcgatctcagagccgcttcacacgaacaggctgctgcagctttgaagaatgcgggtcaggccgttacaatcgttgcccaataccggcctgaagagtacagtcgattcgaggcaaagatccacgacctgagggaacagatgatgaatagcagcatatcctccggctctgggtctcttagaactagccagaaacggtctctctatgtgagggcactgtttgactacgataagaccaaagattcagggctgccaagtcagggactgaatttcaaattcggcgacatcctccacgtgatcaacgctagtgatgatgagtggtggcaagctagacaggtaacccctgatggcgagtctgacgaagtcggagtcattccctcaaagcgtcgggtcgaaaaaaaagaacgtgctcggctgaaaaccgtcaagtttaattccaagacgcgtgataagggtcagagcttcaacgataagcgcaaaaagaacctgttttccaggaagtttcctttctacaagaataaggaccagagcgaacaggaaacctctgatgctgaccagcacgtgactagtaatgccagcgacagtgaatcttcatacaggggccaggaggagtacgttttatcttacgagcctgtgaaccaacaagaggtcaattacaccaggccagtcatcattttagggccaatgaaagatagaatcaatgacgacctaatctctgagttcccagataagtttgggagctgcgtgccccacaccactagaccgaaaagagactatgaggtggacgggagagattaccactttgttactagcagggagcagatggaaaaggatattcaggagcacaaatttattgaggccggtcagtataacaaccacctttacggtacaagcgtgcaatcagttcgcgaggttgccgagaagggaaaacattgcatcctggatgtgtctggcaacgccattaaacggttgcagattgcccagctttaccctatctcaatcttcatcaaaccgaagagtatggaaaatatcatggagatgaataagaggcttacggaggaacaggcacggaagacatttgaacgagctatgaaattagagcaagagttcacagaacactttacagccatcgttcagggagatacattggaggatatttataaccaggtgaagcagatcatcgaggagcagtctggcagttacatctgggtccccgcaaaagaaaagctctag

SEQ ID NO: 220951 - DNA, 2754 bp, Artificial Sequence
  Description of Artificial Sequence: Synthetic coding sequence
atgcccgtgcggaagcaggatacacagagagcgctgcacctgcttgaagaatacagatccaaactgagccaaaccgaggatcggcaactgcggtcatccattgaacgtgtcattaatatatttcagtccaatctctttcaggccctaatcgacattcaagaattttatgaagtgactctcctggacaaccctaagtgtatcgacaggagcaaaccctccgaaccgattcaacctgtgaacacttgggagataagctccctgccgtcatcaaccgttacaagcgagaccctgcccagctcacttagtccctccgtcgagaagtacagataccaagatgaggacacccctccgcaggaacacatatcccctcaaataaccaatgaagttatcggccctgagttagtccacgtgtcagaaaaaaacctctccgagattgagaacgtgcatggctttgtctcacacagccacattagtccaattaagccgaccgaggctgtgctgcccagcccaccgactgtgcccgtgattcctgtcctcccagtgcctgcagagaacactgtgatcttgcccactatcccccaggccaatccgccaccagtcttggttaacactgatagcctggagactccaacttatgtgaacggaacggacgccgattacgaatacgaggagataacactagagcgcggaaattccggactgggcttctcaatagcaggcggaacagataatcctcatatcggagacgactctagcatctttataaccaagatcattaccgggggtgcagcggctcaagacgggaggctcagggtcaatgactgtatcctgcgggtcaacgaggtggacgtccgagacgtgactcactcaaaagcggtggaagcgctgaaagaagccggaagtatagtgcggttgtacgtaaagagaagaaaaccagtctccgagaaaatcatggagatcaagcttatcaagggtcccaagggactagggttttccattgccggaggggtagggaaccaacacatccctggcgacaactctatctacgttaccaagatcatcgagggaggtgccgcacataaagatgggaagctacagattggtgataagctcctcgctgtgaataatgtatgcctcgaggaggtcacacacgaagaggcagtcaccgccttgaagaatacttccgattttgtatacttgaaagtggctaagccaacaagcatgtatatgaacgacggttacgcccctcccgacatcacgaactctagcagtcaacccgtggacaatcacgtgtctccgtcatctttcttagggcagacccctgccagtcccgctcgttattcccccgtctcaaaggcagttcttggtgatgacgaaataacgcgagagcctagaaaagtggtactgcatagaggatctaccgggctcggctttaacatcgttggcggagaggacggagagggaattttcatttcatttatactggcgggaggaccagccgatctctccggggaactcaggaagggggacagaatcataagcgtcaatagtgtggacttaagagctgccagccacgagcaggctgccgcagcactcaagaacgcagggcaggcagttaccatcgtcgcccagtatcgccctgaagagtattccagatttgaggccaaaatccatgacttgcgtgaacagatgatgaactcttccatcagtagcggcagtggttctctgcggacaagccagaaaagatctttatacgtgcgtgccctattcgattatgacaagacgaaggattcaggcctgccaagtcaaggactgaatttcaagttcggggacatcctccatgtgatcaatgcctcggatgacgagtggtggcaggcccgacaagtgacccctgatggggaatcagatgaggtgggagtgatcccctccaagagaagggttgagaaaaaagagagagcaagattaaagacggtgaagtttaactcaaaaacgcgcgacaagggagagattcccgacgatatgggctctaagggtctgaaacatgtgacaagcaatgcctctgattccgaaagctcttatctaatcctaatcaccgatgagtatggttgctccaagggtcgtggtcaggaagagtacgtgctctcgtacgaaccagtgaaccagcaggaggttaattatactcgacccgtcatcattctgggaccgatgaaggatcgaatcaatgacgaccttatctctgaatttcctgataagtttgggtcctgcgtgcctcacaccactagacctaagcgggattatgaggtggatggtagagactaccatttcgtgacttctcgtgagcaaatggaaaaggacattcaggagcacaagtttattgaggctggccagtataataatcatctgtatgggacctcagtgcagagcgtgcgggaagtggcagaaaagggcaagcattgcatcttagatgtgtctgggaacgcaatcaagcgccttcagatagcacagctctacccaatatccatatttatcaagcctaaatctatggagaatatcatggagatgaataaaaggttgaccgaggaacaggccaggaaaaccttcgagcgtgctatgaaactcgaacaggaatttactgagcatttcaccgccatcgtacagggggacacactggaagacatttacaatcaagtaaagcaaatcatcgaggaacagtcagggtcttacatctgggtgccagctaaggaaaaactgtag

SEQ ID NO: 220952 - DNA, 2676 bp, Artificial Sequence
  Description of Artificial Sequence: Synthetic coding sequence
atgcccgtgagaaaacaggatactcagcgggcactacatctgctggaggaataccgatccaaattgagtcagaccgaggaccggcagctcaggagtagtatcgaacgcgtgataaatatcttccaaagcaacctatttcaggccctgatcgacatccaggaattttacgaggtcaccctcctggataaccctaagtgtattgaccggtccaaaccttccgagccgatacagccggtgaatacatgggagatatcatcattgccaagtagcactgttacctcagaaaccttaccctcgagcctgagcccaagtgttgagaaataccgttatcaggatgaagacacccctccgcaggagcacataagtccccaaatcacgaacgaagtgatcggcccagaattagtgcacgtgtcagagaaaaacctctcggagatagaaaacgtgcatggctttgtttctcattctcacatatctcccatcaaacctactgaagccgtgctgccttcccccccaaccgtgcctgtcattcctgtgctccctgtgccggctgagaacaccgttattctccccacgatccctcaggccaacccaccacctgttctggtcaataccgatagcctcgaaacccccacttatgtgaacgggaccgatgcagactacgaatacgaagaaattacacttgagcgtggaaactccggtcttggttttagtattgctgggggaaccgataacccacacattggggatgattctagcatttttatcaccaaaatcataactggaggggctgccgctcaggacggcaggctgcgcgtgaatgactgcatcctaagggttaatgaggttgacgtgagagatgtcactcactcaaaggccgtcgaggccctaaaagaagccggtagcattgtcagactatacgtcaaacgcagaaaacccgtgtctgaaaaaatcatggagattaaactgatcaagggccctaaaggactcggcttcagcatcgctggaggagtgggaaatcaacacatccctggagacaattccatctacgtaacgaagattattgagggaggcgctgcacacaaggacggtaagctgcaaatcggggacaagctcctggccgtgaataacgtatgtttggaagaggtgacccacgaagaggcggtgactgcactcaagaataccagtgacttcgtgtatctgaaagttgccaagcctaccagcatgtacatgaacgatgggtacgcaccaccagatatcaccaactcaagttctcagccagttgacaaccacgtcagcccgagctccttcttgggacagactcctgcttcccctgcacggtactcgccagtcagtaaggcagtgttaggagacgatgaaatcactcgggagccacgtaaagtggtcctccaccgtggatccactgggcttggctttaacattgtagggggtgaggacggcgaaggaatcttcataagcttcatcctcgcaggcggacccgcagatctgagtggagagctgaggaagggcgaccgaatcatttcagtgaattctgtcgatctcagggctgcctcccatgagcaggccgcagccgctctcaagaacgccggacaagctgttacaattgtcgcacagtataggcctgaagaatattcaagatttgaggctaaaatccacgatctacgggaacagatgatgaattccagcatttcctcaggaagcggatcgctcagaaccagtcagaaaaggtccttgtacgtcagggcacttttcgattacgacaaaacaaaggacagcgggttaccctcacaagggcttaatttcaaattcggtgatatattgcatgtcattaatgcgagcgatgatgaatggtggcaggcgcgtcaggtgactccagatggcgagagtgatgaggtaggcgtgataccatctaagaggagagtggagaaaaaggagagagccaggctgaagaccgtgaagttcaattccaaaacgagggacaagggggagattccagacgacatgggctctaaggggctaattggaggacaggaggagtatgtgctcagttacgagcctgtcaatcagcaggaagttaactatacaagacctgtcattatcctgggcccaatgaaggaccgaatcaatgatgacctcatatccgaatttcccgacaagtttggcagctgcgtgccacatacaacgagacccaaacgagactatgaagttgatgggagagactatcacttcgtcacttctcgcgagcagatggaaaaagacatccaggaacacaaattcatcgaggcaggacagtacaataatcatctctacggcacttcagtccaaagcgttagagaggttgccgagaaagggaagcactgcattctcgacgtgtccgggaatgctataaagaggctgcaaatcgcccaactctatcccatttccatctttatcaaaccaaagtcaatggagaacataatggaaatgaataagagactcaccgaggaacaggcgaggaaaaccttcgaacgagccatgaagttagagcaagaatttactgagcacttcacagctattgtccaaggggatacacttgaagacatctataatcaggtgaagcagattattgaggagcagagcggatcgtacatctgggtcccggctaaggagaagctctag

SEQ ID NO: 220953 - DNA, 627 bp, Artificial Sequence
  Description of Artificial Sequence: Synthetic coding sequence
atgccagtgaggaaacaggatacccagcgcgcattacacttgctcgaagaataccgctcaaaactttcccaaacagaggatcgccaattacgatcttctatcgagcgggtcattaatatattccaaagtaacctgtttcaggcgctcattgacatccaggagttctacgaggtcactttgttggacaacccgaagtgtatcgacaggtccaagccttcagaacccatccagcccgtgaacacctgggaaatatctagcctcccctcatcaactgtcactagcgaaaccctgccgagcagcctgtctccgagcgtagaaaagtaccgctaccaggacgaagatacccccccacaggagcacattagcccacagattactaacgaagtcatcggtccggaacttgtgcacgtgtctgaaaaaaacttaagcgagattgaaaatgtgcacggatttgtcagtcattctcacattagcccaataaagcctaccgaagcagtgctgccatcacctcccacagtgcctgttatccccgtgttgcctgtacccgcagagaatacagttatactccccactattcctcaggcgaaccctcctccagtgctcgtcaataccgactccctcgaatag

SEQ ID NO: 220954 - DNA, 2616 bp, Artificial Sequence
  Description of Artificial Sequence: Synthetic coding sequence
atgcctgttcgcaagcaagacacacagagagctctgcatctgcttgaagaatatcgcagcaagctctcgcagactgaagaccggcagctcagatcttccatcgaacgggtcatcaatatcttccaaagcaacctttttcaggctctgatcgacattcaggaattctatgaagtgacactactggacaatccgaaatgtatagaccgcagcaagccttctgagccgatccagcctgtcaatacctgggagataagcagcctgcccagtagcacagtcaccagtgaaaccctgccatcatcccttagccccagtgtcgagaaatataggtatcaagatgaagacaccccccctcaagagcatatcagcccgcagatcacaaacgaagtgatagggccagaactggtacacgtgagtgagaaaaacctcagtgaaatcgaaaacgtacacgggttcgtttcgcacagtcatatctctcccattaaagccaatccgcctccggttttggtaaataccgactccctcgagacacctacgtatgttaatggtaccgatgccgactatgaatacgaagagataactctcgagaggggcaatagtggacttggcttctcaatcgctggcggaaccgataacccgcatatcggcgacgattctagtatctttatcaccaagatcattacagggggtgccgcagcgcaggacgggcgactgagggttaacgactgcatacttagggtgaacgaagtggacgttagagatgtgactcattctaaggcagtcgaagccctcaaagaagcaggctccattgtccggttgtatgtgaagcggaggaagccagtatccgaaaagattatggagatcaagctgatcaagggtcccaagggtctgggtttcagcatagccggaggagtggggaatcagcacattcctggggacaattctatctatgtgaccaaaatcatagagggaggagcagctcataaggatggaaaactgcagattggcgacaaactgctcgcagtaaacaatgtgtgtcttgaagaggtgacccacgaagaggcagtcaccgcattgaaaaacacaagcgatttcgtctatctgaaggtggccaaaccgaccagtatgtacatgaacgacgggtatgcccctccagacataaccaactctagtagccagcccgttgataaccacgtatcaccgtcctcattcctgggtcagacaccagcaagccccgcacgatacagcccagtgtcaaaggctgtcctcggcgatgatgagatcacgagagagcctcgtaaggtggtgctacaccgtggatctacgggcttaggcttcaatatcgtgggaggggaggacggagagggcatattcatcagttttatactggctgggggaccagctgatctgagtggcgaactgagaaaaggagacagaattataagtgtgaattccgtcgatctcagggctgctagccatgagcaggctgcagcagcactcaaaaatgccggacaggcggtgactattgtagctcagtacagacccgaagaatatagtcgctttgaggcaaaaatccacgacctacgggaacaaatgatgaactcctcaatctcttcaggttcagggtctctgaggacttcccaaaagagatctctctacgtcagggcactcttcgattatgacaagactaaggacagtggccttcccagccaggggctgaacttcaagttcggtgatatcctccatgtcattaatgcctctgacgacgagtggtggcaggcgagacaagtcacacccgatggcgagtccgatgaggtgggggtgattccttcaaagcgtcgcgtcgagaagaaagagagggctaggcttaaaactgtcaagtttaacagtaagaccagggacaaaggggagatcccggatgacatgggaagcaaaggcctgaagcatgtgactagtaacgctagcgactccgaatccagctaccgcggacaggaggagtacgtgctgtcttatgaacctgtgaaccaacaggaagtgaactatacccgccctgtcataatcctgggcccaatgaaggataggattaacgatgacctgatatcggagttccccgacaaattcggcagctgtgtaccccacaccacgaggcctaagagagattatgaggtggacggcagggattaccatttcgtcactagcagagaacagatggagaaagatatccaagaacataagtttatagaggccggacagtacaacaatcatttgtatgggacgtctgtacagagcgtgcgggaggtggccgagaaaggaaagcattgcattctggacgtgagcggcaatgctatcaagaggttgcagattgcgcagctgtatcctatttccatctttatcaagccaaagtctatggaaaacatcatggagatgaataagagactcacggaggaacaagcccgtaagacttttgagcgggctatgaagttagagcaagagttcacggagcactttacagccattgttcaaggtgataccctcgaggatatatataatcaggtcaagcaaatcattgaagagcagtctggctcttacatttgggtgcctgccaaagagaaactttag

SEQ ID NO: 220955 - DNA, 321 bp, Artificial Sequence
  Description of Artificial Sequence: Synthetic coding sequence
atgccggtccggaaacaggacacccagcgggcactgcatctgctcgaggaatatagaagtaaacttagtcagacggaagaccgccagctgcggtcgtccattgagcgggtgatcaacatcttccagtctaatttattccaggccctaattgatattcaggaattctacgaggtgaccctgctggataatccaaagtgcatcgaccggagcaaaccatccgaaccaatacaaccagttaacacatgggaaattagttccctgcctagctccaccgttacgtccgaaaccttgccatcttcgctatcaccctccgtggaatag

SEQ ID NO: 220956 - DNA, 1113 bp, Artificial Sequence
  Description of Artificial Sequence: Synthetic coding sequence
atgccagtaagaaagcaggatacacagcgcgctctccatctcttggaggagtataggtccaagctgtcccaaactgaggataggcagctgagaagttccatagagagagtgattaacatcttccagtccaacctgttccaggctttgattgacatccaagaattttacgaggtgacattgttggacaatcccaagtgcattgataggagcaaacctagtgagccgattcagcccgtaaacacatgggagatatccagcctcccgtcctctacggtgaccagcgagaccttgccttcctctctgagccctagcgtcgagaaatataggtaccaggatgaggataccccgccacaggagcacatctctccgcagattacaaatgaggtgatcggaccagagctcgtgcatgtgtcagaaaagaaccttagcgaaattgagaacgtacacgggttcgtcagtcattcccatatcagccctataaaagtgaacggcaccgatgcagactacgagtatgaagaaatcactctcgaaagagggaatagtgggttggggttttccattgcaggtggcaccgataacccacacattggggacgactctagcatcttcatcacaaagattatcaccgggggtgcagcagcccaggacggcaggctgagagttaacgattgtattttgcgggtgaatgaagttgacgtcagagatgtgactcacagcaaagccgtggaggccctgaaggaggccggtagtattgtcagactctacgtaaagcgcaggaagcccgtgagcgagaagatcatggaaattaaactcatcaagggacctaagggcctggggttttcaatcgccggaggcgtgggtaaccagcatatccccggagacaacagcatctatgtgacaaagattatcgagggaggggctgcccataaggatggcaagctgcaaatcggagataaattgctcgcggtgaataacgtctgtctcgaagaggtgacccacgaggaggccgtcactgcactcaaaaatacttctgactttgtatacctcaaagtggcgaaacctacttctatgtatatgaatgatggctatgccccaccagacattacaaattag

SEQ ID NO: 220957 - DNA, 2715 bp, Artificial Sequence
  Description of Artificial Sequence: Synthetic coding sequence
atgcccgtacggaagcaggacacacagcgggcattacacctgctggaggagtaccgctccaagctttcgcagaccgaggatcggcaattgagaagcagcatcgagagggtgatcaacatttttcaatccaacctgtttcaggctctgatcgacattcaggagttctatgaagtgacactgttggataatcctaagtgcatcgaccggagcaaaccatcggagcccattcagccagtgaacacttgggaaatctcgagcctgccatcgtccacagtgaccagcgagacgttgcctagttcacttagtccatccgtggaaaagtataggtatcaggatgaggatactcctcctcaggagcatatatcacctcagatcaccaacgaggtgattggcccagaactggtccacgtgagcgagaagaaccttagcgagatcgagaatgtccacggctttgtgtcgcattcacatatctctcctatcaagcccaccgaggcagtgttgccaagtcccccaaccgtcccggtaattcctgtcctaccagtcccagctgagaatacggtgatcctgccgaccataccgcaggccaatccgccacctgtcctcgtaaacactgacagtctcgagaccccgacttacgtcaacggcactgatgcggactatgaatatgaggaaattacacttgaacggggaaatagtggcctcggattcagcatagctgggggaacagacaatccgcatataggtgatgactcctctattttcatcaccaagatcattactgggggagcagccgctcaggacggcagactgagggtcaacgactgcatattgcgcgtgaacgaggtcgacgtgagggatgtaacacactccaaagccgtcgaggcactgaaagaggcgggttccatagttcgattgtacgtgaaacggaggaagcccgtctctgaaaaaatcatggaaatcaaactgatcaagggacctaagggactcggcttttccattgccggtggggtgggaaaccagcatatcccaggggataacagcatatatgtgacgaaaataattgagggcggtgctgcgcacaaggatgggaagctgcaaattggagataaacttctcgcagtgaacaatgtgtgtttagaagaggtcacacatgaggaagccgttaccgccctgaaaaacacaagcgacttcgtgtacttgaaagtggctaaacccacgtccatgtatatgaatgatggatacgcccctcccgatatcacgaacagcagtagccagcccgttgataatcatgtgtcccctagctccttcctgggacagacccctgcgtcccctgcaaggtactcccctgtatccaaggcagttttgggcgatgacgaaatcacccgtgaaccaagaaaggtagtgttgcacagaggaagcaccggacttggttttaacattgtcggaggcgaggacggagagggaattttcatttccttcatcttggccggtggcccagcagacctatcgggtgagctgcgaaagggcgaccggatcataagtgtgaatagcgtcgacttaagggccgcatcccacgagcaagcagccgctgcgctcaaaaacgcgggtcaagccgtcaccattgtggcccagtatagaccggaggagtactcgagattcgaagccaaaatccatgacttgagagagcaaatgatgaattcttcgattagtagcggttcggggtccctgcggacaagccagaagcggtcactctacgttcgcgctttgtttgactacgacaagaccaaggatagtggcctgccctcccagggattaaattttaaattcggcgacatcctgcacgtaatcaatgcatctgatgacgaatggtggcaggctcgccaggttacccccgatggcgagtccgacgaggtgggcgtcattccttccaagagacgtgtggagaagaaggagagggcccgtctgaaaaccgtgaaattcaactcgaagactcgggataagggtgagatccccgatgatatggggagtaagggtttgaaacacgtcaccagcaatgcatccgacagtgagtcttcctatagaggacaggaggagtatgttttgtcctatgagcccgtgaaccagcaggaggtgaattatactagacctgttatcattctcggcccaatgaaagatcggattaacgacgatctgatttccgagttccctgataaatttgggtcatgtgttccacacactactcgaccgaaacgtgactacgaggtcgacgggagggattaccactttgtgacttcccgtgagcaaatggaaaaagatatacaggagcacaagttcattgaggcaggacagtacaataaccacctgtacggtacaagcgttcagtccgtgcgggaagtggctgaaaaggggaagcactgcattctggatgtaagtggaaatgcaatcaaaagactccagattgcacagctatacccaattagcattttcattaagcccaaatcgatggaaaatattatggagatgaacaaaaggttgacggaagagcaggcaaggaagacattcgagcgcgctatgaaactggaacaagaattcactgaacatttcacagccatcgttcaaggtgatactctggaagatatttacaatcaggtgaagcagatcatcgaagagcagtctgggagctacatctgggtgccagcgaaggagaagctgtag

SEQ ID NO: 220958 - DNA, 465 bp, Artificial Sequence
  Description of Artificial Sequence: Synthetic coding sequence
atgcccgtgcggaagcaggacacccagcgggctctgcacctcctggaggagtacagatccaaactgagtcaaaccgaggaccggcagctgagaagttcaatcgaacgcgtcatcaatatttttcagtctaacctctttcaggcgctcatagacatccaagaattctacgaggtgaccctgctggataatcccaagtgcatagaccgatctaaaccttcagagcccatacagccagtgaatacatgggagatctcctccctacctagtagcacagtcacatctgagacactcccctcgagcctgagtccttcagtggagaaataccggtatcaggacgaagacacaccacctcaagagcacatatccccacaaatcaccaacgaggtgattgggccagagctggtgcatgtttcagagaaaaacctgtcagaaattgaaaatgtgcatgggttcgtctcacactag

SEQ ID NO: 220959 - DNA, 2562 bp, Artificial Sequence
  Description of Artificial Sequence: Synthetic coding sequence
atgcctgtgcgcaaacaggacactcagcgagcactgcacttactggaggaataccggtccaagctctcacaaacagaggatcggcagctccgatcctctatcgagcgggtcataaacattttccagtctaacctattccaggctttaattgacatccaggaattctacgaagtgactctgttggataatccaaagtgcatcgatcgcagtaagccctcagagccaattcagccagtgaatacgtgggaaatatcatccctgcctagtagtaccgttactagtgagacgctgcccagttccctcagtcccagcgtggagaagtatcgttaccaggacgaagatacaccgccacaggagcatatttcaccccagataactaacgaagtcataggaccggaacttgtgcacgttagcgagaagaacctttctgagatcgaaaatgtgcatggctttgtatcgcacagccacatttcccctatcaaagtcaacgggacagacgctgactatgagtatgaggagattacactggaaaggggtaatagtgggctgggattcagcattgcaggaggtaccgacaacccgcacattggggatgactcttctatcttcatcactaaaatcattaccggtggtgccgctgcgcaggatgggagactgcgcgttaacgactgcatcttgagggtaaatgaggtggatgtgagggacgtgactcatagtaaagccgtcgaggcactcaaagaagccggaagcatcgtgcgcctgtatgtgaaacgacgcaagcctgtgtcagaaaaaatcatggaaatcaaactgattaaggggcctaaaggacttggtttcagcatcgccggaggtgttgggaatcagcatatcccgggagataactctatatacgtcaccaaaattatagagggtggagctgcccacaaagacggcaagctgcagatcggggataaactgcttgccgtcaacaacgtttgtttagaggaagtgacgcacgaagaggctgtaactgctctgaaaaacaccagtgactttgtgtacctcaaggtcgccaagcccacttccatgtacatgaatgacggctatgcgcctccggacatcacaaatagctcttctcagcctgtcgacaatcatgtgagcccatctagtttcttgggacagactcctgccagtcccgctcgttattctccggtgagcaaagccgtgctcggtgacgacgagatcacgcgcgaaccacgcaaagtggtgctgcatcgagggtccacggggctggggttcaacatcgtgggtggcgaggatggcgaagggatctttatcagtttcattttagcaggagggcctgccgaccttagtggagaactgagaaaaggggaccgcatcatcagtgtgaactccgtggatctgcgggcagctagccacgagcaggctgccgcagccttaaaaaacgccggtcaggcagttaccatcgttgcccagtacaggccagaggagtactccaggttcgaggctaagatccatgaccttcgtgagcaaatgatgaattcctccatttcttcgggcagtgggtctcttcgcacatctcagaagcgttccctctacgtccgggcactgttcgactatgataaaactaaggatagcggtctcccaagccaagggctgaacttcaaattcggagacatcctgcacgtgatcaacgcctccgatgatgaatggtggcaggctagacaagtgacacccgacggggagtctgatgaggtcggagtgatccccagcaagaggcgggtcgaaaagaaggaacgtgctcggctgaagaccgttaaatttaattccaagacacgggataaaggcgaaattccagacgacatgggttccaaaggtctaaaacatgtgacctccaacgccagcgattctgaatcatcttacagaggacaggaggaatacgtcctctcgtatgaacccgtgaaccaacaggaagtgaattacacccggccagttattatacttggcccaatgaaggatcggatcaacgacgatctcatatccgagtttccagataagttcggctcctgcgtaccacataccacccgccctaaacgggattatgaggtggacggccgagactatcacttcgtcactagccgagagcagatggagaaggatatccaagaacacaagtttattgaagccggacagtacaacaatcatttgtacggcactagcgtgcagtcagtccgggaggtcgcagagaaaggcaaacactgtatcctggatgtgtccgggaacgccattaaacgactccagattgcccagctgtatcccattagcatctttataaaacccaagtctatggagaacataatggaaatgaataagcgactgaccgaagagcaggccaggaagacctttgagcgcgcaatgaagctggagcaggaatttaccgaacactttactgctatcgtgcagggcgacacactggaggacatttataaccaggtgaagcagatcatcgaggagcagtctgggtcatacatctgggtgcccgcaaaggagaagctgtag

SEQ ID NO: 220960 - DNA, 111 bp, Artificial Sequence
  Description of Artificial Sequence: Synthetic coding sequence
atgccagtgcggaagcaggacacccaacgtgccttacatctattggaggagtataggtccaaactcagccagactgaagaccgtcagctaagaagcagtattgagcggtag

SEQ ID NO: 220961 - DNA, 372 bp, Artificial Sequence
  Description of Artificial Sequence: Synthetic coding sequence
atgcccgttcgtaagcaggacacccaacgggcactacatctactggaagagtaccgttcgaagttgtcccagactgaggaccggcagttgaggagctccatcgaacgggtgattaacatctttcagtctaacctgtttcaagcccttatcgacatccaggagttctacgaggttactctcctcgataatccgaaatgcatcgacaggtctaaaccttcagaacccatacaacctgtgaatacttgggagattagctccctgccctcttcaacggtcaccagcgagacgctcccaagttcactttccccaagcgtagagaagtaccgttatcaagatgaggacaccccaccccaggagcacatatccccttag

SEQ ID NO: 220962 - DNA, 2715 bp, Artificial Sequence
  Description of Artificial Sequence: Synthetic coding sequence
atgcccgtgagaaaacaggatacgcagagggccctgcatttactggaagagtacaggtctaagctatcccagacagaggaccgacaactaagatcatcaatagaacgcgtcataaatattttccagagcaacttatttcaggccctgattgatatccaggagttctatgaagtcaccctcctggataaccctaagtgcattgatcggagtaagccctctgaaccgatacaacctgttaatacttgggagatcagttcactccctagttccacagttacttccgagactctaccatcttccttgagccctagcgtagagaaatacagataccaggatgaggatactcctccacaggaacacattagccctcagataactaacgaggttatcggacccgagctggtgcacgtgtccgaaaaaaatctaagcgagattgagaacgtgcacggatttgtgtcacacagccacataagcccaatcaaacccacggaggctgtcctcccatcgcctcctacagtgcccgtaatacctgtgttgccagtgccggctgaaaatacggttattttgcccacaatcccccaagccaaccctccccctgttttggtgaatactgattcgcttgagactccaacctatgtgaacgggacggatgctgactatgagtatgaagaaattactctggaaagaggaaacagcggactgggcttttcaattgctggcggtacagataacccgcacatcggagacgactcaagcatcttcatcactaaaatcattacaggcggagccgcagcacaggatgggaggctccgcgtgaatgattgcatcctgagagtcaacgaagtcgatgtgagggacgttacccacagcaaggcggttgaagcccttaaagaggccggatccatcgtgcgactctatgtcaagagacgaaagccggtgagcgagaagatcatggagatcaaactgattaaagggccaaaaggcctggggttttcaatcgccggtggagtaggtaatcagcatatcccaggcgacaatagtatctatgtgacgaaaatcatcgaaggaggcgctgcgcacaaggatggaaagctgcaaatcggtgacaagctgttggccgtaaataacgtgtgcctggaagaagttactcacgaagaggccgtgaccgccctgaaaaataccagtgactttgtctacctgaaagtggcaaaacctacatctatgtatatgaacgatggctacgctccaccagatatcacgaacagcagctcacaacccgtcgataatcatgtgtccccctcatctttcttggggcagacacccgcttcccccgctcgctatagccccgtgagcaaggcagtcttgggggacgatgaaataaccagggagccgaggaaagtggtgcttcatcgcggaagcaccggccttggatttaatattgtggggggagaggatggagaaggaattttcattagctttatcctggccggtggacctgctgatctttcaggagaattgcggaagggcgataggatcatcagcgtcaacagtgttgacctcagggcagcgtcacacgagcaggcagccgcagccttgaaaaacgccggtcaggctgtcaccatcgtcgcccagtacaggcctgaggagtattcacgattcgaggctaagatacacgacttgcgggagcagatgatgaactcctccatcagtagtggcagcgggtctttgcgtacctcacagaagcgcagtctctatgtgcgcgcactgttcgactatgacaaaactaaggactcgggcttgccctcccaaggactgaactttaaattcggcgatattctgcatgtaataaacgcctccgatgatgagtggtggcaggcacgccaggtcacgccagacggtgaatccgatgaagttggcgtgatcccctcaaagaggcgcgtggaaaaaaaggaacgggctagactgaaaacagtcaaatttaattctaagaccagggataagggcgaaatccccgatgacatgggctctaagggcctgaaacacgtaactagtaatgcgtctgattccgaatcatcataccggggtcaggaagagtacgtattatcatatgagccagtcaaccaacaggaagtgaactatacccgacctgtcattattctcgggcctatgaaggataggattaatgatgatctgatctctgagttccctgataagtttggaagttgcgtccctcacaccactagaccgaagagagattatgaggtcgatgggagggactaccacttcgtaacatctagggagcaaatggaaaaagatattcaggagcacaagttcatcgaagctgggcagtataataaccacttgtacggaacgagcgtgcaaagcgttagagaagtggcagagaaggggaaacactgtatacttgacgttagcggcaatgcaatcaagcggttacagatcgctcagttatatccaatttccatcttcattaaacctaaatctatggagaacataatggagatgaacaaaagactcacggaagagcaggctaggaagacctttgaacgggctatgaaacttgagcaagaattcaccgagcatttcacagcaattgtgcagggggacaccctggaggacatttacaaccaagtcaagcagataatagaggagcaaagtggctcctacatctgggttccggctaaggagaaactgtag

SEQ ID NO: 220963 - DNA, 2682 bp, Artificial Sequence
  Description of Artificial Sequence: Synthetic coding sequence
atgcccgtgcgaaagcaggacacccagagggccctgcatctgctggaagaatatcgaagtaaattgagccagacggaagataggcaattgcgaagctccatagaacgagtaatcaatatcttccagtccaatttgtttcaggccctcatcgatattcaggagttctatgaagtcactctcttggacaatccgaagtgcattgataggtctaaaccatctgagccaattcagcccgtgaatacttgggagatttcatccctaccctctagcactgtcacatcagaaactttaccaagcagcttgagtcctagcgttgagaagtaccgttaccaggacgaggatactcctccgcaagagcatataagcccgcaaatcaccaacgaagtgattgggccagagttggtgcatgtgtctgagaagaacctgtccgaaatcgagaacgtgcatggatttgtgtctcatagccacatctctccaattaaagcgaaccccccaccagtgcttgttaataccgactcacttgaaactccaacctacgtgaatggtacagatgcggactacgagtatgaagagataaccctcgagagaggtaatagtgggttgggattcagcatcgccggaggcacagataacccacacatcggagacgactcttctatctttatcacgaaaatcataacaggaggagccgcagctcaggacggaaggctgcgggtgaatgactgtattttgagggtaaatgaggtggacgtgagagatgtcacacactcgaaagctgtggaggctcttaaagaggctggcagtatcgtgcgcctgtacgtgaagcggaggaaacctgtgagtgagaagattatggaaattaagttaattaaaggaccaaaggggctcggattttcaatcgctgggggtgtggggaatcagcacattcctggcgacaattcaatttatgtgaccaagatcatcgaggggggagcagcccacaaagatggaaagcttcaaatcggcgacaagttactggccgtcaacaacgtttgtctggaggaagtgacccacgaagaagcagtcacagccctcaaaaataccagcgactttgtttacctgaaggtagcgaagcccacctccatgtatatgaacgatgggtatgcgcctccggacatcacaaatagtagctctcagcctgtggacaaccacgtctcaccctcctctttcttaggacagaccccagccagcccagcgaggtactctccagtatctaaggccgtgttgggtgacgatgagattacacgggagcctcgaaaagtggtgctgcataggggctccaccggactcggttttaatattgttgggggagaggacggagagggcattttcatctccttcatccttgccggaggtccagcggacttgtcaggagagttgagaaagggggaccgcatcattagtgtgaattcagtggatctgcgcgctgcctcccacgagcaggcagccgcagctctcaagaacgccggacaggccgttaccatcgtagcccagtaccggccagaggagtactcacgctttgaggctaagattcacgacctgcgcgagcaaatgatgaattccagcatttctagcggctctggatctctgcgtactagtcagaaaagaagcctgtacgtcagggccctgtttgattatgacaaaactaaagactctgggctgccaagccaggggctgaactttaagtttggagatatactgcatgtgatcaacgctagtgacgacgaatggtggcaggcacggcaggttacacccgacggtgagagcgacgaggttggggtgatccccagcaaacggagagtggaaaagaaggagcgggctaggctcaagaccgtaaaatttaacagcaagaccagggataaagggcaatcattcaacgataaaagaaaaaagaacctcttttcccggaagttccctttttacaaaaacaaggaccagtccgaacaggagacctccgatgccgatcagcacgtcacatccaacgcctccgacagcgagtctagctacagaggccaggaggaatatgtcctgagttacgaacccgtaaaccaacaagaggtcaattacactcgtcccgttatcatcttgggcccaatgaaggacagaatcaacgacgacctgatcagtgaattccccgataaatttggtagttgtgtaccacacaccactcgccctaagagggactacgaggtagatggccgagattaccacttcgtgacgagtcgtgagcagatggagaaagacatccaagagcataaattcatcgaagcagggcagtataataaccacctttacggaaccagtgtccagtccgtgagggaagtcgctgaaaaaggaaagcactgtattctagacgtgagcggaaatgcaatcaaacggctccagatagcccaactctacccaattagcatattcatcaaacccaaatccatggagaacatcatggaaatgaataagcgtctgaccgaggaacaggcacgcaagactttcgaaagagcaatgaaactagaacaagaattcactgaacattttacggcgattgtccaaggagacaccctcgaagatatatacaaccaagtgaaacagatcattgaggagcagagcggttcatacatctgggttcctgccaaggagaaactctag

SEQ ID NO: 220964 - DNA, 2730 bp, Artificial Sequence
  Description of Artificial Sequence: Synthetic coding sequence
atgaatgcctacctgaccaagcagcactcctgctcacgaggctctgatggaatggatgcagtccgaagtgcacccactctaattcgtgatgctcattgcgcttgcggctggcagcgtaattgtcaaggcctcggatattcttctcagaccatgccttcttcggggcctggtggacctgccagtaatcgcacaggaggctcctcattcaacagaaccctgtgggactctgttcggaaatctccccacaagacgtccaccaaggggaaagggacctgcggtgaacattgcacctgtccacatggttggttctcacctgcacaggcttctcctgcccctatcattgttaatacagataccctggataccattccttatgtgaatggaacagaaattgaatatgaatttgaggaaatcacccttgaacgtggaaatagtggccttggattttcgattgccggaggcactgacaatcctcatatcggagatgatcctggtatctttataacaaagatcatacccggaggagccgcagccgaagacggcagactacgtgttaacgattgtattctgagagtcaacgaagtcgatgtctcagaagtctcccatagcaaggccgtcgaggctctgaaggaagccggatccattgtccggctctacgtgaggagacggagaccaattctggagacggtggtggagatcaagctgttcaaaggtcctaaggggctcggctttagcatcgccggaggagtgggaaaccaacacattccaggcgacaattccatctacgtaaccaaaatcatcgatgggggtgcagcccagaaagacggacggctgcaggtgggcgacagactactcatggtcaataattactctctggaagaggtgacccacgaagaagccgttgctatcctcaaaaatacttccgaggtcgtatatctgaaggtcggaaaacctaccaccatttatatgacggatccttatggtcctcctgatatcacacattcttattcgcccccaatggagaaccatttgctcagcggaaataacgggaccctggaatataagactagcctcccacctatctcgcccggaagatattcccccatccctaaacacatgctcgtggatgatgattacactcggccacccgaacctgtttattctactgtgaacaagttatgcgataagcccgctagtcccagacattacagtcctgtagaatgcgacaagagctttcttttaagcgctccttacagccactaccaccttggcttgctgccggattctgagatgaccagtcacagtcagcattctaccgcaacgaggcaaccctcaatgacgctgcagcgcgctgtgtcactggagggagagcccagaaaggtggtgctccacaagggctctactgggcttggctttaatatcgtggggggtgaggacggcgaggggatatttgttagctttatcctggcaggagggccagctgacctgagcggcgagctccagagaggtgatcagatactctccgtcaatggtatcgacctccggggagcttcacatgaacaggcagcggcagcccttaaaggcgctggccagactgtgaccatcatcgcacagtaccagcccgaggattacgccagatttgaggcaaagatccacgacttgagggaacagatgatgaaccacagcatgtcctctggttctggttccctgaggactaatcagaagcgaagcctttacgtgagagcaatgtttgattatgacaaatcaaaggattccggcctcccgtctcaagggctgtctttcaaatacggagatattctgcacgtgattaatgcgtctgacgatgagtggtggcaggctagaagggtcatgcttgaaggtgattcagaagagatgggggtgatacccagcaaaagacgcgtggagcgaaaagagcgcgctcggttgaaaaccgtgaagttcaatgccaagcctggcgttatcgacagtaaaggaagctttaatgacaaaaggaagaagtctttcatcttctcccgcaagtttccattttataagaataaggagcagtctgaacaggagactagcgacccagagcgtggacaagaggacttgatcctatcttatgaacccgtaaccagacaggaaatcaattatacccgtcctgtaataatccttggtcctatgaaagatcgaatcaatgatgacctgatcagcgaattccctgacaagttcggttcttgcgtgccacatacaacaagaccaaagcgcgattacgaagtggacggtcgcgactaccattttgtgattagtcgggagcaaatggagaaagatattcaggaacacaaatttatcgaggcgggacagtataatgacaatttgtatggtacctctgtccagtctgttagattcgtagccgaacggggaaaacattgtattttggacgtgagtggcaatgctatcaagagacttcaagttgcacaactctaccctatcgccatttttattaagcccaggagcctggaacccctgatggagatgaacaaaaggttgactgaggagcaggcgaaaaagacatatgatcgggcaatcaagctcgagcaggaattcggtgagtattttacagcaatcgtgcagggtgacactctcgaagatatctataaccagtgtaaactagtcattgaagaacaaagtggaccctttatctggattccgtcaaaggagaaactatag

SEQ ID NO: 220965 - DNA, 2376 bp, Artificial Sequence
  Description of Artificial Sequence: Synthetic coding sequence
atgcagcacgcctttattcccgcttctcctgcccctatcattgttaatactgatacactggacaccatcccatacgtcaacgggacagaaatcgaatatgagtttgaagagattacattggagcggggaaactctggcctgggattttcaattgcaggcggaaccgataaccctcacatcggggacgaccctggcatttttatcacaaagatcatccctggtggcgctgccgctgaggacgggcgtctgagagtgaacgactgcattcttagggtgaatgaggttgatgtctccgaagtgagccacagtaaagcagtggaggcactcaaggaggctggctccatagttaggctgtacgtgagaaggcggaggcctattttggagacagtcgtggagattaagctctttaaaggcccaaagggcttgggattctcaattgccggtggcgtgggcaatcagcatatcccaggtgataattcaatttacgttactaaaatcatcgatggtggagccgctcaaaaagacggacgactgcaggtcggcgatcggctactgatggtaaataactactccttagaggaagtcacccacgaagaggcggtcgccatccttaagaatacctccgaagtggtgtacttaaaggtgggcaagccaacgaccatctatatgactgatccatacgggccaccagacattacacactcctacagtccgccaatggagaaccatttgttatcgggtaataacggtacactggaatacaagactagtcttccccctatcagccccggtcgatactctcctattcccaagcatatgttggtagacgacgactatactaggccgcctgagccagtgtattccaccgtgaataaattgtgtgacaaaccagcttctcccagacattactctcctgtggaatgcgataagtcgttcctgctcagcgctccttacagccactaccacctgggactgttaccagattccgagatgacaagccactctcagcattccaccgccaccaggcagccatcaatgactctgcaaagggcggtaagcctcgaaggagagcctcgaaaggtcgtgctgcacaaaggctccaccggattggggtttaatatcgtcggaggggaggacggcgaaggtatttttgtgagtttcattcttgccggtggacccgctgacctctcgggggagttgcagcggggagaccaaattttgagcgtaaacgggattgatctacggggagcctcccacgagcaagcagcggcagcactaaaaggcgctggtcagaccgttacgatcattgcccaataccaaccagaggattacgctcgattcgaagctaagatacatgatctgcgcgagcagatgatgaaccatagcatgtcttcaggaagcggtagtctgcgaactaatcaaaagaggagtctttatgtgcgggcaatgttcgactatgacaaaagcaaggatagtggattaccaagtcagggacttagcttcaaatacggcgacatattgcacgtgattaacgctagtgacgatgagtggtggcaggcaagacgtgtcatgctggagggagacagcgaggagatgggagtaatcccttcgaaaaggagggtagagcgaaaagaaagagcccgacttaagacagtgaagttcaacgccaagcctggagtgattgacagcaaaggtgatatccccggactaggcgatgacgggtatggcaccaaaaccctcagaggccaggaggatctcattctttcgtacgagccggtgactcggcaggaaattaattatactaggccagtgattatcctgggtccaatgaaagatcggattaacgatgacctgatctctgagttcccggataagttcgggtcatgcgtcccccatacaaccagacccaagcgcgactacgaagtcgacggcagagactatcactttgtgatatcacgggagcagatggagaaagacatccaggaacacaagttcattgaggctggccagtataacgataacttgtacggtacatccgtgcagtccgtgcgcttcgtcgccgagcgcggaaaacattgcatcctggacgtttctgggaacgccatcaagcgtctgcaagttgcccagttgtatcccatagcgatcttcattaagcccagatctctagagcccctgatggaaatgaacaaacgcctcactgaagaacaggcaaaaaagacatacgaccgcgctattaaattagagcaagaattcggcgaatacttcacagccatcgtgcaaggggatacccttgaggatatttacaatcagtgcaaactcgttatcgaggaacagagtggtccctttatctggattccctccaaagagaagctatag

SEQ ID NO: 220966 - DNA, 2928 bp, Artificial Sequence
  Description of Artificial Sequence: Synthetic coding sequence
atgggtatctttaagagctcactctttcaggccttgctcgacatccaggagttctacgaggtcacactactgaacagccagaaaagctgtgagcagaagatcgaggaggccaaccaggtcctccaaaagtgggagaagacttctctgcttgccccttgtcacgataggttgcaaaagtcgagtgaactgaccgattgtagcggatcgaaagagaatgccagctgcattgagcagaacaaagagaatcaaagctttgagaacgagacggacgaaacaactacacagaatcaagggagatgtcctgctcagaattgctccgtggaggcacccgcttggatgccggtccaccactgcaccaagtatcggtatcaggatgaagacgctccacacgatcatagtctcccccgacttacccatgaagttagaggtcccgaactcgtgcacgtaagtgagaagaacctcagccagattgaaaacgtacacggctatgtcctgcaatcccatatatccccattgaaggcatccccagccccaattattgtgaacacagacacactagacactattccatacgtgaatggaaccgaaatcgagtacgagttcgaggagattacgctggaaagggggaactccggtctaggatttagcatagccggaggtacggacaacccacatattggtgacgaccccggtatctttatcactaagattattcccggaggtgccgctgccgaggatggcagattgcgtgtgaacgactgcatcctgagagttaacgaggtggacgtctctgaggtatcacactctaaggcggtggaggctttgaaggaggcgggtagcatagtcaggctctatgtgaggagaaggcggccaatcctggaaacagtggtcgaaataaagctttttaagggcccaaaaggattgggcttttctatcgccggaggtgtgggcaaccagcatatccccggtgacaatagtatctatgtcactaaaataatcgatgggggagcagcacaaaaagacgggagactacaggtcggcgatagattactgatggtcaacaattatagccttgaagaggtgactcatgaggaggcggtggcaatcctaaagaacacctccgaggtagtgtacctcaaggtcgggaagccaaccactatttatatgaccgatccctacggaccacccgacatcacgcatagttactcccctccgatggagaatcacctcctttcaggcaataacggcacactggagtacaagacctcactgccacccatatcgcccggtcggtattccccaatccctaaacacatgctagtggatgacgattacactcgccctcccgaacctgtctatagcactgtgaataaattgtgcgataaacccgctagccccaggcactatagtcccgtggagtgtgataagagttttcttctatccgccccatattcccactaccacctcggcctcttgccagactctgaaatgacctctcactctcagcactctaccgccacaaggcagccgagtatgactctccagagagcagttagtctcgaaggtgagccaagaaaggtggttcttcacaaaggctctacaggcttggggttcaatattgtgggaggggaggacggcgagggaattttcgtgagcttcattctagccggaggaccggctgatctgagtggcgagctccagagaggtgatcagatcctgtctgtcaacggaatcgacctccgcggtgccagtcatgagcaggctgccgctgcactaaagggtgccggacagaccgtgactataattgcccagtaccagcccgaagattacgcaagatttgaagcaaagatacacgatttacgagaacagatgatgaatcactccatgtcaagcggatcagggtcccttcgtaccaatcagaaaagatccctctacgtgagggccatgtttgattacgacaaaagtaaagattcgggccttcctagtcagggcctttctttcaaatatggcgacattttacatgtcattaacgctagcgacgatgagtggtggcaggccagacgcgtcatgctcgagggggattcggaggaaatgggcgtcatcccctcaaaaaggcgcgttgagcggaaagaaagagctcgactcaaaacagtcaagtttaacgcgaaacctggagtgatcgattctaagggtagttttaacgacaagcgaaagaagagcttcatttttagtagaaagttccccttctacaagaacaaagagcaaagcgagcaagagaccagcgaccctgaacggggacaggaagacctaatccttagctacgagcctgtgacacgtcaagagattaactacacccggcctgtgattattctgggcccaatgaaggaccgtatcaatgatgacttgatcagcgagttccctgataagtttggatcctgcgtgccacataccactagacctaagagggattatgaggtagacggcagggattatcacttcgtcatctcgagagagcagatggagaaggatattcaggagcacaaatttatcgaagccggacagtataatgacaacctgtacggcacatctgtgcaatctgtgcgcttcgtggctgagcgtggcaaacattgtatcctcgacgtgtccgggaacgccatcaaacgcctacaggtggcacaactgtaccccattgctatttttataaagccgaggtctctggaacccctgatggagatgaataaacgcctcaccgaggaacaggccaagaagacctatgatagagccatcaaactggaacaagagtttggcgagtactttactgccatcgttcagggcgataccctagaggatatctataaccagtgtaagctagttatcgaagagcagtctggtccgtttatctggattccatctaaagaaaaactttag

SEQ ID NO: 220967 - DNA, 1005 bp, Artificial Sequence
  Description of Artificial Sequence: Synthetic coding sequence
atgatgaaccattcaatgtccagcgggtcaggaagtttgaggactaaccaaaagcgcagtctctatgtgagagcaatgttcgactacgacaaatccaaggactccggcctcccaagtcagggcctgagttttaagtatggtgacatactgcacgtcataaatgcttccgatgatgagtggtggcaagctcggagggtaatgctggaaggtgactcagaagagatgggggtcataccctccaagagaagggtagagagaaaagagcgtgcaagactgaagacggtgaaatttaacgctaaacctggcgtaattgactccaagggggatattcccggtctcggtgacgatggctacggcaccaaaaccctgaggggacaggaggatctgatcctgagctatgagcccgtgacccgacaagagattaattacaccagacctgtcatcatattgggcccaatgaaggacagaattaatgatgacttaatcagtgaatttccagacaagttcggatcttgtgtgccacacacaactcgccctaagagggactacgaggtagacggaagagactaccactttgtcatctccagggaacaaatggagaaagatatccaggagcacaagttcatcgaagccggacagtacaacgataatctctacggaacgagcgtgcagtccgtgagattcgtggccgagagaggaaagcactgcatactcgacgtgtctggcaatgccattaaacggttgcaggtggctcaattgtaccctattgctatattcatcaaacccagaagtctggagcctctgatggagatgaataaaagactcacggaggagcaagctaagaagacttacgaccgcgctattaagctcgagcaggagttcggggagtatttcacggctattgtgcaaggagatactttagaggacatatataatcagtgcaagttagtgattgaagaacagagtggaccattcatctggataccatctaaagaaaagctctag

SEQ ID NO: 220968 - DNA, 2613 bp, Artificial Sequence
  Description of Artificial Sequence: Synthetic coding sequence
atgtttttcgcatgctattgcgccctccgcaccaacgtcaaaaagtacagataccaggatgaagatgcaccccatgaccatagcctccctagactcacccatgaggtcagaggacccgagctggtgcacgtatctgagaaaaacctcagccagattgaaaatgtacacggatacgtcctgcagtcacacattagcccattgaaggcatctccagcccctataatcgtgaacaccgacaccctagacacaatcccctacgtgaatggcacagagatcgagtacgagttcgaagaaataacgctcgaacgaggaaatagcgggttgggcttctctatcgccggtggaaccgacaacccgcacataggtgatgaccctgggatttttataaccaagatcattcctgggggtgcagcagctgaagacggcagactgagggtcaacgactgtatcctccgggtcaatgaagttgatgtaagcgaagttagccacagcaaggctgtggaggcgctgaaggaggctggcagcattgttcggctgtacgtgaggaggagacgaccaatcctggagacagtcgttgaaatcaagctgttcaagggaccgaagggcctcggcttcagcattgctggcggagtggggaatcagcacatccctggcgacaatagcatctatgtgactaagataattgatgggggtgccgctcagaaggacggacggcttcaagtcggcgatagactgctgatggttaataattatagtttagaagaggtcactcacgaggaggctgtagctattctcaaaaatacgtcagaggtagtatacctgaaggtggggaaacctactactatctacatgaccgacccttacggccctccagatattacccacagttatagcccacccatggagaaccacctgctaagcggtaataatggaactctggagtacaagaccagtctgccaccgatctctcccggtcgctactcgccgatccccaaacacatgttagtggacgacgactacactcggccacccgaacccgtgtatagcaccgtaaacaaattgtgtgataagcctgcctctcctaggcattattcaccagtggagtgcgacaagagttttcttctctccgcaccatattctcactaccaccttggccttttgccagattcagagatgactagccacagccagcactccactgcaacacgccagccttctatgactctgcagagagcagtcagtctggagggggaaccccgtaaagtggtattacataagggctcaactgggcttggattcaacatagtgggtggggaggacggtgaaggtatctttgtcagttttatcttggctgggggaccagcggaccttagtggcgagttgcagagaggcgatcagatcctgtccgtgaacggtatagaccttcgaggtgctagtcatgaacaggcagccgcagccctaaagggcgcagggcagaccgtcaccatcatagcacagtatcagcccgaagactacgcgcgatttgaagctaagatccacgatctgagagagcagatgatgaatcactcgatgagctccggctccggcagcctgcgcaccaatcagaaaaggtccctatacgttcgggctatgttcgactatgacaaatcaaaagatagcggcctgccatcccaaggcctctcattcaaatacggggatatcctgcatgttatcaacgccagcgatgacgagtggtggcaggctcggcgagtgatgttggaaggagattctgaggaaatgggcgtgatcccctccaagcgccgtgtggaaagaaaggaaagagcaaggctgaagacggtaaagtttaatgcgaaacctggcgtcatcgacagtaaggggtcctttaatgacaagcgaaaaaagtccttcattttttctcgcaaattccccttttataaaaacaaagagcagtccgaacaggagacctctgatcccgaaaggggacaggaggatttgatactaagctatgagcccgtgactagacaggaaatcaactacacaagacctgttatcatactgggcccaatgaaagaccggattaatgacgatctgatttcagagttccctgataagtttggatcctgtgttcctcacaccacgcgaccaaagagagactatgaggtggacgggagggactaccactttgtgatcagtcgggagcagatggaaaaggacatccaagagcacaaattcatcgaggctggccagtacaatgacaacttgtacggcaccagcgtgcaatccgttcgattcgttgcagagcggggtaaacattgcattctggacgtgagtggtaacgctatcaaaaggcttcaggtagctcaactgtaccctatcgcgatctttattaagccgagatcgttggagccgctcatggagatgaataaaaggctcactgaggaacaggccaaaaagacctatgatcgcgctattaaacttgaacaggagtttggggaatacttcaccgctatcgtgcagggcgataccctcgaagacatttataaccaatgtaagctggtgatagaggaacaatcaggccctttcatttggatcccctctaaggagaagctgtag

SEQ ID NO: 220969 - DNA, 1047 bp, Artificial Sequence
  Description of Artificial Sequence: Synthetic coding sequence
atgatgaatcactctatgagctccgggagtggctccctccggaccaatcaaaaacggtccctgtatgttagagcgatgtttgattacgataagagtaaggacagtggattgcccagtcaaggcctgagcttcaagtacggggatatccttcatgtgatcaatgccagcgacgacgagtggtggcaggctaggagagtgatgctcgaaggcgatagcgaggaaatgggcgttatcccctccaaacgtcgcgtcgagaggaaggaaagggcacgcctcaagacagtgaagttcaatgcaaaacccggagtcatcgattctaagggcgatattcctggcttaggagacgacggctacggcacgaagactctgaaacacgttagctccaacgcgagcgactcagagtccagctatcggggtcaggaggatctgatcttaagctacgagcccgtgactcgtcaggaaatcaattatacacgcccagtcatcattttgggtcctatgaaggataggattaatgacgatctgatttcagagttccccgataagtttggtagctgcgtcccacacaccaccagacctaaacgagattatgaagttgacggacgagattatcatttcgtgatcagcagggagcagatggaaaaagacattcaagaacacaaattcatcgaggctgggcagtataatgacaacctgtacggcacgtctgtgcagtccgtccggttcgtggcagaacgcggtaaacattgcatcctcgacgtatctggcaatgctattaaaaggctgcaagtggcccagttgtatccaatcgcgattttcataaaacccagatcactggaaccactgatggaaatgaataagcggctgactgaggagcaggcgaagaaaacctacgatagggctataaaactcgaacaggagtttggtgaatacttcaccgccatcgtgcagggcgatacgctggaagatatctacaatcagtgtaaacttgtgattgaggagcagtctggcccttttatttggatccctagtaaagagaagttatag

SEQ ID NO: 220970 - DNA, 2250 bp, Artificial Sequence
  Description of Artificial Sequence: Synthetic coding sequence
atgcagaggccgagcgtgagccgggctgagaattaccagctcctatgggacacaattgcaagcctgaagcagtgcgagcaggccatgcagcacgcttttattcccgtgaacggcactgaaattgaatacgagtttgaagaaatcacactggaacggggaaacagtggcttggggttctccatcgctggaggcacagacaacccacatattggggacgatcctggaatctttatcacaaagatcattcctggaggggcagctgcagaagacggaaggctgcgggtgaatgactgcattctgagggttaatgaggtggacgtctctgaagtgagccacagcaaggcggtagaggccttaaaggaggctgggtctattgtgagactatacgttcgaagacggcgacctatcctggaaacagtggtcgagattaagctttttaaaggccctaagggcctaggcttttccatcgccggaggcgtcggaaatcaacatattcccggagataattctatttacgtcacgaagataattgacggcggtgcggctcaaaaggatggcaggctgcaagtcggggatcgcctccttatggtgaacaattactccttagaagaggtaacacacgaggaagccgtggccatattgaaaaacacatctgaagtggtgtatctcaaggtaggaaagccaacaactatttacatgactgatccttacgggccacccgatatcacccacagttattcacctccgatggagaaccatcttttgagcggtaataacggcacactcgagtataagacaagcttgccgccaatctcccccggtagatacagtccgataccgaagcacatgctggtggatgacgactacacctcccactcccaacattccaccgccactagacagccatccatgacactgcagagggctgttagtctggagggtgagcctaggaaggtggtcttacacaaggggtcaacagggctgggattcaacattgtgggaggagaggacggggaggggatattcgtctccttcatcctggctgggggaccagctgacctgtcaggcgaactgcaacggggagatcagattctttctgtcaacgggattgacctgagaggtgcctcccatgaacaggcggctgccgctttaaaaggggcaggccaaactgttacgatcattgctcaataccagccagaagattacgccaggttcgaggctaagattcatgatctacgggagcagatgatgaaccacagtatgagctcaggctctgggtccctgcgcacaaaccagaagaggtcactgtacgtgagagcgatgttcgactacgataagagtaaggactctgggctcccctcccagggactgagcttcaaatacggcgacattttacatgtcatcaatgcctcagacgatgagtggtggcaagctcggagagttatgctcgagggagatagcgaagagatgggggtcattccgtcgaaaagacgcgtggagcgcaaagagagggccagactgaaaacggtcaaattcaatgctaagccgggtgtgatcgactccaaaggcgatattcccggactgggagatgacgggtatggtacaaaaactctccgtggccaagaggatctgatcctatcctatgagcccgtgacccgacaggaaatcaattacacgcgccctgtgatcatactgggtcccatgaaggatcggatcaatgatgacctaatttcggagtttcctgataagttcgggagttgcgttccccatactacccggccaaagagagattatgaagtcgatgggagggattatcactttgtgatcagccgagaacagatggaaaaggacattcaagagcacaaatttatcgaagcaggacaatataatgataatctctacggcacttctgtgcaatctgtgcgcttcgttgccgaaagaggtaagcactgtatcctggacgtgagtgggaacgctattaaacgacttcaggtcgcccagctctatccaatcgcgattttcatcaagccaaggagcctggaaccattaatggagatgaacaagcggcttaccgaggagcaagcgaaaaagacctatgaccgagccatcaaactcgaacaggagtttggagagtattttaccgccatagtgcaaggagacacgctggaagatatctacaaccaatgtaagctggtcatcgaggaacagagtggaccattcatttggattccctccaaagaaaagctatag

SEQ ID NO: 220971 - DNA, 1005 bp, Artificial Sequence
  Description of Artificial Sequence: Synthetic coding sequence
atgatgaatcacagcatgagttctggaagcggctccttacgaactaaccagaagaggtctttatacgtaagagccatgttcgattatgataaaagtaaggatagcgggcttccctcgcagggtctgtcgttcaaatatggcgacatccttcatgtcatcaatgcctcagatgacgagtggtggcaggcacggagagtgatgctggagggggattccgaagagatgggtgtgatccccagtaagcggagagtggagcggaaggagagagcaaggctaaagactgtcaaatttaacgccaagcctggagtcatcgactccaaaggggatattcccggactaggggacgatggctatggaacaaagacattgcgcggacaggaagatctcatcctaagttacgagcctgtgactagacaagaaataaattatacccgaccagtgataatcctcgggccaatgaaggacagaataaatgacgatttgatatccgaattccctgataaatttggctcctgtgtgccccacacgacaagacccaaaagggattacgaggtggatggcagggattatcacttcgtgatctcgcgggaacagatggaaaaggacatccaagagcataaattcatagaggcagggcaatataatgataacctgtacggcacctccgtgcaatccgtgaggttcgtggccgaacggggtaagcactgcattttagatgtaagtgggaatgcaatcaagaggctgcaggttgctcagttgtatcccattgcaatctttatcaagcctcgaagcctggaacctctgatggaaatgaataagcgactgacggaggagcaggcaaaaaaaacatacgaccgcgcaattaagttggagcaggagttcggggaatattttacggctattgtccaaggggatactttagaagacatctacaatcagtgcaagcttgtgatcgaggagcaatccgggccatttatctggattccttccaaagagaagttgtag

SEQ ID NO: 220972 - DNA, 2601 bp, Artificial Sequence
  Description of Artificial Sequence: Synthetic coding sequence
atgtttttcgcgtgctactgcgccctccgtacgaacgtgaagaagtaccgttatcaggacgaggacgcacctcacgaccattctctcccacgccttactcacgaagtcagaggaccggagctggtacacgtgagcgaaaagaacctgtcccagattgaaaacgtccacgggtatgtcctgcagagccacatttccccactgaaggctagcccggcacccataatagtgaatacggacaccttagacaccattccctatgtcaacgggaccgaaattgaatatgaattcgaagaaatcactctcgaaagaggaaattccgggctgggctttagtatcgccggaggcacggataatccccacattggagacgacccgggaatcttcattacaaagattatacctggtggcgctgccgctgaggacggtcgtctgagggtgaatgactgcattctgcgagtgaacgaagtggacgttagcgaagtgagtcattccaaagccgttgaggcactgaaggaggcaggttctatcgtgaggctatacgtcaggaggaggcgacccattttagagaccgtagtagagatcaaattgtttaagggtcctaaagggctcggcttttccatcgccggaggagtggggaatcagcacatcccgggtgacaatagcatttatgtgactaaaataatcgatggcggtgctgcccagaaagacggcagactgcaggtgggcgaccgcctccttatggtaaataactactccttggaggaggtgacccatgaggaggcagtcgcaattcttaaaaacacatctgaagtggtgtatcttaaggtaggtaagcccacaacaatctatatgacggatccttacggtcctccggatataacgcattcttattcccctcctatggagaatcacttactctcaggaaataatggaactttggagtacaagacttctcttcccccaatctcaccaggaaggtacagtcctatccctaagcacatgttggtagacgacgactatacccggcctcctgaacctgtgtactccacagttaataagctgtgcgataagcccgcttctcctaggcactatagtccagtagagtgtgacaagagcttccttctgagtgctccctactcacactaccacttaggccttttgccagattctgagatgacttctcatagtcagcacagtacagccacccggcagccgtccatgactctgcagagggccgtcagcctggagggagagcctaggaaggtggtcctgcataaaggctccacagggttgggattcaacatagtcggcggagaagatggagagggtatttttgtgtcctttatcctggccggaggtcccgctgacttgtctggtgagcttcagaggggtgaccagatcctaagcgtgaatggcatcgatcttcggggtgcatctcatgaacaggccgcagctgctttgaaaggagccggacagacagttaccattatcgctcagtatcagcctgaagattacgcccgtttcgaagcgaaaatccacgatctgagggaacagatgatgaaccacagtatgagtagcggcagtggaagcctgaggactaaccagaaaagaagtctatatgtacgggcaatgtttgattatgataagagcaaagacagtggccttccttctcagggactttcctttaagtacggagacattctgcacgtcatcaatgctagtgacgacgagtggtggcaggccaggagggtcatgctcgagggagactccgaagaaatgggcgtgatcccaagcaaaaggcgcgtggagagaaaagagcgagcaagactgaaaactgtgaagtttaacgcaaaaccaggcgtaattgactcgaaaggggacatccccggtctaggtgatgatgggtatggcaccaaaacactcaagcacgtatctagcaacgccagtgacagcgagtcaagctaccggggtcaggaggacctcatcttgtcctacgaacctgtgactaggcaggaaatcaactacacaagacctgtcattatcctcgggcctatgaaggaccgaatcaatgatgatctcatctctgaatttcctgataaatttggaagctgcgtgccacacaccacccgccctaaacgcgactatgaggtggacggaagagactaccatttcgtgatctcacgtgaacaaatggagaaggatatccaggagcacaaatttattgaggctgggcagtacaatgacaacctctacggcactagtgtacaatccgtcaggttcgtcgccgagaggggcaaacattgcatactcgacgtctcaggcaacgccattaaacgcctgcaggtagcccaactgtatccaatagctatcttcattaagcccagatcacttgaaccgctgatggagatgaacaagcgactgactgaggagcaagccaagaaaacatacgaccgcgcaattaaactggaacaggaattcggagagtacttcacagctattgtgcagggggacaccctggaggacatatacaatcagtgtaagctcgttattgaagagcagtccgggccatttatctggatacccagcaaagaaaagctgtag

SEQ ID NO: 220973 - DNA, 285 bp, Artificial Sequence
  Description of Artificial Sequence: Synthetic coding sequence
atgatgaatcactccatgagttccggatctggtagtctgcggacaaaccagaagcggtcactctacgtccgagccatgtttgattatgacaaaagtaaagatagcggtctcccctcgcaggggttaagctttaaatatggggacattctccacgtcatcaatgccagtgatgatgagtggtggcaggctagaagggtgatgctggagggggatagcgaagagatgggggtcattccctccaaaagaagggtggaacggaaggagagggcaagacttaagacttag

SEQ ID NO: 220974 - DNA, 2559 bp, Artificial Sequence
  Description of Artificial Sequence: Synthetic coding sequence
atgttctttgcttgttactgcgctctcagaacgaacgtgaaaaaataccgataccaggatgaggacgccccacacgaccattcccttccaagactcacccacgaagtaaggggacccgagctggtccacgtgagcgagaaaaatctgtcccagattgaaaacgtccatggatacgttttacagagtcacattagcccgttgaaggcttctccagcgcctatcatcgtcaacactgataccctcgacactattccatatgtcaacggaaccgagattgagtatgagttcgaagagattactcttgagcgcggtaattccggcctaggcttctccatcgccggagggaccgataaccctcatattggtgatgatccaggcatatttattaccaaaatcatccccggtggggcagcagcggaagatggaaggttgcgcgtgaatgattgcatcttgagggttaatgaagtggatgtgtcagaggtgtcccactcaaaggcagtggaggctctgaaagaggctggcagcatcgtgcgcctttatgtgcgacggcgtagaccaattctcgagaccgtagttgaaatcaagctcttcaaggggcctaaggggctgggcttctcaattgccggtggggttggaaaccagcacatccctggcgacaattcaatctatgtcacaaagatcattgacggaggagcagcacagaaggatggacgccttcaggtaggcgatcggctgctcatggttaataattactcacttgaagaagttacacacgaagaggcggtggccatcctgaaaaacactagcgaggtggtatatctcaaagtcggcaaacctacaactatctacatgacagatccatatgggcctcctgacatcacccactcatatagtcctccaatggaaaaccatctcctctccggcaacaatgggaccctcgaatacaaaacctcgcttccccctatctctcccggacgctatagccctattcccaaacacatgctcgtggacgacgactatacccggccacccgagccagtctactctactgttaacaaattgtgtgacaagccggcttcccccaggcactactctccagtggagtgtgataagtcttttctgttgagtgctccatactctcactaccacctgggcctcttacctgacagcgagatgacaagccattcacagcatagtaccgctacacgacagccatcaatgacacttcaacgcgctgtgtctttggagggagagccccgaaaggtggtactgcacaaaggctccactggactaggcttcaacattgtgggcggagaggacggagagggcattttcgtatctttcatcctcgccggaggcccagctgacctgagcggggagctccaacgtggtgaccagattctgtctgtcaacggaatagacctaagaggcgcatctcacgaacaggcggcagccgctctgaaaggagctgggcaaacggtcaccatcatagcacagtaccagcctgaggactatgctagatttgaagccaaaatccatgacctccgagaacagatgatgaatcactctatgtccagtggcagcggctcactgaggacaaaccaaaaaagatccctctacgtgagagctatgttcgactacgacaagagcaaggactccgggctgccatctcaaggactgtccttcaaatatggggacattctccatgtgatcaatgcaagtgatgacgagtggtggcaggcaagaagagtcatgctggagggggatagcgaagagatgggagtgatcccctccaagaggagagtagagcgcaaagagagagccaggctcaaaacagtgaagttcaacgctaaacctggtgtgatcgattcaaaaggagacattcctggtctcggcgacgatggatacggaacgaagacgctgagaggacaggaggatctgatactgagctatgagcccgtgacccgccaggaaatcaattacactagacccgtgataattctcggcccaatgaaagacagaatcaatgacgatcttatatcagagtttccagataagttcgggtcctgcgttcctcacacgaccaggccgaaaagagactacgaggtggatggcagggactaccacttcgtgataagcagagagcaaatggaaaaggacatccaggagcacaaatttatcgaagccggacagtacaacgacaatttatacggaacttccgtccagagtgttagattcgtggccgagcgtgggaagcattgtatcttagacgtttcaggaaacgctataaaacgcctgcaggttgcccaactgtaccctatcgcaatctttataaagccgcgatctcttgaaccgctgatggaaatgaacaagaggctgacagaggagcaggcaaagaagacgtatgacagggccatcaagctagaacaggaatttggggagtacttcacagcaatcgtgcagggcgacactctggaagatatttataaccagtgcaagctcgttatagaagaacagagtgggcctttcatatggatacccagtaaggagaagctgtag

SEQ ID NO: 220975 - DNA, 1863 bp, Artificial Sequence
  Description of Artificial Sequence: Synthetic coding sequence
atggtaaacaactattcactggaagaggtcacacatgaggaagccgtcgctatattgaagaatacttccgaagtggtgtatctgaaggttggtaaacccactaccatctatatgactgacccctatggacctcctgacattactcattcctatagtccgcctatggagaaccacctgcttagcggtaacaatggtaccctggagtacaagaccagccttccaccaatttcccctggtagatattcacccatccccaaacacatgctggtcgacgatgactacacacggccacctgagcccgtctattctaccgtgaataaactgtgcgataaacccgcttcaccgcgtcattattcacccgtggagtgcgacaaatcattcctgctatccgccccatattctcattatcacctgggactgttacccgatagcgagatgacctctcacagtcagcactctaccgctactcggcaaccctccatgaccctgcagcgagcagtctccctggagggggagcctcgaaaagtggtcctgcacaaggggtcaacaggcctgggttttaacattgtgggcggagaggacggagaaggcatattcgtctcctttattctggctggagggccagcggatctgagtggagaactgcagagaggggaccaaatcctatctgtaaacggcatcgacctgagaggcgcaagtcatgagcaggccgcagcagccctgaaaggcgctgggcagacggtgactatcatcgctcagtaccagcctgaagactatgccagatttgaggctaagatccatgatctgcgggagcagatgatgaatcactcgatgtcgagtggtagtggctctcttaggaccaatcaaaagcgtagcttgtacgtcagggccatgtttgactatgacaaatctaaggactctggcctcccgtcccagggtctgagtttcaagtatggagacatcttgcatgtgattaacgcctccgacgacgagtggtggcaggcaaggagggtcatgctcgaaggcgactctgaggagatgggcgtcatcccttccaagcgacgcgtggagcgcaaggagcgggcacgtctcaaaaccgtgaagttcaacgcaaaacccggagtgattgatagtaaaggcgatattccgggactgggagacgacggttatggcacaaaaaccttgaagcacgtctcttccaacgcaagtgattctgagtcctcgtaccggggacaagaagacctgatcctgtcctacgaacccgtcactcgccaggagattaattacacccgcccagtgattatcttgggccctatgaaagaccgcattaatgatgatctcatctccgagttcccggataaattcgggtcctgcgtcccacataccactcggcctaaaagggactatgaggtggacgggagggattaccactttgtcatcagcagggagcagatggaaaaggacatccaggaacataaattcatcgaagcaggtcagtacaacgacaatttgtacggcaccagtgtccagtccgtccgctttgttgcggagagggggaagcactgcatcctggacgtgtccggcaacgctatcaaacgactccaggtggctcagctgtatccgattgctattttcatcaagcctcggagcctcgagccactgatggagatgaataagcgattaaccgaggaacaggccaagaaaacttacgatagagccattaaactcgagcaagaatttggcgagtacttcacagctattgtacagggagataccctcgaggacatctataaccagtgcaagctggtgatcgaggagcaatccggacctttcatttggattccctccaaagagaaattatag

SEQ ID NO: 220976 - DNA, 2928 bp, Artificial Sequence
  Description of Artificial Sequence: Synthetic coding sequence
atgggcatatttaaatccagcctgttccaagccttactggatatacaagaattttatgaagtaactcttctcaatagccaaaaatcttgtgaacagaaaatcgaggaagctaaccaggtcctgcaaaaatgggaaaaaacctcactgttggccccttgccatgatagacttcagaaatcaagcgaattgacagattgctctgggagtaaagaaaacgccagttgtattgaacagaacaaggaaaatcaatctttcgagaatgagactgacgaaaccaccactcagaatcagggcagatgcccagctcagaactgttcggtcgaggctcctgcatggatgccggtccaccattgcactaaataccgctatcaggacgaggacgctccacacgatcactcattgcctcggcttacgcacgaggtgcgaggcccagagctggtgcacgtgtcagaaaagaacttaagccagatagagaatgtccatgggtatgtcctgcaatcccacatttcgccactgaaagccagccctgctccaatcatcgtcaacactgacactctggacacaatcccatacgtgaacggcacagagatagagtacgagtttgaggagattacactggagcgaggcaatagtggattgggattttctatcgctggaggtactgacaaccctcatatcggggatgatcctgggatcttcatcaccaagatcattcctggcggagcagcggctgaggatggtagacttcgtgtgaatgactgcatcctgcgcgtgaacgaggttgacgtaagtgaggtgtcccactccaaggctgtggaagcactgaaggaggctggaagcatcgtgcggctctacgtgaggcgccgtagacccatcctggagaccgttgtcgagataaaacttttcaaaggtcccaaggggctgggttttagtatcgccggaggagtgggcaatcagcacatccccggagacaattccatctacgtaactaagatcatagacgggggagctgctcagaaggacggaagactccaggtgggggaccgcctcctcatggttaacaactactccctggaagaagtgacacacgaagaagctgtggctattctcaagaatacgtcagaggtagtctacttaaaggttgggaagcccactaccatctacatgaccgacccctacggccctcccgatattactcatagttacagtcctccaatggaaaatcacctgctaagcggaaataacgggacacttgagtacaagaccagccttcccccaatctctccgggacggtatagcccaattcccaaacacatgctcgtggacgacgattacacacgtccgccagagcctgtgtattcaaccgtcaacaagctgtgtgacaagcctgcttctcctcgtcactactcacctgtcgagtgcgacaaaagctttcttctctcagccccttattctcactatcacctgggtttgcttcctgactctgaaatgacttctcacagccagcacagcactgcaacgcgccagccctcgatgacgctccaaagagccgtctccctggaaggggagcctcgaaaagtggttctacacaaaggatctacaggcctcggcttcaatatagtcggcggagaggatggcgaaggcatattcgtctctttcatcctggcaggcggtccggcagatctgagtggagagctccagcgaggtgaccagattctgtctgtcaacgggattgacttacgtggcgcttcccatgaacaggcagccgcagctctcaagggtgctggccagactgtgaccatcattgctcagtatcagcccgaggactacgcccgatttgaagccaaaatccatgacctcagggagcagatgatgaaccacagtatgtcaagcgggagcgggtccctgaggaccaaccaaaaaagatctttgtatgtacgggcaatgttcgattacgacaagagtaaggattcaggattgccaagccagggcctgtcctttaaatatggcgacatacttcatgtgattaatgctagcgacgatgaatggtggcaagcacgcagagtgatgctggaaggcgacagcgaggaaatgggggttatcccctctaagcgccgagtggagcggaaggaacgagcacgcctgaagacagttaaattcaatgccaaaccaggagttattgacagtaaaggatcatttaatgacaagcgcaagaagtcttttatattcagcagaaagtttccattttacaagaataaggaacagtctgagcaggagacttccgatccggaacgaggccaagaggacctgatcctttcatacgaacctgtcaccaggcaggaaattaattataccagaccagtgattatcttggggcctatgaaggatcggatcaatgacgacctgatcagtgagttcccagataagttcgggagttgcgtcccccataccaccagaccaaagcgggactacgaagtggacggacgagattaccacttcgtgatctccagggagcagatggagaaagatattcaggaacataaattcattgaagcagggcagtacaacgataatctgtatggcaccagcgtccaaagcgtcagattcgtcgccgagagaggtaagcactgcattctggacgtgtcgggcaatgcgattaaacggctccaggtggcgcagctgtatcctattgctattttcatcaagcctaggagtctggagcctttgatggaaatgaacaagaggttgaccgaggagcaggccaagaagacatacgatagagccatcaaactggaacaggaatttggagagtattttacagcaatcgtgcagggggacactctcgaagacatctacaatcagtgtaaacttgtgattgaagaacaaagcggtccatttatttggatcccaagtaaggagaaactctag

SEQ ID NO: 220977 - DNA, 2928 bp, Artificial Sequence
  Description of Artificial Sequence: Synthetic coding sequence
ttcggctttattgttagtgtgcactttcagtcctatctgaacattcaggagttctatgaagtgactttgctcaattcccagaagtcttgcgagcagaagatagaggaggcgaatcaagtgctacagaagtgggagaaaacatctctacttgccccttgccatgaccgcttacagaagagcagtgagctgaccgactgcagcggctcgaaggaaaacgcatcctgtattgagcagaataaagagaatcagagctttgaaaacgaaaccgatgaaacaaccactcagaatcaggggcgatgccctgcccagaattgttcagtggaggcccctgcatggatgcccgtgcatcactgcacgaagtatcgataccaggatgaggacgcaccccacgatcattccttaccacgtttgacccatgaggtgcgcggaccggaactggtccatgtatctgaaaaaaacctgtcgcagattgagaatgtgcacggctacgtgctgcagtcccacatttcgcccctcaaggcttctcctgctcccatcatcgttaatacagataccttggatacaatcccctatgtaaatggcaccgagatcgaatacgaattcgaggaaatcacactggagcgcggaaactccggtctagggtttagcattgctgggggaaccgacaatccccacataggggacgacccaggcatcttcatcacaaaaatcattccaggcggagccgcagctgaagatggcagattacgcgtaaatgactgcattctgcgcgtcaatgaagtggacgtctccgaagtgtcgcattcaaaagcagtagaggcgcttaaagaagcaggcagcatagtccggctttatgtgcgcaggcggcgaccgatcctggaaacagtcgtcgagatcaaattgttcaaaggccctaaaggcctcggattttctatcgccggaggggtggggaaccagcacattcccggtgacaacagtatttacgtcaccaaaataatagacggcggtgccgctcagaaagacggcaggctacaggtgggagacaggctactgatggtgaacaattattccctcgaagaggtaacacatgaggaagccgtggcaatattgaagaacacaagtgaggtcgtctacctcaaagttggtaagccaaccacaatttatatgaccgatccctacggccctccagatattacgcacagctatagtccaccaatggaaaaccacctgctttcaggtaacaatggcacactcgagtacaagacctctttgccacctatatcccccggtcgatattcgcccatccccaagcacatgctggtggatgacgactatacaagaccacccgagcccgtctattctacagtgaacaagctgtgtgataagccagcctcgcctaggcactatagccctgtggaatgcgataagagtttcctgcttagcgcgccttattcgcactatcacttgggtctgctgcctgattccgagatgacaagtcactcacagcactccacagcaactcggcagcctagcatgaccctgcagcgtgccgtgtcattagaaggagagccacgcaaggtggttttgcataaaggcagcacaggtctggggtttaatatcgtaggtggcgaagacggagagggaattttcgtgtcatttatcctagcgggtggaccagccgatttgtccggagagctgcagcgaggagaccagattttaagcgtgaatgggatcgacctcaggggagcatcccacgagcaagccgctgcagctcttaaaggcgctggccagacggttaccataattgcgcagtatcaaccagaggactacgccaggttcgaggccaagattcacgatctacgggaacagatgatgaaccattctatgagcagcgggtccgggagcttaaggaccaatcagaaacggagcctgtatgtgcgcgcaatgtttgattacgataagtcaaaggattcagggcttccgagccaaggcctgtcctttaaatatggcgacatcctccacgtcattaacgcgtctgatgatgaatggtggcaggctagacgcgtgatgctggaaggggacagtgaagaaatgggcgtgatcccgagtaaaaggagggtggagagaaaagagagggccagactcaagacggtcaaattcaacgcaaagcctggggtgattgatagtaagggaagctttaacgataaaagaaaaaagtccttcattttttctagaaaattcccattttacaaaaacaaggaacagagcgaacaggagacctctgatcccgagaggggacaggaagatttaatcctcagttatgagccagttacgaggcaggaaattaattacactcgtcccgtgatcatcctggggcctatgaaagaccggattaacgacgacttaataagcgagtttccggataagttcggaagctgcgttcctcatacaaccaggcctaagagggactacgaggtcgacggtcgcgactatcacttcgtgatctcaagggagcagatggagaaagatatccaggagcacaagttcatcgaagctgggcagtacaatgataacctgtatggcacaagcgtccagagcgtgagattcgtagccgaacgagggaagcactgcattctggacgtgagtggcaatgccatcaaacgtctgcaggtcgcccagctctatcctatagctatatttatcaaacccaggagcttagagccgctgatggagatgaataaaagactaaccgaggagcaggccaagaagacctatgatcgtgcgatcaagctcgagcaggaatttggagagtacttcactgctattgtccagggggatacgttggaagacatatataatcaatgtaagctagtgatcgaggaacaatcaggtccttttatctggatcccttccaaagagaagctttag

SEQ ID NO: 220978 - DNA, 2550 bp, Artificial Sequence
  Description of Artificial Sequence: Synthetic coding sequence
atgcataaacaccaacattgttgtaaatgccccgagtgttacgaagtaacaagattggccgcactcagaagactagaaccaccgggatatggagactggcaggtcccagacccatacgggcctgggggagggaacggagcctctgccggatatggaggttactccagtcagacactcccgtcccaagcgggtgctactcctaccccgagaaccaaagccaagctgattccaaccggacgtgatgttggaccggtgccccctaagcctgtccctggtaaaagcaccccgaaattaaatgggtccgggccttcatggtggccagaatgtacgtgtactaacagagactggtatgagcaggcacggcctgcacctcttctcgttaatcccgagacactgaaacacagtctgtcagttaacggctccgatgggatgtttaagtatgaggagatagtcctcgagcgcggaaacagcggcctcggattctcaatcgccggaggaatcgacaatcctcatgtgccagacgatcccggaatcttcattaccaagatcataccagggggtgcggcagccatggatggtaggttgggagtaaacgattgcgtgctgagagtgaacgaggtcgatgtgtctgaagtcgttcactcccgggcagtggaggccttaaaggaggcaggcccagtcgtcagactcgtggtgcgaagacggcaaccccctcccgaaacaattatggaagtcaacctgctcaaaggccctaagggactgggcttctcaatagccggtggtattggaaatcagcacatacctggagacaacagcatttacatcactaagattatcgaggggggagcggcacagaaagatgggcgacttcagatcggcgacagactgctcgccgtgaacaacacaaacttacaagacgtgcgacacgaagaggccgtggcctcccttaagaacactagcgatatggtttacctgaaggttgcgaagcctggtagcctgcacctgaatgatatgtacgctccacctgactatgccagcacctttacggctcttgccgacaatcatattagccacaactcatccttgggatatctgggcgcagtggagagcaaagtttcatacccggctccaccacaggtccctccaacccggtactcgcctattccccgtcatatgcttgccgaggaagactttaccagggaacccaggaagattattcttcataagggcagtactgggctgggatttaatattgtggggggagaggacggggagggaatctttgtgtcttttattctggctggtggtcctgcggatttgtcaggtgaattgcgtaggggcgatcggatcctgagcgtgaacggcgtcaatctgagaaacgcgacacatgaacaggccgctgccgcactcaaacgcgcaggacagtctgtcaccattgttgcgcagtatcgacccgaggagtatagtcgctttgagtctaaaatccacgacctgcgggagcagatgatgaattcctcaatgtcatcagggtcgggcagcctgcggacttccgagaaacgatctctgtatgtgagggccttatttgattacgatcgtacccgagattcttgcctgccgtctcagggcctttcttttagttacggagatatcttgcacgtcatcaatgcgtcagacgacgagtggtggcaagcccgattggttaccccccacggggagtcagaacagattggtgtgatcccctccaagaagagggtggagaagaaggagcgggctcggctgaagactgtgaagtttcacgctagaaccgggatgatcgagtctaaccgggatttccctggactatccgacgactattacggggctaaaaatctaaaaggcgtgacttctaacacctctgattccgagagttcctccaaggggcaagaagacgccattctgagctatgaaccagtgacccgccaagaaattcactacgccagaccggtgataatattagggccaatgaaggatagggtgaatgacgacctaatctctgagtttccacacaagttcggctcatgtgtgccacacacaacaaggccgaggagagataacgaagttgatggtcaggattatcactttgtagtgtctcgcgaacagatggagaaagacattcaggataataaatttattgaggcaggccagttcaacgacaacctatacgggaccagcatccaaagtgtacgggctgtggccgaacggggaaaacattgcatactcgacgtcagtggaaacgccattaagcgtttgcagcaggcacagctgtacccaattgccatttttatcaagcccaagtccatcgaggcattgatggagatgaaccggcgtcagacttacgaacaagctaacaaaatttacgacaaggccatgaaactggaacaagagttcggtgagtactttaccgcgattgtccagggggacagtctggaggaaatctataacaagattaaacaaatcattgaagaccagtcaggacattatatttgggttcctagccctgagaagctgtag

SEQ ID NO: 220979 - DNA, 2454 bp, Artificial Sequence
  Description of Artificial Sequence: Synthetic coding sequence
atgcataagcatcagcactgctgtaagtgtcctgagtgttatgaggtgacaaggcttgcagccttaaggcggctggagccacccggatatggcgactggcaggttccagacccatatggtcctgggggagggaatggcgctagcgcaggttatggtgggtattcctcacagaccctgccctcacaggcgggagccaccccgacccccagaaccaaggctaagctcatccctacaggcagagacgtgggccctgtgccccctaagccagtacccggaaaaagtacccctaaactgaacggatccgggcctagttggtggccagaatgcacatgcaccaaccgggactggtatgaacaagtgaacggctcagacgggatgttcaagtacgaagagattgtgttagaacggggaaacagcggactcgggttctcgatcgcgggaggcatcgacaatcctcatgtgcctgacgatccaggcatttttattactaagattattcctggtggggcagctgcaatggacggtcgtttgggagtaaacgattgcgttctgcgagtgaacgaggtggatgtttccgaggtggttcactcaagggccgtggaggctctgaaagaggcaggtcctgttgtgaggctggtcgtcagacggcgacagcctcctcctgagacaatcatggaggtaaacttgttaaagggccctaagggattggggttttctattgctggaggaatcggaaatcaacatatcccaggtgataacagcatttatattactaaaataatcgagggaggcgcagcccagaaagatggacgcctgcagattggtgataggctgctggccgtcaacaataccaacctgcaagacgtgaggcacgaggaagcggtggcaagcttaaagaacacctcggacatggtgtacctcaaggtagcaaagccaggttcactgcacctaaatgacatgtacgctccacccgactacgccagtaccttcactgcactggcagacaatcatattagccacaactcaagtttgggatatctgggcgcagtagagtccaaggtgagctaccccgcacccccacaagtcccgcctacccgatattcacccattcccaggcacatgctcgccgaagaagacttcacacgggaacctcgtaagattattctgcacaaggggtctacaggccttggatttaatatcgtgggaggggaagatggagaaggaatctttgtaagcttcatcctcgcgggagggcctgctgacctgagcggtgaactccggcgaggcgacagaattttgagcgtgaacggagtgaacttaagaaatgccactcatgaacaggccgcagccgctcttaagcgggctggccaaagtgtgaccatcgtcgctcagtatcgtcccgaagaatatagcaggttcgagtcaaaaatccacgacctgcgagaacagatgatgaattctagcatgagcagtggttctgggagccttcgcacttccgaaaaaaggtctctgtatgtgcgcgctttgtttgattatgacagaacacgcgattcttgtctgccaagccaaggcctctcttttagctatggcgacatcctccatgtgattaatgccagtgacgatgagtggtggcaggccagactcgtgacgccacatggggagtcagaacagattggtgtgatcccttccaagaagagggtggaaaaaaaagaacgcgcaaggctgaagacagtaaaatttcacgcgcgtactggcatgattgaatcaaatcgggattttccagggttatcagacgactactacggagccaagaacctaaagggacaagaagacgctattctgtcgtatgaacctgtgacccgacaggagattcactatgcgagaccagtaatcatcttgggacctatgaaagatcgcgtcaacgacgacctcatcagcgaattcccccacaaatttggctcctgcgtaccccacacaaccaggccacgaagagacaatgaagttgatggccaggactatcacttcgtcgttagccgggagcagatggagaaagatattcaggacaataaattcatcgaagccggacagtttaatgacaatctctacggtaccagtatccagagtgtccgggctgtggccgagcgcggtaagcactgtatcctggatgtttcagggaacgctatcaaacgtctccagcaagcacagttgtacccgatagcaatctttatcaagcccaaatcaatcgaagccctgatggagatgaatcgacgtcaaacctatgagcaggccaataagatctatgacaaggccatgaaactggagcaagagtttggggagtacttcaccgctattgtgcagggcgatagtctggaggagatttacaataagattaaacagatcatcgaggaccagtccggacactacatctgggtaccatcaccagaaaagttgtag

SEQ ID NO: 220980 - DNA, 1101 bp, Artificial Sequence
  Description of Artificial Sequence: Synthetic coding sequence
atgatgaatagttctatgtcatcaggatccggaagtctgcgcacatcagaaaaaaggtctctgtacgttcgggctctgttcgattacgataggactcgggacagctgtctcccctcccagggattgtccttttcctatggggatatcttgcatgtgattaatgcatctgacgatgaatggtggcaggccaggctggtcactccgcatggcgagtcagagcagattggggtcattccaagcaaaaaaagagttgagaaaaaggagagggcaaggttgaagaccgtgaaatttcacgctcgtacaggtatgattgaatcaaatcggtctataaagaccaaacgcaaaaagtcatttcgattatccaggaaattcccattttacaagagtaaggagaacatggcacaggagagcagcattcaggagcagggagtgacatccaacacttcagatagcgaatcatcaagcaaggggcaagaggatgcgatcctcagctatgaacccgtaacccgacaggagatacattacgctcgccctgtaataatactgggacctatgaaagatcgcgtcaacgacgatctgatctctgagtttccccataagtttggcagctgcgtgcctcacaccaccaggcccagaagagataacgaggtggatgggcaggattaccatttcgtggtgtcaagggagcagatggaaaaagatatacaggataacaaattcattgaggccggacaattcaatgataatctctacggcacatctatacagagcgtgcgagcggtggccgagaggggcaagcattgcatcctggatgtgagcgggaacgccatcaaacgcctccagcaggctcagctgtaccctatcgccatcttcatcaagcccaagtcaattgaggccctaatggaaatgaatcgcagacagacgtacgaacaggctaacaagatatacgacaaagctatgaaactggagcaagaatttggagaatactttactgccatagtccagggggacagcctcgaggaaatctacaacaaaatcaaacagatcatagaggatcagtctggacattatatctgggtgccctcccctgaaaagctgtag

SEQ ID NO: 220981 - DNA, 2304 bp, Artificial Sequence
  Description of Artificial Sequence: Synthetic coding sequence
atgtcacagagacccagagctcccaggagtgccctgtggctcctggcccctccattgctaaggtgggcccctcccctccttacagtgttgcatagcgacttgtttcaggccctgcttgacatcctggattactatgaagcatctctcagtgagagccaaaaataccgctatcaggatgaggacacacctcccttggagcactctcctgctcatttgccaaaccaggccaattctccccctgtgatcgtgaatacagacactctggaggcgcctggctatgaactccaggtaaatgggacagaaggggaaatggagtacgaggagataacattggaaaggggtaactcagggctaggattctcgattgctggaggcaccgacaacccccacatcggtgacgaccccagcatcttcataacaaaaataatccctgggggtgcagcagcacaggatggacgcttgcgggtgaatgacagcattctgttcgtcaacgaggtcgatgtgcgagaagtgacacactcagccgcagtcgaggccctcaaagaagcgggaagcatagtgcgtctgtatgtgatgaggaggaagccacccgcagaaaaagtgatggagatcaaactgataaaaggccctaagggtctagggttttcaattgctggaggggttggaaaccagcacattcctggggacaactctatttacgtcacgaagatcatcgagggcggtgctgctcataaggacggacgcctccagattggcgacaaaatcctcgccgtgaattcagtgggactggaggacgtgatgcacgaggacgccgtcgccgctcttaagaatacatacgacgtggtctacctgaaagtcgctaagccaagcaatgcgtatcttagcgactcctatgcacctccagacattacaacatcctactctcagcacttagacaatgagatctcccatagtagctacctgggcacagattacccgacggcaatgactcctacaagtccccgtcggtacagtccagtggctaaggacttactgggtgaagaggatatccctcgagagccaagacgcatagtgatccacaggggctccactggcctgggcttcaacatcgtcggtggcgaagatggagagggaatttttatctccttcatattggctggaggtccagctgatctgagtggcgagctgcgcaagggggaccagatcctttctgtgaatggagttgatctgaggaatgcatcccacgagcaagctgccatagctctaaaaaacgcgggacagaccgtgactataattgcccaatataagcccgaggagtatagccgcttcgaagcgaaaatccacgacctgagagaacaactgatgaactcttccctcggctcagggacagcatctctccggagcaatccaaagcggggtttctatatcagagctctattcgactatgacaagacaaaagactgtggttttctaagccaggcattatcattccgttttggagacgtgctccacgtgattgacgctagcgatgaggaatggtggcaggcccgacgtgtgcactcagacagtgagaccgacgatattggctttattcctagcaagaggcgcgtcgagaggagggaatggtcccgcttgaaggccaaagattggggaagcagctctggaagccagggaagggaggatagcgtcctatcttacgagacagtcacacagatggaggtacactatgcacgccctataattattctcggcccaaccaaggacagggccaatgacgacttgctgtccgaattccctgacaaattcgggtcctgcgtccctcatactactcggcctaaacgcgaatacgaaattgatgggagggattatcatttcgttagttcaagggaaaagatggagaaagatatccaagcccataaatttatagaagccggacaatataacagccacctgtacggtacttccgtccagtcagtgcgtgaggttgcagagcagggaaaacattgcattctggatgtgtcggcaaacgcggtcagacggctgcaggcagcgcacctgcatcctatcgcaatttttatccggccacgttctcttgaaaacgtactcgagattaataaaagaattactgaggaacaagcgaggaaagccttcgacagggccacaaagctggagcaagagttcaccgagtgtttcagtgccattgttgaaggcgattcatttgaagagatttaccacaaggtcaagagggtgattgaggatctgtcaggtccttacatttgggtgcccgctagggaacgcttgtag

SEQ ID NO: 220982 - DNA, 2166 bp, Artificial Sequence
  Description of Artificial Sequence: Synthetic coding sequence
atggattgcttgtgtattgtgacaacaaaaaagtatagataccaggatgaagacacccccccacttgagcattccccagcacatttgccgaatcaggccaatagcccgccagtcatcgtgaacacagatacattggaggcacctgggtatgtcaatggcaccgaaggagagatggagtacgaagagattactctagaacgtggtaactcaggcctggggttcagcatcgccggtgggaccgataatccgcatataggggatgaccctagcattttcatcactaaaattatccccggaggggctgccgctcaagatgggaggctgcgggtcaatgattctattctgttcgtgaatgaagtcgatgtgagggaggtgactcactccgcagctgttgaggctctgaaagaggccggaagtatcgttcgcctttatgtgatgcgacggaagccccctgccgagaaggtgatggaaataaaactgatcaaagggccaaaagggctgggattttccattgcagggggagtgggcaaccagcacatccccggagacaacagcatatatgtgacaaaaattattgaggggggagcagctcacaaggatgggaggctgcaaatcggagataagatcctggctgtgaactcagtaggactcgaggacgtcatgcacgaagacgcagtcgctgcactcaaaaatacatatgatgtggtgtatctcaaggttgcgaagccgagcaacgcttacctttccgactcctatgccccaccagatatcactaccagttactctcagcacctggataacgaaatatcacattctagttatctcggcaccgattatcctacggccatgacaccaacttccccacgccgatacagccccgttgccaaagacctgcttggtgaagaagacattcctcgcgagcctcgccgaattgtcatccacagagggagcactggactgggtttcaacattgtcggtggtgaggatggcgagggcatctttatcagctttatccttgctggcggtccagctgacctaagcggcgagcttagaaagggagatcagattctctcagttaatggggtcgaccttcgcaatgcctcccatgagcaggccgcaatcgcattgaaaaacgcaggacagaccgtcaccatcatcgctcaatataagcccgaggagtattctcgcttcgaggccaagatccacgacctgcgagaacagctgatgaattcgtcgctggggtcaggcaccgctagtctgcggagtaaccctaagcggggtttctatattcgtgctctattcgattacgacaagaccaaggattgtggctttttatctcaggcgctgagctttaggtttggcgatgtcctgcacgtcatagacgcgagtgacgaagagtggtggcaggcacgacgcgtacacagcgactctgaaacagacgatatcggcttcatacctagcaaaaggcgggtggaacggcgagaatggtcccggttgaaagcgaaagactggggctcctcctctggctcgcaggggagagaagacagcgtgctctcctatgaaactgttacccagatggaggtccactacgccagacctattattattcttggacccactaaggatagagctaatgacgatttactgtccgagttcccagataagttcggcagctgtgtgccgcacaccacccggcctaaaagagagtacgagattgatggaagagattaccactttgtgtcctcccgagaaaagatggagaaggacattcaagcacataagttcatcgaagcaggccagtataactctcacctttacggtacgagtgtgcagagtgtcagagaggtcgcagaacagggcaaacattgtattcttgacgtgagcgcgaacgctgttaggcgcctacaagcggcacatctccaccctatagccatcttcatcagacctcggtcactagagaacgtcctggagatcaacaagcgaatcacagaagaacaggccagaaaagccttcgatcgagctacgaagctcgagcaagaatttaccgagtgcttctctgccatcgtggaaggcgatagttttgaggaaatctaccacaaagtgaagagggtaatcgaggatctgtctggcccttacatctgggtcccggcacgagaacggttatag

SEQ ID NO: 220983 - DNA, 1995 bp, Artificial Sequence
  Description of Artificial Sequence: Synthetic coding sequence
atggaatacgaagagattactctggaacgagggaacagtgggctgggcttttccatcgcaggaggcaccgacaacccgcacataggggacgatccttccatcttcataaccaaaatcatcccaggtggcgctgcggcacaggacggccgtcttagagtgaacgactctatactgttcgtaaatgaagttgatgtgagagaagttacacattcggctgccgtcgaggctcttaaggaggcgggaagcatcgtgcggctctatgttatgcgcagaaaaccccctgcagaaaaagtgatggagattaagctaattaaaggacctaaaggattaggtttttcaattgccggaggcgtaggaaatcaacatatccctggggacaacagcatatatgtcactaaaatcattgaagggggagcggcacacaaggatggacggctgcagatcggggacaagatcctggccgtcaattcagtcggcttagaagatgtgatgcatgaggacgcagtcgccgcattgaagaacacatatgacgttgtctacctgaaggttgctaagccttccaacgcctatttgtccgattcttacgccccacctgacatcacaaccagctattcacagcatttagataacgagattagccactcctcatacctggggactgattatccaaccgcgatgaccccaacaagcccacgccgttacagtccagtggcgaaggacctgctaggggaagaagatatcccccgagaacctaggcgaatcgtcatccatagagggagtactggacttggatttaatatcgtgggtggagaagacggtgagggcatctttatctcattcattttggctggaggcccagcagatttgtccggggagctcagaaaaggggatcaaatcttgtccgtgaatggggttgacttgaggaatgcatctcatgagcaggctgccattgcactgaaaaatgctggtcaaacagtcactattattgctcagtacaagccggaagagtacagtaggtttgaagccaagattcatgatctgcgggaacagctgatgaattcttcactgggctcaggcaccgcttcactgcgcagcaatcctaaacgaggcttttacatacgggctctgtttgattacgataagaccaaggattgcggtttcctcagccaagccttgtccttcagattcggagatgtccttcacgtgattgacgcaagtgacgaagaatggtggcaggctaggcgcgtgcactctgactccgagactgatgacatcggcttcatccccagcaagcggagagtcgaaaggagggagtggtcgaggttaaaagcgaaggactggggatcatccagcggctcacagggtcgggaagattccgtcctcagctacgaaaccgtgactcagatggaagtgcattacgcacgccctatcatcattctggggcctactaaggatcgggctaacgacgacctgttgagcgaattccctgacaagttcggctcctgtgttccccataccacacgccctaagcgggagtacgaaatcgatgggcgagattatcacttcgtgagttcaagggaaaaaatggagaaagatatacaggcccataagttcattgaagccggtcagtacaatagccatctttacggcacaagcgtgcaaagtgtgagggaggtggcggagcagggtaagcactgtatcttggatgtctctgccaacgcagtccggaggcttcaggctgcacacctgcaccctatagcaattttcatccgaccgagaagtctggaaaacgtcttggagattaataagcgtattaccgaggagcaggctaggaaagcgtttgatcgagcgaccaagctggaacaggagttcacagaatgctttagcgcgatagtagagggcgattccttcgaggaaatttaccataaagtaaaaagagtcatagaggacctgtctggaccctacatatgggtgccagcccgagagcggctctag

SEQ ID NO: 220984 - DNA, 2175 bp, Artificial Sequence
  Description of Artificial Sequence: Synthetic coding sequence
atggattgcctatgtatcgtgacgacgaaaaagtaccgatatcaggatgaggacactcctcccctggagcacagtccagcacatctgcctaaccaggctaactctcccccagtgatagtgaacactgacactctggaagccccaggctacgttttgcaagtgaatggaaccgagggggaaatggaatacgaagagataacccttgagcgcggtaactcagggcttgggttttcaattgcgggaggcacggataatccccacattggtgatgacccgtccatttttattaccaaaatcatcccagggggagccgcagcccaggacggaagacttcgcgtaaatgacagtatcctctttgtgaacgaagtggatgtgagagaggtgactcattcggcagctgtagaggccctcaaggaggcaggcagcattgtgcgcctgtatgtgatgagacggaagcccccagcagaaaaggtgatggaaatcaaattgatcaaaggccctaaggggttgggattcagcattgcgggaggcgtgggtaatcaacatatccccggagataactctatctacgtcacaaagatcatcgaaggtggggcagctcataaagacggccgtctgcagataggagataaaatcctagctgtgaactctgtgggcctggaggacgtaatgcatgaggacgctgtggcagccttaaaaaatacgtatgatgtcgtttacctaaaagtggctaagcctagtaacgcctatttgtctgatagctacgcgcctcctgacatcactacctcatacagccaacacctcgacaatgaaatatcccactctagctatctggggacagattacccaacagccatgacgcctacatccccaaggcggtacagtcccgttgcaaaggaccttctgggagaggaggacataccgagggagcctcgacggatcgtgattcacagaggatccacgggactgggattcaacatcgtcgggggtgaagacggagaggggatctttattagctttatcttagcagggggtcctgcagacctttccggcgagctccggaagggtgaccagattctgtctgtcaacggggtcgatctaaggaatgctagtcatgaacaggcagctatcgcactgaagaacgctggccagactgttaccatcatcgcccagtacaaacccgaggagtattcacgtttcgaagctaagatccatgatctgcgcgagcagctgatgaacagctctctgggatctggtaccgctagcctgagatcaaaccccaaaaggggtttctatatcagggcccttttcgactatgataagacaaaagattgcggatttctgagccaagccctatcatttaggttcggcgacgtattgcacgtgatcgatgctagcgacgaagagtggtggcaggccaggagagtgcacagtgattctgaaaccgatgacataggcttcattccctcaaaacgaagagttgagcgacgcgagtggtccagactgaaggctaaagattggggctcctcctctggaagccagggcagggaggattctgtgctgtcttacgagacagtaactcaaatggaagtgcactacgccaggcctataattattcttggccctactaaggacagagccaatgacgatctcctgtcagagttccccgataagttcggtagttgtgttccccatacaaccagacccaaacgggagtacgagatcgacgggagagactaccatttcgtctcatccagggagaaaatggagaaagatattcaggcccataaattcattgaggcagggcaatacaactcgcacctctacggtacgagcgttcagtcagtgcgagaggtggccgagcaggggaagcactgtattcttgatgtatccgctaacgctgtcagaagactccaggctgcccatctgcaccccatcgccatttttatccggccacgctcattggaaaatgtgctcgagatcaacaagaggataacggaagagcaagcaagaaaagcctttgaccgggctaccaagttggagcaggaatttaccgaatgtttttccgcgatcgtggagggagattcgttcgaggaaatctatcacaaggtcaaacgtgtgatcgaggacttgtcggggccttacatttgggtgcccgcaagggagcgtctgtag

SEQ ID NO: 220985 - DNA, 2304 bp, Artificial Sequence
  Description of Artificial Sequence: Synthetic coding sequence
atgagtcagaggcccagggcgccacggtcagcgttgtggctcctagcccctcctctgttacgttgggcaccacccctgctgaccgtgctccattctgacttattccaggccctcctggacatacttgattattatgaagcgagcctctcagaaagtcagaagtaccgctaccaggatgaagacactccgcctctcgaacactcccctgcgcacctgcccaatcaagctaactccccaccagttatcgtcaatactgacactctggaggccccaggttacgttttacaggtaaatgggacggagggggaaatggagtacgaggaaatcactttagagcgcggtaactccggccttggcttttctattgccggagggacagataacccccacattggggacgatccctctattttcatcaccaagattatcccaggaggcgcagcggctcaggacgggaggctgagggtcaatgacagtattctgttcgttaatgaagtggatgtgcgcgaggtgactcattcagccgcagtggaggcactgaaagaggccggttctatcgttaggctgtatgtcatgcgcagaaagcctcccgcagagaaggttatggagattaagttaattaaagggcctaagggcctgggttttagtattgccggaggagtcggaaaccagcacatccccggtgataactctatctatgtgaccaagattattgagggaggagccgcacacaaggacgggcgactccagattggcgataagatcctcgcggtcaacagcgtcgggctagaagatgttatgcacgaagacgcagtcgccgctctgaaaaacacctatgacgtcgtatacctcaaggtggccaaaccttcgaatgcctacctgtccgactcatatgcaccacccgacatcacgacatcctacagccaacacttggataacgaaatcagccactctagctacctcggcacagactatcccaccgctatgacgcccacatcgcccagaaggtattcccccgtggctaaggacctgctcggagaggaagacataccacgggaacccaggcggattgtcattcatcgaggcagcactggactgggcttcaatatcgttgggggtgaggacggcgaaggaatctttatttccttcatcttggcaggcggtcctgctgatttaagtggagaactacgcaagggagatcaaatcttatccgtaaacggcgtcgatctgagaaatgcaagccatgaacaggccgctatcgccctcaagaacgccggacagacagtgacaataattgcgcaatacaagcccgaggaatacagtcggtttgaggcgaagattcacgaccttcgggagcagctgatgaacagttcacttgggtccggcactgcctctttacgttccaaccctaaaagaggcttttatattcgtgccctgtttgactacgataagactaaagactgcgggttcctatctcaggctctcagctttcgatttggggatgtgctgcacgtgatagatgccagcgacgaagagtggtggcaagctaggcgcgtccacagtgatagtgaaacggacgacatcgggttcattccttctaagcgtcgagttgaacggagagaatggtccagattaaaggccaaagactggggtagcagttcaggaagccaaggcagggaagactcagtactcagctatgagaccgtaacacaaatggaggtgcactatgctcgccctattataatcctcgggccaacaaaagatagggctaatgatgacctgttgagcgagttcccggataagttcggttcgtgcgtcccgcacacaactcgcccaaagcgcgaatatgaaatcgacggcagggactaccatttcgtctcgtcccgcgaaaaaatggaaaaggatattcaggcccacaagtttatcgaggccggacagtataactcacacttatacggcacctccgtgcagagcgttcgcgaggtcgctgaacagggaaagcattgcatacttgatgtctccgctaatgcggttcgacgactgcaggcagcacatttgcaccctattgcaatctttatccggcctcgatctctcgagaacgtgcttgagattaataaaaggatcaccgaggagcaggcacgcaaagccttcgacagagccacaaagctggaacaggagttcaccgagtgcttctccgctatcgttgagggggacagctttgaggagatctaccacaaagtgaagcgtgtgatcgaggatcttagcggaccctacatttgggtgccagcccgtgagaggctctag

SEQ ID NO: 220986 - DNA, 2004 bp, Artificial Sequence
  Description of Artificial Sequence: Synthetic coding sequence
atgagtcagcggccaagggctcccagatcggcactctggctgctggccccaccactattacgttgggcccctccacttctgacggtcttgcacagcgacctcttccaggctcttttagatatcctcgattactacgaagccagtttgtcagaaagtcaaaaatatcgctatcaggatgaggacacccccccacttgaacactcccctgcccatctgcctaaccaagccaatagtcctccggtgatcgtgaatactgacaccttagaggcccctgggtacgagctacaggtcaatggcactgaaggcgagatggaatatgaggagattaccctggaacgcggaaactccgggctgggttttagcattgctgggggaacagacaatccgcatatcggcgacgatccaagcattttcatcactaagatcattccagggggagctgctgcacaggacggaagattgcgcgtgaatgacagcattctttttgtaaatgaggtggatgtgcgcgaggtaacgcactcggcagcggtggaagccctgaaggaggccggttccatagtgagactgtacgtaatgcgcaggaaacctcctgccgaaaaggtgatggagattaaactaattaagggtccaaagggccttggattttctatcgccggaggtgttggcaaccagcacattccaggagacaactctatatatgtaacgaagataatcgagggtggcgcagcgcataaagatggcaggttgcagataggtgataaaatcctagctgtcaatagtgttggattggaggacgttatgcacgaggacgctgtcgctgctcttaaaaatacatacgatgtggtctatttaaaggttgcaaagccttctaatgcatacctgtcagattcctacgctccacccgacatcaccacctcttacagtcagcaccttgataacgaaatcagccactcatcctacttgggaaccgattacccgactgcgatgacaccaacctctcccagacggtacagccccgtcgcaaaagatctgctgggggaagaagacatccctagagagccccgacggatcgtaatccatcgaggctctactggcctggggtttaacattgtgggaggggaagatggagaaggaatctttatctctttcatcctggctggcggaccggctgatctatccggtgaattgaggaagggagatcagatcctgagcgtgaacggagtggacttgcgaaatgcctctcacgaacaagcagcaatcgcgctaaaaaacgctggacagacggtgaccatcatcgcgcagtacaagccggaagagtacagtaggttcgaggcaaaaatccatgacctcagggaacagctgatgaatagctcactgggttctggaactgccagcttgaggagcaatcctaaacggggtttttacatacgcgctttgttcgattatgataagacgaaggattgcggcttcttgtcgcaggctctcagcttcaggttcggcgatgtgctgcatgtcatcgatgcctcagacgaggaatggtggcaggctcgaagggtgcacagcgactcggaaactgatgacataggtttcatcccaagcaagaggagggtggaacgtcgagaatggtcacgcctcaaggcaaaagactgggggtccagcagcgggagtcagggacgcgaggattcagttctctcctacgaaacagtgacccaaatggaagtccattacgctcgaccaatcataatcctcgggcctaccaaggacagggcgaacgatgacctgctcagtgagttccctgacaaatttgggtcatgtgtgccacacaccactcgccctaaaagggaatacgaaatcgacggaagagattaccacttcgtgtccagcagagaaaagatggaaaaggacattcaggcccacaaattcatcgaggctgggcaatacaacagtcatctgtacggcacaagcgtgcagtccgtgcgggaggttgctgaacagagagattag

SEQ ID NO: 220987 - DNA, 4740 bp, Artificial Sequence
  Description of Artificial Sequence: Synthetic coding sequence
atggagccccagaggagggagctgcttgcacagtgccagcaaagcctcgcgcaggccatgaccgaagtggaggcggtgctcgggttattggaggccgctggggctctctctccaggagagcgcaggcagttggacgaggaagctggcggagccaaagctgagctcctgctcaaactcctcctggcaaaagagcgggaccattttcaggacctgcgggctgccctggaaaaaacccagcctcacctgctgcccatcctctatttgaatggcgtcgtgggaccaccgcagccggcagagggtgctgggtcaacttactctgttctgagtaccatgccaagcgacagcgaatcatcctctagtttgagctccgtgggtaccaccggcaaggcccctagccctccccctctgttaaccgatcagcaggttaatgaaaaagtcgagaacctttccattcaactccgtttgatgacacgcgaaagaaatgagttgcggaaacgtctggcttttgctacccacggcactgcatttgataagcgcccataccacagactcaatcccgattatgagaggttgaagatccaatgcgtacgagccatgtctgacctgcagagtcttcagaatcagcatacaaatgcgctgaagagatgcgaagaagtggctaaggagacggacttttatcacactctgcactcccgcctgctgagtgaccagacaaggctcaaagatgacgtggacatgctacgacgggagaacgggcaattgctgcgggaacggaatctgttgcagcaaagttgggaagatatgaaaaggctccacgaagaagatcagaaggagatcggagatctccgtgcacagcagcaacaagtgttgaaacataacggctcctccgaaattctcaacaagctgtacgacaccgccatggacaaactcgaggtggtgaaaaaagattatgacgccctgcggaagcgatacagcgagaaagtggccatccacaatgccgacttgagtcgcctggagcagctgggggaggaaaatcaaagactcttgaagcagacagaaatgctgacccagcagagggataccgcaatccagctccagcatcaatgcgctctgtctctgcgcaggtttgaggccattcaccacgagctgaataaagccactgcacaaaacaaggatttgcaatgggagatggagctgctgcagtctgaattgaccgagctgcggaccactcaggtgaaaaccgcaaaagagtccgagaagtatagggaggaaagggatgccgtgtatagtgagtataagctgatcatgtcagaaagagatcaggttataagcgagttggataagctgcaaaccgaagtggagctcgcagaatcgaagctgaagagcagcacaagtgagaagaaggcagcaaacgaggagatggaagcactgaggcagataaaggacaccgtgactatggacgctgggagggctaataaagaggtggaaatcctcaggaaacagtgcaaggccctctgtcaagaacttaaagaagcactgcaagaggctgatgtcgcaaaatgccggcgagattgggcatttcaggagagggacaaaattgtggccgagcgcgattccattcgcactctatgcgacaacctgcgccgagaacgagaccgggcagtttctgagctagctgaggctttaagatccctcgatgacactcggaaacaaaagaacgatgtgtctagagaactgaaagaactcaaagaacagatggaatcacagttggaaaaagaagccaggtttcgccaattaatggctcacagttctcacgacagtgctatcgataccgacagcatggaatgggaaaccgaagtcgtggagttcgagagggagaccgaggacatagatttgaaagctctgggattcgacatggccgaaggcgtaaacgaaccatgctttcccggagactgcgggatcttcgtgacaaaggtggacaaagggtcaattgctgatgggcgactccgggtcaatgattggctactgcgtataaatgacgttgatcttattaataaagataagaaacaggcaataaaggcacttttgaatggagagggagccattaatatggttgtcaggcgcagaaagtccctgggaggtaaggttgtcaccccactgcatatcaatctgtcaggacaaaaggactcaggtatttctctggagaacggtgtgtacgcagcagccgttctccctggatcgcctgccgctaaagaaggctctcttgctgtgggcgaccgaatagttgctatcaacggaatcgcactggataacaaatccttaaatgagtgtgaatctcttcttcggtcctgccaagactctctaaccttgtccctgctgaaagaacaaaaatgcgtgcctgcatctggtgaactgtcccctgaactgcaggaatgggccccatattcccctggccacagctcccggcactctaatcctcctctgtatcccagcaggcctagcgtgggcacggtacccaggagtttgactccgtctaccactgtctctagtatcttgcgcaatccaatatacacagtgcggagccacagggtcggtccctgctcaagtcctcctgcagccagggatgctggacctcaaggtctccacccatcagttcagcatcagggcagactatcactggatctttctcacagaacttgttccgactattctgaaatgagagccactcatgggagcaattccttgccttcatcggcaaggctaggctctagttcaaatctgcagttcaaggcagaaaggataaaaattccaagcaccccgagatatccccgttcggtggtcggcagtgagagggggagtgtgtcccactccgagtgcagcactcctccccagtctccattaaatatcgacaccctgtcttcttgttcacagtcacagacatctgctagtacgctgcctaggatagcggttaaccccgcttcgcttggggagcgtcggaaggatagaccgtatgtagaagaaccccgacacgttaaggtgcaaaagggatctgagcctctggggatctctattgtcagtggcgagaaggggggtatctacgtttctaaagtgacagttggctctatcgcgcaccaggcgggacttgaatatggcgaccaactccttgagtttaatggcataaacctgagatctgccacggagcagcaggcccgactgattataggtcagcagtgtgatactatcactattttagcacagtacaatcctcacgtgcatcaattaagttcccactcacgttcctcatctcatctggaccctgctggcacacactctaccctgcagggcagtggcactactactcctgagcatccatctgtcatcgatccactgatggaacaggacgaaggtccatctacccccccagccaagcagtcaagctccaggatcgcgggtgatgccaacaaaaaaaccctggagcctcgggtcgtgtttataaagaagagccagctggaactcggggtgcacctctgcgggggaaatttgcatggggttttcgttgctgaagtcgaagacgattcccccgctaaggggccagacggacttgtgccaggagatttaatactagagtacgggtcactggatgtgcgcaacaagaccgtagaggaggtgtacgttgagatgctgaaaccccgagatggtgtaaggctgaaggtgcaatatcgacccgaggaattcacgaaagccaagggactgccaggcgactcattctacattcgggcactgtacgatagactagctgatgtggaacaggaactatcattcaaaaaggacgatattctgtacgtggacgacacgttaccacagggtacttttggatcgtggatggcttggcaactggatgagaatgcacagaagatccagagaggtcagatacccagcaaatacgtcatggaccaggaattctctcgaagactgtccatgagcgaggtgaaagatgataacagcgcgaccaaaactctctcagcagctgctcgcaggtcttttttccgacgtaagcataaacacaaacgttcaggctctaaggacggcaaagaccttctggccctggatgccttcagcagcgatagcatccccttgttcgaggactccgtgtcattggcttatcaacgagttcagaaggtggactgtacggccctccgccctgtgctcatcctggggcctctgctcgacgtcgtgaaggagatgctggtcaacgaggctccgggaaagttttgtagatgtccattggaagtgatgaaagcttcccagcaggccatcgaaaggggtgtcaaagattgtctatttgtggactacaaacgcaggtctggtcactttgacgtcaccactgttgcatctatcaaagaaattacagaaaagaacaggcattgtctccttgacatcgcaccccatgcaattgaacgacttcaccacatgcacatttatcccatagttatctttatccattacaagtcagccaagcatatcaaggagcagcgagatccaatctacttgagagataaagtaacccagagacatagcaaagagcagttcgaagccgctcagaaactagaacaggaatattcccgctacttcaccggcgttatccaaggaggtgccctgagctcaatttgcacgcaaatccttgccatggtgaatcaggaacagaacaaagtcctgtggattcctgcatgccctctctag

SEQ ID NO: 220988 - DNA, 5759 bp, Artificial Sequence
  Description of Artificial Sequence: Synthetic coding sequence
atggaaccgcaaaggcgtgaattgctggcccagtgccaacagtccctggcccaggccatgacagaagtagaagcagtgttggggctgctggaagccgctggcgctttatcccccggagaaaggcgacagctggatgaagaagcaggcggagccaaagccgagctccttctgaagctccttctcgccaaggagcgggaccacttccaggacctgcgcgcagctttggagaagacacagccccaccttcttcctatcctctatttgaatggcgtcgtgggaccacctcaacctgctgaaggagcagggagtacatactccgtgctgagtaccatgcccagtgacagcgaatcctctagttccctgagctccgtcgggaccactggtaaagctcccagcccaccacccctgcttacagaccaacaggtgaacgagaaggtagaaaatctcagcattcagctgcggctgatgacccgcgaacgaaatgaactgcggaagaggttggctttcgccactcacggcactgcattcgacaagcgcccttaccacagactcaatcctgactatgagcgactgaagatccagtgcgtgcgcgcaatgtccgacctgcagtccctccaaaaccagcacactaacgctcttaaacggtgcgaagaggtggccaaggaaaccgatttctaccatacacttcatagccgccttttaagcgaccagacacgactcaaagatgacgtggatatgctcagacgggaaaacgggcagctgctgagagagagaaatttgcttcagcaatcttgggaggatatgaaaagattgcatgaggaggaccaaaaagagatcggtgatctgcgagcccagcagcagcaggtgctgaagcacaacggatcttcagaaatccttaacaagctttatgatacggcaatggacaaactggaggtggtgaaaaaggattacgacgctctccgcaaaaggtatagcgaaaaagtggccatacacaacgctgatctctcaaggttggaacagttaggagaggagaaccagagactgctaaagcagactgaaatgctgacacagcaaagggataccgccatccagctgcaacatcagtgtgctctttccctgcgcagatttgaggccatccaccacgaacttaacaaggccacagcccagaacaaagacttgcaatgggagatggagcttctccagtccgagctgacggaactgaggactacacaggtgaaaacagctaaagagtccgaaaaatatcgcgaggaacgtgacgctgtctattctgaatataagctgattatgtccgaaagagatcaagtgatctctgaacttgacaaacttcaaactgaggttgagttggccgagtccaagctgaagagctctacaagcgagaagaaggccgcaaacgaagaaatggaggcgctgaggcagatcaaggatacagtgacgatggacgccggacgcgcaaacaaagaggttgagatcctgaggaagcaatgtaaagccctgtgccaagagctgaaggaggccctgcaggaagcagacgttgccaagtgccggcgagactgggcattccaggagagagataagattgtggctgagcgagactctattagaactctttgtgataacttaagacgggaacgagatagggctgtgtctgaactcgcagaagcattacggtctttggacgacacccgcaaacagaagaacgatgttagccgggagctcaaagagcttaaagagcagatggagagccagctggaaaaagaagcgagatttagacagctgatggctcacagctcccatgactccgctatcgatactgattcaatggagtgggaaaccgaggtggtcgaattcgagagggaaacagaggatatagatcttaaggccctcggcttcgatatggccgagggtgtgaacgaaccatgtttccccggagactgtgggatctttgtgaccaaagtggacaaggggtctattgcagacgggagactgagagtgaatgattggttactccgcatcaatgacgtggacttaatcaacaaggataaaaaacaagcaataaaggcgttgctgaatggagaaggcgctataaatatggtggttcgcagacggaagtcactcggcggtaaggtggtaacacctttacacatcaatctgtccggtcagaaagatagcggtatcagtctcgaaaatggggtgtatgcggctgccgtgctgccaggctcaccggcagctaaagagggctcattggccgtgggggacaggattgtggcaatcaacggcatcgcactcgacaataagtctctgaacgagtgcgagtcgcttctgaggagttgtcaggattcactcaccttgtctctgttgaaagtttttccccagtctagctcctggagtggacagaacattttcgagaatatcaaagactccgacaaaatgctctccttccgggcacatgggcctgaggtgcaggcacataacaaaaggaacctaattcaacacaacaacagtacacaaacggacatattttatacagaccggctggaggacaggaaggaaccgggtccgccagggggatcatcttcatttctgcacaaacccttccccggaggacctctgcaggtctgcccacaggcatgcccttcagcatccgagcggtcactcagctctttcaggtccgacgctagtggcgataggggtttcggtctcgtggatgttcgcggaaggcggccacttcttcctttcgagacagaagtcggtccttgcggtgtgggtgaagcatcactggataaggccgattcagagggttcaaactccgggggaacctggccaaaagcgatgctgtcatccacagccgtccccgaaaagctgtccgtttataaaaaacccaagcagcgcaagagtatcttcgatccgaatacattcaaaagaccccaaacccctcccaagattgactatctcctgccagggccagggcctgcacattctccccagccgtcaaagagagccggtcccctgacacctcccaaacctcccagaagatccgactctattaaatttcagcatagacttgagacttcgtctgagagcgaggccacgttagttggcagctcccccagcacatctccaccatctgctctgcccccagatgtcgaccccggtgaacccatgcacgcaagtcctcccaggaaagcaagagtgcgcatcgcgagcagctactatcccgagggggacggggattcttctcatctgcctgcaaagaagagttgcgacgaggatctgacttcccagaaagtggatgaactgggacagaaacgccgaagaccaaagtcggcgccttcatttaggcctaagctggctcctgtagtcatccccgcacagttcctagaggaacagaagtgcgttcctgcttcaggcgagcttagtcccgaattgcaggaatgggcgccatatagccctgggcattcttccaggcattccaatccccctctatatccttcccggccatccgtcgggactgttcccagatctctgactcccagtaccacagtgagttcaattttgaggaaccccatttacacagtacgctcccaccgggtcggcccatgctcatctccgccagccgcaagggacgctgggccacaaggccttcatccatccgtccagcatcagggtcggttgagcctggacctgtcgcatagaacatgtagtgattattcagagatgcgcgcaacacacggctccaactccctccccagctccgctagactaggaagttccagtaacctgcagttcaaggcagaaaggattaagatcccatcaacgccccgttacccaagatccgttgttggaagcgaacgtgggtccgtgtcccacagcgagtgttccacccctccccaaagccctctgaacatagatacgctgtcctcttgtagccagagccagactagcgcctccacgttacctcggatcgcagtgaatccggctagtctgggcgagaggaggaaagatcgcccatacgtggaagagcccaggcacgtaaaggtgcagaagggcagcgagccactcggcatctcgatagtgtccggcgaaaaaggcggaatatatgtttccaaggttacagtcggatccatcgcccaccaggccggtctggaatacggtgatcagctcctggagtttaatggcattaatctgagaagcgccaccgaacagcaagcgagactgatcatcggacagcagtgtgatacgataaccatattagcacagtacaacccgcatgtgcaccagttgtctagtcacagccggagttcctcccacctcgatcccgctggcacacattccacccttcagggatcagggactacaactcctgaacatcctagcgtgatcgatccattgatggagcaggacgagggcccttcgacccccccagctaagcagtcctcgtcccgaatcgccggagatgctaataaaaagacactggaaccccgtgtggtgttcatcaagaagagccagcttgaactaggtgtgcatctctgcggaggcaacctgcacggcgtattcgtcgcggaggttgaggacgacagtcccgcaaaaggacctgatggcctcgtgcctggagatttaatcctggaatacgggtcccttgacgtgcgtaacaagaccgtggaggaggtatatgtggaaatgctgaagccacgagatggcgtgcgcttgaaagtccagtaccgtcccgaggagttcaccaaggcgaagggacttccgggtgactccttttacattagagccctttacgataggcttgccgacgtggaacaggagttaagcttcaaaaaagacgatatcctttatgttgatgacaccctgccacaggggacttttggtagctggatggcctggcagctggacgaaaacgctcagaagatccagcgtggccagattccatctaagtatgtaatggaccaggaattctctaggcggttatccatgtcggaggtaaaagacgataatagcgccactaaaactctcagcgccgctgccagacgttcattttttagaagaaagcataagcacaaacgatccggctctaaggacggcaaggacctgctcgccctcgacgcctttagttctgattctatccctcttttcgaagattccgtttccttggcataccagcgggtgcaaaaagtcgattgtacagccctgcgcccagtgctgatcttaggacccctgttggatgtcgttaaggagatgcttgtgaatgaagccccaggaaagttctgtagatgccccttggaggtcatgaaggcctcccagcaagcaattgagcggggtgtcaaggactgcctctttgtggactacaagagacgctcaggccattttgacgttactactgttgcatctatcaaggagataaccgaaaaaaatcgtcattgtctgctagatatcgctcctcacgctatcgagagactccatcacatgcacatatatccaattgttatcttcatccactataaaagcgccaaacacattaaggagcagagagaccccatctaccttagagataaggtcacacagcggcactccaaggagcaatttgaggccgctcagaagctcgagcaggagtacagtcgctacttcacaggagtgatacagggcggagcactgagttcaatatgcacacagatcctggcaatggtgaatcaggagcagaataaagtgctgtggattccagcctgccccttgta

SEQ ID NO: 220989 - DNA, 2052 bp, Artificial Sequence
  Description of Artificial Sequence: Synthetic coding sequence
atggagccccagcggagagaactgttggctcaatgccagcaaagccttgctcaagccatgacagaggttgaagccgtgctgggcttgctggaggcagcgggagctctgtcaccaggagagcgtcgccagttagacgaggaggctggcggtgctaaagccgaactgcttcttaagctgctactcgcaaaagagcgggaccatttccaggacctgagggccgctcttgagaaaacccagcctcatttactacccattctctatcttaatggcgtggtgggccctccacagcccgctgagggggcaggaagcacatacagcgtgctgtcgacaatgccttcagacagtgagtccagcagcagcctgagtagtgtcggaacaaccgtcaagcacctccgcgaacagatggaatcccagcttgagaaagaggcccgttttcggcagcttatggcgcacagcagccacgactcagccatcgatacagattctatggaatgggagacagaagtcgtcgaatttgaaagagagacagaagatatcgatcttaaagctctggggtttgacatggcggaaggagtgaatgaaccgtgctttccaggagactgcgggatcttcgttaccaaggttgataagggaagtatcgctgatgggaggcttagagtgaacgattggttactgagaattaatgacgtcgacctcatcaacaaggacaaaaagcaggccatcaaagctctgcttaacggtgagggcgctatcaatatggttgtaaggcggcgaaagagcctagggggaaaagtcgtaactcccctgcatattaacttgagtggtcagaaggatagcgggatcagtcttgagaacggcgtatacgctgctgccgtactgccagggagtccagccgctaaggaggggtcccttgctgtaggagaccgtatcgtggcaattaatggaattgccctcgacaataaatctctcaatgaatgtgaaagcttacttcgctcgtgccaagactcactgacactgtcccttctgaaagttttcccgcaatcctcttcatggtccggacagaacattttcgagaacattaaggattccgacaagatgttgtccttcagggctcatggaccagaggttcaggcacacaacaagagaaatctgattcagcataataacagtacccagactgacatcttttatactgataggctggaggatcgcaaggaacctgggcctccaggtggttcctcttcattccttcacaagcctttcccaggcggacctttacaagtgtgcccacaggcctgtccctccgccagcgaacgtagcctctcctcctttagatccgatgcctccggcgatcgtggcttcggacttgtcgatgtgagaggtcggagaccccttctaccatttgaaactgaggtcggaccctgcggggtgggggaggccagcctggataaagccgactcagaaggctcaaacagcgggggaacttggccaaaggcgatgctttcttccaccgcagtccccgagaagcttagtgtctacaagaagcctaaacagcggaagtcaatctttgaccccaacactttcaaacggccacagacaccgccaaaaatagactacctgctccccggtcccggtccagcccactcccctcagccttccaaaagagccggaccactgacacctcctaagcctcccagaaggtccgattccattaaatttcagcaccgtctggaaacctccagtgaaagcgaggcgaccttggtggggtcttccccatcaacatctcccccttccgcgttgccaccagacgtggaccctggcgagcccatgcacgcaagcccgccacgtaaggcacgtgtcaggattgcaagctcatactatccggagggcgacggcgacagcagccacttacccgcaaagaagtcctgcgatgaggacctgacctctcagaaagtcgacgagctcggccagaaaagacgcagacccaagtccgcgcctagttttagaccaaagctggcaccagtggtcattcctgcacagtttctagagtag

SEQ ID NO: 220990 - DNA, 2643 bp, Artificial Sequence
  Description of Artificial Sequence: Synthetic coding sequence
ggcgcaatcaatatggtggttcgcaggaggaaatccttgggcggtaaagttgtgaccccactccacatcaacctttcagggcagaaggattcagggatctctctcgagaacggcgtttatgccgctgcggtgctgccaggaagccccgcagcgaaggaaggcagcttagcagttggcgaccggatcgtggccatcaacggcatcgccctcgataacaagtcactcaacgaatgcgagtctctgttgaggtcttgtcaggattcactgacactgagcttgctgaaagaacagaagtgtgtgccggcttcaggagagctatcccccgagctgcaggaatgggccccttatagtccaggccattcttcacgtcacagcaacccgcctctttatcctagcaggccatccgtgggtacggtccctcgctcactgacgccttcaacaacagtctcaagcatactcagaaaccctatatatactgtcaggtcacaccgggtgggaccatgctcaagccccccagcagcaagggacgccggaccccaggggctccacccctcagtgcagcatcaaggccgtctgtccctggacctgtcccaccgaacatgcagcgactattccgaaatgagagccacacacggatcgaatagcctccccagttccgcaagactcgggtctagctccaatctccagttcaaggccgagcggataaaaataccaagcactcccaggtacccgaggagtgtggtgggaagcgaaaggggaagtgtgagccactccgagtgctctacacccccacagagccctctcaatattgataccctgtcctcttgttcccagtctcagacctccgcctccacactgccgaggatagcagtgaaccctgcctccctgggcgaacgacgcaaagaccggccttacgtcgaagagccaaggcacgtaaaggtgcagaaaggctcagagcccctcgggatttcgatcgtgtctggcgagaagggcggaatctatgtctctaaggtaacagtcggctccatcgcccatcaggccggactggagtatggggaccagctcctggagttcaatggaattaacctgcgctcagccactgaacaacaggcacgactgattatagggcagcaatgcgatacaataacgattctagctcagtacaaccctcacgtgcatcagttgtctagtcacagtaggtcttcaagtcatctggacccagccggaacacactccaccttgcaaggaagcgggacaactacaccagaacaccccagtgtcattgaccccctcatggaacaggatgagggaccatccactccacccgctaaacagagctcctcaagaatcgccggagatgccaataagaagactctggaacctcgggttgtttttatcaaaaagagccagttagaactgggagtccacttatgcggaggaaatctgcatggggtgttcgtcgccgaggtggaggacgattcaccagcaaaaggaccagacggacttgtgccaggagacttgatcctggagtatgggtctttggatgtaaggaataagacagtcgaggaagtctatgtggagatgctgaaacccagggatggagtcaggctgaaggtccagtaccgcccagaagagtttactaaggcaaaaggtctgcccggtgacagcttctacatccgagccctttacgaccgtctcgccgacgtggaacaggagctgtcttttaaaaaggatgacatcctgtacgtagacgacacactgcctcaggggacatttgggtcctggatggcttggcagctcgatgagaacgcacagaaaatacagaggggtcagattccctccaaatacgtcatggaccaagagttctcgaggcggctcagcatgagtgaggtgaaggacgacaatagtgccactaaaaccctgagtgctgccgcacgaagatctttttttcggcgaaagcacaagcacaagcgcagcggaagtaaagatggtaaggatctccttgctctcgatgcgtttagttcagatagtattcctctatttgaggactccgtctcccttgcatatcagcgggtgcagaaagtcgattgtactgctttgcgtcccgtgctaatcctcggacctctcctcgacgtggtgaaagagatgttggtgaatgaggcgccaggcaaattttgtaggtgccctctggaagtgatgaaggcctcccagcaggccatcgaaaggggggtcaaggactgcctgttcgtggattataaaaggagatcaggccacttcgatgtgaccacggttgcaagcatcaaggaaattactgaaaaaaatcgtcactgtctgcttgatattgcaccacatgccattgaaagactgcaccatatgcatatttatccaatagtgatctttatccactataagtcagcaaaacacataaaggaacagcgggaccccatctacctgcgggacaaggtcacgcagcgtcactccaaagagcagttcgaagccgctcaaaagctggagcaggagtacagccgctactttactggggttatacaggggggtgctctttcatctatctgcacacaaattctggcgatggtgaatcaggagcagaataaagtcctttggatcccggcttgtcctctgtag

SEQ ID NO: 220991 - DNA, 3237 bp, Artificial Sequence
  Description of Artificial Sequence: Synthetic coding sequence
atggccccacggaagcggggaggtagggggatctcctttatcttttgctgctttcgcaataacgaccatcctgagataacctatagattgaggaacgattccaacttcgctctgcagaccatggagccggctctccctatgccccctgtcgaagagctggacgtgatgttctctgagcttgttgacgaattggatctaacggacaaacatagagaggctatgttcgcgctccctgccgagaaaaagtggcagatctactgtagcaagaaaaaagatcaggaggaaaacaagggggctacttcttggccagagttctatattgatcagctgaacagtatggccgcaaggaagtctctcctcgctcttgaaaaggaagaagaggaggagcgatctaaaacgatcgagtcgctgaagaccgcgctcagaaccaagcccatgagatttgtgacgaggtttatcgacctagatggactgagctgcatactcaacttcctcaagacgatggattacgaaacctccgaatctcggatacacacctctcttatcggttgtatcaaagccctcatgaataacagccaggggagggcccacgtgctcgcccacagcgaaagtatcaacgtcattgcccaatctctgtccacagagaacatcaaaacgaaggtggctgttttggagatcctgggcgcagtttgcttggtgcccggagggcacaaaaaggtgctgcaggcaatgctgcactaccagaagtacgcttctgagcgcactcgcttccaaacactgatcaacgatctagacaaatctactgggaggtaccgggacgaggtgtcactgaaaactgcgattatgagcttcatcaacgcagttctgagccagggggcaggggtggaatcactggacttccgcttgcaccttagatacgaattcctgatgcttggcattcaacccgtgattgacaagcttagagagcacgaaaattcgacactggataggcacctcgacttctttgagatgcttcggaacgaggatgagctggaattcgcaaagcgctttgagcttgttcacattgatacaaagtcagctacacagatgtttgagctgactcggaagcgcttaacccatagcgaggcctatccccattttatgtctattctgcatcactgcctgcagatgccctataaaagaagtgggaataccgtacagtattggctcctgctggatagaatcatacagcaaattgtcatacaaaacgataaggggcaagatccagacagtacgccactggagaatttcaacatcaaaaacgtcgtgagaatgctggtgaatgagaacgaggtaaagcagtggaaggaacaggcagaaaagatgcgcaaagaacataatgaactacaacagaagctcgaaaagaaagagcgggaatgtgatgcgaaaacacaggagaaagaagaaatgatgcaaaccctcaacaagatgaaggagaagctggaaaaggagacaacagagcataagcaggttaagcagcaggtggcagatctcaccgctcagctgcacgaactgtctcgtagagccgtgtgcgcaagcattcccggaggacctagtcccggagccccagggggaccattcccttcttctgttcctgggagtctcttaccacctcccccaccccctccattgcccggtggaatgttgcctcctccaccccctcccctaccaccagggggtcccccaccccctcccggtccccctcccctgggagccatcatgccaccaccaggcgctcccatgggactggctctgaagaagaagagcatcccacaacctacaaacgcactaaagtccttcaactggagcaaactgcctgagaataagctggagggaacagtgtggacagaaatcgatgacacaaaagtctttaagatattagatcttgaagatttagagcgcacattttctgcataccaacggcagcaggactttttcgtgaacagcaactcaaaacagaaggaagccgacgccatcgacgacaccctttccagtaaactcaaagtgaaagaactgagtgtgatagatggccgacgagcacagaactgtaacattctgttgtcccggttgaaacttagcaatgatgaaatcaagcgggctatattaactatggacgaacaggaagatcttccgaaagacatgcttgagcaattgctcaaattcgtgccagagaagagcgacattgatctcctcgaggagcacaaacatgagttagaccggatggctaaggcagatagatttctgtttgagatgagtaggatcaatcactatcagcagcggctgcagagcctttattttaagaagaagttcgctgaacgggtggcagaagtgaagcccaaagtggaggcaatccgaagtggctccgaggaggtcttcagatccggagcgctcaagcagctcctggaggttgtgttggcgtttggcaattacatgaacaaaggccaacggggtaatgcgtatggttttaagatttctagcctgaataagatcgcggacacgaagtcatcaatagataagaatatcacgcttttgcactacttgattaccattgtggagaacaaatacccgagcgtcctaaatctgaacgaggagctccgcgatattccgcaggcagccaaagttaatatgaccgagttagacaaagagatctcgacactccgctcaggtctgaaggcggtcgaaacggagctggagtaccaaaaatctcagccccctcagcccggtgataaatttgtgagcgtggtcagccagttcattactgttgcgagcttctcgttcagcgacgttgaggacctcctggctgaggcaaaggatctatttactaaggcggtcaaacattttggcgaagaggcgggaaagatccagcccgacgagttcttcggcatcttcgaccagtttcttcaggcagtgtccgaggcaaaacaggaaaatgagaacatgaggaagaagaaagaggaggaggaacgcagggcccgtatggaagcccagctgaaggagcagcgcgagcgcgagcggaaaatgcgtaaggccaaggagaacagcgaggagtccggagaattcgacgacctcgtgagtgcattgaggtctggcgaggtgttcgacaaggacctctccaaactgaagaggaaccggaaacggatcaccaaccaaatgaccgattcaagccgtgaacgcccaataaccaaacttaacttttag

SEQ ID NO: 220992 - DNA, 2649 bp, Artificial Sequence
  Description of Artificial Sequence: Synthetic coding sequence
atggctcctcgcaaacgaggcggtcgcggtatatccttcatcttttgctgctttcggaataacgaccacccagaaatcacctacagactgcggaacgactccaacttcgccctgcagactatggaacccgcattgcccatgcccccagtggaggaactggatgtgatgttttcagagctagtcgatgaattagacctcaccgacaagcaccgcgaggccatgttcgcactcccggcagagaagaaatggcagatatattgctctaagaagaaggaccaggaggaaaataagggcgctacctcttggcccgagttttacatcgaccagctcaactccatggccgctagaaagtcattactcgccctcgagaaagaagaggaagaagagcgatcgaagactatcgagtctctgaaaaccgcactgaggactaaacctatgaggttcgttacaaggttcatagacctggatggactttcctgcattctcaactttctcaaaaccatggactatgagactagcgaatctcgcatccatacttcccttatcggatgcattaaggctctgatgaacaactctcaaggtagggcacatgtgctggctcacagcgaaagcatcaatgtgattgcccagtcactgtctacggaaaatattaagactaaggtcgcagtgctagagattctcggagctgtttgtctggtacccggaggccataagaaggtgttgcaggctatgctccattaccagaagtacgcaagtgagcgcactcgctttcagaccctgatcaacgacctggacaagagtacggggaggtaccgggacgaggtcagcttgaagactgctatcatgagtttcatcaacgctgtgctgtcacagggcgcaggcgtggagtccctcgactttcgcctgcacttacgttatgagtttctaatgctgggaattcaaccggttattgacaaactccgggagcatgagaacagcaccctggaccgccaccttgacttcttcgaaatgctgcggaacgaggacgaactggaattcgcgaaacgatttgagctcgtccatatcgatacaaaatctgctacgcaaatgtttgagctgacacggaaacgtctgactcactccgaggcctaccctcattttatgagcatattacaccactgtctccagatgccctataagcgcagtggtaataccgttcagtactggcttttgctagataggatcatacaacaaattgtcattcagaatgacaagggtcaggacccagattctacccctctcgaaaattttaacatcaagaacgtggttaggatgttggtgaatgagaacgaggttaagcaatggaaggaacaagccgaaaagatgcggaaggagcacaatgagctgcagcaaaaactcgagaagaaggaacgggaatgtgatgccaaaacacaagaaaaagaggagatgatgcagacactcaataagatgaaggaaaaactcgaaaaagagactactgaacataaacaggtgaaacagcaggtagccgaccttactgcacaactgcacgagttatcaaggagagccgtctgtgcctctattccaggcggaccttcaccaggggctcccggtggaccattcccatcaagtgtgcctggtagcttgctacctccaccccctcccccaccgctgcccggaggcatgctcccaccccctcctccccctttgccccctggcggaccccctcctcccccagggcctccaccactgggagcaatcatgccccctccaggtgccccaatggggctcgcattgaagaaaaagtccataccccagcccactaatgcgctgaaatcatttaattggagcaagctgcccgagaataagttggaggggacagtttggaccgagattgacgatactaaggtgttcaagattcttgatctggaggacttagagcgtacattttccgcttatcagcgtcagcaggatttcttcgtaaatagcaactcaaagcagaaggaagccgacgccatcgacgatacattatcgtccaagctcaaagttaaggagctctcagtcattgatggtaggcgggctcagaattgcaacattctgctgtcacggttgaaactctccaacgatgagatcaaacgagccatcctcactatggacgaacaggaagacctgcctaaagacatgctcgagcagctgcttaaatttgtgcctgagaaatcagatatagacctcttagaagagcataagcacgaactggacagaatggctaaggcagataggttcctgttcgagatgtctcggatcaatcactaccagcagagattacagagtctgtactttaaaaagaaatttgccgaacgagtggcttttgggaactatatgaataaaggtcagcggggtaacgcatacgggttcaagatatcttctcttaacaagatcgcagatacaaagtcttctattgataaaaacattaccctcctccactacctcatcacaatcgtcgagaacaaataccccagcgtcttaaatctgaatgaagagcttagggatattcctcaagccgctaaagtgaagtcttggaatatccgttctctgtctccccatagtcctgaaatttccctgtgcctgctcagcgcttcctcttcacaatag

SEQ ID NO: 220993 - DNA, 3207 bp, Artificial Sequence
  Description of Artificial Sequence: Synthetic coding sequence
atggctcctcgcaagagaggcggtcgcggtatttcattcatcttctgttgtttccgcaataacgaccatcccgaaatcacatacagactgcggaacgattctaactttgcgcttcaaaccatggaacccgctttacctatgccaccggtcgaagaactggatgtcatgtttagcgaacttgtggatgagttagacctcacggataagcatagagaagcgatgttcgctctccccgctgagaagaagtggcagatttattgctctaaaaagaaggatcaggaagaaaacaagggagccacctcctggccggaattttacatcgaccagctgaatagcatggcggcacgaaagagcttgctggccttggaaaaagaggaagaggaggaaaggtccaagactatcgagtccctcaagacagcattgcgcactaaacctatgagatttgtcactagatttattgacctcgacggcctgtcctgtattctaaactttctgaagacaatggactacgaaacgagtgaatcccggattcatacttcactgataggttgcattaaagccctgatgaacaactcacagggtagagctcacgttctggctcactccgagtcaatcaatgtgattgcccagagtctgtccaccgaaaacatcaaaaccaaggtcgctgtcctcgagatccttggagccgtctgtttggttccaggaggacataaaaaggttttgcaggcaatgcttcactatcaaaaatacgcgtcagaacggactcggttccagactctcattaatgatttggacaaatccactgggaggtaccgtgacgaagtatctcttaagactgctattatgagcttcattaatgccgttcttagtcagggcgctggcgtggaaagtctggacttccggcttcacctccgctacgagttcctgatgctgggcatacagccagtcatcgataagctccgagagcacgagaacagcactcttgatcgacacctcgacttctttgaaatgctgaggaacgaagatgagctggagtttgccaagaggtttgagctcgttcacatcgatacaaagagcgctacacagatgtttgagctcacacgcaagagactgacccattccgaggcctatcctcattttatgtccattttacaccactgtttacagatgccatataagcgcagcggtaatacagtgcagtactggctgttactggatcgtataatccagcagattgtcattcaaaacgacaaaggacaggaccccgactccacacccctggaaaacttcaacatcaaaaatgttgtgcgcatgctcgtaaacgaaaacgaagtcaaacaatggaaagaacaggcagaaaagatgcgtaaagaacataacgaacttcaacagaagttggagaagaaagagcgagaatgcgatgccaagactcaagaaaaggaggagatgatgcagacactgaataaaatgaaggagaaacttgagaaggagaccaccgagcacaaacaagtgaagcaacaggtggctgacctgaccgcacagctgcacgagctaagtagaagagccgtgtgcgcttctatcccaggaggcccatcaccaggtgcaccgggaggaccgttcccaagtagtgttcccggatccttactgcctccccctcctcccccacccctaccagggggtatgctgcctccgccacctcctccgctgcctccgggaggccctcctccccctcccggaccgccaccattgggagccattatgcccccaccaggggcaccgatggggctggccctgaagaaaaagtcgatcccacagcccacaaacgccctcaaatctttcaactggtcaaagttgcccgagaacaaactggaaggaactgtctggacggaaatcgacgatactaaggttttcaagatcttggacctcgaagacttggagcgtaccttcagtgcctaccagcggcagcagaaggaggccgacgcaatcgatgatacgctcagcagcaaattgaaagtgaaggagcttagcgtgatcgacggcagacgagctcagaattgcaacattttgctgtcccgactcaagctgagcaacgacgaaatcaagcgggctatcttgaccatggatgagcaggaggacttgcccaaggacatgttggagcagttactcaaatttgtgccagaaaagagcgacattgacctgctggaggaacacaagcacgaactggatagaatggctaaggcagatagattcctctttgagatgtcccgaattaatcattaccagcaacgccttcagtcactttactttaagaaaaaattcgccgagagagtcgctgaagtgaaacctaaggttgaagcaattcggtccgggtctgaggaagtgttcaggtcaggtgctctcaagcagttattagaagttgtgttggcctttggcaactacatgaacaagggccaaagaggaaacgcctacggatttaaaatcagcagtctgaacaaaattgcagataccaaatcgagtatagacaagaatattaccctgctgcactacctgatcacaattgtcgagaacaagtacccctccgtgcttaatctgaatgaggaattgcgcgatattccccaggccgcaaaggttaacatgaccgagctggacaaggagataagcacacttaggtccggactgaaagccgtggaaacagaactagagtaccagaagtcccaacctcctcaaccaggcgataagtttgtcagcgtggtctcacaattcatcacagtagcctccttctcgttcagcgacgtggaagatctgctcgccgaggcaaaggatctgttcaccaaagccgttaaacatttcggcgaggaagcaggaaagattcagccggacgaatttttcggcatctttgatcagtttctgcaggcagtaagcgaggcaaagcaggagaacgagaacatgcgaaagaagaaggaggaggaggagcgccgtgcccgtatggaagcacagcttaaggaacaaagggaacgagagcggaagatgagaaaggccaaggagaactctgaagaatctggggagttcgatgacctggtgagtgctctgagaagcggagaggtgttcgacaaggatctgagcaagctgaagcggaaccggaaaagaatcacaaaccaaatgactgactcatctcgggaacgcccaattactaaactcaacttctag

SEQ ID NO: 220994 - DNA, 3237 bp, Artificial Sequence
  Description of Artificial Sequence: Synthetic coding sequence
atggcgcctagaaaacgcggtggcagggggatatcttttatcttctgttgctttaggaacaacgatcacccagagattacataccgccttagaaacgactccaacttcgcgctgcagaccatggagccagccttgccgatgccgccagtggaggaactggacgtgatgtttagtgagttagtggacgagctggacctgactgacaagcatcgggaagcaatgttcgccctcccagccgagaaaaagtggcaaatatactgctctaagaagaaagatcaggaagaaaataaaggcgctactagctggcccgagttctatatcgatcagttgaatagcatggctgcacgtaagagtctcttggctcttgagaaagaagaggaagaagaacggagtaagacaattgagtctctgaaaactgccttgagaacaaaacctatgaggttcgtaactcgtttcattgacctcgacggcctcagttgtattctaaattttttgaaaaccatggattatgaaacgagcgagtcacggatccacacgtctctcattggatgcatcaaagccctgatgaacaattcccaggggagagctcacgtgctagcccacagcgaaagcatcaacgttatagcgcagagcctgtctacagagaatataaaaactaaggtagcggtactagagattctaggagctgtgtgtctcgtccctggtggacacaagaaagtgctccaagcgatgctgcactatcagaaatatgcgtcagaaagaacaagattccaaacattaatcaacgatctcgacaagtccacaggtaggtaccgggacgaggtgtcattaaaaaccgcgatcatgagttttatcaacgcggttctgtcacaaggggcaggtgttgagtcactggattttcggctgcacctgagatatgaattcttaatgctgggcatccagcctgtgatcgacaagctgagagagcacgagaattctacgctggatcgtcatctcgattttttcgaaatgttaagaaacgaggacgagttggagttcgccaaacgattcgagctggtgcacatagacactaagtccgccactcagatgttcgagcttacaagaaaaaggctgacacactctgaggcctatcctcacttcatgtctatcttacaccattgcctccagatgccctacaaacgttcggggaacaccgtgcagtactggctgttgctggatcgcattattcagcaaatagtgattcaaaatgacaaaggccaagacccagactctacccccctcgagaattttaacattaaaaatgttgtgcgaatgttggtgaatgagaatgaggtcaaacagtggaaggagcaggcagaaaaaatgcggaaggaacacaacgagttgcagcagaaactggagaagaaggagcgagaatgcgacgccaagacccaagagaaggaggagatgatgcagacattaaataagatgaaggaaaagctggaaaaagagactactgagcacaagcaagtgaagcagcaagtggccgacctgactgctcagttacatgagctctctcggagagccgtttgcgcaagcatccctgggggacccagcccaggcgctcccggtggaccttttccgagctcagtcccagggtctctgctccctcctcctcccccaccccctctaccgggtgggatgcttccaccgccaccacccccactgcctcccggaggacctcctccaccgcctgggcctccaccactgggcgcaatcatgcccccaccaggggcacctatggggctggccctcaagaaaaaatcaattcctcagcctaccaacgcattaaagagctttaactggagtaaattgccagagaacaaattagagggtacagtttggacagaaattgatgatactaaagttttcaaaatattagacctggaagacctcgaacgtaccttctcggcctaccagcgacagcaagacttcttcgtcaatagcaactcaaagcaaaaggaggccgacgcgatagacgatacattgagcagcaagctgaaggtcaaagagctcagtgttatcgatgggagacgtgcacagaattgtaacattctgctgtcccgacttaagctgtctaatgatgagattaagcgggctatactgactatggacgaacaagaggaccttccaaaagatatgctggaacagctccttaagttcgttccggagaaatcggacatcgacctgctggaagagcacaaacacgaactggataggatggcaaaagccgaccgtttcctgtttgaaatgagcaggatcaatcactaccagcaaagattgcagagtctctacttcaagaaaaagttcgcagagagagtggctgaggtcaagccgaaagtggaagctatcaggtccggatctgaagaagtgttcaggtctggtgctctgaagcagctgctcgaggtggtgctcgccttcggcaactacatgaacaagggacagcgtggcaacgcctatggctttaaaatttcaagcctaaacaagatcgccgatacaaagagctccattgataaaaacataacactcctacactatctgattacgattgtggagaacaagtatccctcagtgctaaacctaaacgaagagctgagagacattccccaagcagccaaggtcaacatgaccgagcttgataaggaaattagcactcttcgtagtggcctgaaggcagtggagaccgagctggagtatcagaagtcacagcctcctcaacctggagacaaattcgtttctgtcgtctcccagttcattactgtagcatccttcagtttctccgacgtggaagaccttctggcagaggctaaggatctgtttaccaaggcagttaagcattttggcgaagaggctggaaagattcagcccgatgagttttttggcatttttgatcagtttctacaggcggtcagtgaagccaaacaggagaatgagaatatgcgcaagaaaaaagaagaagaagagaggagagcaagaatggaggcccagcttaaggagcaacgggagcgcgagcgcaagatgcgtaaagcgaaagaaaactccgaggagtccggcgaattcgatgatttggtatctgccttgagaagtggcgaggtctttgataaggatctgagtaaactaaagcgcaaccgcaagaggataaccaatcaaatgaccgacagcagccgggagaggcctattacgaagctcaatttctag

SEQ ID NO: 220995 - DNA, 3207 bp, Artificial Sequence
  Description of Artificial Sequence: Synthetic coding sequence
atggctccacggaaacgctcacatcacgggctcggcttcctgtgctgttttggcggttccgacataccggagataaatctcagggacaaccaccctctgcagttcatggaattttcgtcaccgattcctaatgctgaagagctcaatattcgattcgccgaacttgtcgacgagctggatttgaccgacaagaatagagaggctatgttcgctctgccccctgaaaagaagtggcagatttactgtagcaagaaaaaagagcaggaggatcccaacaagctggccaccagttggccagactattacatcgaccgaattaatagcatggccgctatgcagagcctatatgcctttgacgaggaggaaacggagatgaggaatcaggtagtggaggacctgaaaacagctctgaggacacaacctatgagattcgtcacacggtttatcgagctggagggcttgacctgtctgctgaatttccttcgctctatggatcacgcaacttgtgaaagtaggatccacaccagtctcatcgggtgtatcaaggcactgatgaataactcacaaggccgagcccatgtcctcgcccagccagaggcaatttccaccattgctcagagccttcgtactgagaactcaaagaccaaggtcgctgtgcttgaaattcttggcgctgtctgtctcgttcccggaggccacaaaaaagtgctgcaggccatgttacattaccaggtctatgcggctgagcgtacacgcttccagacgctgctcaacgaactggaccgctctctgggtcggtatcgcgatgaggtaaatctgaagaccgcaattatgtcttttataaacgcggtattaaacgccggagccggagaggataacttggagttcaggctgcacctccggtatgaatttctcatgctgggaatacagcctgtcattgacaagttgcgtcagcatgagaatgcaatcctggataaacaccttgacttctttgagatggtcagaaatgaagacgatcttgagctcgctaggcgttttgatatggtgcacatcgacactaagtccgcctcacaaatgttcgagctgatccacaaaaagttaaaatacacagaggcttatccctgcctgctgtcggtgctgcaccactgcctccagatgccttataagcgtaacgggggatactttcagcaatggcaactgctggaccgcattctccagcagatcgttctccaggatgagcgcggagtcgaccctgacttggctccactggagaatttcaatgtcaagaatatcgttaacatgctcatcaatgagaatgaggtgaagcaatggcgagatcaggcagaaaagtttcgcaaagagcacatggaactagtgagccgcttggaacgcaaggaaagagagtgtgaaaccaaaacactggagaaggaagaaatgatgagaaccctgaataaaatgaaggacaaattggctagggagtctcaggagctaaggcaggcacgaggacaggtggctgagctagttgctcagctgagtgagctgtctacgggaccagtgtcctcaccaccaccaccagggggtcctctgaccctttcttcctccatgacaaccaatgacctgcccccaccaccgcctcctctgccctttgcgtgctgccccccacctccgccaccgcctttgccccctggcggacctcctacaccccctggggctcccccttgcctgggcatgggcctgcccttgccacaagatccttatccttccagtgacgtgccactccgcaagaagagggtgccgcagccctctcatccactcaaatcatttaactgggttaagctgaatgaagaaagagttccagggaccgtctggaacgagatcgacgacatgcaggtttttcgcatcctcgatttagaggatttcgaaaaaatgttttcagcttaccagcgccaccagaaagagctggggtcgacggaggatatttacctggcttccagaaaggttaaggagctcagtgtgatcgatgggagacgcgcacagaattgcatcattctcctgtctaagttaaagctctcaaatgaggagatccggcaggccatcctgaaaatggacgagcaggaagacctggccaaggatatgttggagcaactactgaaattcatccccgaaaaaagtgatatcgacctcctcgaggagcacaagcacgagattgagcgaatggcacgtgccgaccgtttcctgtacgagatgtcccgtatcgatcactatcagcagcggctccaagctcttttttttaaaaaaaaattccaggagcgcctggcagaggccaagcccaaagtggaggctatactgctagcctctcgagaattagtccggtcaaagagactcaggcagatgctagaggttatccttgcgatcggcaatttcatgaataaagggcagcgaggcggagcatatgggttccgggtcgcctcactcaataaaatcgctgatacaaaatcctctatcgatagaaacatcagtttgctgcactacctgattatgatcctcgagaagcacttcccagacattctgaacatgcctagcgaattgcagcatctgcctgaagcagctaaagtgaatttggccgaactggagaaagaagtgggaaatctgcggagaggcctccgcgcagtggaggtcgaactggaataccaacggcgacaagtcagggagcccagtgataagtttgtccccgtgatgagcgattttataactgtgagttcgtttagcttctccgagctcgaagatcagctgaacgaagccagggacaaatttgcaaaagctttgatgcactttggcgaacacgatagtaagatgcagcctgatgagttttttggcatttttgatacttttctgcaagcttttagcgaagctaggcaggacctggaagccatgcgtcggcgtaaagaggaagaagaaaggcgagctaggatggaagctatgttaaaggagcagcgagaaagggagcgatggcagagacagagaaaagtgctggccgctggttcttcgctggaagaaggcggtgagtttgatgatctagtgtcagctctgaggtcaggtgaagtgtttgataaggacctgtgcaaattaaaaagatctcgcaaacggtccggctctcaggcgctggaagttactcgcgagagggcgattaataggttgaattattag

SEQ ID NO: 220996 - DNA, 3207 bp, Artificial Sequence
  Description of Artificial Sequence: Synthetic coding sequence
atggctcctaggaaaaggagccaccatgggctggggtttctgtgttgctttgggggatcggacataccagagatcaatttacgcgataatcaccctctccagtttatggaattcagctctccaatccccaatgccgaggagctgaatatacgctttgctgaacttgtggatgagctggatcttactgataaaaaccgggaagcaatgtttgcccttccgccagaaaagaagtggcagatttattgttccaagaagaaggagcaggaagatccgaacaagctggcaaccagctggcctgactactacattgatcgcatcaactccatggccgcaatgcaaagtctgtatgcctttgatgaggaggaaaccgagatgcggaaccaggtggtggaggatctgaaaactgccttgcgtacacaaccaatgcgatttgtcactcggttcattgaactcgaagggcttacatgcctgctgaactttctcagatcgatggaccacgctacatgtgaatctaggattcacacatctctcatcgggtgcatcaaggcacttatgaataactcacaggggagagctcacgtattagcccagcccgaagctatctccacaatcgctcagagtctcagaacagagaactcgaaaactaaggtggctgtgctggagatcctaggagcggtgtgcctcgtaccaggcggacacaagaaagttctccaggccatgctccactaccaagtttatgcagctgagcggactagattccaaacactgttaaacgagttggatcgcagtctcggcaggtaccgcgacgaagtgaacctgaagacagccattatgtcttttatcaacgctgtgctcaacgccggagccggtgaggacaatctggagtttaggctccacctaagatacgagttcttgatgttggggatacagccggtcattgacaagctacgccagcatgaaaatgccatccttgataagcacctggatttttttgagatggttagaaacgaagatgacctggaacttgccagacgttttgacatggtgcacatagacacgaagtccgcatcacagatgttcgagttgatccataagaagctcaagtataccgaagcgtatccttgccttttgagtgttctgcaccactgcctgcagatgccttataaacgaaatggtggttacttccaacagtggcaactgctggatcggatattgcaacagatcgttttgcaggacgagcgaggcgtcgacccagaccttgcgcctctggaaaatttcaacgtcaagaatatcgtcaacatgctcattaatgagaatgaggtgaagcaatggcgagatcaggccgaaaagtttcgcaaggaacacatggagctggtgtcaagattggagcggaaagagcgggagtgcgagactaagacattggagaaggaagagatgatgagaaccctcaacaagatgaaggacaaactggccagagagtcacaggagctgcggcaagctcgcggtcaggttgccgaactagtggcccaactgtcagaactctcaacaggaccagtatctagccccccaccccctggcggaccacttactctgtcgtctagcatgaccactaacgacctacctccccctccgccacccctgcctttcgcatgctgccctcctcctccacccccaccgctgccgcctggaggtcccccaacacctcccggagcacctccctgcctggggatgggactgcccctgccccaggatccctacccaagcagcgacgtgccactccgcaaaaaaagggtaccacagccctcacaccctctgaaaagcttcaattgggtcaagctgaacgaggaaagagtccccggtaccgtgtggaacgaaattgatgacatgcaggtgttcaggatcctggatctagaagactttgaaaagatgttttccgcctatcagcgtcatcagaaggaactcggctccactgaagacatatatttagcctctagaaaagtgaaggagttgtccgtcatagacggacgacgagcgcagaactgcataatactgctttctaagctcaaactgagtaacgaggaaatacggcaagcaatactaaagatggacgagcaggaagaccttgctaaggacatgttagaacaactgctgaagtttatcccagagaaaagcgacattgacctgttggaagagcataagcacgaaattgaaagaatggctagggccgatcgcttcttgtatgagatgagcaggattgatcattaccaacaacggttacaggccctcttttttaagaagaagtttcaggaaaggctcgctgaggcgaagcccaaggtcgaggcaattctcttggccagccgggaactggttaggtccaagcgcttacggcaaatgctggaagtcattttggccatagggaacttcatgaacaagggccaacggggaggcgcttacgggttcagagtcgcatctctgaacaagattgccgatacgaagtcaagcatcgatcgcaacatctccctgctccactacctgattatgatcttggagaaacatttcccagacatactcaatatgccatcagaactccaacatttgcctgaagcagccaaggtcaatctcgccgagctagaaaaggaggtaggtaaccttagaagaggtctaagagccgttgaggtggagcttgagtaccagcgccgacaggtgagggaaccatccgataagtttgtacccgtgatgtctgacttcataacagtcagtagcttcagtttctcagagctggaagatcaacttaacgaagcccgagacaaatttgcaaaagccttgatgcacttcggagagcatgactctaagatgcagcctgatgaattctttggtatcttcgatacttttctgcaagcgttttccgaggcaaggcaggacctggaagctatgcggaggcgcaaagaggaggaggaacgtagggcacggatggaagccatgttgaaggaacagagagagagggagcggtggcagagacagaggaaggtgctggctgcaggtagcagtctggaagaaggcggagaattcgatgatcttgtctcagcactgcggtcaggggaagtgtttgacaaggacttatgtaaactgaaaaggtcccgcaaacgctccggctcccaagcactggaagtgaccagagagcgcgcaatcaaccggctgaattactag

SEQ ID NO: 220997 - DNA, 399 bp, Artificial Sequence
  Description of Artificial Sequence: Synthetic coding sequence
atggctccaaggaagcgatcccaccatggcctgggattcctctgttgttttggagggagcgacatacccgaaataaatttgcgggacaatcaccctctgcaatttatggagttcagctcccccatcccaaacgctgaggagctcaacatcaggtttgcggagctggtagatgaactggacctcacggacaagaaccgcgaggccatgttcgcgttgcctccagaaaagaagtggcagatttactgcagcaagaagaaggtcccgtcacttaccccattagccacaagtcaagggtcctggcatggggttgctctcgctgctctggcatgctcctgtatccacctgatgttcattacgtgtcagccttgtagcaggtgttggcgaaataactccgagtag

SEQ ID NO: 220998 - DNA, 3204 bp, Artificial Sequence
  Description of Artificial Sequence: Synthetic coding sequence
atggcccctagaaaacggagccaccacggactgggattcctgtgttgttttggcggatccgatatccctgaaatcaatttgcgggacaatcaccccctgcagttcatggaattttcaagccctattccaaacgccgaagagctcaacataaggttcgcagaactggtcgacgagctcgacctaactgacaagaatagggaagccatgtttgcattaccacctgaaaaaaagtggcaaatatattgctcaaagaagaaggaacaggaagacccaaataagttggcaacctcatggccagactattacatagacaggattaacagtatggccgcaatgcagtcactgtatgctttcgacgaagaagagaccgagatgcgcaatcaggtggtggaagaccttaaaactgccttacgcacacagccaatgagatttgtgacccggtttattgagctcgaggggttgacatgcctgctgaactttctgagaagtatggatcacgcgacctgcgagagtcgcatccacacatctctaatcggctgcatcaaagcactcatgaacaactctcagggcagggcccacgtgcttgcccaacctgaagcaatctctaccattgcacagagcctacggaccgaaaatagtaagactaaagtagcggtacttgagattctcggagccgtttgcttggtccctgggggacacaaaaaggtgttgcaggcgatgctccactatcaggtctacgcagccgagagaactagattccagacactgctgaacgaactggatcgcagcctgggacgttacagagacgaggtcaacctgaagacagccattatgtctttcattaatgctgttctgaacgccggtgcaggagaagacaacctcgagttcagattgcacttacgctacgagttcctgatgctgggaattcaacctgttatcgacaaactgcgtcagcacgagaatgccattcttgataagcacctggactttttcgagatggtccggaacgaggatgacctggaactggcccgacggttcgatatggtgcacatcgatacaaaatcagcctcccagatgttcgagctgattcataagaagctgaagtacaccgaggcatacccttgtctgttgagcgtgctgcatcactgcctccagatgccttataagagaaacggtgggtattttcagcagtggcagctactggacagaatccttcaacagattgtcctgcaggatgagcgaggcgtggacccagatctggccccactcgagaatttcaacgtcaagaacatcgtgaacatgcttatcaacgagaatgaggtgaagcaatggcgggaccaagctgaaaaattccgtaaggaacacatggaattagtgtcccgcctggagcgaaaggaaagagagtgtgaaacaaaaactcttgagaaggaggagatgatgaggacactgaataaaatgaaagacaagcttgcgagggagagccaggagttgaggcaagccagggggcaggtggcagagttagtggcccaattgagcgagctatccacagggcctgtgtcttcccctccaccacccggtggcccactgacactttcatcctcaatgacgacaaatgatctgcccccaccaccaccccctctgccctttgcctgttgtcctccacctcctccacctcctctgccacctggcggaccacccaccccacccggagctccaccatgtctgggcatggggctgcctctgccccaggacccgtaccctagctctgatgtacccctccggaaaaagcgcgtgccacaaccaagccatccccttaagtccttcaactgggttaagctgaacgaggagcgtgtgcccggtaccgtgtggaatgagatcgatgacatgcaggtgtttcgaatccttgacctagaagatttcgaaaaaatgttcagcgcctaccagaggcaccagaaagaactggggtcaacagaggacatctacctggcgagtaggaaagtcaaagaactctcagttattgacgggagacgggcacagaattgcatcatcctgctaagtaagctcaaattaagtaatgaggaaatcaggcaggccatcctcaagatggatgagcaggaggatctggccaaagatatgcttgagcagcttctcaagtttattcctgagaagtccgatatcgacctcctggaggagcataaacacgaaattgagcgaatggcccgtgccgaccgattcttgtacgaaatgagccggattgaccactatcagcaacgcctccaagctctatttttcaaaaagaagtttcaggaacgtcttgcggaagcaaaacccaaagttgaagctattttgttggcctctcgagaactggtacgttctaaacgtctgcgccagatgttggaggtgatactcgccatcggcaattttatgaataaaggccagcgaggtggagcttatggtttccgcgtagcctccctcaataagatcgctgataccaaatcgtctatcgatcgcaacatcagcctgctccattacctgattatgattctggagaagcacttccctgacattctcaatatgccttctgagctccagcacctccctgaggccgcaaaggtgaatctcgccgagctcgagaaagaggtggggaacctgcggcgagggctccgtgcagtagaggtcttggaataccagcgtagacaggttagagagccctcagacaaatttgtgcccgttatgtcagactttattacggtgtcaagcttctccttctcggagttggaagaccaactcaatgaggcacgggataagtttgcaaaagcactgatgcatttcggcgagcatgactctaaaatgcaaccagacgaattcttcggtatatttgacacctttctgcaggcattcagtgaggctcggcaggacctagaagccatgcgccgacgcaaggaggaagaagagcgtagagcacgcatggaggcaatgctaaaagagcagcgggagcgtgagagatggcagcgccaacgtaaggtactggccgcaggctctagtctagaggagggcggagagtttgacgatttagtgtcagctctgagaagtggtgaggtctttgataaagacctgtgcaagctgaaaaggtctcgcaaacggtccggcagtcaggccctcgaggttacaagggagcgggctataaacaggctgaactactag

SEQ ID NO: 220999 - DNA, 1062 bp, Artificial Sequence
  Description of Artificial Sequence: Synthetic coding sequence
atgggtgcactcttgtgtgaccatcgctcctgtcgcccaatttccctaacagtggccaagtgttgggatccaactccaaggtcctactttacagtacctagagctgacccagtgagacctatcgatcctgctgcctggctgagccacaccgctgccctgaccggcgcattgccgagatatgaactggaggaggcccctctgaccgtgaaatcagatatgtccgctgtggtccgtgttatgcagctacccgatagcggcttagaaattcgggacagaatgtggctgaagataacaattgcaaatgcggtcataggggcagacgtcgtcgactggttatacacacacgtggagggcttcaaggaacgtcgagaggcgaggaagtatgcgtccagtctgctcaaacacggttttttacggcacaccgtgaataaaattacattcagtgaacagtgctattacgtgttcggagacttgtgcagcaacctggccacactcaatctcaatagcggttctagtggcacctcagaccaagacacgctggctccactgccccatccagcagccccttggcctttggggcaggggtacccctatcagtaccctgggccacctccctgtttcccccctgcttaccaggaccctggcttctcttacggcagtggatccaccggctcacagcagagcgagggaagcaagtcaagcggctcgacccggtcatctagaagagcccctggtcgcgagaaggaacgcagagcagctggtgccggtgggagtggatccgagtcggaccatacagccccttccggcgtcggcagttcctggcgggagagacctgcagggcagctctctagagggtcctcgcccagaagtcaggccagtgccaccgctcctggcttgccaccaccacatccaaccaccaaggcatacaccgtagtcggcggacctccagggggacccccagtcagagagctcgctgcagttccgccagaattgactggatcacgccagagtttccaaaaagctatgggcaatccttgtgagttttttgttgacattatgtag

SEQ ID NO: 221000 - DNA, 1335 bp, Artificial Sequence
  Description of Artificial Sequence: Synthetic coding sequence
atggctgagacaaaaatcatataccacatggacgaagaggaaacaccctacttggtgaagttgcccgtggctcccgaaagggtcactttagctgattttaagaacgttctctccaaccgtccggttcacgcttacaaatttttttttaagtccatggaccaggattttggtgtagttaaggaagaaatattcgatgacaatgcaaaactgccttgttttaatggccgagttgtgagctggcttgtcctcgccgagggagcacactcagatgcgggtagtcaaggtacagactcccacactgacttgcctccgcctctggagaggaccgggggaattggggattctagaccaccttcattccatcccaatgttgcgtctagcagggatggaatggacaatgagaccggcactgagtcaatggtttcacatcgaagggagagagctagacgtagaaacagagaagaggccgcaagaaccaatgggcaccccaggggcgatcggagaagggatgtcgggctccctccagactccgcttcaacagctctgtcctctgaactggaatcatcttcatttgtggactcagacgaggatggctctaccagccgtctctcatctagcactgaacaatcaacatctagcagactaattcgaaagtacgcgagtagcctgctgaagcacggattcttgcggcacacggtaaacaagatcaccttctctgaacagtgctactatgttttcggggatttatgttcaaatctagccaccttgaacctcaactccgggtccagtggcacctccgatcaggatacgcttgcaccactgccacatcccgctgcgccttggcccctgggtcaagggtatccttaccaataccctgggccacccccttgcttcccgccagcttatcaggaccccggattttcgtacggcagcggatctacagggagccagcagtccgagggaagcaaaagttctgggtctacccgttcatctaggcgagcccctggcagggaaaaagagaggcgagcggctggggcaggcggaagcgggtccgagagtgaccatacagcaccatctggagtcggatctagctggagggagagacctgcaggtcagttatcacgaggaagctccccacgatcgcaggcaagtgcaactgccccaggcttgccccctccccaccctaccactaaagcctacaccgtcgtggggggaccgccaggcggtcctccggtcagagagctggccgcagtgcccccagagctgactggatcccggcagtcatttcagaaagctatgggaaatccttgcgaatttttcgtcgacatcatgtag

SEQ ID NO: 221001 - DNA, 2088 bp, Artificial Sequence
  Description of Artificial Sequence: Synthetic coding sequence
atggctgaaacaaaaataatttatcacatggatgaggaggagacaccttatctagttaaattacccgttgcccctgagcgggtaacactggcggactttaagaatgtcctatcaaatcgacctgtgcacgcatacaaattcttttttaaatcgatggatcaggatttcggcgtagtaaaagaggagatctttgatgataatgccaagttaccctgctttaacgggagggtggtctcctggctggtgctggccgagggggctcatagcgacgctggcagccaagggactgactcgcatactgacctaccaccccctctggaacgaacaggaggaattggcgattccaggccaccctcctttcatcccaatgtcgcaagcagtagagacggcatggacaacgaaactggcacggaatccatggtgagtcaccggcgtgaaagagctcgccgaaggaatcgtgaggaggccgcacgaaccaatggccacccccgaggagaccgccgaagagatgtgggcttgccgccagactcagcttctactgccctgtcttctgaacttgaaagctcctcatttgtcgacagcgatgaggacgggtctacatctcgattgtcgtccagcacggaacagtccacttccagccggctcataaggaagcacaagcggaggagaaggaagcagaggttaagacaggcggaccgggcatcatcattcagcagcattacagactcaacaatgagcctcaacatcgttactgtgacactgaatatggagagacatcactttctcggaattagcatcgtggggcagagcaatgacaggggagatggtggcatatatattggctcaattatgaaaggaggcgctgtcgccgcagatggcaggattgagccaggggatatgctgcttcaagttaacgacgtcaattttgagaatatgagcaatgacgacgcagtgagggtgttgcgcgagattgtgtcccagaccggacctatctcactcaccgtcgcaaaatgttgggaccccactcccaggtcttattttaccgtgccgcgagccgacccagttcggcctatcgatcctgctgcatggcttagccatactgccgcactgacaggcgctctgccacggtatgggactagtccctgtagctccgctgtgactcggaccagctcttcctcactcacatcttccgtgccgggtgccccacagctggaagaagcgccactgaccgtcaaatctgatatgagtgccgttgtgagggtcatgcagctgcccgattcaggtctcgagatcagggatagaatgtggctcaagataacgatcgcaaatgccgtgattggcgctgacgttgtggattggctctatacacacgtcgaaggctttaaggaacggagggaagcgaggaagtatgcctcctccctgctcaagcatggcttccttcggcacacagtaaacaagatcacatttagcgagcagtgctactacgtcttcggggatttgtgctccaacctcgccacccttaacctgaactctggctctagcggcaccagtgatcaggacaccctggcaccactgccgcacccagctgcaccatggccgctgggccagggctacccttaccagtaccctggcccaccaccctgttttccgcctgcttatcaggatcccggttttagctacggctctggcagcactggaagccaacagtccgagggaagcaagtcttcaggatcaaccaggtctagccgcagagcacctggcagagaaaaagagaggagagcggctggcgctggtggctctgggtccgagagtgatcacaccgcaccctccggggttgggtcctcttggcgtgaacgaccagccggacagcttagtagaggctccagcccacgctcgcaggctagtgcaaccgctcccggtcttccccctccccaccctaccacaaaggcctatacagtcgtgggcggtccacctggtggccctcccgttcgcgaactggccgctgttcccccagagctcacgggctcccgtcaaagctttcagaaggcaatgggaaacccgtgtgaattctttgtcgatataatgtag

SEQ ID NO: 221002 - DNA, 2013 bp, Artificial Sequence
  Description of Artificial Sequence: Synthetic coding sequence
atggccgaaactaaaattatttaccacatggatgaggaggagaccccctacctggtcaagctccccgttgccccagagagggtcacactcgccgactttaagaatgtgctttcgaacagacccgtacacgcttacaagttcttcttcaaatcgatggaccaggacttcggggtggtgaaagaggaaatcttcgacgataatgccaagctgccatgcttcaatggcagggttgtgagctggctcgtgctggcagagggagcccacagcgatgcaggcagtcaaggcacagattctcatacggaccttccccctccattagaacgtacaggaggcataggcgactctcggcctccctccttccaccctaacgtggcatccagccgagacggtatggacaacgaaaccggcactgagtcaatggtatcccaccgtagagagagagcacgccgacggaacagagaggaagccgctagaactaacgggcaccctcggggtgacagacgcagggatgttggtctgccaccagactctgcatctaccgccctctctagcgagttggagtccagctctttcgtggactctgacgaggatggctctacatcacgcctatcttcgtccaccgagcagtccaccagctcacgtctgatccggaaacataagcgcaggcggcgtaaacaaaggctcaggcaagctgaccgagctagctcattttcatcaatcaccgatagtacaatgtcccttaacatcgtcactgttacacttaatatggagaggcatcattttttaggtattagtatcgtcggccaatctaatgatcgcggtgacggaggcatctacatcggaagcataatgaaaggaggggctgtggcagccgatgggaggatcgaaccaggtgatatgctgctacaggtgaatgacgtgaacttcgaaaacatgagtaacgacgacgctgtgcgcgtgcttcgagagatagtgtctcagacaggccctatcagcctcacagtcgccaagtgttgggatccaacccccaggagttatttcactgtgccgagagccgatcctgttcgcccaatcgaccccgctgcctggctgagtcatactgccgcactgaccggagcactgcctagatacgagctggaggaagccccacttaccgtgaaatctgatatgtctgcggtggtccgcgtcatgcagctgcccgactccggactcgagatccgggacaggatgtggctgaaaattacgattgctaatgcagttattggcgcagatgtcgtggactggctttacactcacgtggagggctttaaagagagacgggaagccaggaagtatgcctcttcactgctgaagcatgggttcctaagacacaccgttaacaagatcacattttctgaacaatgttactatgtcttcggcgatctgtgttcgaacttagctactctgaatctaaattcgggttcttctgggacctctgatcaggacacccttgcccctttaccacatcccgctgctccctggccactgggccagggctacccctatcagtaccccggaccacccccttgtttccctcccgcttatcaggaccccggattttcttacggttcaggttccaccgggagccaacaaagcgaaggttccaagtctagcggcagtacgcgttcttcaagacgagccccagggagggaaaaggaacgtagggcagccggagcagggggtagcggtagtgagagtgaccacacagccccatccggcgtggggtccagttggcgcgagcggcctgccggacagctgtcccgcggaagctcccctagatctcaagcctcagccaccgccccaggtctccctccacctcatcctaccacgaaggcctacaccgtggtgggcggtccacctggtgggccacctgtccgtgagctggctgctgtaccacccgagttgaccggctcgaggcaaagcttccaaaaagcaatgggaaacccctgtgagtttttcgttgatattatgtag

SEQ ID NO: 221003 - DNA, 2151 bp, Artificial Sequence
  Description of Artificial Sequence: Synthetic coding sequence
atgggcgagacaaaaatcatttatcaccttgacggtcaggagacaccctatctcgtgaagttgcccttgcctgccgagcgggtgacattggccgactttaaaggggtgctgcaaagaccaagttataaattcttcttcaaaagcatggatgacgattttggcgtcgtgaaggaggaaattagcgatgacaacgcaaagcttccatgttttaatggtagggtagtatcttggctcgtatctgccgagggcagccaccccgaccccgcacctttttgcgccgacaaccccagcgagctaccccctcccatggagagaacaggaggcattggggattctcgacccccttcattccaccctcatgctggcggtggcagccaagagaacctggacaacgacacggagaccgactccctcgtgtccgcccaacgtgagaggccccgacgtcgggatggcccagaacacgccactcgcctcaacggcactgcaaaaggagagagacgcagggagccagggggttacgacagctctagcacactgatgtctagcgaactggagacaacatccttcttcgattccgatgaggacgattcaacctcccgcttttcatccagtacagagcagtctagcgccagtagacttatgcgacgccacaagagacggcgaaggaagcagaaggtgtcacggatcgagcgaagtagcagcttttcctctatcaccgactcgactatgtctttgaacatcatcacagttactctaaatatggagaagtataactttttgggcatctctatcgttggtcagagcaacgagaggggtgatggaggaatatacattggtagtataatgaaagggggtgccgtggccgcagatggaagaatagagcccggagacatgttgttacaggtaaacgagattaactttgagaatatgtccaacgatgacgcagtccgggtgctacgcgagattgtgcacaagccgggtccgatcaccctgacagtcgccaaatgttgggacccttccccaagaggctgttttacgcttccccgaagcgaaccgatacggcctatcgatcctgctgcttgggttagccatactgctgccatgacgggtacgttcccagcctatggaatgtctccgtcattgtctactatcaccagtacatcaagctcaattacgagtagcattccggataccgaacgactcgatgatttccacctttcaatccatagcgacatggcggctattgtgaaggccatggccagcccagagtccggtctggaggtcagggacaggatgtggctgaagattactattccaaacgctttcattggatccgacgtagtggattggctgtaccataacgtggagggtttcactgaccgacgcgaggccagaaaatacgcctctaacctactaaaggccggattcatcagacatacagtgaacaagatcaccttctcagagcaatgctactacattttcggcgatctgtgcggaaatatggcaaacctgtcattgcacgatcatgatggtagtagtggcgcaagcgatcaggataccctcgccccattgccgcaccccggtgctgcaccctggcccatggcttttccctatcagtacccacctccccctcacccatacaatccccacccaggctttcccgaactcggttactcctatggagggggttctgctagttctcagcatagcgagggctcacgctccagcggatctaaccgttccggaagcgatcggagaaaggagaaagatcccaaagcgggagatagtaagtccggaggcagcggatccgagtcagaccacaccactcggtcttcgcttcgcggaccaagagaaagagcaccaagtgaacgttcaggacccgctgcatccgaacactctcatcggtcccatcacagcctagcaagcagtttgcgtagtcatcacacccacccctcttacggtccaccaggagtgccacctctctatggcccaccgatgctgatgatgcccccacctcctgccgctatgggaccacctggagcccctcctgggagagacctggctagcgtaccaccagagctgaccgcaagtcgtcaatcttttaggatggcgatgggaaacccatcggagttctttgtggatgtgatgtag

SEQ ID NO: 221004 - DNA, 2172 bp, Artificial Sequence
  Description of Artificial Sequence: Synthetic coding sequence
atgggtgaaacaaagatcatatatcacttggatggacaagagaccccgtacctcgtgaaattaccactgcccgcagagcgggtcactctggctgatttcaaaggggttcttcaacgaccatcttacaaatttttttttaagagtatggatgatgacttcggagtggtgaaggaagaaatcagtgatgacaatgccaagctcccctgttttaatgggagggtggtgagctggctggtatctgcagagggttcgcaccccgaccccgcaccgttttgtgcagataacccctccgagctgccaccccctatggaacgaaccggtggcatcggcgattcaagacctccctcatttcatccccacgccggaggaggtagtcaggagaacctagataacgataccgagacagattctttggtaagtgctcagcgggaacggccacgtcggagagatgggcctgagcatgccacgcggttgaatgggaccgccaagggggagcggagacgtgaaccaggcggatacgactcaagttccaccttgatgtcctcagagctggaaaccaccagcttttttgacagtgacgaggacgactccaccagtcgcttctcctccagcactgagcagtctagtgcaagtcgcctgatgcggagacataagcggaggcggagaaagcaaaaagtgagccgaattgaacgcagtagcagtttttcctccatcaccgactctaccatgagccttaatataattacagtaactttaaatatggagaagtacaattttttgggcatctctatcgtgggacagagcaacgagagaggggatggaggcatttatattggctctattatgaaaggcggagccgtcgctgccgatggcagaatagagcccggagacatgctactccaagttaacgagattaactttgagaatatgagcaacgatgatgccgtgagagttctaagagagattgtgcacaagccaggtcccataacccttactgtggctaagtgttgggaccctagccctcggggatgcttcacactgccgcgatcagagcccatacgaccaatcgatcctgcggcatgggtgtcccacaccgccgctatgactggtaccttcccagcctatgggatgagcccctccctgtcaaccattacatctacgtcatccagtattacaagctccattcccgatactgaacgccttgacgacttccacttatcaatccactccgatatggccgctatcgtgaaggccatggcgtctcccgagtctgggcttgaggtgagggatcgcatgtggctaaaaataaccattcccaacgcatttatcggctctgacgtggtcgactggctctatcataatgtggagggattcaccgacagaagagaggcgaggaagtatgcgtccaatctgctcaaagccggattcatcagacacaccgtgaataaaatcaccttctccgaacagtgctattacattttcggggacctgtgtggcaatatggccaatctgtctctacatgaccacgacggctcatcaggtgcctccgaccaggacactcttgcacccctcccacaccctggtgctgctccttggccaatggcttttccctatcagtatcctccccctccccatccttacaacccgcaccctggcttcccagaactggggtatagctacgggggtgggtccgccagcagccagcacagcgaaggctcccgctcgagcgggagcaaccggtccgggtcggaccgaaggaaggaaaaagatccgaaggccggagactcgaagagcggaggatctggttccgagtctgatcatacaacccgtagcagcttacgcggtcctagggaaagggccccttcagaacggtcggggccagcagcatccgagcattcgcatcggagccaccactcactggccagcagtcttcgctcccaccacactcatccatcatacggcccaccaggggtcccgccactctacggcccacctatgcttatgatgccccctcctcctgcagccatggggcctcctggagcgccaccaggacgggatctcgctagcgtcccccctgagctcacggcctcaaggcagtccttccgaatggccatggggaatccctcagagttttttgtcgatgtgatggtactcagagggtggggggcttag

SEQ ID NO: 221005 - DNA, 2100 bp, Artificial Sequence
  Description of Artificial Sequence: Synthetic coding sequence
atgggagagactaagattatctatcatctggatggccaagagactccatacctggtgaaactgcccctgccagccgagagagtgacactggcagactttaagggggttctgcagcgcccttcctataaattctttttcaaaagtatggacgatgacttcggtgtggtgaaggaggaaattagcgacgataatgccaaacttccctgttttaatggcagagttgtaagctggttagtctcagctgaaggctctcaccccgacccagcgccattttgcgctgacaacccgtcagagctgcccccacctatggagagaacaggcggaatcggagactcccggccaccatccttccacccccatgctgggggaggcagccaggaaaatttggataatgacaccgagacagattctctcgtcagcgctcagcgggagagacctagaagaagagatgggccagagcatgctacaagactcaatggtacagcaaagggggagcggcgtagagagcccggtggatacgacagttcctcaacgctcatgagctcagaactcgagacaactagtttctttgattccgacgaggatgacagcacctcgagattttcctcctcaaccgagcagtccagcgccagtagactgatgagaaggcacaagcggagacggaggaagcaaaaggtgagccggattgagcgtagcagctcattcagctccatcaccgatagcacaatgtccctgaatatcattactgtgacccttaacatggagaagtataattttcttggcatctcaatcgtcggacagtctaacgagaggggcgatggagggatctatatcggctccataatgaagggaggagccgtcgccgcagatggccgaatcgaaccgggtgacatgctgctgcaagtaaatgaaatcaatttcgaaaatatgtctaacgacgacgccgtccgcgtgttacgagagattgtccacaagccaggccctattaccctcaccgtagctaagtgctgggacccctcccccagaggctgcttcactttgcctaggaccatgactggtaccttccccgcatatggaatgagtcccagtttgagtacgatcacatctacgtcatcatcgatcacatcctccatccccgacacggagagactcgatgattttcacctatctatccattcagacatggcagcaatcgtgaaggcgatggcctctcctgagagcgggctcgaggtgcgagatcgtatgtggctgaaaattacgatcccaaacgcctttatcggctctgatgtggtcgactggctgtaccacaatgtagagggcttcactgaccgtcgcgaggccagaaaatacgcaagcaacctacttaaagccggattcataagacataccgtcaataaaatcaccttctcagagcagtgttactacatattcggtgacctctgcggcaatatggccaatctgtctctacatgatcacgacggaagttcaggcgctagtgaccaagatacattagctccattgccacacccaggagctgccccttggcccatggcattcccataccagtacccgcctccccctcacccttacaacccacatcctgggtttccagagctaggctacagctacggcggaggcagcgcttctagccaacacagcgagggtagccggagctctggttcgaacaggtctggttctgatagaagaaaggagaaagacccaaaggccggtgattccaagtccgggggttccgggtctgagtctgaccataccacccgctcatccctgcgcggacccagagaacgggcacccagtgagcggagtggaccagcagcctccgaacactcccatcgctctcaccattcactggccagcagcctgagatctcatcacacccatccctcatacggcccaccaggagttcctccactgtatggccctcccatgctgatgatgccccctccacctgccgctatgggacctcccggtgcacctccaggcagagacctggcctccgtccctcctgagctgaccgctagtcggcagagtttccgcatggctatgggcaacccttccgagttctttgtagacgtaatgtag

SEQ ID NO: 221006 - DNA, 315 bp, Artificial Sequence
  Description of Artificial Sequence: Synthetic coding sequence
atgcccgaggcccatatgcagcccgctaagctccagacatccctgccaaccactgatcacggaagcaagaagcccgtgagctgctatttgccccctctgtccaacgctcatcccatgtgcattgaggtgcagaatgctcagaactgttcctcagccgctgccacactggagcccagtatcatctctgatacctgcttctacaaacctattaccaaggaccagctgagttcacgctcagagctgaataccgtccgcctcaaatgcctgaattctcttcgcggttggaaaattctcaatcaactgtcccttacatag

SEQ ID NO: 221007 - DNA, 1437 bp, Artificial Sequence
  Description of Artificial Sequence: Synthetic coding sequence
atgggatcgaggtggagttccgaggaggaacgacagccattgctgggccctggcctcggcccagggctcggagcttcatggaggtcaagagaggccgcagccgcagctttgcctgcggcagtgcctggacctggtcgcgtttatgggagacgctggctcgtcttgttgctgttctcgttgctggcctttgtccaagggctggtgtggaatacttggggccctatccagaatagcgcaagacaggcctacggcttttcttcttgggatattgcactgcttgtgctgtgggggccaatcggattcctcccatgctttgccttcatgtggctgctcgataagagagggctgcggattaccgtgctgctgacctcgtttctgatggttctgggaacaggtttgcgctgcattccgatttctgatctgatactgaagcgacgcctgatacatgggggacaaatgctaaatggattagcaggtccaactgtcatgaatgccgctccgttcttatcaactacatggttttctgccgatgaacgtgcgaccgccactgctatcgccagtatgctctcttatctgggaggggcttgtgcctttctcgtgggccctttggtagtccccgctcctaacggcacgtcccctcttctcgccgctgaatcatctagagcccacatcaaggacaggatagaagcagtactatacgctgagttcggcgttgtgtgtctgatcttttctgcaactttggcttactttccacccaggcctcctctgccaccgtcggtggctgcagcaagtcagcggctgtcttatcgtagatctgtgtgccggctgctgtctaacttccggttccttatgatagccctagcctatgccatccccttgggagtgttcgccggttggagcggtgttctggatctgatcttaacccctgcccacgtgagccaggtcgatgccggatggattggattttggagtatcgttgggggttgcgtcgtggggattgcaatggcaaggttcgcggatttcatcagaggcatgttaaagctgatcctccttcttctctttagcggtgccacgttgtcttcaacttggtttacccttacatgcttgaacagtattacccacctgccattgacaaccgtgacattgtacgcctcttgcattctgctgggcgtgttcctgaatagcagcgtccctattttctttgagttgttcgtggagaccgtgtaccctgtccctgagggaatcacatgcggcgtagttacattcttgagtaacatgttcatgggcgtgctccttttttttctgactttttaccacactgagctatcttggttcaactggtgcttgccaggctcttgccttcttagtctattacttatactgtgtttcagggaaagctatgaccgattgtatctcgacgtggtcgtatccgtctag

SEQ ID NO: 221008 - DNA, 1644 bp, Artificial Sequence
  Description of Artificial Sequence: Synthetic coding sequence
atgcctggcggtggaccgcagggagcaccggcagccgcagggggagggggagttagccatagagcaggatcccgtgattgtctgcctcccgcagcatgttttaggaggagaaggcttgcaaggagaccaggctacatgaggagcagtacaggacccggtattggattcctcagtccagccgtaggcacactatttaggttccctgggggagtgtcgggagaggaaagccatcacagcgagtcgcgcgcaaggcagtgtggtctggacagcagagggctgctggtacgctctcccgtatccaagtccgctgcagcacctacagtgacctctgttcgcggtacatctgcccattttgggatccagctgcgtggaggaactagattacctgataggttatcttggccctgtggacccggaagcgctggatggcagcaggagtttgctgccatggatagtagcgagaccctggatgctagttgggaagcagcctgctccgatggagcacgcagggtgagagcagctggatccttgccatccgccgagctatcctcgaattcctgctcccccggatgtggaccggaggtacctccgaccccacctggctctcactccgccttcacctctagcttctctttcatccggctatccctcggatctgccggagagcgtggagaggcagagggttgccccccatcacgggaagcagaatcacactgccagagcccacaggaaatgggcgctaaggcagcctctctagacggaccccacgaggatcccaggtgtctgtcacggccattttcccttttagccacccgggtgagtgccgatctagcccaagcagccaggaacagtagccgcccagaacgcgacatgcactcattacccgatatggaccctggcagctcaagttctctcgatccaagtctggcagggtgcggtggggacggctcttcgggatccggcgatgcccactcctgggacactcttttgcgcaagtgggagcccgtgctcagggattgtctgctgaggaacaggaggcaaatggaagtcataagcctgagactgaaactgcaaaaattgcaggaagacgccgtggaaaacgacgactatgacaaagccgagaccttgcagcagagactggaggatctcgagcaggagaagatctctctgcattttcaactgccatctaggcagcctgctctttccagcttcctcggacaccttgccgcacaggtccaggccgctctcagacggggtgctactcaacaagcatcaggcgatgacacacacactcctttaaggatggaaccaaggttgctggagcccacagcacaggactccctgcacgtcagtatcactaggcgggattggctccttcaggagaagcaacagctccaaaaagagattgaggcactgcaggcaagaatgttcgtgctagaagccaaggatcagcagctccggagggagatcgaagaacaggagcagcaactccagtggcagggatgtgatctgacaccactagtcgggcaactctcactgggacaactgcaggaagtgtcaaaagccctgcaggataccttggcttccgctggacaaataccctttcacgctgaaccccctgaaacaatcaggaggtgcgtgtag

SEQ ID NO: 221009 - DNA, 1110 bp, Artificial Sequence
  Description of Artificial Sequence: Synthetic coding sequence
atgccaggaggcggaccccagggcgcaccagccgctgcgggaggcggaggggtatcacacagagcaggtagtcgggactgcttgcccccagccgcttgtttcaggcggcgaaggctggctaggagaccagggtatatgcgatccagtactgggccagggattggtttcctgtctcctgccgttggcaccttgtttcggtttcctggtggagtgtccggcgaggagagtcaccactctgaatccagagcccgacagtgtggactggactcccgcggacttctggttcgaagtcctgtttctaagtccgctgctgcaccaacagtgacgtccgtccgcggaactagtgcccattttggaatccagcttcggggaggaactcgccttcccgataggctcagctggccctgcggtcccggttctgccggatggcagcaagagttcgccgcaatggacagcagtgagacactggatgcgtcctgggaagccgcatgcagcgacggtgcaagacgcgtacgggcagccggtagtctgccttcggcggaactgtcgtcaaactcatgctcaccaggatgtggccctgaagtgcccccaacgcctcccggtagccactcagcatttacgtcgagtttctccttcattcggctgagcttaggttccgctggcgagagaggggaagctgaaggatgtccacctagccgcgaagcggaaagccattgtcagtccccccaggagatgggggcaaaggcggcaagcctggacggaccccacgaggacccccgatgcttatctaggcctttttctttgttagcaacccgagtttcagcggacctcgctcaagccgctcgcaattcatccagacccgaaagagatatgcacagtttgcctgatatggaccctggctcaagctcgagtctggacccttcgctggctggctgcgggggagatggttcctcaggctctggggacgctcacagttgggacacgctgctgcggaagtgggaaccagtgctacgcgattgcctcctgagaaacagacgacagatggagctggagccaatcgccctcgatcccccttggaaacctagacaccccgaacctaatagctactag

SEQ ID NO: 221010 - DNA, 717 bp, Artificial Sequence
  Description of Artificial Sequence: Synthetic coding sequence
atggatagctctgagactttagatgctagctgggaagccgcttgcagcgatggcgctcggagagtacgcgcagccggatcgctgccctcggccgaattgtcttccaattcctgcagccccggatgcggtcccgaagtgcctccaacgcctccaggaagtcatagcgctttcacaagctccttcagcttcatccgcctctctttaggttcggccggagagagaggcgaggctgaaggctgtccgccttccagagaagccgaatcgcattgccagtcacctcaggagatgggagcaaaagcagcatcccttgatggtccacatgaggatccaaggtgcttgtctcgaccgttctccctcctggccacccgggtatccgcagacctggctcaagcagcgaggaactcttccagaccagagagagacatgcacagcctgccagacatggacccgggatccagctccagcctggatcccagtctcgcaggttgcggaggcgacgggtcctcagggtctggggacgcgcacagttgggataccttactgagaaagtgggagcccgtgctgcgggactgccttctgcgcaacaggcggcagatggaagtaattagcctgagactgaaattgcaaaagcttcaggaggacgcggttgaaaacgacgattacgataaagcaggtactaactgtttcggatctaccatggaagcttcaacatcctag

SEQ ID NO: 221011 - DNA, 2268 bp, Artificial Sequence
  Description of Artificial Sequence: Synthetic coding sequence
atgccaggcggaggccctcagggagctcccgcagcagccggaggcggaggagtaagtcaccgtgcagggtccagggattgtttgccaccagcggcatgcttccggaggaggcgcctggcgaggagaccaggctacatgcgatcaagcaccggtcccggaatcggtttcctgtcaccagccgtcggaaccttattcagattcccgggtggcgttagcggagaagagtcccaccactctgaatccagggctagacaatgcggactggactcccgtgggctgctggtccgctccccagtttcaaagagcgcagctgcccctacagtgacgagcgtacggggtacgtcagctcactttggtatccagttgcgaggcggtacaaggttacccgatcgcctcagttggccatgtggccctggatccgccggttggcagcaggagtttgccgcaatggactcctccgaaacactagatgctagctgggaggcggcttgctctgatggagcccgacgcgtgcgcgctgctggctctttaccatctgctgagcttagcagtaacagctgctcccctggatgtggcccagaggtcccacctacaccacccggatcccactcagcctttaccagctcattctccttcatcagactgtctctgggctctgctggggagcgaggcgaagcagaggggtgccccccaagcagagaggccgagagccactgtcaatcaccacaagagatgggagccaaggcagcgtccctagacgggccacatgaagatcccagatgcctgtcaaggcctttcagtctgctggctacgcgggtttccgcagatctggctcaggccgcacgaaactcttcacggccagagcgtgacatgcattcactgcccgatatggaccccggaagcagctccagtttagacccaagcctcgcaggctgcggcggagatgggagctccggatccggagatgcccacagctgggacaccctgttgcggaagtgggagcccgtgctccgggactgcctgttgaggaacagaaggcagatggaggtaatttctctacggctcaagctgcaaaagttacaggaggatgccgtggagaatgatgattatgataaggccgaaacgcttcagcagcgcctggaagacctggagcaggaaaaaataagcctccacttccagctgccgtcacggcagccggctctgtcaagttttctgggccatctggccgctcaggtgcaggctgccctgaggaggggcgcaacccagcaggcctctggagacgatactcacacaccgttaagaatggaaccgaggttgcttgaacccacagctcaggattctcttcacgtgtctatcacaaggcgcgattggttgctgcaggagaagcagcaattgcagaaagagatcgaggctcttcaggctcgcatgttcgtcctggaggcaaaggatcagcagttgcggagggagatcgaggagcaggagcagcagttgcagtggcagggatgcgatctcacaccactcgtgggacagttatctctgggtcaactgcaggaggtgagtaaggcacttcaggataccctcgccagtgcagggcagattccatttcacgccgagcctccagagactatcagatctttacaggaaagaattaaaagtcttaacctctcgctgaaggaaattacaaccaaagtgtgcatgagcgaaaagttttgctctactctgagaaagaaggtgaacgatatagagacacagctccctgccctcctggaggctaagatgcacgccatcagcgggaaccacttttggaccgccaaagacctgacggaggaaattcgttccctcaccagcgagagagaaggcctagaaggactgctgagtaagttgcttgtgctatcaagcaggaatgttaagaaattgggctcggtaaaggaggattataaccggctccggcgtgaagtggaacaccaggagacagcttatgatggagttagtctctgccgccctgtctggtctgcagtagtgagatcctgctctctgcagccactgccacctgagtttaagcaattctcctgtctctcactgcgttcctcctgggactatcgttgtcccccaccgtgccttgccaattttgtgtttttggttgagatgggattttatcacgtagatcagaccgggctgaagctcctgacatcatccgatccacccagctccgcaagtcagagcgctggaataaccgacatgagtcattgcgcttggcctctgcaatag

SEQ ID NO: 221012 - DNA, 2037 bp, Artificial Sequence
  Description of Artificial Sequence: Synthetic coding sequence
atgccaggtgggggtccccagggcgcaccagccgcagcaggaggaggcggagtgtcccatagggctggctcacgagactgcctcccgcctgcggcttgtttccgcaggcggagactcgctcgcagacctgggtatatgagatcttctactggtccaggaataggcttcttgtcaccggcagtcgggacactattccggttcccaggcggagtatctggggaagagagtcatcactcagagagtagagctagacagtgtgggctcgatagcagaggcctgctggtcaggagtccagtatccaagtccgcagccgctcccacagtgactagcgtaaggggaacctccgctcactttgggatacagctgcgcggaggcacccgcttgccagaccgactcagctggccatgcggccctgggagtgcgggatggcagcaggagttcgccgcaatggattcctcagaaacactcgacgcaagttgggaggctgcatgcagtgacggggctcggcgagtgcgcgctgctggctccttaccttctgctgaactcagtagcaacagctgttccccagggtgtgggccagaggtgccaccaactcctcctggatcccacagtgcgtttacgtcctccttctctttcatccgactgtcgctaggatccgcaggtgaacgtggggaagctgaaggatgtcctccttcgagagaggcagaatctcactgtcaatccccacaagaaatgggtgctaaggcggcttccttggacgggccacatgaggatccccgatgtctctcccgcccattctcactgctcgcaacacgggtgtccgcagatctcgcccaggctgccagaaactcatccagacctgaaagagacatgcacagcctgcctgacatggatccagggtctagcagcagcctcgacccaagtctcgccggatgcgggggagacggcagcagcggatcaggcgatgcccattcctgggacactctgcttcggaaatgggaacctgtactgagagattgccttctgcggaacaggaggcagatggaggtcattagcttgcgcttaaaacttcagaaattgcaggaagatgcggtcgagaatgatgattacgataaagcggagacactacagcaacgactggaagatctggaacaagagaaaatctccctgcacttccagttgccttcacggcagcctgcattatcctcctttctggggcacctcgccgcacaggtgcaagcagctctcaggcgcggtgccacccagcaggctagcggggatgacacccatactcccttaagaatggagccaagactcctagaaccaactgctcaagattctctccacgttagtataacccgcagagattggttactccaagaaaagcagcagctacagaaggagatcgaggccctccaagctcggatgttcgttctggaggccaaggatcaacagttgaggcgcgaaattgaggaacaggagcaacagctccagtggcaagggtgtgacctgacccccctcgttggacagctgtcactagggcagctgcaggaggtgtctaaagcactacaggatacactggctagcgccggacagattccattccatgcagagccccctgaaacgattagaagcctacaagagcggattaaatccctgaatttatctcttaaagagataactacaaaagtgtgtatgtctgagaaattttgctccacactgcggaaaaaagtgaatgatatcgagacgcagctcccagccctgctcgaggctaagatgcacgccatttctggaaaccacttttggacagcaaaggacctaaccgaggagatccgttcactaactagtgaacgggagggactagaggggctcctttctaaactgctcgtgctgtcctcgcggaatgtgaagaagctcggatctgttaaagaggactacaaccggctgcgccgagaagtggagcaccaggaaaccgcatacggatacaagtactgcgatgctgaatcttggacacaacgctcccagcagttggcatag

SEQ ID NO: 221013 - DNA, 2499 bp, Artificial Sequence
  Description of Artificial Sequence: Synthetic coding sequence
atgcctggcggaggcccacagggggcacctgctgctgctggcggaggtggcgtttcccaccgagcaggttctagagactgtctgcccccagccgcttgttttagacggcgaagactcgctcgacgtccaggctatatgcgttctagcaccggccctggtatcggctttctctcccccgcagtaggaacactgtttagattcccgggtggagtgtctggcgaagaaagccatcacagtgagtccagggcccgacaatgcggcttggactcaaggggcctgctggtaaggtctcctgtgtctaaatctgccgctgccccaaccgtgacttccgtgcgagggacgtcggcacactttggaatacagctccggggagggactcggctccccgaccggttgtcttggccatgcggccctggatccgcaggatggcaacaggaatttgccgcaatggattctagcgagacgctagacgcttcctgggaagctgcgtgttctgatggcgctaggagggttcgggctgccggatccctgcctagcgcagaactgagcagtaactcatgtagccccggatgcggaccggaggtcccaccgaccccacccggatcacacagcgctttcactagtagcttcagtttcataagattatctctcggatcagcaggcgagaggggtgaagcagaaggctgtccgcctagtagggaggcagagtcgcattgtcagagccctcaggaaatgggagcgaaggcagctagcctggacggaccacatgaggaccccagatgtctgtcacgccctttttcactcctggcaactcgcgtctcagcagacctggcccaggccgctcgcaattcttctcggcctgaacgagatatgcactctctaccggatatggacccaggaagtagctccagccttgacccctccctggcgggatgcgggggtgacgggtcctctggtagcggtgatgcccatagttgggatacattgctcagaaaatgggaacccgttctgagggattgtctgctgaggaatcggaggcagatggaagtcataagcctgcggctgaagctccaaaaattgcaggaggacgcggtagagaatgacgattacgacaaggctgaaactctgcagcaaaggttagaagacctagaacaggagaagatcagcctccacttccaactgccatcccgccagccagctctctcatcttttttaggacacctggcagcacaagtgcaagccgcacttcgacgtggagcaacgcaacaggcctctggtgacgacacacataccccactccgcatggagcctaggctgctcgaacccactgcccaagatagtctgcatgtgtctataacaaggcgggattggttattacaggagaagcaacagctccaaaaggaaattgaggcgctccaggctcggatgttcgtactcgaggcaaaggaccagcagctgaggagagagatcgaagaacaagaacaacagttacagtggcagggctgtgacctaactccccttgtgggacagctttccctgggtcagctgcaggaagtgtcaaaagccctgcaggatactcttgcatccgccggtcagatcccctttcacgcagagccacctgaaaccatccgatctctgcaggaacggattaaatccctgaacctgtctctgaaggagatcaccacgaaggtctgcatgtccgaaaagttctgttcaaccctgaggaaaaaggtaaatgatatagaaacacagctgccagccctgcttgaagccaaaatgcacgcaatctctggtaaccatttttggacagcaaaagaccttaccgaagagattcgcagcctgactagcgagcgcgaggggttggaaggtcttctgtctaagctgctggtcctgagctcccggaatgtgaagaagctggggtccgtgaaggaggattacaatcggcttcggagagaggtcgaacaccaggagacagcttatgagaccagcgttaaggagaacaccatgaaatacatggagactctgaagaataaactctgctcctgcaaatgccctctcctcggaaaggtgtgggaagctgacctggaggcgtgtcgcctgctaatccagtccctgcagctccaggaagcccgtggaagcctgtcagtggaagatgagcgtcagatggatgaccttgaaggcgctgcgcctccaatccccccaaggttacactcagaggataaacgcaagacaccactgaaggaatcatatatcctttccgctgaactaggcgaaaaatgcgaggatatcgggaagaagcttctgtatcttgaggaccaactgcacacagcaatacacagccatgacgaggacttgattcactcactgcgcagagagttacagatggtgaaggagacactgcaggcaatgatccttcaactgcagccagccaaagaagctggggagagggaggccgctgccagctgcatgaccgccggagtgcacgaagcgcaggcttag

SEQ ID NO: 221014 - DNA, 2661 bp, Artificial Sequence
  Description of Artificial Sequence: Synthetic coding sequence
atgcctggaggcggacctcaaggcgctcccgctgccgctggcggaggaggggtgtctcatcgggctggctcacgcgactgtcttccacccgcagcctgcttcagaaggcgtcgacttgctcgacggcctgggtacatgagatccagcaccggacccggtatcggatttctctctcccgctgtgggcaccctctttcgatttccaggcggtgtttccggggaggaatcccatcacagcgaaagccgggctaggcaatgtggattagatagccggggactcctagtgaggtcacctgtgtccaagtcagcagctgcgcctacagtgacatcagttcgcggaaccagcgctcacttcggcatccagctcagggggggaactcgactccccgacagattgtcttggccttgcgggccaggcagtgccggatggcagcaagagttcgctgctatggacagttccgaaacacttgatgccagttgggaggcagcctgcagcgacggagcaaggagagtgagagcggcaggctcactgccaagtgccgagctgagtagcaacagctgtagcccgggatgtgggcctgaggtcccacccaccccccctgggtctcactctgctttcacaagcagcttcagctttatccggttgagcctgggcagtgcaggggagaggggagaggccgagggctgtcctcctagcagggaagcagaaagccattgccagagcccccaggagatgggcgcaaaagctgccagcttggatgggcctcatgaagatcctaggtgcttgtctcgcccatttagcctactagccacgcgcgtctctgccgatctcgctcaggcagctagaaattcttcccgtccagaacgcgatatgcactctcttcccgacatggacccagggtcctcaagtagcctcgatcctagcttagccggatgtggtggagacggaagcagcggatcaggggatgctcattcctgggatacgctgttgcgtaaatgggagcctgtgctccgcgactgcctgctaagaaatcgaaggcagatggaagtgattagcctgcgcctgaagcttcagaagctgcaggaagacgcagtcgagaacgacgactatgacaaggttgaaaccgggtttcactacgtgggacaagccggactggagctcttgacatcctctaatccacccgctagcgcctcccaaagcgctggtatcacagctgaaaccctgcagcagcgcctggaagaccttgagcaagagaaaatcagtctccacttccaactgccctctcgtcagcctgctctgagctcttttttgggccatctcgctgcccaggtgcaggctgccctgagacgcggtgctacacaacaagcgagcggtgacgatactcatactcctctgagaatggagcccagactgctcgagccaacagcccaggacagtttgcatgtaagtattacaaggcgggattggctgctccaagagaagcagcagttgcagaaggaaattgaggcgctgcaggctagaatgttcgtccttgaggccaaagaccagcaactacggcgagagatcgaagaacaagaacaacagctgcaatggcaaggctgtgatttgaccccgctcgtgggccagttatcccttggtcagctgcaggaagtctcaaaggcacttcaggatacactcgcttccgcgggacagattccctttcatgccgagccccctgaaaccatcagatctctccaagaacgcatcaagtcattaaaccttagcttaaaggagatcaccaccaaagtgtgcatgtccgagaaattctgcagcactctgagaaagaaggtaaatgatattgagacgcagcttccagcgcttcttgaggccaaaatgcacgcaatttcaggaaaccacttttggacagccaaagacctcactgaggaaattaggagtctgacctcagaaagagaaggattggagggtctcctatcaaagctactggtgctgtccagccggaatgtgaagaagcttggcagcgttaaagaggattacaacaggctacggcgtgaggtggaacaccaagaaaccgcttacgagacatccgtcaaagagaatacaatgaagtacatggaaacgctgaaaaacaagctctgtagttgcaaatgcccccttctcggtaaagtctgggaagccgacttggaggcctgccggctccttatacagtcacttcagctgcaggaagcaagaggatccctgagtgtggaagatgaaaggcaaatggacgatctcgagggagctgctccccctatccccccacggctgcattcagaagataaacgcaaaactccactgaaagtattagaggaatggaagacccaccttattccttctctgcattgcgctggcggtgagcagaaggaggaaagctacatattgagcgctgagctaggcgaaaaatgcgaggatataggtaagaagcttctgtatctggaggaccagctgcataccgctatccactcccatgacgaggacctgatacatagcctgcgtagggaacttcagatggtgaaggaaactctgcaagccatgatcttgcagctgcagccagctaaggaagctggtgaaagagaagccgcagcttcatgtatgacagccggagtgcacgaagcacaagcctag

SEQ ID NO: 221015 - DNA, 621 bp, Artificial Sequence
  Description of Artificial Sequence: Synthetic coding sequence
tgaaaccatttttggactgccaaggatttgacggaggagatccgttccctaacttccgagagggagggtcttgagggactactctccaagctgctggtcctgagcagcaggaacgtgaagaaactgggctctgttaaggaggattataatcgactgcgccgagaggtggagcatcaggaaacagcctacgaaaccagtgtcaaggaaaatactatgaagtatatggagaccctaaagaataagctttgctcatgtaaatgtccattattgggcaaggtctgggaggcagatcttgaggcatgtaggctcctcatccagtcactgcagctccaggaggcacggggatctctgagtgtcgaagatgagagacagatggatgacctggaaggcgctgctccaccgatcccccctaggcttcactctgaagacaagaggaagacccccctgaaggtgttggaggagtggaagacgcatctgattccttcgctccactgtgccggaggcgagcagaaggaagtgtgcccattccatatggcctcacgtggcgacccctacagcaaagggtgctttggcaccatgctccagatgggaacaattaacatcgggaaagcaagccattag

SEQ ID NO: 221016 - DNA, 279 bp, Artificial Sequence
  Description of Artificial Sequence: Synthetic coding sequence
atgaaatatatggaaacgctgaaaaataagctgtgtagctgtaagtgtcccttactggggaaagtttgggaggcagacctggaggcctgccggctgctgatccagtccctgcaactgcaggaggcccgtgggtctctcagtgtcgaagacgagcgacaaatggatgatctcgagggggctgctccacccattccaccacggctgcacagcgaggataaacgtaagacacccctcaaggtgctggaggaatggaagacacatcttatcccatccctgtag

SEQ ID NO: 221017 - DNA, 2565 bp, Artificial Sequence
  Description of Artificial Sequence: Synthetic coding sequence
atgcctgggggtggccctcagggagctcccgctgccgcaggcggtggcggagttagccatcgggctggttctcgggattgcctcccgccagccgcatgtttcaggagaaggcgcttagctagaaggcctggctacatgcgctcaagtactggacctggcatcgggttcctgtcccccgctgttggcacactctttagatttcccggaggcgtgtccggggaagagagccaccactccgaatcgagggcaagacaatgtggcctggattctagggggctgctcgtccgtagcccagtcagtaaaagcgccgcagcccctactgtcacctccgtaagaggcacctccgcccatttcggtatccagttgcgtggcggaacaaggttgcctgaccgcctgagttggccatgtggcccaggaagtgctggatggcagcaggaattcgcagcaatggattctagcgaaacgttggatgcttcatgggaagcagcttgctctgacggagccagaagggtaagagcagctggatccctgccctcagcggaactgagttccaactcttgcagcccagggtgcgggcctgaagttccacctacgcctccagggtcccactcagcatttactagttcattttcttttatacgactttcactgggatctgccggagagagaggcgaagcggagggatgcccccctagcagggaagccgaatcacattgccaaagcccccaggaaatgggggcaaaagccgctagtttggacggtccccatgaggatcctcgttgtctctctcggccattctctctgctggccacacgtgtatccgccgaccttgcgcaagctgctaggaattctagcagacccgagcgagacatgcacagtctacctgacatggaccccggatcttcgagctcgttagacccttccctagctgggtgcggcggagacggctcttccgggagcggtgacgcacacagttgggataccctgctcagaaagtgggagccggtcttgcgcgactgcctgctgcggaaccgccgacagatggaggtgataagtctaaggctgaaactgcagaaattacaggaggatgccgtggagaatgacgattacgacaaagctgagacactgcagcagcggctcgaggatttagaacaagagaaaatttctctgcattttcagttgccgtctcgccagcctgccctctcaagttttctaggccacctggccgctcaggtacaagccgcactgcgcagaggggctacccagcaggcttctggagacgacactcatacccccttgagaatggagcccagactgctggaaccaactgcacaggattcacttcacgtgagcatcactaggcgggattggctccttcaggagaagcagcaactgcagaaagagatcgaagcactacaggccagaatgttcgtgttagaagcaaaggatcaacaattgcggagggagattgaagagcaggagcaacaacttcagtggcaagggtgcgacttaacccccctcgtgggtcaactgtctctgggacagctgcaggaggtgtccaaggctctgcaggacacccttgcatccgccggacagatacctttccacgccgaacctcctgagacaatcagaagcttacaggagagaatcaaaagcttgaatctgtcgctgaaagaaataaccacaaaagtttgtatgtctgaaaagttctgctccaccctgcgtaagaaggttaacgatatcgagacacaactgcctgcactcctcgaagcaaagatgcatgcgatttctgggaaccacttttggactgccaaagatcttactgaggagattcggtctctgacatccgagcgtgaggggcttgaggggttgctgtcaaagcttttggtcctgtcttctagaaatgtcaaaaagctgggctctgtcaaggaggactacaatcggctccgcagggaggtggagcaccaggagactgcatatgaaaccagcgttaaagagaatacaatgaagtacatggaaactcttaaaaacaagctatgtagctgtaaatgccccctcctcggaaaagtctgggaagctgacctcgaggcctgccggctgctgatacagtctttacagctgcaagaggcgcgaggctccctatcggtggaggacgaaaggcagatggatgacttggaaggcgcagcaccaccgattcctccaaggttacatagtgaagacaagcgaaaaactccgctgaaggtcttagaggaatggaagacacatttgattccaagtctccattgtgctggcggagagcaaaaagaagaatcatacatactgagcgcagaactcggtgagaaatgtgaagatatcggcaagaaactgttgtacctagaggatcaactgcacacggccattcactcccacgacgaggatctaattcacagtctccgtagagagctacagatggtgaaggagacacttcaggccatgatccttcagctacagccagccaaggaggcaggggagcgtgaggcagccgcttcttgtatgaccgccggagtacacgaggctcaagcatag

SEQ ID NO: 221018 - DNA, 2199 bp, Artificial Sequence
  Description of Artificial Sequence: Synthetic coding sequence
atgcctggcggtggccctcagggcgcacctgccgcagctggcggtggcggagtgagccacagggccggaagccgggactgccttccccctgccgcatgctttagacgccgtcgcctggcacggcgtcctggatatatgcggtcctctaccggccctggaatcggctttttatctcctgctgtgggtactctctttcgtttcccaggcggagtcagtggcgaggagtcacatcattcagagtctcgggcacgccaatgcggacttgactcacgcggactgctcgttaggtctccagttagcaagtcagctgctgcccctactgtgacctcagttcgcggaacatcagcacacttcggaattcagctgcgcggtgggacacggctgccagatcgtctatcttggccttgtggtcctgggagtgccggatggcagcaggagtttgctgctatggactcctccgagaccctggatgcgagttgggaggctgcttgtagcgacggagctagacgtgtgcgtgctgctggtagtttgccatccgccgaactctcttctaattcgtgctcccctggttgtggacctgaagtgcctcctacacctccaggctcccactctgcatttacctcctccttctcctttatcagactgagcctggggtctgcaggggagaggggcgaagcggaagggtgtcctccctctcgcgaggcagagagccactgtcaatccccccaggaaatgggtgcaaaagccgcttctctggacggcccacatgaggacccgcgatgcctgagtcgtccattctctctgctcgccactcgtgtttcggcagaccttgcccaggccgctcgtaacagctcccggcctgagcgcgatatgcacagcctcccagacatggacccaggcagtagctcctccctcgatccctcccttgccggttgcggtggagacggctcctctggctctggcgatgcgcactcatgggatacgctccttagaaagtgggaaccggtcctgagggattgcttattgcgcaacaggcggcagatggaggtgatttccctgcgcctcaaactgcagaaactgcaggaagacgcagtggagaatgatgactacgataaagccgaaacactacagcagcggttagaggatctggaacaggaaaagatctctttgcattttcagttaccgtctaggcagccagctctttctagctttctgggccatctcgccgctcaggtccaggcagccctgagaagaggtgctactcagcacctccaggaaagaatcaagagcttaaacctgtctttgaaagaaataaccacaaaggtgtgcatgtctgagaaattttgttcaacactgcggaagaaggtgaacgatatagagactcaactgcccgcactgctggaagcaaaaatgcacgccatttcaggaaatcacttctggacagctaaagacttgacagaggaaatcagaagcctaacttcagagcgcgagggccttgagggactgctctccaaattactggttctctcttcaaggaacgttaagaaattaggatcggtgaaggaggattataaccggctgcggagagaagttgagcaccaggaaaccgcctacgagactagcgtgaaggaaaatactatgaagtacatggagaccctcaagaataaattatgttcttgtaaatgtcccctgctcggcaaagtgtgggaagccgacctagaagcctgccggcttttaattcaatccctgcagctccaggaagccagaggctcacttagcgtcgaagacgagaggcagatggacgaccttgaaggcgcagccccaccaatcccccctagacttcattccgaggacaagagaaagacaccccttaaagtgctcgaagaatggaagactcatcttatcccctcactgcattgtgccggaggcgaacagaaggaagagtcctacatcctgagtgcagaactcggcgagaaatgcgaagatatcggcaaaaagttactctacttggaggaccagttacacaccgccattcactcccacgatgaagatctcattcactctctccgacgagagctacaaatggtaaaagaaacattgcaggccatgatcttgcagttacagcctgcaaaggaggcgggagagagagaggcagctgcgagttgtatgacggccggagtgcatgaggcccaagcttag

SEQ ID NO: 221019 - DNA, 1830 bp, Artificial Sequence
  Description of Artificial Sequence: Synthetic coding sequence
atgccaggcggaggtccgcaaggcgctcctgcagccgctggcggagggggtgtgtctcaccgcgctgggtcacgagactgcttaccccctgcggcatgtttccgccgacggcgtcttgcgcgtagaccgggatatatgagatcctcgacagggccagggataggcttcctgagccctgcagtaggtactctgttccgcttcccaggaggtgttagcggggaggaaagtcatcacagcgagagccgggctcgacaatgtggcctagatagcagaggactgcttgtcagatcaccggtctccaagtccgcagcagccccaaccgtaactagtgtgagaggcactagcgcccacttcgggatccagttgaggggcggaacccgcctgcccgatcgtttgagctggccatgtggccctggcagcgccggttggcagcaggagtttgccgctatggattcaagtgagaccctcgatgcttcttgggaagctgcctgttccgacggcgctcggcgagtgcgggctgctggcagtctccccagcgcggagctcagtagtaactcttgcagtccaggctgtggccctgaagtgccaccgacaccaccaggaagccattctgccttcaccagcagtttctccttcattcgcttatcattgggctcagctggtgagaggggtgaagcagaagggtgcccaccatcccgggaggccgagtctcattgtcaaagcccccaggaaatgggcgcaaaggctgcaagcctggatggtccgcacgaagacccccgttgcctcagccggccattcagtcttctcgcaaccagagtttcagctgatctggcccaggccgctcgaaattcttcgagacccgagcgggatatgcatagtctgccggatatggacccaggttctagttcaagcctagatccttcccttgcagggtgcgggggtgacggcagtagcggcagtggtgacgcccactcttgggacactttactgcggaaatgggagccagtgcttagggactgtctgctcaggaaccgacgtcagatggaagtcattagtctgcgcctgaaacttcagaagttgcaggaggatgcggtggagaacgacgattacgacaaagctgagacactccaacagagattggaggacctggaacaggaaaagattagcctacacttccagcttcccagtcggcagcccgctctgagctccttcctgggacacttggctgcccaggtccaggcggctttgcgtcgcggagcgactcagcaggcctccggcgatgatactcacacccccctgcggatggaacctcgcctcctcgagcctaccgcccaggactctctgcacgtgtccatcactcggagagactggctcctgcaagagaagcagcagctacagaaggaaatcgaagctctacaggccagaatgtttgtgctggaggcgaaagatcagcagctgcgcagggaaatagaagagcaggaacaacagttgcagtggcaggggtgtgatcttacccctctggtgggccaactctctctgggccaactgcaggaggtgagtaaggcactccaagacactctagcaagcgccggtcagattccgtttcacgccgagcctcccgaaactattcggagagaggtgcggcatcaaactgccccatgcagaaatcatcagctggagaagccagttataaatatatgggcctttcacctccggcgtaagatctgcctcttccaggcggatggactgcagcacggaagtgcggaggtgaagcatctgaaggagacatccgtcgagccagccggttccaccgccagtaggaaagaatag

SEQ ID NO: 221020 - DNA, 2088 bp, Artificial Sequence
  Description of Artificial Sequence: Synthetic coding sequence
atgccgggaggtggacctcagggcgcacccgctgcagctggtgggggaggtgtctcacaccgggcagggtctcgggattgcttgcccccagcggcttgctttagaaggaggcgcttagcacggagacccggttacatgcgaagcagcacgggaccaggaataggattcctgtcaccggctgtgggtaccctgttcaggtttcccggaggcgtgagcggcgaagagtcacatcattctgaatctcgagcgagacagtgtgggctggacagccgcggactcctggtcagatcccctgtgagtaagtctgctgcagccccaaccgtcacttctgtgagaggtacttctgcgcactttggcatccagctgagggggggaactcgacttccagaccggttgtcctggccctgcggccctggatctgccggatggcagcaggaattcgcggctatggattctagcgaaacgctggacgcgtcatgggaggccgcttgttccgacggagcaagacgtgtgagagcagctggatccctgcctagcgcagagttgtcctccaactcttgcagcccaggctgcggacctgaagtcccacctacccctccaggttctcatagcgctttcacatcgtccttcagtttcatccggttgtcactaggctcagctggggaaagaggtgaagctgagggttgcccccctagccgcgaagctgagagccattgtcagtctccacaggagatgggtgcaaaagcggcttctcttgatggaccccacgaggacccacggtgtttgtctcggccattctcactgcttgcaacaagagtatccgcagacctcgcccaggccgctagaaacagcagccgaccagagcgagatatgcattctctcccagacatggatcctggctccagctctagtctggacccatccctggctgggtgtggcggagacggaagctctggaagcggtgatgcacatagctgggacaccctcctcagaaaatgggaaccagtgctcagagactgcctcctcagaaatagaaggcaaatggaagttatcagtctgagattgaaacttcagaagctgcaggaggacgcggtggagaatgacgattacgataaagctgagaccctccaacaaagactggaagatctggaacaggagaagatctccttgcactttcagctcccctctcgccagcctgcgctgagtagctttctgggccatttggccgcacaggtccaggcagctttgagaagaggagctacccagcaggcttcaggggacgacacacacacaccgctgagaatggaaccacggctgctggagcctactgcccaggattctcttcatgtgtccatcacacggagggattggcttcttcaggagaagcaacagctgcaaaaagagatcgaggctttacaggctcggatgtttgttttggaggctaaagaccagcagctcaggagggagatcgaagagcaggagcagcagctgcagtggcagggctgtgatttgacgcccctcgtagggcaactgagtcttggtcagctacaggaagtaagcaaggcactgcaagataccctggccagtgctggtcaaattccatttcatgcggaaccacctgagaccatccgaagcctccaggagcgtataaaaagcctgaacttatcactgaaggaaattaccactaaggtctgtatgtctgaaaaattttgcagtacactgcgcaaaaaggtgaacgatatagagacacagctgccagccctgcttgaggcaaagatgcacgcaatctccggaaaccatttttggacagccaaggatctcactgaagaaattcgctcactcacatcagaacgcgaggggttggagggcctgctgagtaagcttctagtgttatccagtcgaaacgtgaagaagctcggcagcgtgaaagaggattacaatagactgcgccgagaagtggaacatcaggagacggcatacgccgcatccgtgcactgtctcggcaagtgtgggaagttgacgtggaagctagtggactgtttgtcgcgggcttattcaagccgcaaacctggcgaagcctgtttgtag

SEQ ID NO: 221021 - DNA, 1680 bp, Artificial Sequence
  Description of Artificial Sequence: Synthetic coding sequence
atgcccggaggcggtccacagggcgctcccgctgcggctggcggtgggggagtaagccacagggcgggaagcagggattgtctgcctccggctgcttgctttcggaggcgacgactggctagacgacccggttacatgcggtcgagcaccggtcccggtatcggctttttgtcaccagccgtggggactctctttcgctttcctggaggcgtgagcggcgaagagagccaccattcggagtcgagggcaagacagtgtggcctggattcacgaggcctcctggtccggagcccagtcagcaagtccgctgctgctcccacagtcacttcagtgcggggaacctccgcccacttcggtatccagctccgagggggaactagactgcctgaccgcctgagttggccttgcggtcccggatccgctgggtggcagcaagaattcgcagctatggactcctcagagactctagatgcgtcgtgggaggcagcttgttccgatggggctcggcgagtaagggccgcaggctccctcccatctgccgagctgtcctcaaacagctgctcccctggatgtggcccagaagtcccgcctacacccccaggctctcactccgcgttcaccagctctttcagttttataaggctctcattaggatccgccggagaaaggggtgaggccgaaggatgcccaccctcgcgcgaagcagagtcccactgtcagagcccccaggagatgggcgctaaggctgcctctcttgatggtccccacgaggatccaagatgcttgtcaagaccattctctctgctcgccacgagggtgtccgcagacctggcacaggccgctcgaaactctagcagaccggagcgcgacatgcactccctgcctgacatggaccccggtagttcctcctctctcgacccctccctggcaggctgcgggggagacgggtcgtccgggtccggtgacgctcactcctgggacactctgctcaggaaatgggaacctgtgctcagggactgcctgttgagaaatagacggcaaatggaggtgatcagtctgcgattaaagttacagaagctacaggaagacgccgtggaaaacgacgattacgataaggccgagacgcttcagcaaaggctggaagacctcgagcaagagaagatctcgctgcacttccagttgccaagcaggcagcccgcactctctagcttcctcggccacctcgctgcgcaggtacaggccgcactacgcaggggggctacgcagcaagcctccggagatgatacccacacaccactgaggatggaaccacgccttctggaacctactgcccaagactccttgcatgttagtatcacacgcagggactggttgctgcaagagaagcagcagcttcaaaaagagatcgaagccctgcaagccaggatgttcgtcctggaggccaaggatcagcaacttcgacgcgagatcgaggaacaggagcagcaactccagtggcaggggtgcgatttgaccccactggtcggccagctgagcctggggcaactgcaggaggtcagcaaagccctccaggataccctggccagcgccggacagatcccttttcatgccgagccacccgaaactataagaagaaataaatgtgagggtaagtactatgaggttcatggtaacacttag

SEQ ID NO: 221022 - DNA, 1740 bp, Artificial Sequence
  Description of Artificial Sequence: Synthetic coding sequence
atgcctggaggcggtcctcagggggcacctgctgcagccggagggggaggtgtatcacatcgcgctggcagtagggactgtcttcctccagccgcttgcttcagaaggaggagactggccaggcgtcccggatacatgcggtcctccactggccctgggatagggtttctcagccccgcagtcggaaccctgttcagattcccgggaggagtgtcaggtgaggaatctcatcattctgagagcagggccagacagtgtggcctggattcacgaggtctcctggtcaggagccctgtctctaaatctgccgctgcccctacagtgacctcggttaggggaacgtcagcccactttggtatccagctcaggggtggcacccgcctgccagacagactgtcatggccatgtgggccagggtctgcaggatggcagcaggaattcgcagccatggacagttctgaaactctagacgcctcttgggaggcagcatgtagtgacggggcaagacgcgtgcgggctgcgggaagtctgcccagcgctgaactgtccagcaattcgtgtagccctggttgtggacctgaagtgccacccaccccacctgggagccactccgcctttaccagtagcttcagttttatccggttgtcactcggatccgccggtgagcggggagaagctgaagggtgcccacctagccgcgaagccgaaagccactgccagagcccacaggagatgggagccaaagcagcctccctagacggcccacatgaggatcctcgttgtcttagccgccctttctctcttctggctactagagtgtccgccgacttggctcaagccgctcggaacagttcgagaccagaacgggacatgcactccctccctgatatggaccctggtagcagttcatctcttgatccgtctctggcaggttgtggcggagatggttccagcgggagcggcgacgcccacagctgggacaccctcctgcggaaatgggagcccgtcctcagggattgtctgctgcgtaataggagacagatggaggtcatctcactgagacttaaattgcagaagcttcaagaggacgcagtcgaaaacgatgactacgataaagctgaaactcttcagcagagactcgaagaccttgaacaagagaaaatctccctgcattttcagcttccctcaagacagccagcattgagttcattcctcgggcatttggccgctcaggttcaagctgcgctccggagaggggctacccaacaagccagcggggatgatacccacactccactgcgcatggaacccaggttgctggagccaacagcacaggacagtctccacgtgtccatcacgaggagagattggttgctgcaggagaaacagcaattacagaaagaaattgaggctctccaagcacgtatgttcgtcctggaagcaaaggatcaacagttacgccgagaaatcgaagaacaggagcagcagctacagtggcaggggtgcgatctcactccactggtggggcagctttcactgggccaactgcaggaagtctcaaaggcactacaggacaccctcgcctctgcaggccagatcccatttcacgcagagcctcccgagacaattagatccctacaggagcgcattaaaagcctgaatttatctctaaaagaaatcaccactaaagaaacaatttcagggcgactcaaaacatcccctaggagacttgatcactag

SEQ ID NO: 221023 - DNA, 390 bp, Artificial Sequence
  Description of Artificial Sequence: Synthetic coding sequence
atgaccatgacaaccatgcccgagtccctgaatagtcctgtttccggaaaagctgttttcatggaatttggaccacccaatcagcagatgtccccctctccaatgtcacacggacactattccatgcactgcctccacagcgccggacatagtcaaccagacggcgcatattctagcgccagctcatttagtagaccattaggctatccctatgtgaattctgtttcctcacacgcatcttcaccctacatctcctcggtgcaaagctatcctggcagtgcctctctcgcccagagccgactcgaggaccccggacaggacctggtgccgaagcaggcaatccaggtgcaggaagcggacgaggctggctggggaggcagtgggggatag

SEQ ID NO: 221024 - DNA, 516 bp, Artificial Sequence
  Description of Artificial Sequence: Synthetic coding sequence
atgacaatgaccaccatgcccgaaagccttaacagtcctgtttccggcaaggcagtgtttatggagtttggccctccaaatcagcaaatgagcccatcgcccatgtctcatggacactattcgatgcactgcctgcacagtgctggacacagccaaccggatggggcatattcatcagctagttccttcagtcggccactgggctacccttacgtgaactccgtaagctctcacgcaagctctccctacatctctagcgtgcagtcatatccagggagcgcctcattggcacaatctcgcttggaagatcctggggctgatagcgagaagagtaccgttgtagaaggaggggaggtgcgatttaacggcaaaggcaaaaaaattcgcaaacctcgcacgatttacagtagtctccaactgcaggctctgaatcgccgttttcaacagacccagtatctggccttgccagaacgagcagaacttgctgcctctctgggtctgacacagacacagtag

SEQ ID NO: 221025 - DNA, 768 bp, Artificial Sequence
  Description of Artificial Sequence: Synthetic coding sequence
atgacaatgaccacgatgcccgaaagtctaaatagccccgtgtctggcaaagccgtatttatggagttcggacctcctaaccagcaaatgtctccttccccaatgagccatgggcactacagtatgcactgtttgcactcagccggtcactcccagccagatggcgcatactcgagcgctagcagcttttctcgacccttgggatacccatatgtcaactccgtgtccagtcatgccagctcaccatacatttcctcagtgcagagttacccagggtctgcaagcctggcccaaagtagactcgaggacccgggagccgactcggagaagtcaacagttgtcgagggtggggaggttaggttcaatggcaagggcaagaagatccggaagcccaggacgatttactcttcactgcagctgcaggccttgaataggcgctttcagcagacacagtacctagcgctgcccgagcgggctgaactggctgcctcactgggcctgacccagacacaggtcaagatttggtttcagaacaagagaagtaagttcaagaagctgatgaaacagggcggagcagcgttggagggaagcgcactcgctaatggccgtgccctgtcagccggaagtcctcccgtgcccccaggctggaacccaaattcatccagtgggaaaggaagtgggggaaacgccggatcatatatcccatcatatacaagctggtacccaagcgcgcaccaggaggcaatgcagcagccccagcttatgtag

SEQ ID NO: 221026 - DNA, 564 bp, Artificial Sequence
  Description of Artificial Sequence: Synthetic coding sequence
atgaccatgacgaccatgcctgagtcactgaacagtcctgtgtctggcaaggcagtgttcatggagttcgggccaccgaaccagcagatgtccccctcccctatgtcacacgggcattattctatgcattgcctgcattccgctggccattcccaacctgatggagcgtattcaagcgcatccagtttttcccgccctttgggatatccttacgtgaacagtgtttcgagtcatgcgagctctccctatatttcttcagttcagtcatacccagggagcgcctctctcgcccagagccggctcgaggatcccggagctgattctgagaagtctactgttgtcgagggaggggaggtgcgctttaacgggaagggtaagaagattcggaagccaagaacgatatacagctcacttcagcttcaagcattgaatcgaaggttccagcagacccagtaccttgcactgccagaacgggctgagctcgccgcaagcctgggcctcacccaaacgcaggttaagatttggttccagaataagcgctcaaaatttaaaaaactaatgtag

SEQ ID NO: 221027 - DNA, 1722 bp, Artificial Sequence
  Description of Artificial Sequence: Synthetic coding sequence
atggggaaatgcttaagttgctgtaaagaagaccagagtttccagaggtgttccccagaagaccaggtgagcacggatgctcagcaccggggtgcgagtagcatcagccagccctctatcagtctgggacacaagactagttactcacctgttacccataaagtgaatgctgctaaggcttctagaagactattatctgtctcctcgccttccttttcagagagacgttattccctcttcgtaggcttccagaaaaggaatgcgtctccctactggcagcaatcccgcgcaaacttcgatagcgaagaagacaccggctttacagatataaaaagtagctccgaccactgtggctcctttataagccgccgaagaaggttcagctccagaaagcttagcatcgtttcttactacaagtctgccatattcttcgacccccaggcatctggccagaatgttttcaatttgaacgaaatcgagatttttagcaaaacttcttctaatacagatgcgaaaaagcatataactatcagtgctcccgagtataacacgaagaatttcaagaactttgagacgaacaccacatccccagcatttgggaacacgatcgacaccgctagttaccaacaatcaacaagctcattctttagcttagcctcggatatttcctctccagatcagcagaacggaattgcgaatgatatacaacagcgcggtcagctgtgtaaggaccttaaagacttccttcatccacgtcctgagagttatagtacaggccactcaccaattatgatcccgcagcaccctagccagagcggcacatttcctttcttgcataaagcagggttttcctcttcttacaagaactcaggttgttttattcccccacagtctgagctcacatccggcttgtttgaggatgaagacttcgccgttctgttccaagacgaagataggagttctccaatcgaaatccctaagatccggtacattaccgcaaatacagacaccgaagagcagtccttccctgtgcccaaggcatttaatactcgcgtcgaggaactcaatctggatgtgctcttgcagaaggtggatcatctgcggatgtccgagtcaggcaaatctgaatctttcgagcttctgagagaccataaagagaaattcagagacgaaattgagttcatgtggcgtttcgcaagagcctatggggatatgtatgaactgagtactaacacacaggaaaagaagcactatgctaacattggcaagacattgtctgaacgggcaatcaaccgcgctcccatgaacggacattgtcatctatggtatgcagtcttgtgcggctacgtctcagagtttgagggactccaaaacaagattaactacggccacctgtttaaagagcacttagatatcgctataaagttgctgcccgaggagccattcttatattacttaaaaggcagatactgttacactgtcagcaagctgagttggatcgagaagaagatggccgcaaccctctttgggaagatcccatcaagcacagttcaggaggccctccataatttcctcaaggcagaggaattgtgtcccggatatagcaatcccaattatatgtacctggctaaatgttatacagatctagaggagaatcagaacgctctaaaattctgcaacttagctctgctgctccctacagtcaccaaagaagagctttag

SEQ ID NO: 221028 - DNA, 654 bp, Artificial Sequence
  Description of Artificial Sequence: Synthetic coding sequence
atgacaggcgtttttgattcattagtggccgatatgcactcaacgcagatcgctgcctcgagtacgtaccaccagcatcagcaaccccctagtggtggaggagctggacccggtggaaatagctccagctcatccagcctgcacaaaccccaggagagccccacgctccccgtgtccaccgcaaccgatagcagctattatacaaaccagcagcaccctgcgggaggtggcggaggaggtggctccccctatgcacacatggggtcctatcagtatcaagctagtggcctgaataacgtgccatactcggctaaatcatcctatgacttaggctatactgcagcatacacttcgtatgctccgtatggaactagtagtagccctgccaataatgaacctgagaaagaggacctcgaacccgagatccggatcgtgaacgggaagcctaagaaagtacgaaaacccaggactatctactcaagcttccaactggccgctttacagcgcagattccaaaaaacccagtatctcgcccttccagaacgggcagagctcgccgctagcttgggcctgactcagacccaggtgggcttggccccatgtagaggagaagagtcggctggccttcgctggcttggtagtaggagggtttag

SEQ ID NO: 221029 - DNA, 864 bp, Artificial Sequence
  Description of Artificial Sequence: Synthetic coding sequence
atgtctggaagcttcgacagaaagttgtcatctatactcacagatatcagcagctcactgagctgccatgcaggctccaaagactcaccaacactgccagagagctctgttaccgaccttggctactacagcgctcctcagcacgactactatagcgggcagccttacgggcagacggtaaacccatacacataccaccatcagttcaatctgaatgggcttgctggcaccggtgcctacagccccaaaagcgaatatacttacggagcctcctaccggcagtatggcgcttatcgggagcagcctctccctgctcaggaccctgtcagcgttaaagaggagcctgaagcggaggttaggatggtgaatggaaagcccaaaaaagtccggaaacctagaacaatttacagttcttaccaactggccgctctgcagagacgattccagaaggctcagtacctggctctgccagaacgggcagaactggccgctcagttggggctcacccagacccaggtcaagatctggttccagaataggcggtccaaatttaaaaagttgtacaagaatggtgaggtgcctctggaacatagcccaaacaattccgatagtatggcttgtaactctccgccatcccccgcactctgggatacaagcagccactccactcctgcgcctgccaggtcgcagctgccccctccccttccctattcagcgtccccttcttatctggacgaccctacgaatagctggtatcatgcgcagaatctcagcggtccacaccttcagcaacaacccccacaaccagcaacactgcaccacgcaagcccaggccctccaccaaatcccggagcagtgtactag

SEQ ID NO: 221030 - DNA, 723 bp, Artificial Sequence
  Description of Artificial Sequence: Synthetic coding sequence
atgactagtctgccatgcccccttcctgggcgagacgcctccaaggctgtcttccctgatctggcacctgtacctagcgtcgcagctgcctacccactaggtttatcacccaccactgcagcaagccccaacctgagttatagccgcccttacggccatctactgtcctacccctacaccgagcccgcaaatcctggggattcctatctgtcttgtcagcaaccagccgctctatcccagcccctgtgtggtcctgctgaacatccacaggagctggaagcagactctgagaagccacggttgtccccagagccttccgagcggcgaccccaggctcctgccaaaaagctgaggaagcctcggacgatttacagcagcctacagctccaacacttgaaccagcgttttcagcacacccagtacttggcactgcctgaaagggcgcagctcgccgctcagctgggcctgacccaaactcaagtcaagatctggtttcagaacaagcgcagtaagtataagaagttactgaaacagaatagcgggggtcaggagggggacttccctggcagaacattttctgttagtccttgttctccacccctgccctctctgtgggatctccccaaagcaggtactttaccaacgtctggctacggaaattcttttggtgcatggtatcaacaccactcaagcgatgtgctggcctctccacagatgatgtag

SEQ ID NO: 221031 - DNA, 507 bp, Artificial Sequence
  Description of Artificial Sequence: Synthetic coding sequence
atgaagctttccgtcctcccccctcgcagtttgctggccccttacacagtgctgtgttgtccgcctgactctgaaaaacctcgcttgtcgcctgagccctcggagcgcaggcctcaggctccggctaagaagctgagaaaacctcggactatctactcttctttgcagctccagcaccttaatcagagatttcagcatactcagtatttggccctgccggagagggcacaacttgcggctcaactgggcctgacccagactcaagttaaaatctggttccagaacaaacggagcaaatacaagaagctgttaaagcagaactctggtggccaagaaggggacttcccaggcagaactttttctgtttccccttgcagccccccactcccaagtctctgggaccttccaaaggcaggtaccctacctacttcggggtatggaaacagctttggagcctggtatcaacaccactccagtgacgtgctggcatctccacagatgatgtag

SEQ ID NO: 221032 - DNA, 1473 bp, Artificial Sequence
  Description of Artificial Sequence: Synthetic coding sequence
atggatcacacggacaacgagctgcaagggacaaattcaagcggctctttgggcggtctggacgtccggaggaggatacccattaagctaatttccaagcaggccaacaaagcaaagcctgctcccaggacacagcgcacgataaacaggatgcctgcaaaagctcctcctggagacgagggtttcgattacaacgaggaagagaggtacgactgcaaaggtggcgagttgtttgcaaaccaacgaagatttcccggtcacctattctgggactttcaaattaacatactgggtgagaaagacgacactccggtgcatttctgtgacaagtgcggactccctattaagatctatggtagaatgatcccatgcaagcacgtgttttgttatgattgcgccatcttgcacgaaaaaaaaggggataaaatgtgtcctggctgtagtgatcccgtccagaggatagagcaatgtaccagaggctcgctctttatgtgttccattgtgcaggggtgtaagcgtacttacctgtctcaacgcgaccttcaggcacatatcaatcacaggcatatgagagctggtaaacccgtgacaagagcctctctcgaaaacgtacaccctcctattgccccaccacccactgaaattccagagcgttttattatgccaccagataagcaccatatgtcacacattccacccaagcagcacatcatgatgccacctcccccactgcagcatgtccctcacgaacattacaatcagccccacgaggatattagagctcctcccgctgaactgagtatggcccctcctccaccacgtagtgtcagccaagaaacattccgtatttccacgaggaagcacagcaatcttattacggtccccattcaggatgactcaaactccggagcacgggagccaccacccccagccccagcccctgctcaccaccaccctgaataccaagggcagccagtggtgtctcatcctcatcatattatgcccccacaacagcattatgccccacccccaccacctcccccaccaatttcccatccaatgccccaccctccacaggccgcaggaactcctcatttagtgtatagccaagcccctccgcctccaatgacatcggcccctccaccaattacaccaccacccggacacatcatagctcagatgcccccttatatgaaccatcctcctcccggtcctccgcctccacagcatgggggacctcctgtcacagcgccacctccccaccattacaacccaaacagtctcccccagttcacagaagatcaaggtaccctgagcccccctttcacccagccgggaggaatgtcgcctggtatctggccagctcctagaggacccccacctcctcccagactccagggtcccccatctcagacccccttgcctgggccacatcatcccgatcagacacggtaccgcccatactatcagtag

SEQ ID NO: 221033 - DNA, 798 bp, Artificial Sequence
  Description of Artificial Sequence: Synthetic coding sequence
atgatgacaatgaccaccatggcggacggcctggagggacaggattcctctaagtccgcttttatggagtttggacagcagcagcagcaacaacactccccagccatggctggggctcactatcctttgcactgtctgcactctgctgccgcagcagctgcagctggttcacaccaccaccaccaccaccagcatcatcaccacggctctccttatgccagcggcggaggcaactcttataatcataggtctcttgcagcttatccctatatgtcgcactcccagcacagcccatatctgcagtcataccataattcttccgcagctgcacagacgaggggggacgacactgatcagcagaagacaacggtgatcgaaaacggcgagatccgctttaatggcaaaggtaaaaagattcggaaaccgagaactatttattcctctctgcaactccaggcgttgaaccacagattccagcagacacaatacctcgctctgccagagcgggctgagttagctgcatcactcggcttaactcaaactcaggtaaagatctggttccagaacaaaaggtctaaatttaagaaactgttgaagcaggggagcaatccacatgagtccgacccactgcagggaagcgctgcactgtctcccaggtctcccgctttgcctccagtgtgggatgtttcagcatctgccaagggggtgagcatgccccctaacagctatatgccgggatactcacattggtattcctcaccccatcaggatacaatgcagcggcctcagatgatgtag

SEQ ID NO: 221034 - DNA, 882 bp, Artificial Sequence
  Description of Artificial Sequence: Synthetic coding sequence
atgatgaccatgactaccatggctgacgggttggaaggccaggacagcagtaaatcagcgttcatggagtttggacagcagcagcaacagcagcaacagcagcagcagcagcaacagcagcagcaacaacagccaccacctcctccgcctcccccaccccagccgcattctcagcagagctccccggctatggcgggagctcactaccccctgcactgtctgcattctgccgcagccgcagccgctgcagggagccaccaccatcatcaccaccaacaccatcatcatggctccccatatgcctcaggtggagggaatagttacaaccatcgttcgctggcggcttatccgtatatgagccacagccaacattctccatatttgcagtcatatcacaatagtagcgctgcagcccaaaccagaggcgacgacaccgaccagcagaagaccacagttatcgagaatggcgaaataagattcaatggcaaaggaaaaaaaattaggaaaccaaggactatctattcctccctgcagttacaggcgctaaaccaccggtttcagcagacccagtacctcgcccttcctgagagagcggaactggcagcaagcctgggcctgactcagacgcaggtgaaaatatggtttcagaacaaaagaagcaagttcaagaagctattaaagcaggggtccaacccgcacgagagtgatcctctgcagggctccgcagcgttaagcccaaggagccccgcactgccgccagtgtgggatgtctcggcttctgctaaaggggtgtcaatgccaccgaattcttacatgcctggctatagtcactggtatagttccccccatcaggacaccatgcagagaccacagatgatgtag

SEQ ID NO: 221035 - DNA, 9084 bp, Artificial Sequence
  Description of Artificial Sequence: Synthetic coding sequence
atgaatctacaccaggttctcacgggagccgtgaatccaggcgatcattgtttttcagtgggctccattggcgatcagaggtttactgcttacgcgtctggctgcgatatagtgatccttggtagtgatttcgagcgcctgcagatcatccctggagctaagcacgggaatatccaggttggatgcgtcgactgcagcatgcagcagggtaagatagccgcttcttatggcaacgtgatctctatttttgagccagtgaacctgccaaaacagaagaagaatctggaactgtacagtcagtggcagaagtcagggcagttttttctagagagtattgcccataatattacgtgggaccctactggaagtcgtctcctgactggctcctcgtatctgcagttgtggtctaataccaatcttgagaagcctaccgaagacgaaaacctaaacaaaaccgatttaaacttcggtgactggaaatgcatctggcactgcaagaccgcctcccaggttcatctgatgaaattcagccccgacggagaattttttgcaaccgccggaaaggatgactgcctgctgaaggtgtggtacaacgttgaaaattggcgaaccgcagtcacgtccccagacggaagttccgaaaagcaaagccagggcgagatcgactttagtttcgtctatctggctcaccccagggccgtgaacggtttcagttggaggaagactagcaagtatatgcctcgagcctccgtttgtaacgtcctgctgacttgctgcaaagacaacgtatgtagactatgggtggaaacctttctacctaatgattgcctcttatacggcggtgattgttctcactggacagaatccatcaacctgaccaacaatttcaagcgcaacgctagctccaaggagcgagtgcagaacgcccttgaggtgaatctacggcacttcagaagggggagacgccgatccttggctttagtcgcacatacaggctacttgccacatcagcaggaccctcaccatgtccatagaaacactccgctgcacgccaacgccctgtgtcacttccacattgcagcgagcatcaatcctgctacagatataccactcctgcccagcatcacttcactcagcctgaacgagaatgaagaaaagacgggcccatttgtagtgcattggctgaataacaaggaactacatttcacccttagcatggaggtgttcctgcagcagctacgtaaaagttttgaacagccgtcgagcgaggcctccgtcgaagactctaatcaggccgacgtgaaatcggatgaagagacagatgacggtgtggatgatttaaagatcaatcccgagaaaaaagagttgggctgtgacaagatggtgcccaattcaagcttcacgtctctgtcgagcgctgcaattgaccaccagattgaggtactcttgtctgagtggtcaaagaatgccgacatgctgtttagcatccatcctatggacggcagccttctggtatggcacgtggactggttagacgagtaccagcctgggatgtttcgccaggtgcaggtgtcctttgtgagccggattccggtggcttttcccaccggcgatgctaacagtctgtgcaaatcaattatgatgtacgcatgcacgaaaaacgtggaccttgcaattcaacagggcaaacagaaacctagcggcctaacacgctccacctccatgttaatctccagcggccataacaaaagtagcaatagcctcaaattgtctatcttcacacccaacgtcatgatgatcagcaaacatgctgacggtagcctgaatcaatggcttgtgtcttttgcggaggaatctgccttcagtacggtgctttcaattagccacaaatccaggtattgtggacaccgattccacctgaacgacctcgcctgccactcagtgctgccactactcttaacaacgagtcaccacaatgccctgcgaacacccgatgtggacaatccagaacaaccctttgacgcccttaatattgaagaatgctctttaacccagcagaataagagtacggtggacgtcgcctttcaagacccgtccgcagtgtattcagagctgattctctggcgggtagacccagtaggccctttaagcttctcgggtggagtttctgaactcgccaggatcaactctttacatgtctcagcattctcaaatgtcgcttggttgccaaccctgattccatcatattgcctgggggcttactgcaattcccctagtgcgtgctttgtcgccagtgatggacagtatttaaggctctatgaggcagtcattgacgctaaaaaactcctatcagagctgtcaaatcccgagatcagtaagtatgtgggagaggtgtttaacatcgtgtcccaacagtctactgcccgtccaggatgcatcatagccctggatcccattaccaagctgcacgggaggaaaacacagcttctgcatgtttttgaggaggactttatattgaataaccttgagaagaaatcactgggaaaagactctatcctctcgaacgcaggaagctcacctaacggcttttctgagaagttttatttgattgtgatcgagtgcacacaagataacagatcccttctgcacatgtggaaccttcacctcaaatcaattccagttagtctcgatgaaaaggtcgatacaaagctttccgaagctgtttggcaaccagaagagcactactccagctctcctgaaaagattctgtcgcccttcagtcagaagtaccaggcttgcagggccaatttgcaatctaccagcaggttgacattgtttagtgagatggtgtattcacaggaattgcatctcccagagggcgttgaaatcatttctatcaaaccctccgccggacacctgagctcctcgtccatttatcccgcttgttccgccccttacctgctggctacttcttgcagcgatgaaaaggtaagattctggcgatgtcgggtcacagatggcgaatctgcgacatccaaaaatggtaaaattgacctagcttacatctgggaggagtggcctctgctgatcgaagacgggctccagtcgaattcctctattaccgttccgggacggcctgtggaggtgtcctgcgcccatacgaacagactggctgttgcatacaagcagccagcaagtaactcgcggtcctcacaggatttcgtcatgcacgtatctatcttcgaatgtgaatcgaccggcggatcctgttgggtcctagagcagaccatacacctggatgagctatcaaccgtgctagattccggaattagcgtggactcgaatctagtcgcttacaataagcaggatatgtacttgtcgtctaaagaaaacattaccagtaataccaagcacctagtgcacctggactggatgtccagggaagatggttctcacatcctcacagttggcatcggcagcaagctgttcatgtatgggccactggctggtaaagtgcaagatcagactggaaaggaaacactagcctttccactgtgggaaagtacaaaagtcgtgcccttgtcaaagtttgtgctccttaggagcgtggacctcgtgtccagtgttgatggctcacccccttttccagtctccctgagctgggtcagggatgggatccttgtagttggcatggactgcgaaatgcacgtgtactgccagtggcaaccatcatctaaacaggagccggtcatcactgacagttatagtggctccacccccagcatcacctccctcataaagcagtcgaattcatcttcagggctgcatccaccaaagaaaactttgaccagatctatgacctccctggcgcaaaagatctgcgggaagaagacagcatttgaccccagtgtcgacatggaggacagcggattgtttgaggccgctcatgtgctgagtccaacactgcctcagtatcacccactgcagctgctcgaactaatggatttgggaaaggttcgacgcgcaaaggctatcttgagccacttggttaaatgtatagccggtgaagtggtagcactgaatgaggctgagtcgaatcatgagcgtcgactcaggagtctgactatctccgctagtggcagcacaaccagagaccctcaggcatttaacaaggcggagaacaccgattacaccgaaatcgattccgttccacccctgccattgtacgcgttactagccgcagatgacgactcatgctattcatcactggaaaagtcgtccaacgagtcaaccctgtccaaatcaaaccagctgtcgaaggagtcatatgacgagctgttccagacccagctgctgatgaccgacacacacatgctcgaaacagacgaggaaaacacaaagccacgtgtaattgatctcagccagtatagtcctacatacttcggccctgagcacgcgcaggtgttgagcggtcacctgctgcatagctcattacctggactcagccgcatggagcagatgagtctgatggctctggctgacaccatcgctacgacttccacagatatcggtgaatctcgcgacaggagtcaagggggagaaacactggatgagtgtggactgaagttcctcctcgctgtgaggttgcatacatttctcacaactagtctacctgcataccgagctcagctcctccaccaaggtctcagcaccagccatttcgcctgggcatttcactccgtggcagaggaggagctgcttaatatgctaccagcaatgcagaaagatgaccctacctggtctgagttgagagctatgggcgtaggctggtgggtgcgaaacaccaggattctgcgcaaatgtatcgaaaaagtagctaaagcggcattctacaggaaaaacgacccactcgatgcggcaatcttctacctggcaatgaaaaaaaaagccgtaatctggggactgtaccgtgcggagaaaaacaccaggatgacccaattttttggccataattttgaggatgaacgctggcgcaaagccgctttgaagaacgccttctctctcctcggtaagcagcgctttgaacattctgcagcttttttcctcctcgccggttgtcttagagatgcgattgaggtctgcctcgaaaagctcaacgacattcagctggccctggtgatcgccagactgtacgagtccgagttcgatacgtcagccgcttataagagcatcttgcggaaaaaggtacttgggattgactccccagtcagcgagctgtgttcccttaatattaatatgcaccacgacccatttttgaggtcaatggcttattggattctcgaagactatagcggcgctttggaaacactcatcaaacagccaatacgggagaatgacgaccaggtgttatcagcttctaacccaacagtgttcaacttttataattacttgcgcacccaccccctgctcctgaggcggcacttcggttcctcagacacatttagcactcatatgtctctgaccgggaagagcggactggccggaacaattaacctcagcgagcggcgtttattttttaccacagcttccgctcacctcaaggccggatgtcctatgctggcactggaggtcttgtccaagatgcccaaagtgataaagaagactaggccgttctaccgcgctagctccttcctggatacttcgaaagattgttcaccaagctctcccttaaagctcgatgcaagggaagacaaatcctccgctgtagactggagccagagcttaatcaacggcttcggttcctcttcagagggttccagtgaaaagcaaagtaatagcaccctttctttcgattggtcccagccatcagtagtctttcaagatgattcactggagttgaagtgggatagcgacaatgatgaggagaatgaggacgtgcctatttccatgaaggagctgaaaccactgcagaggaagactgacaaaaagttggatgacattagcagcaattatacagaatcgttcagcaccctggacgagaatgaccttctaaatccctctgaggatatcatcgctgtgcaattgaagtttagagcatgcctgaagatcctgacagttgaactgcgaaccctatctacaggatatgagatcgatggcggaaaattaagatatcaactctaccactggctggaaaaggaagtgatagctcttcagcgaacttgtgacttctgttcggatgcagaagagctgcagtcagcctttggcaggaacgaggatgaattcggtctgaacgaagacgccgaagatttgcctcatcaaaccaaggtgaagcagctacgcgagaactttcaggagaagaggcaatggctcctgaaataccagtccctgctacggatgtttctcagctactgcatcttacacggtagtcatggaggtggcctcgctagtgtgcggatggagctgattctcctactccaggagtcgcagcaggagaccagcgagcctctgttctcttctcccctgtccgagcagacctcagtgccattgctgttcgcgtgcacagcgaatgccaagactgtggtagctaatccactactacacttgtctaatctgactcatgacattctgcacgctattattaactttgactcaccaccccatccagatattcagagcaacaaagtctacgttatgcataccctggcagctagcctctcagcctgtatctatcagtgcctgtgtggcagccacaactattccagcttccaaaccaaccagtttaccggtatggtgtatcagactgtccttttgccccacagaccatccctgaaaactggaagcctcgatgaggccctgacaccaaatacaagtccggcacaatggccgggtatcacttgtctcatcagactcctgaactcctcaggcgaagaagctcagagtggtctcaccgttctgctgtgcgagatccttactgcggtgtacctttccttgtttatacatggcctggccacccattcaagcaacgagctatttcgcatcgttgcgcacccactgaatgagaagatgtggtcggccgtctttggtggaggagcccacgtccccagcaaggaacagacgcacagcaaaacactgccggtctccagtctggtggaagaaggcgagaagcagaacaagcgattccgaccctctaagatgtcatgtagagagagcgctcctctgactccttcctctgcccctgtgagccaggagtccctggcagtgaaagagaagttcatcccaccagaactgtctatctgggactatttcattgcgaagcccttcctcccatcctcccaatctagagccgagtatgactctgaagagtcgctgggaagtgatgatgacgataacgacgacgatgacgatgtccttgcaagcgactttcatctacaggagcactccaactccaattcttacagctggagcctgatgcggctggccatggttcagctagtcctcaataacctgaagacattctacccattcgctggtcacgacctggctgagctgccggtaagctcaccgctctgtcatgctgtcctgaagacactgcagtgctgggagcaggttctgcttcggcgattagagatacacggtggacctccccagaactacatagcctcgcacacagccgaggaatctctgtccgccggacccgcaatcctacggcataaggcccttctggagcccactaacactccctttaaatcgaagcaccatctcgccttgagcgtgaagcgactgtggcaatatctggtgaagcaggaggaaatccaagagactttcataaaaaatatttttactaaaaagcggtgccttaatgaaattgaggcggacctgggttatccagggggaaaagccaggatcatccataaagaaagcgacattataaccgcctttgccgtcaacaaagccaatagaaactgtatcgccatagcttcctctcacgacgtacaagagctagacgtcagcggcatcttggccacgcaggtgtatacctgggttgacgacgacatcgaggtcgagacaaagggctccgaggattttctggttatccatgcccgtgacgacctgaccgctgtacaggggacaaccccttacacacactcaaaccctggcacacctattaatatgccttggcttggaagcacacagaccgggagaggcgctagcgtgatgattaaaaaggctattaataatgttagaaggatgacctcacatccaacactcccatactatctaactggggctcaggacggatccgtcaggatgtttgaatggggtcatagccagcagattacttgcttccgctcaggaggcaacagccgagtcactaggatgagattcaattatcagggcaacaagttcggaattgttgatgcagacgggtatctgtctctgtaccagacaaactggaaatgttgcccagtcacaggatcaatgccaaagccttacctgacctggcagtgccacaataaaacggctaatgacttcgttttcgtcagctcctccagtttgatagccaccgccggactgtcgaccgataatagaaacgtgtgtctgtgggacaccctggtagccccagccaacagcttggtgcacgccttcacctgccacgatagcggcgcaacagtgctggcctacgctcccaaacaccagttgttaattagcgggggacggaagggtttcacttacgtcttcgacttatgccagcgccaacagcgtcaactgttccaatctcacgattcccccgtcaaggctgttgcggtagaccccactgaagagtattttgtgactggctctgccgagggaaacataaagatctggtcattatctacctttgggctcctgcacacattcgtctccgagcatgctcgccagtccatcttcagaaacatagggactggggtcatgcaaatcgaaaccggacctgccaatcatattttcagttgcggcgctgacggtacgatgaaaatgcggatcctccctgatcagttctcaccgctgaacgaagtcttgaagaatgacgttaagttcatgctgtat

SEQ ID NO: 221036 - DNA, 1770 bp, Artificial Sequence
  Description of Artificial Sequence: Synthetic coding sequence
atgaatctgcaccaggtgctcactggggcagtaaaccctggcgatcattgcttctcagtgggctcaattggtgatcaaagattcacagcatatgcctctgggtgcgatatcgtcatccttggaagcgatttcgagcgcctccaaatcatccccggagctaagcatggtaatatccaagtgggctgtgttgattgttcaatgcagcagggaaagatcgcagccagctatgggaacgtgataagcatttttgagccagtgaacctgccaaaacagaagaaaaatctcgagctgtacagtcagtggcaaaagtccggacaattttttcttgagtccatcgcacacaatatcacctgggacccaacaggaagcaggctcttgaccggctcctcctaccttcaattatggtctaatactaatttggagaagcccacagaagatgaaaatctaaacaagaccgatctaaacttcggagactggaagtgtatctggcactgtaaaactgccagtcaagtccatctcatgaaattttcccccgacggggagtttttcgctaccgcgggaaaggatgattgtctcctgaaggtctggtataacgttgaaaactggaggacggcagtgacctctccagatggttcctcagaaaaacagtcacagggggagattgactttagcttcgtgtatctcgcccatcctcgggctgtgaatggcttcagctggaggaagacatctaaatacatgccccgtgccagcgtctgtaatgtgctcctgacatgctgcaaggataacgtgtgccgactgtgggtggaaacattcctgcctaacgactgtttgctgtacggaggggactgctctcactggactgaatcaatcaatctcactaacaatttcaaacgaaatgccagttcaaaagagcgggtgcagaatgcgctcgaagtgaatctccggcatttccggcgagggaggcgcaggagccttgccctggtcgctcacactggatatttgccacatcaacaggatccacatcatgtgcaccggaatactcctttacacgcaaacgccttgtgtcattttcacattgcagcaagtattaaccccgcaacagacattccgctgctgcccagcatcactagtctgagcttgaacgagaacgaagagaagactggaccattcgtggttcactggcttaacaacaaggaactccactttacgctctcaatggaagtgttcctccaacagctgaggaagtccttcgagcagccctcaagcgaggctagcgtcgaggacagcaatcaggccgatgtgaagagtgatgaggagactgatgacggcgtcgacgacctaaaaattaaccccgaaaaaaaggaactgggttgcgataagatggtgcctaacagctccttcaccagcctgtcttctgcggcaattgatcaccagatcgaagtcttactgtctgagtggtctaagaatgcagacatgttgttcagcattcacccaatggacgggtcactgttggtttggcatgttgactggctggacgagtatcaaccaggtatgttccggcaggtgcaggtgagtttcgtcagccggatccctgtcgccttcccaaccggcgatgccaatagtctgtgcaagagcattatgatgtatgcttgtaccaaaaacgtggaccttgccatccaacaggggaaacagaaaccttcgggattgacacgctcaaccagcatgctaataagctccggtcacaataagtcatctaactccctgaagtag

SEQ ID NO: 221037 - DNA, 9146 bp, Artificial Sequence
  Description of Artificial Sequence: Synthetic coding sequence
atgaacctgcatcaggtccttaccggcgcagttaatcctggcgaccattgtttttcggtgggcagcattggcgatcagcgcttcactgcctacgcgagcggttgtgacattgtgatcttggggtcggacttcgaacgactgcagattatacccggagcgaagcatggaaatatccaggtgggctgcgtggactgctcgatgcagcagggcaagattgcagcctcttatggaaacgttatttccatcttcgaaccagtgaatctgccaaagcaaaaaaaaaacctggagctgtattcacagtggcaaaagagcggacaattttttctcgagagcatagcgcataatatcacgtgggatcccactggttcacgccttctgaccgggtcttcatatctgcagttgtggtccaacactaatttagaaaaaccgacagaagatgaaaacctgaacaaaacagatctgaattttggggattggaagtgcatttggcattgcaagactgcgagccaggtgcacctgatgaagttctcccccgatggggagttcttcgctaccgcgggaaaagatgattgtttattgaaagtgtggtacaatgtcgagaattggaggaccgccgtgacttcacctgacggaagcagcgagaagcagtcacagggggagatcgacttctcctttgtttatcttgcccatccgagggcagttaacggcttctcttggcggaagaccagcaagtatatgcccagagctagcgtatgcaacgtccttcttacatgctgtaaggacaatgtgtgccggctctgggtcgaaactttcctgccaaatgattgcctgctatacggaggagactgctcccattggaccgagtcaatcaacttaacgaacaattttaaaaggaatgcatcaagcaaagaacgcgtgcagaatgccttggaggtgaatctccgtcatttcagaagagggcgtagacggagcttggctctagtagcccacaccggttatctccctcaccaacaggatccgcaccacgtccatagaaacacccctctgcatgccaacgccctctgtcacttccacatagccgcttccatcaatcctgccacagatatcccactactgccttctatcaccagcctctccttaaatgagaatgaggagaagacaggaccctttgttgtacattggctcaataacaaagagttgcactttactctatcgatggaggtatttctgcagcagctgcggaagtcttttgaacaaccctcgtcagaggcatctgtagaggattccaatcaggcggacgtaaagtccgacgaagagacagatgatggcgttgacgacctgaagatcaaccctgagaagaaggagctggggtgcgataagatggttcccaatagctccttcacctctttatcgtcagccgctattgaccaccagatcgaggtgctgctgtcggaatggtcaaaaaatgctgatatgttgttctcaatccatcctatggacggttctctcctggtgtggcacgtagactggctcgatgagtaccagcctgggatgtttcgccaggtgcaggtgtcttttgtgagcaggattcctgtcgcgttccccaccggggacgctaattcgctttgtaagagcataatgatgtacgcctgcaccaagaacgtggatttagcaatccagcaggggaagcagaaaccttctggccttacaagatcgacctccatgctgatttcgtccggacacaataaatcaagcaactcccttaagctctctatattcacaccaaatgtaatgatgatatccaagcatgcagacggatcattgaatcagtggcttgtgagttttgcagaggaatcagcctttagcaccgtgctgagcatcagtcataaaagcagatactgtgggcatcggttccacctgaacgacttggcctgtcatagcgtgcttcccctgctgcttactacatctcatcacaacgccttgcggacacctgacgtagataatccggagcaaccctttgacgcgctcaatatcgaggaatgtagtctgactcagcagaataagtctacagttgatgtagcctttcaggacccctctgctgtttactctgaattgattctgtggcgggtggaccccgtgggccctctgagctttagcggcggtgtttctgagctggcacggatcaactccctccacgtgtctgctttcagcaacgtagcctggctgccaaccctgatcccatcctactgccttggcgcttattgcaacagcccaagcgcgtgctttgtagcctccgacggacagtaccttcgactatacgaagcagtgattgatgccaagaagttactgtcagagctttccaaccccgagatctctaaatatgtgggagaagtcttcaacatagtgtctcagcagtcaacggccagacctgggtgcataatcgcgctcgaccccatcactaaactgcacggcaggaagacacagttattgcacgttttcgaagaggacttcattctaaataacctggagaagaaaagtcttggcaaggattcgatcctctcaaacgccggatcctcccccaacggtttctccgagaagttctacttaatagtaatcgaatgcacccaggacaacaggagcctgctacatatgtggaacttgcacctgaagtctattcctgtgtctctggatgagaaggtggacaccaagttatctgaagcagtgtggcagccagaagagcactatagtagcagcccagagaagatcttgtctcccttctcacaaaaatatcaggcatgccgtgccaacctccagtcgactagcaggctgaccctcttttccgagatggtctattctcaggagctgcatctgcctgaaggggtcgagatcatatctattaagccttctgcgggtcacctgagtagcagctctatctatccagcttgctcagctccctatctgctcgcgacttcctgcagtgatgagaaggtgcggttctggcggtgccgcgtgacagacggtgagagcgccaccagtaaaaacggcaaaattgacctggcctacatatgggaggaatggcccctactaattgaagacgggcttcagagtaattcctctattactgtgccaggccgacctgttgaagtctcctgcgcccatacaaatcgtctggccgttgcatataagcagccagcttctaacagtcgcagttcacaggattttgtgatgcacgtttccatctttgagtgtgagtccaccggaggatcttgctgggtgctcgaacagaccatccacttggacgagttgagcacagtactagattctggtatttcagtggactcaaatctggttgcctacaacaaacaggacatgtacctgtcatcaaaagaaaacatcaccagtaacacaaagcatctggtgcatctggattggatgtcccgcgaagatggttctcatatcttgacggtcggaattggaagtaagttgtttatgtacgggcctcttgccggaaaggtgcaagaccagacaggtaaggagacactggccttcccactttgggagagcactaaagtggtgccactcagcaagtttgtgttactgaggtctgtggacttggttagcagcgtggacggaagccccccattccccgttagcctgtcctgggtgagagacgggattctcgtggtgggtatggactgtgagatgcatgtttactgtcagtggcagcccagtagcaagcaggagccagtgattacagactcttacagtggatccaccccctctattacttcgctgatcaagcagtccaattccagtagtgggctccacccgcctaagaaaacactgactcgatccatgactagtctggcacaaaaaatctgcgggaagaagactgcctttgatcccagtgtcgacatggaagactccggcctgtttgaggctgcacatgtattgtctcctaccctgcctcagtaccatccgctacagctgctggagctgatggatttaggtaaggttaggagagccaaggccattctgtcacacctagtgaaatgcatagcaggggaagtcgtagcactgaatgaagctgaatctaaccacgagcgccgtctgcggtccctgaccatttctgcaagtggctctacaacccgcgacccccaagccttcaataaggcagagaatacagactacacagagatcgatagcgtacctcctctgcccctatacgccctgctggcagccgacgatgattcctgttacagctccttggagaaaagctctaacgagtcaacattatcgaagtccaaccagctgtccaaagaaagctacgatgagctgtttcagactcagctgctaatgacagacactcatatgctggagacagatgaagaaaacactaagccaagagtcatcgacctgtcacagtatagtcccacttatttcggacctgaacatgcacaggtcttatcggggcacctcctgcatagtagcctgccaggtctgtcccggatggagcagatgagtctaatggccctggccgatacaatagccaccacaagcacagatattggagaatccagagatagatcccaggggggagagacacttgacgaatgtggactgaaatttctcctggctgtccgcctgcatacttttttaacaacttctttacctgcatatcgggctcagctgctgcaccaaggtctgagcaccagtcacttcgcttgggccttccatagtgtagccgaggaggagctcttaaatatgttgcccgctatgcagaaggacgatccaacttggtctgaattgagggcaatgggggtggggtggtgggtgcgaaatacaaggattctccggaaatgcattgagaaagtggcgaaggcagccttctatagaaagaacgaccccctggacgctgcaatcttttacctagcgatgaagaagaaggcagtgatatgggggctgtaccgcgctgagaagaacacgaggatgactcaattttttggtcacaatttcgaagacgaaaggtggaggaaggcagccttaaaaaacgcatttagtctgctgggcaagcaacgtttcgaacattcagccgcatttttcctcctggccggatgtttaagggatgctatcgaagtttgtcttgagaagctgaatgatatccaactggctctcgtaattgcgaggttgtacgagtccgagtttgacactagcgcggcttacaagagcatcttgcgaaaaaaggtcctagggattgacagccctgtgtctgaactatgttctctcaatatcaacatgcatcatgaccctttcctgcgtagtatggcctattggatcctagaagactactctggggcactggagacactgataaaacagcctattcgagagaatgatgaccaagtgctgtccgcttctaatccaacagtgttcaacttctataattacctgaggacacatcccttattgctgagaaggcactttggcagctctgataccttctccacacacatgagtcttacgggaaaatcaggcctcgctggcactatcaacctgtcagaacgaagactgttctttacgaccgctagtgcgcacctaaaagctggctgcccaatgctggcactggaagtcctgtccaagatgcccaaggtgataaagaagaccaggccattctaccgcgcaagcagcttcctcgatacttctaaggactgctcaccctctagcccccttaaactggacgcacgggaggacaaaagcagtgcagttgactggtcccagtccctgatcaatggcttcggcagttcctctgagggatcaagcgagaagcagtcaaactcaaccttgagcttcgactggagccagccttccgtggtgttccaggacgactctcttgaactgaagtgggatagtgacaacgacgaagagaacgaagacgtgccgattagcatgaaagagctaaagccacttcagaggaagacagataaaaaactggatgacattagttcgaattatacggaatcattcagtaccctggacgaaaacgacctgttgaacccgtccgaagatattatcgccgtccagctgaaatttcgcgcatgtttaaagatcctgactgttgagctcagaactcttagtaccgggtacgaaattgacgggggtaagctgcgctaccagctttaccactggctggagaaggaggtcattgctctgcaacggacctgcgatttttgttccgacgccgaggaactgcagagtgcgttcggaagaaatgaagatgaatttgggctaaacgaagacgcggaggatctcccccatcagaccaaagtcaagcagctgagagaaaattttcaggagaagaggcaatggctgctgaagtatcagagtctgctaaggatgttcctgagctattgtatcctgcacggaagccacggcggaggcctagccagcgtccgcatggaactcatcctgctgctgcaggagtcccagcaggagaccagcgagcctctcttttctagcccgttgagcgagcaaacgtcagttcccctcctgttcgcctgcactgccaatgccaagaccgtggttgctaaccctctcttgcacctcagtaaccttacacatgacatcctgcacgctataatcaactttgattccccaccccaccctgacatccagtcgaataaggtctacgttatgcatactctggcagcttccttgagtgcttgcatataccagtgcctgtgtggcagccataactattccagctttcagacaaaccagtttacaggtatggtttaccaaaccgtcctattgccacaccgtccatccctgaaaacaggatctctggacgaagccctcacccctaatacctctcctgcacagtggccaggcattacatgcctgattcgactgctgaacagctcaggtgaagaagctcagtccggattaaccgtgctgctttgtgaaattttaacagccgtttatctgagccttttcattcacggactggctacccacagttccaacgaactattccggattgttgcccatccacttaacgaaaagatgtggtctgcagtgtttggaggtggtgcccatgtcccatctaaggagcagactcattctaagaccctaccggtgagttctctggtcgaggagggcgagaagcagaataagcggttcagaccaagcaaaatgtcttgcagggagtccgcaccccttaccccatcaagcgctcctgtgtctcaagaatctcttgccgtgaaagagaagttcataccccctgagctgtccatctgggactacttcatcgccaaaccatttcttccttccagtcagtctagagccgagtacgacagtgaggaatccctggggagcgatgacgacgataacgatgacgacgacgacgtgctggcatccgacttccacctccaggagcattcaaacagcaacagctattcttggtctctgatgcgcttagctatggtgcagttggtccttaataatctgaagactttctacccattcgccggtcatgacctggcagagcttcccgtcagcagtcccctatgtcatgctgtgctgaagaccctgcagtgctgggaacaagtattgctgaggagactcgaaatccatggcggacccccacaaaactatatcgcctctcacactgcagaggagtccctgtccgccggtcccgcaatcctgcggcacaaggcccttctcgagcccaccaatactccatttaaatccaagcaccacttagccttgtcagtgaagagattgtggcaatatctggtcaagcaggaagaaatccaggaaacatttattaaaaacatcttcactaagaaaaggtgtctgaacgagtcacttgaagataactccgaaacgattaagaattccatgatggaagagcccaatattaataagatcgaagccgacctagggtatcctgggggtaaggcacgcatcattcacaaagagagtgacatcataactgcttttgcagtgaacaaagcaaataggaactgcatagctatcgcctctagtcatgatgtgcaggaattagacgtgtctggaatactggctacgcaagtttacacctgggtggatgatgacattgaggtggagactaaaggatctgaagatttcctggtcattcatgctagggacgatctcacagccgtgcaggggactaccccatacactcatagtaatcctggaacacccatcaatatgccctggctcgggtcaacgcagacgggcagaggggcttctgtcatgatcaaaaaggccattaacaacgtccgaagaatgacctcccaccctactttaccatactacctcaccggcgcacaggacgggagcgtccgcatgtttgaatggggacatagtcaacagataacttgctttagaagtggtggtaactcaagagtaacacggatgcgctttaattatcagggaaacaaattcggcatcgtggatgcagacggttatttgtcactctatcaaacaaattggaaatgctgtccagtgacaggctctatgccgaagccatatttaacctggcagtgtcacaacaagacagccaatgatttcgtgtttgtgagttcctcctccctgattgcaacagctggactttccacagataaccgcaacgtctgtctttgggacacattggtcgctcctgcgaatagcctggtccatgcctttacctgtcacgactcaggtgcaaccgtcctggcttatgcacctaagcaccagctgctgatatccggaggcaggaaagggttcacctatgttttcgacctatgccagcggcagcagcgacagctcttccagagtcatgattctccagttaaagccgtcgcggtagatcctaccgaggagtacttcgtaacaggctcagccgaaggtaacattaaaatctggtctctttccacttttggcctcctgcacacatttgtcagcgaacacgctcgtcagagcatctttaggaacatcggcacaggcgttatgcaaatcgaaactggacctgctaatcatatcttctcgtgtggtgcagacggaaccatgaagatgaggatcctgcccgaccagtttagtcccctgaatgaggttctgaaaaacgatgttaagtttatgctgta

SEQ ID NO: 221038 - DNA, 9111 bp, Artificial Sequence
  Description of Artificial Sequence: Synthetic coding sequence
atgcatctccatcaggtcctgacaggtgccgtaaacccaggggataactgctactctgttggatccgtgggcgatgtccctttcacagcctatggatccgggtgcgatatagtcattctcgcgaacgattttgagtgtgtacagattattcctggcgctaaacatgggaacatccaagtttcatgcgtggaatgtagcaaccagcagggacgcattgccgctagttatggcaatgccgtgtgcatcttcgagcccctgggcattaatagccataagcgcaattgccagctgaaatgtcagtggctgaagacaggacagttttttctcagttcagtgacctacaatttggcctgggacccgcaagataacaggttactgaccgccactgactcaatccagctttgggcacctcctggggatgacatccttgaggaggaagaggaaatcgataacaccgtcccacccgtgcttaatgactggaagtgtgtttggcaatgcaaaacctccgtgtctgtccatcttatggaatggagcccagacggggaatactttgcaacagccggtaaggatgattgcctacttaaggtgtggtaccccatgaccggctggaaaagtagcattatcccccaagaccaccacgaggtaaagaggcgacagtcctcgacccaattctccttcgtgtatctcgctcaccccagggcagtgactgggttttcatggaggaaaacctctaagtatatgcctagggggtctgtttgtaacgtattactgacaagctgccatgacggagtttgcaggctttgggccgagactctcttgcccgaagattgcctcttgggtgagcagatctgcgaaactactaccagttctattgcatcctccctcagccatgctgggaggcacaaagaccggatacagcacgcgctcgagacaattcaccacctgaagaacctgcggaagggtcaaaggaggagctcggtattggtaacgcacgccgagctcatgcccgaccagacggcaatgcatgaggtacagaggcacatatcacatcatgcaaacgcactctgccatttccacatcgctgccagtatcaatcctgccactgatataccgaatgttttggttggcaccgcatttaacgtggacgatgggaacgggggtttcgtggtgcactggttgaataacaaggagttccactttaccagctcgaccgaagtctttatgcatcagttaaggaagctctccgacaaacaggttgatcatgaaaatgacgacgcggatagggaagacgaggaacatagccaggaggacagagaaagggggctgcacatgaagctcgaccacgatctatctctggatcgtgaatcggaagccggtacaggctccagcgaacacgaagatggagagcgtgagggtagccctcgcacttactctcgtctgagcgtaccaatgccgctgcccaccgtcttgttggatcgaaaaattgagaccctgctgacagaatggaataaaaacccagatatgctcttcactatccaccctgtcgacggcacattcctggtgtggcacgtcaagtatctggacgaatacaaccctgggatttttcgccaagtacaggtgagtttctccagcagaatacctgtagcattcccatctggcgatgcctccagtcttagcaaaaacattatgatgtacgcatgcatcaatgcgaccaaagattcacaccatacacttctgcatcaggagggcatgagcgtgggaagcccacacggttcccagccccattcaaggtcccactcaacacacatgaatatccttgcaccaacggtgatgatgatatctaaacacatcgacggaagcctgaaccagtgggctgtcaccttcgctgacaagtcagcatttactacggtactcacagttagccacaagttcaggtactgcggtcataggttccatctcaatgatttggcctgccactcggtgctcccattgctgctgacaagcagccatcacaatgccctattaacgccagagctggattgccagtgggattcagataataagcttagccggctgatggaccctgttaagcacatcaaaggatcttccaaacagccgctacgcaacgctgcaacccgtacttttcatgaccctaacgcaatttatagtgaacttatcctgtggcgtgtggatcccataggacctctgagctacactggcggagtttccgaacttgcccgtatcaactctctgcatacgagtgccttctcgaacgttgcttggctgccaaccctgatcccaagctactgcctgggcacctactgcaattctgcatccgcctgttttgtggcaagcgacggaaagaatctccggctgtaccaggcagtggtggatgcacgcaagctgctggatgagttatcagatcccgaatccagcaaattgatcggagaggtgttcaatattgtgtcccagcagtctaccgctagacccggatgtattatcgaactcgatgccattactaaccagtgcgggtctaacactcagctgctgcacgtgtttcaggaggatttcattataggatacaagccccataaagaagacatggagaagaaggagaccgagatctttttccagccatctcagggttataggccgccacctttcagtgagaaattcttcttagttgtcatcgagaaagacagtaataacaatagcatactacatatgtggcacttgcatctaaagtctgtgcaggcatgcttagctaaggccagtgagggagcttcttccgaaagcctgttgtccgtccctggacagaagaacgttgactcaagtcccgaaacctccccttccgtttctccaatgccacactcatctagcatcgctaatctacaaaccgcatctaaactgattttgtcctccaggcttgtatattcccagcctcttgacctgcctgagtccgttgaagtaatacgggctactcccagtgcgggacatctgagtagtagtagtatatacccggtctgtttagcgccttatcttgtggtgacgacttgtagcgacaacaaggtaaggttctggaaatgttgcatggaagcgaatcctgaatgtaataagagtgacgagaaagagatctatcattggaagagatggccgctgatgaatgatgagggagaggacaatagcagcactgtaagcatcgtcgggagacctgtggcagtctcatgttcctacacgggtaggttagcagtggcatacaagcaaccaatccaccataatggcttcgtgtccaaagagttttcaatgcacgtgtgcatctttgagtgcgagtccacggggggaagcgagtgggttttggaacaaaccatccacctcgacgacctggtgaaggtgggatctgtgttagattcacgtgtgtcagtagactctaatctgtttgtttattccaaaagtgacgccttattgtcaaaagacagatatcttatccccaatattaagcacctcgtgcaccttgactgggtgagtaaggaagacggctctcacatcttgaccgtgggcgtcggcgcaaatatctttatgtatggccgtttgagtgggattgtgacagaacagacaaactctaaagacggtgtggccgtgattacactgcctttggggggatctatcaaacagggagtcaagtctcgctgggttctgctacgcagcatagacctcgtcagtagcgtggatggaactcccagcctgcctgtaagtctttcatgggtgcgggacggtatactcgtcgtggggatggactgtgagatgcatgtgtacgcacagtggaagcatgccgttaaattcggggatactgaggcggacagcagcaacgcagaagaagccgctatgcaggaccattcaacttttaagtcaaacatgctggccaggaagagtgtcgttgagggcacagccatctccgatgatgtgttttgtagccctacagttatccaggacgggggactctttgaggccgcacatgtgctgtctccaacgctgccacagtatcatcccacccaactcctggagctgatggatctgggcaaagttaggcgggcaaaggctattctgtctcacctcgtcaagtgtatagccggagaagtggccatagtgcgagaccctgatgccggtgagggcaccaagcgtcatctctcccggacaattagcgtttcagggtctactgccaaagaaaccgtgacagtggggaaggacggtacgcgcgactacaccgagattgattccatcccacccttgcctttatacgcgctgctggccgctgatcaggacacctcctatcggattagcgaagaatcaaccaagatcccccaatcatacgaagaccaaacagtctcacagccggaggaccagtacagtgaactctttcagatccaggatatccctacggatgacatcgaccttgaacccgagaaaagagaaaataagtcgaaggtaatcaacctcagtcagtacggcccagcatactttggccaagagcatgcaagagttctctcaagccatctgatgcatagctcattgcctggtctgacccggctggaacagatgttcctggtcgccctcgccgacactgtggctacaacaagtacagaactggacgagtcacgggacaaaagctgctccggccgagacacccttgacgagtgtgggttgcggtatcttctcgcgatgagactgcacacctgcctcctcacgtccctgcccccactgtatcgagtgcagctacttcatcagggtgtatccacctgccacttcgcgtgggcctttcacagtgaggcggaagaggaactgattaatatgatccccgcaatccagagaggagacccacagtggagcgaactccgggcaatgggaattggctggtgggtgaggaatatcaacactctgcggcgatgtatagagaaggttgcaaaagcaagtttccagagaaacaacgatgcgctggacgctgctcttttttatttgtccatgaaaaaaaaggctgtggtgtggggcctgttccggagtcagcacgatgaaaagatgacgaccttttttagccacaattttaacgaagaccgctggcggaaggccgcactgaagaacgcttttagtctcctgggcaagcagagatttgagcagagtgcggcattctttctgcttgcagggagcttgaaggacgccattgaagtgtgcctcgaaaagatggaggacattcaactagcaatggtcatagccaggctttacgaatcagagtttgaaacgtcctccacctatattagcatcctgaaccagaagattctgggttgccagaaggacggttcaggatttagctgtaagaggttgcacccagaccctttcctccgcagccttgcctactgggtgatgaaggattacacacgggctctggatacgctattagagcagacccctaaggaagatgacgagcatcaagtgatcatcaagtcatgtaatcccgttgcgttctcattttataattatctgaggacccatcctctattaattcgacgtaatctggctagccctgaagggaccctggcgaccttaggccttaagacggaaaagaatttcgtggacaagattaatctgatcgagaggaaactgttctttaccacagccaacgcccatttcaaggtgggttgtccagttttagcactggaggtcctgtccaagatacccaaggtgaccaaaacctcggccttatctgccaagaaggaccaaccggattttattagccatcggatggatgacgtgccttcccactccaaggccctgtccgatgggaatggatccagcggtattgagtggtcgaacgttacatcctctcagtatgattggtcgcaaccgatcgttaaagtggacgaggagccactcaacctggattggggtgaggatcatgacagcgcccttgacgaggaggaagatgacgccgtgggcttggttatgaaatcaaccgacgccagggagaaagacaagcagtccgatcagaaagcctccgatcctaacatgctcctgacgcctcaggaagaagacgatccagagggagatactgaggtggacgtgatagcagaacagttaaaatttcgcgcttgcttgaaaatattgatgacggaactaaggacactggccactggatacgaagtcgatggaggaaaactccgcttccagctgtacaactggctggagaaggagatcgcagccctgcatgagatctgcaatcatgagtctgtgatcaaagagtactccagcaaaacttactccaaggtggaatcagatttgttagatcaggaagagatggtggacaagcccgatattggttcctacgaacgtcatcagatcgaaagaagaaggctgcaagctaagcgggaacatgccgagcgtaggaagtcatggctgcagaagaatcaagatctgttgcgtgtttttctaagttactgttccctgcacggcgcacagggaggcggtctggcctccgttagaatggagctgaaatttctcctccaggaaagtcaacaagagacgacagtgaaacagctgcagagccccctccctctgccaactaccttgcccctcctgtcagcaagcatcgcttccacaaagacagtgatagccaaccctgtgctctacctcaataatcacattcacgacatcctgtacacgatagtgcagatgaaaacgccaccgcatccttctattgaggacgttaaggtgcacactctccactctctggcagccagtctgtccgcctctatctaccaggccctttgtgactctcattcatattctcagaccgagggaaatcagttcaccggcatggcctatcaggggctcctgctgtctgatcggagacggctgaggaccgaatctattgaggaacacgcaacacctaatagcagccctgcccaatggcccggtgtgagttccctaatcaatctgctgagctcagcacaagacgaagatcagccaaagctcaatatcctgctgtgcgaggcagtggtcgccgtgtatctgtcactgcttattcacgccttggcaacaaattcttcttcggaacttttcaggcttgcggctcacccactcaacaatagaatgtgggccgctgtcttcgggggtggcgtgaagctcgtcgttaaaccaaggagacaaagtgagaatatctctgcacctccggtgctttcagaggacattgacaagcaccggaggagattcaatatgcggatgctggttccaggtaggcccgtcaaagacgccactccaccaccagtacccgctgagaggccttcctacaaggagaaatttattccaccagagctcagtatgtgggactactttgtggctaaaccctttctgcccttgagtgactcaggcgtgatctatgatagcgacgagtcaatccactccgatgaggaggacgacgctttcttctctgatacccaaattcaggagcatcaggaccccaattcatatagctgggcacttctccacctgactatggtgaaactcgcgctccacaatgtaaagaattttttcccaatagccggactagagttctctgagctccctgttacctccccactgggtatcgccgtaatcaaaaatctagagaactgggaacagattctccaagagaaaatggatcagtttgagggccctccaccaaactacatcaacacatacccaactgatctgtcggtcggcgctggccctgcgatcctccgcaataaggctatgctggaacctgagaacaccccatttaagagtcgggattccagcgcttttccagtgaagcggctatggcatttcctcgtcaagcaagaagtgcttcaagagacattcattagatatatatttactaagaaacgcaagcagtcagaagtggaggctgatctcggctacccgggtgggaaggctaaggtcattcacaaggagtccgatatgattatggcgtttagtgttaataaagccaactgtaatgagatcgtcctcgccagcactcacgatgttcaagagctagacgtgacgagcttgctggcgtgccagagttacatttggattggcgaagagtacgatcgcgaaagtaagtcttccgacgacgtggattaccgaggaagtactacgacgctttatcaacctagtgccaccagttactcagcctcccaggtccatcctccttctagtcttccctggcttggcacagggcagactagcaccggagcgtcagttctgatgaaacgtaacctacataacgtgaaacggatgacttcacatcctgttcaccaatactatctgaccggagcacaggacgggtcagttcgcatgtttgaatggacccggcctcagcagctggtctgttttaggcaggcaggtaatgctcgagttacacgactatatttcaactctcagggaaataagtgcggcgtagctgatggtgagggctttctcagcatttggcaggtgaatcagacagcttcaaacccaaaaccttatatgagctggcaatgtcactcaaaagccacctccgatttcgccttcatcacaagttcttccttggtggctacttccgggcatagcaatgacaaccgcaacgtctgtctgtgggatacacttatctcaccaggaaattccctcattcacggtttcacttgccatgaccacggtgctacagttctgcagtacgccccaaaacagcagctcctcatctccggaggcagaaaggggcacgtctgtattttcgacattcgtcagcgtcagctcatccataccttccaggcacacgactctgcaatcaaggctctggccctggacccatacgaggaatatttcaccaccggttcagcggaggggaacatcaaagtgtggaggctgacaggacacgggcttatccactcattcaaaagcgaacatgcgaaacaatccatctttagaaacataggagcaggcgtcatgcagatcgatatcattcaggggaacaggttattcagttgtggcgcagacggtaccctgaaaacccgggtcctgcctaacgcctttaacattccaaatcgcatccttgacatcctgtac

SEQ ID NO: 221039 - DNA, 1809 bp, Artificial Sequence
  Description of Artificial Sequence: Synthetic coding sequence
atgtgggattacttcgtcgccaaaccgtttctacccctctccgattccggcgtgatctacgacagcgacgaatctattcactcggatgaggaagatgatgcattcttcagcgacacccagatccaggaacaccaggaccccaattcatattcctgggctctgctacacctgacgatggtgaagctggccctgcataatgtcaagaatttctttcccattgcagggcttgagtttagcgagcttcccgtaacctccccactcggcatagctgtcataaagaacctcgagaactgggaacaaatcctgcaggaaaaaatggaccagtttgaagggccaccacccaattacattaatacgtatcccaccgacctgtcagtcggggctggtccggctatcttaaggaataaggccatgctggagcccgaaaatactccctttaaatctcgtgactcttccgcctttcccgtgaaacgactttggcacttcctcgtgaagcaggaagtcctccaggaaacattcatccggtacatcttcactaaaaagagaaagcagtccgaatcgatcgaggagcatgtggagcaggtcaatcagaattgtatcgcagaggactgccatattaaagtggaggccgacctcggctaccccggaggaaaggccaaagtcatacacaaggagagtgatatgattatggctttctccgtgaacaaagctaactgcaatgagatcgtgctagcaagcacacacgacgtacaagaactggacgtgaccagcctgctggcgtgccaatcctatatctggatcggtgaagaatacgaccgggagtccaaatcaagtgacgacgtagattaccggggatccacaaccacactctatcagccctcggctacatcgtatagtgccagtcaggttcaccctccatccagcctgccctggctgggcactggtcagacttccactggtgcaagcgttttaatgaaacggaatctgcacaacgtgaaacggatgacctcacaccctgtgcatcagtactatctgacgggagcacaggatggctccgtccggatgtttgaatggacccgaccccaacagctcgtctgctttcggcaggcagggaacgcacgagttacaagactctactttaactcgcagggtaacaagtgtggcgtggccgacggggagggatttctgtccatttggcaggtcaatcagacagcaagcaacccaaaaccctacatgtcatggcaatgccattccaaggccaccagtgacttcgcatttattacctcctcatctctggtcgcaacctccggacatagcaacgataatcgcaatgtgtgcctgtgggataccctgatttcccctgggaattctctcatacacgggttcacatgtcatgatcacggcgcaaccgttcttcaatacgctccaaaacagcagcttttgataagcgggggtcgtaaggggcatgtctgcatcttcgacataagacagcgacagctgatccacacattccaggcccatgatagtgcaatcaaggccctcgctctggacccatacgaagagtacttcaccacaggctcagcggagggtaatatcaaagtctggcgactaaccggccatgggctgattcactcattcaaatccgagcacgccaagcagtccatcttcagaaatattggagcaggagtgatgcagatcgacatcatccagggaaacagactgttcagttgcggcgctgatggtacgttgaaaacccgggtgctgcctaacgcctttaatatcccgaaccggattctggacattctgtag

SEQ ID NO: 221040 - DNA, 7202 bp, Artificial Sequence
  Description of Artificial Sequence: Synthetic coding sequence
atgcatttgcaccaggtgctcaccggagcagtgaaccccggtgacaactgttacagtgtgggatctgtgggggatgtgcccttcactgcatacgggtcagggtgtgatattgttatcttagcaaacgacttcgaatgcgtacaaatcattcccggagctaagcacggaaatatccaggtgagttgcgtggaatgcagtaaccagcaaggtcgaattgccgcttcctacggcaacgccgtctgcatttttgagcccctgggcataaattcgcataagcggaattgccagctgaaatgtcaatggctaaagactgggcagttcttcttgtctagcgtgacatacaatctcgcctgggacccacaggataacaggctgctaaccgcgaccgactcaattcagctctgggcccctcccggagacgacatcctggaggaggaggaggagatagataataccgtccctcccgtgctgaacgattggaaatgcgtttggcagtgcaagaccagcgtgtctgtccatttgatggaatggagccccgatggcgagtactttgctacagcagggaaggatgattgtttattgaaggtgtggtaccccatgacaggttggaagtcctcaattatcccccaggatcatcacgaggtgaaaagacggcagtcctcaacgcagtttagctttgtgtacctggctcaccctcgagcagtgaccggcttctcctggagaaagacatcgaagtacatgcctagaggttctgtttgcaatgtgctgcttacgagctgtcatgatggagtctgccgcctttgggccgaaaccctgctccctgaggactgtctgttgggagagcagatttgcgaaacaaccacctcatctatcgccagtagtctgagtcacgccggtcggcacaaggaccggatacagcacgccttggaaaccatccaccacctgaagaatctccgcaagggacagagaaggtctagcgtgctcgtgacgcacgctgaactgatgcctgatcagaccgccatgcatgaagtccaacgacatataagccatcatgctaatgctctgtgccacttccacattgcagcatcaattaaccccgcaacggatattcccaacgttctggtagggaccgcatttaatgtcgacgatggcaacggaggctttgtggtgcactggttgaacaacaaggaattccatttcacctcatctacagaagtatttatgcaccagcttcgaaagctttccgataaacaggttgatcatgagaatgatgacgcggacagagaggatgaggagcatagccaagaagacagggagcgcggactccacatgaaactcgatcacgaccttagcctggacagggagagtgaggctggaacgggcagttcagagcatgaagatggagaacgtgaagggtccccacgtacttactctcgcctctccgtacctatgcctctcccaaccgtgcttctagatcgaaagatcgagaccctgctcaccgagtggaacaaaaatccggacatgctgtttacaatccatcctgttgacggcacttttcttgtttggcatgtcaaatatctggatgaatataatcctggaatttttagacaggttcaggtgtctttttccagtaggatcccagtggcatttccgagtggtgacgcatctagcctgtcaaaaaacatcatgatgtatgcctgcatcaacgctaccaaggactctcaccatactttactccaccaggagggcatgtctgtcggtagccctcatggaagtcagccccacagcagatcccactctactcacatgaacattttggcgcctaccgttatgatgatatccaagcacatcgatggcagcttgaatcaatgggccgtaaccttcgctgacaagtctgccttcacaaccgtgttgactgtgtcacacaagtttcggtactgcggccaccggttccacctcaatgatttggcttgtcacagcgttctgccacttttgcttacctcttcgcaccataacgcgttgttgacaccagagctggactgtcaatgggacagtgacaacaaactttctcgcctaatggacccagtgaaacacataaaaggctccagtaagcagcctctgcgaaatgctgccactcgaacattccatgatcccaatgcgatatactcggagctgattctatggcgggtggacccgatcggccctttatcatatactggaggagtgtcagaactcgcgagaatcaattctctacacactagcgctttctcaaatgtggcgtggctcccaactttaatcccaagctactgtctgggaacatattgtaactccgcctctgcttgcttcgtcgcttccgacggcaagaacctgcggctgtatcaggcagttgtggatgctcgaaaattgcttgacgaactgtctgaccccgagagctcaaagctaatcggggaggtgtttaacatcgtgtctcagcagtctacagccaggccaggctgtatcatcgaactcgacgctatcaccaatcaatgtgggtcaaatacccagctgctccatgtgttccaagaagacttcataatcggctacaagccccacaaggaggacatggaaaaaaaagagaccgagattttctttcaaccctcgcagggatacagaccccctcctttttctgagaagttttttctggttgtgattgagaaggatagtaacaacaattcgattctgcacatgtggcatctgcatctgaagtctgtccaggcttgtctggggagagacaccctcgatgaatgcggactcaggtacctcttagcaatgaggctgcacacatgtctcttaacatccttgccgcctctgtatagggtgcagctgttgcatcaaggcgtgtcaacttgccatttcgcttgggcgttccattcggaggctgaggaagaactcatcaacatgatacctgctattcaacggggagacccccagtggtccgagttgcgggcaatgggaattgggtggtgggtacgtaacattaacactcttagacgctgtattgagaaagtcgccaaggcctccttccaacggaataacgacgccctagatgctgcgctgttttatctaagcatgaaaaaaaaggccgtggtgtggggtttgttccggtcgcaacacgatgagaagatgacgacattcttttcccacaacttcaatgaggatagatggagaaaagcagccctcaagaatgcattctctctgctgggaaaacagcgttttgaacaaagcgccgctttttttctccttgctggctccctgaaggacgctatcgaggtgtgcctggagaaaatggaggacattcagctagcaatggtgattgcgagactgtacgaaagcgagtttgagactagctccacgtacattagcattctcaaccaaaagattctgggatgccagaaggacggatccgggttttcctgcaaacgccttcaccctgatccctttctgagaagcctggcctactgggtgatgaaggactatactcgggctctggatacactcctggaacagacccccaaagaggacgacgagcaccaggtgataatcaaatcctgcaaccctgtcgccttctcattctataactatttgcgcacacaccctctgttgattcgaagaaatctggcgtcgcctgagggcaccttggcgactctcggtttgaagaccgagaaaaattttgttgacaaaatcaacctcatcgagagaaaattgttctttacaaccgctaacgctcacttcaaagtggggtgtcccgtgctggccctggaggtgctttctaaaatcccaaaggtcactaagacctctgctctgagtgccaaaaaggaccaacctgactttatttcccaccgtatggacgatgtcccgagccactcaaaagctctgtctgatggcaatggatcatcaggcattgaatggagcaacgtcactagctctcaatacgactggtcccagcccattgttaaggttgatgaggagccattgaacttggactggggcgaggatcacgattctgcattggacgaggaggaagacgacgccgtggggctagtaatgaagagcacggatgcgagggagaaggataaacaatccgaccagaaggcatctgatcccaacatgctgctgaccccacaggaggaggatgacccagagggggacacggaggtcgatgtgatagctgagcagctcaagttccgggcatgtctgaagatcctgatgaccgagctgagaacgctcgctacaggctacgaggttgacgggggtaagctccgctttcagttatacaactggctggagaaagagatcgccgcacttcacgagatctgtaaccatgagagtgtaattaaggaatattccagtaaaacttactctaaggtagaatctgacttgctggatcaggaagaaatggttgataaacctgatattggcagctatgaaagacatcagatcgaacgccgtcgactacaagcaaaacgagagcatgctgaaaggcgaaaaagttggctgcagaagaaccaggatctgcttcgcgtgttcttgtcttattgtagccttcatggggctcaaggtggcggtttagcttcggtcagaatggaactcaaattcttgctgcaggaaagccaacaagagaccacggtgaagcagcttcaatctcctcttcccctcccaaccacacttcctcttctgtctgcttcaattgcttcaacaaagacagtgattgcaaatccagtgctatacctgaataatcacatccacgacatcctctacacaattgttcaaatgaagacaccaccacacccatcaatagaggatgtcaaagtgcatacactccactcacttgccgcaagcctgagtgcatctatttaccaggctctctgtgatagtcactcctactcccaaacagagggaaaccagttcaccggcatggcttaccagggccttcttctgagcgatcggaggcgcctacgcacagaaagcatcgaggaacacgccactcctaattcaagccccgctcaatggcctggagtgtcttcattaatcaacttgctttcgagtgcgcaagatgaggatcagcccaagcttaacatcctgctgtgtgaggctgttgtggctgtgtatctgagtcttctaatccatgcccttgctacgaactcctcctctgaattatttagacttgccgcacatccactgaacaaccgtatgtgggccgctgtgtttggcggtggcgtgaaattagtggtgaagccacggcgtcagagtgaaaacatctcagccccaccggttctatccgaagatatcgacaaacaccgacggcgattcaatatgagaatgttggtcccgggacgcccagtaaaggatgctaccccccctcctgttccagccgaacgtccatcctataaggagaagtttatacctcctgagttgagcatgtgggattattttgtggccaaacccttcttgcccttgtcggactctggcgtgatatatgattctgacgaaagcatccacagcgatgaggaggacgacgcctttttctcagacacccaaatccaggagcaccaagatcccaattcgtacagttgggctcttctgcacttgactatggtcaagttggcccttcacaacgtaaagaacttcttcccaattgcaggcctggagttctctgaactacctgttacgagcccactggggatagcggtcataaagaacctcgaaaactgggagcagatcctgcaagagaagatggatcagtttgaaggccctccaccaaattacattaatacctatcctactgatctatccgtgggcgctggccctgccattctgaggaacaaagctatgctggagcctgagaatacaccatttaagtccagggactcttccgcctttcctgtgaaaagactgtggcactttctcgtgaaacaagaggtgttgcaggagaccttcatccgctatatctttactaaaaaacgcaagcagtccgaggtcgaggctgatctgggctacccaggtgggaaagccaaggtgattcacaaggagagtgacatgatcatggcattttccgttaataaagctaactgtaacgaaattgttctcgcctccacacacgacgtacaggagctagacgtgacctctctgcttgcatgtcaatcctacatttggatcggagaggagtacgatcgcgaatctaagtctagcgatgatgtcgactatcggggttccaccacaaccctctatcagccctcagcaacaagctacagtgcatctcaggttcacccaccgagctcccttccttggctcggtacgggacagacttctactggggcatccgtgctgatgaaaagaaatctccataatgtcaaaaggatgacttctcaccccgttcatcagtactatctgactggtgctcaagacggctcagtgcgaatgttcgagtggactcgtccccaacagctggtttgttttcgccaggcaggaaacgccagagtgacccgcctgtactttaatagtcagggaaacaaatgtggggtggcagatggcgaaggctttttatccatctggcaggttaaccagaccgctagtaaccctaagccatacatgtcatggcagtgtcatagcaaggcaaccagcgatttcgcctttatcacttccagctccctggtggctacatccgggcacagtaacgataaccgaaatgtgtgtttgtgggacacccttatttcccccggaaattctttaatacacggctttacctgtcacgaccatggggctacggtcctgcagtacgccccaaagcagcagctactgatctccgggggacgaaaagggcacgtttgtatattcgatatccgtcaacggcagttaatccacactttccaggctcatgattctgccattaaggccctagcgttggacccttacgaggaatacttcaccaccggttccgcagaggggaatattaaggtgtggcgcctaaccggccacggtctaattcatagtttcaagtctgagcatgcgaaacaatctatttttaggaatattggtgccggagtgatgcagatcgatattatccaaggcaatcgcctgttctcatgtggtgcagatggcaccctgaagacccgcgttctgcctaatgcattcaacatacccaacaggattctcgacatcctgta

SEQ ID NO: 221041 - DNA, 9113 bp, Artificial Sequence
  Description of Artificial Sequence: Synthetic coding sequence
atgcacctgcaccaagttcttaccggcgctgtcaacccaggggataattgttatagcgttggttccgtgggggacgtgcccttcacggcctacggcagcgggtgtgacatagtgatactggccaacgattttgagtgcgtgcagataatccccggtgcaaaacacggaaatatccaggtctcctgcgtggagtgtagcaatcagcaggggaggattgctgcttcctatggcaatgctgtgtgtattttcgagccactaggcatcaacagtcacaagcgtaattgccagcttaagtgtcagtggctcaaaaccggccagttctttttgtcgagcgtaacctataacctggcctgggatccacaggacaacagactcctgactgccaccgacagcatccaactctgggccccacccggagacgatatcctggaagaggaagaggagatcgacaataccgtgcccccagttctaaatgattggaagtgtgtgtggcagtgcaaaacctcagtgtctgtacatctgatggaatggtctcctgatggcgaatatttcgccacagccggaaaggacgattgcctgcttaaggtgtggtacccaatgacagggtggaaaagctctataattccccaggaccatcatgaggtgaagcgcagacagagttccacgcagttttctttcgtttacctggctcaccctagagcagttaccgggttttcatggagaaaaacgtccaagtatatgccgcgtggatctgtctgtaacgtgctgctgacgtcttgtcacgacggagtttgcagactgtgggccgagaccctgctaccagaggattgtctcctcggcgaacagatatgcgaaacgaccacatcatctatcgcctcctctttgtctcatgcgggaaggcacaaggaccgcattcaacacgctttagagacaattcaccatctgaagaatcttcgcaaggggcagcgcagatcctctgtgctggtgactcacgctgaactgatgcctgatcagactgccatgcatgaggtgcagagacacatatctcaccacgccaatgctctttgccactttcatattgccgcatcaattaaccctgccacagatattccgaatgtgttggtcggtacagctttcaacgtcgatgacggcaacggaggcttcgtcgtacattggctgaataataaagaatttcacttcacctcctctaccgaggttttcatgcaccagctgagaaagctatctgacaaacaggtggaccatgaaaatgatgacgcagaccgcgaggatgaagagcattctcaggaagacagagagcgcggactccatatgaagctggaccatgacttgagcctggaccgggagtcagaagcaggcaccggctcctcagaacatgaggatggcgagcgtgagggctcaccgagaacctactcccgcctgagtgtgcctatgcctctccctaccgtactgctcgacaggaaaatagagaccctgcttacagagtggaacaagaatcctgacatgttgttcacaattcacccggtggatggcacttttctagtgtggcacgtaaagtatcttgatgaatacaaccctggaattttcaggcaagttcaagtgtccttctcctcacgaatacctgtcgcattccctagtggtgatgcgtctagcctctcgaaaaacatcatgatgtacgcatgtattaatgcgacgaaggactctcatcacactttgctccatcaggagggcatgagcgtcggtagcccccacgggtcccaacctcattcaaggtcccactcgactcatatgaatattttagcccctactgttatgatgatttctaagcatatagatggatccttgaatcagtgggctgttacctttgctgacaagtctgcttttacaacagtgttgacagtttcccacaagtttcgttactgcggccacaggttccacttgaacgatcttgcttgtcactccgtgctgccactgctcctgacctccagccaccacaacgccttgttgacccccgagttggactgccaatgggacagtgacaataagctctctcggctgatggacccagtcaagcacattaagggtagttccaaacagcccctgagaaatgcagcgaccaggacattccatgaccccaatgccatttactctgaactgattttgtggagggtagatccgatcggcccactgagctacaccggaggagtctccgagctcgctagaattaactcactgcacaccagtgccttcagcaacgtggcttggcttcctacactgatacctagctactgcctgggaacctattgcaactcagctagtgcatgtttcgtggccagcgacggcaagaacctgcgcctttatcaggcagtggtcgacgccagaaagctcctggacgagctcagtgacccggagtcatctaaattaattggggaggtgtttaacatcgttagccagcagtccacagcgagacccggatgcatcatcgagctggacgctatcacaaatcagtgcgggtccaacactcagttgctccacgtattccaagaggactttataattggctataaaccccataaagaggacatggagaaaaaagagaccgagatctttttccagccctcgcagggctaccgaccaccgcctttctccgaaaagttcttcttggtcgtcatcgagaaggactctaacaacaacagcatactgcacatgtggcaccttcatttaaaatctgtccaggcctgtctggctaaggctagcgaaggcgcttcatcagagagcctgctgtccgtcccgggacagaagaatgtagactcatctccggagacaagcccatctgtgagccctatgccacactcaagtagtatcgcaaatttgcagactgccagcaagttgattttatcctcccggctggtgtactctcaacctctcgacctacctgagagcgttgaggttatcagagcaaccccttccgctggccatttgtcgtcaagtagcatctaccctgtgtgcctcgctccataccttgtggtgacaacttgctcggacaacaaagtgcgattttggaagtgttgcatggaggccaatcctgaatgcaataagtctgacgaaaaagaaatctatcactggaaacgctggcctctcatgaacgacgaaggtgaggacaactcttccaccgtgtcaattgttggtcgcccagttgctgtgtcctgttcatacactggccgtttagctgtggcttacaagcagcctattcaccacaatggttttgtttccaaagagttttccatgcatgtttgcatttttgagtgtgagtccaccggcggtagtgagtgggttttggagcagaccatccacctagacgatcttgtgaaggtcggctctgtgctcgatagcagagtttctgtggactcaaatcttttcgtttatagcaaaagcgacgcactgctgtccaaagatcgctatctgattccgaacataaaacatcttgtgcaccttgattgggtgagcaaggaggatggatctcacatccttactgtgggcgtgggagccaatatcttcatgtatggcaggctctccgggatagtgaccgaacagacaaacagcaaagacggagtcgccgtgattactctgcctctggggggaagtattaagcaaggcgtgaaaagccgctgggtcctgctgcgtagtattgatctagtcagttctgtggacggcacacctagtctgcccgtttcgctctcttgggtccgcgatggtattttggtggtggggatggattgcgagatgcatgtgtacgctcagtggaagcatgccgtcaagttcggagacaccgaagccgatagcagcaacgctgaggaagccgctatgcaagaccactcgaccttcaaaagtaacatgctggcaaggaaaagcgtcgtggaaggtaccgccatctctgatgatgtcttttgcagtcctaccgtcatccaggacggcggactgttcgaggcagcccacgtgctgagcccaacgctgccccaataccaccctacccagctgcttgagctgatggatctgggtaaagtaaggcgagctaaggcaatccttagccatctagtgaagtgcatcgcgggtgaagtggcgattgtgagggaccctgacgcgggagaggggaccaaacgccaccttagcaggaccattagcgtatcaggctccacagcgaaggagaccgtgactgtgggtaaagatggtacgcgcgactacacagaaattgactccatccctccccttccactgtacgcgctgttagccgcagaccaggacacctcataccgcatcagcgaggagtccacaaaaatcccacagagttacgaggatcagaccgtttcgcagcctgaggaccagtactcggagctcttccaaattcaggacatccccaccgatgatattgatctcgaaccagagaagcgggagaacaagtcgaaagtgatcaacctgtcgcaatatggaccggcatatttcggacaggagcatgctagggtgcttagttcccatctcatgcattcctccttgccaggcctcacacgtctcgagcagatgtttctcgtggccctggctgacaccgtagcaactacatccaccgaactggacgagtctagggacaaaagttgcagcggaagggatactcttgacgaatgcgggttgagataccttttagcaatgcggctccacacctgcttgctgacctccctccccccactctacagggttcagctgcttcaccaaggggttagcacatgtcactttgcttgggcatttcactccgaggcggaggaagagctgatcaatatgattccggctatccagcggggagatccccagtggtcagagttacgggcaatgggcataggctggtgggtgagaaatatcaatacacttagacggtgcattgaaaaagtcgccaaggctagttttcaacggaacaatgacgccctcgacgctgccttgttctatctaagtatgaaaaaaaaagccgtcgtatggggactcttccgatcccagcatgatgaaaagatgacaaccttcttttctcacaactttaacgaggacaggtggcgcaaggctgccctgaagaatgccttctcgcttctggggaaacagcgcttcgaacagtccgccgcattttttctcctggcgggttcactcaaggacgccatcgaggtgtgcctcgaaaaaatggaggatatccaactggcaatggtgatcgcccgactgtatgaaagtgagtttgagacaagttcaacctatatctcaatactgaatcaaaaaatcttaggatgtcaaaaggatggcagcgggttcagctgtaagagactccatccagatcccttcctgcggtccctggcatattgggtcatgaaggactacactcgtgctctggataccttgctggaacagacaccaaaggaagacgacgaacaccaggtgatcattaaatcgtgcaacccagtggcctttagcttctataattacctccgtactcaccctctgctaatccgcagaaatctggccagcccagaagggacattagccaccctcggcctcaaaacagagaaaaattttgttgacaagataaatctgattgagcgtaagctgttcttcaccacagccaatgcacacttcaaagttgggtgtcctgtcctggcactagaggtccttagtaagatccctaaggtcacgaagacctccgctctgagcgcaaagaaggaccaacccgacttcattagccacagaatggacgatgtgccctcgcacagcaaggcactcagcgatggcaacgggagttctggaattgagtggtccaatgtcacttcatcccagtatgattggagccagccaatcgtgaaagtggacgaggagcctctgaacctggattggggcgaagaccacgattccgctttagacgaagaagaggatgatgcggtcgggctggtcatgaagagtacggatgctcgtgagaaggacaagcagagtgatcagaaggccagcgatcccaacatgcttctgacaccccaggaagaagacgatcctgagggcgatactgaggtagacgtgatcgctgaacaattaaaatttcgggcttgcctgaaaatacttatgacagagctgcgaaccctggccaccgggtacgaagtggatggcggaaaactgagattccaactctacaattggctggagaaagaaatcgctgccctccatgagatttgcaatcacgagtcagtaatcaaggaatactccagtaaaacctattccaaggtcgagtctgacctacttgatcaagaagaaatggtagataaacctgatattgggagttatgagaggcatcagatcgagagacggaggctgcaagctaaaagagaacatgccgaaaggagaaagtcttggctccagaaaaatcaggacttgctgagggtatttctgagttactgctctctgcacggggcacagggcggtggacttgcgagcgtgagaatggagctgaagtttctgctgcaagaaagccagcaggagacaaccgtgaagcaactgcagtcccccttacctcttccaacgacccttccattgttgtctgcaagcatcgctagtacaaagaccgtcatcgccaatcctgtgctgtacctaaataaccacattcacgatatcttgtataccatcgtgcagatgaagacgcccccacacccatcgatcgaggacgtgaaagtgcacacactacacagcctggctgccagtctatcagcatctatttatcaggccctgtgtgattctcactcatactctagccagacagaggggaaccagttcactgggatggcatatcagggccttctgctttcggaccggcgtcggttaaggaccgagtcaatcgaggagcacgctacacccaacagcagtccggctcagtggcccggagttagctccctgattaacctactgagctccgctcaggatgaagaccagccaaagctgaacatccttctgtgtgaagccgtcgtggcagtctacttgtccctgttaatccatgccctcgccacaaatagttcttctgagctctttaggttggctgcacacccactgaataacaggatgtgggcagcagtcttcgggggtggcgtgaaactggtggtgaagcccaggcggcagtctgagaacatcagtgcccctccggtgctctctgaagacattgataaacatcgcagacgcttcaacatgcggatgctggtgcccggtcgacctgtcaaagacgcgacgcctcctccagtgcccgctgagaggccctcgtacaaggagaagttcataccgccagagctgtcaatgtgggactacttcgtagctaagcctttcctacccctttctgactcaggcgtcatatacgactccgatgagtctatccactcagacgaggaagatgacgcttttttctctgatactcagattcaggagcaccaggaccccaacagctattcctgggctctgttgcacttaaccatggtcaaattggccttgcacaacgtgaagaatttcttccctatagctgggctcgagttcagcgaactgccggtaaccagccctctggggatcgccgtgatcaagaatctagagaattgggagcagatccttcaagaaaagatggatcagtttgaggggcctcctcctaattacattaacacttaccctacagatctctcggtcggggcaggacccgctattctccggaacaaggcaatgcttgaacccgagaatactccattcaaaagccgggattcttctgctttccctgtcaagagactgtggcatttcctggtcaaacaggaagtgctgcaagagacattcatcaggtatatttttaccaagaaaaggaagcaaagcgaagtggaggcagatttggggtatcccggtgggaaagctaaggtaatccataaggaaagcgacatgattatggcttttagcgtcaacaaagccaattgtaatgaaattgtgctggcaagcacacatgatgtgcaggaactggatgtcactagcctgctagcctgtcagagctacatttggatcggcgaggaatacgatcgggaaagtaaaagttcagacgacgtggattaccgagggagtacaactacgctgtatcaaccaagcgcaacatcttactccgcctcacaggtgcatccgcctagctctttaccttggttgggaaccggccaaacttcgaccggcgcaagtgtgctgatgaagcgtaacctgcacaatgtcaaacgcatgacctcccatcccgttcaccagtactacctcaccggcgcacaggatggtagtgtgcgaatgttcgagtggacgagaccacaacagcttgtgtgctttaggcaggccggtaatgctcgggttacgcgcctgtattttaactcccaagggaacaagtgcggagtggcggatggcgaggggttcctcagtatttggcaggtgaaccagaccgcctcgaaccccaaaccatacatgagctggcagtgccacagcaaagcaacatccgattttgcattcatcacgtcaagcagtctggtcgccaccagtggacatagtaacgataaccggaatgtttgcctctgggacactctgatctcgccgggaaattccctaatccacggattcacttgtcacgaccacggagccaccgtcctgcagtatgcccctaaacagcagctgctgataagcggtgggcgtaagggacatgtgtgcatcttcgatattcgtcaacgtcagctgattcacacattccaggcacacgactcagcgattaaagcactggccttggatccttatgaagaatactttacaacagggagcgctgaaggtaacatcaaggtatggaggttgactgggcacgggctgattcattccttcaaatctgagcatgcgaagcagagtattttccggaacatcggggcaggagttatgcagatcgatatcattcaggggaaccggttgttctcctgtggagccgatggcacactgaaaacacgcgttttgcccaacgccttcaatatacctaataggatcctggacatcctgta

SEQ ID NO: 221042 - DNA, 4851 bp, Artificial Sequence
  Description of Artificial Sequence: Synthetic coding sequence
atgccagcacgaacagcaccagcaagggtgccaacactcgcggttcctgcaatttcactgccagatgacgtgcgcagacgtctgaaagatcttgaacgcgacagtctcactgagaaagaatgcgtgaaggaaaaactgaacctactgcatgagtttctccaaactgagattaaaaaccagctgtgcgatctagagacgaaacttcgaaaggaggagctcagtgaggaaggatatttggcaaaggttaagtccttgctgaacaaggacctgagcctcgaaaacggagcacacgcatataaccgtgaggtcaatggacggttggagaacggaaaccaggctcgtagcgaagctcgcagggtgggaatggccgatgccaactctcccccaaagcccttgtcaaagcccagaaccccgagaaggtccaaatctgacggggaagccaagcctgagccaagccccagtccaagaatcacacggaagagcaccaggcagactacaatcacctcccacttcgctaagggaccggctaagcgtaagccccaggaagagagcgagcgggcaaaatccgatgaaagtatcaaggaggaggataaggatcaggacgaaaagcgcaggagggtgacgtcccgggagcgggtcgcaagacctctgcccgctgaggagcctgaacgcgcaaaatccggcacaaggacagagaaagaagaggagagggacgaaaaggaagagaaacgactcagatcccagaccaaagagcctacgccaaaacagaagctcaaggaggaacccgacagggaggcaagggccggagtgcaggctgacgaagacgaggacggggatgagaaggatgaaaaaaagcaccgcagccagcctaaggatctggcagccaaacgaaggcctgaggagaaagagcccgagaaggtgaatccccaaataagcgatgaaaaggatgaagacgaaaaagaagaaaaaagacgcaaaaccacaccaaaggagcctaccgagaagaagatggctcgggcaaagaccgtcatgaatagtaagacccatcctcccaagtgcatacaatgcgggcaatatctcgatgatcccgacctgaagtacggacagcacccccctgacgccgtggatgagccacagatgctgaccaatgagaaactgtctatatttgacgcaaatgagtccggtttcgagtcctatgaagcccttccgcagcacaaactgacttgcttctctgtgtactgtaaacacggtcatctgtgccctattgatactgggctgatcgagaaaaatatcgaattgttcttttccggtagcgccaaacctatttatgacgatgacccttctttggaaggcggagtcaatggcaagaacctcgggcctatcaatgaatggtggatcacaggctttgatggtggcgagaaagctttgataggtttctctacctcctttgccgaatacatcctgatggacccaagcccggaatatgctccgatcttcggattgatgcaggagaagatctacataagcaagatagtggtggagtttttgcaaagcaattctgatagtacctatgaagatctgatcaacaaaatcgagactactgtccccccatctggtctgaacctcaaccggttcaccgaggattccttgctgaggcacgctcagttcgtggtcgagcaagtggagagctatgacgaggcgggtgatagcgacgagcagcctatttttctgactccttgcatgcgagacctgattaaactggcaggtgtaactttgggccaacggcgtgcccaggcccgacgtcagaccattcggcatagtacaagggaaaaagatcggggtcctacgaaagctacgactaccaagttggtgtatcagatcttcgacaccttttttgccgagcaaattgagaaagatgatcgggaagataaggagaatgccttcaaacgccgtaggtgtggagtgtgcgaggtctgccagcaacctgagtgtggtaagtgcaaggcctgcaaagacatggtgaagttcgggggaagtgggcgatctaaacaggcctgccaagagaggcgctgtcctaacatggcaatgaaggaagcggacgatgatgaagaggtggacgacaacatcccagagatgccaagccccaagaagatgcaccaaggcaaaaaaaagaaacagaataaaaaccgcatttcatgggtcggagaggcggtgaaaacagacgggaagaagtcatactacaagaaggtgtgcatcgatgccgagaccctggaggtaggagactgcgtgtcagtgattccggatgacagtagcaaaccgctgtatctggccagggtcacggcactgtgggaggacagcagtaacgggcagatgttccacgcccattggttttgtgcgggtacagacaccgttctcggcgcaacatccgatcccctggaactgttcctagtggatgagtgcgaagatatgcaactcagttatattcacagtaaggtgaaagttatttataaagcaccttcagagaactgggccatggaaggaggaatggaccccgaatccctgctggaaggggacgacgggaaaacgtacttctaccagctctggtatgatcaggactacgccagattcgaatcccccccaaaaacccagccaacagaagataataagtttaagttctgtgtgtcatgcgcccgactcgcggagatgcggcaaaaagagataccaagagtcctcgagcagctggaagacttggatagcagggtgctatattactctgccacgaaaaatgggatactgtaccgtgttggggatggcgtgtatctccccccagaggccttcacttttaatatcaagctatcctcccccgtaaagcggccaagaaaggaacctgtagacgaggacttatatcccgaacactacagaaaatactccgattacatcaagggatcaaacctggatgctccagagccatatcgcattggacgaattaaggagatattctgcccaaaaaaaagcaacggaagacctaacgaaacagacatcaagattcgggtcaacaagttctatagacccgaaaacacccataagagcacccctgcttcttaccacgctgacattaacttactgtactggtcagacgaggaggcagtggtcgatttcaaagcggtgcaggggaggtgcaccgtggagtacggggaagatctgcctgagtgtgtccaggtgtacagtatgggtggcccaaaccgcttttattttctcgaggcttataatgctaaaagtaagagcttcgaggaccccccaaatcacgccagatcgccgggaaacaagggtaagggcaagggaaaaggcaaagggaagccgaaaagtcaagcctgtgagcccagcgaaccagagatcgagatcaaactgccaaaattaaggacactggatgtcttcagcggctgtgggggactgtctgagggatttcaccaggcaggcatttctgacaccctatgggcaatcgaaatgtgggaccctgccgctcaggcatttcgactcaacaacccaggctccactgtttttactgaggattgtaacatcttgctgaagttggtgatggccggagaaaccacgaactcacggggtcaacggctcccacagaagggggatgtcgagatgctgtgcgggggacccccatgtcaaggattttcgggaatgaaccggttcaacagcagaacctacagcaagtttaaaaatagtcttgtggtgtcatttctctcctactgcgattactataggccacgattcttcttgttagaaaatgtgaggaattttgtatcttttaagaggtctatggtcttgaagctgaccctgcgctgcctagtgcgtatggggtaccaatgtacctttggcgtgctgcaggctgggcagtatggcgtagcacagacgcgcaggagggcgatcatattggcagcggctcccggagagaaactgcctttgttcccagagcccttgcacgtgttcgcgccaagggcgtgtcagctctcagtcgtagtggacgataaaaaatttgtgtcaaacatcactagactgtcttctggacctttcagaacgatcaccgttagagacaccatgagtgatttgccggaagtgagaaacggggcaagcgcattagaaatttcgtataatggggagcctcaatcctggtttcagcgtcagctgagaggcgcacagtaccagcccattctccgagatcatatctgtaaggatatgagcgctctggtggccgcaagaatgcgacacataccactcgcacccggtagtgattggagggaccttcctaacatcgaggtgcgcttaagtgatggaacaatggctcgcaagttaaggtacacgcaccacgataggaagaacggtcgaagtagctctggagctttgcgaggagtgtgctcatgcgtcgaggccggaaaggcctgcgatcctgcagcccgacagtttaatacgctgatcccttggtgtctgccccacaccggcaataggcataaccactgggccggattgtacgggaggctcgagtgggacggttttttttcgactacggtcacaaatcctgagcccatgggaaagcaagggcgtgtgctccaccctgagcaacatagagtggtgagtgttcgcgagtgcgcacgatcacagggctttcctgatacctacaggctcttcggcaacatcttggataagcacaggcaggtagggaacgcggttcctccaccactggccaaggctattggcctggaaatcaagctatgcatgctggctaaagccagggagtctgcatccgcaaagatcaaagaagaggaagcagccaaggattag

SEQ ID NO: 221043 - DNA, 4899 bp, Artificial Sequence
  Description of Artificial Sequence: Synthetic coding sequence
atgcctgcaagaaccgcgcctgccagagtccccacgctggccgttcctgctatctccttacctgacgatgtgaggcggagactgaaagatttggaaagagattccctaacagagaaggagtgcgtgaaagagaagctgaatctgctgcacgaatttctgcagaccgagatcaaaaatcaattatgcgatctcgaaaccaaactgagaaaggaagaactctctgaggagggttatctggccaaggtcaagagtttactgaataaagaccttagccttgaaaatggagcacacgcctataacagagaagtcaacggtcgcctggagaacgggaatcaggcccgtagcgaggctaggcgtgtcggaatggctgatgcgaactcgccacccaaaccactttctaaaccccgaacccccagacggtcaaaatcggacggagaggcaaagcgttctagggatccgccagctagtgcttcccaggtgaccggaatcagagccgagcccagtccaagcccacgcattacccgaaagtctaccagacaaacaactatcacttcccactttgccaagggcccagctaaacggaaaccacaggaggagagcgaaagagctaagtctgatgaatcgatcaaggaagaggataaagaccaggatgagaagcgacgcagagtgacatcacgcgaacgcgtggctaggcctctccccgctgaagaacctgagcgagcaaagtccgggaccagaacagaaaaggaagaagaacgggacgagaaggaggagaagagactgcgatctcagacgaaagaacccactccaaaacagaagctgaaggaggaacctgatcgagaggcaagggccggagtgcaggccgatgaagacgaagatggcgatgagaaggatgaaaaaaaacatcggagtcagcctaaggacctggccgctaagcgcaggccggaagagaaggaaccagaaaaggtaaacccccagatctccgatgaaaaggacgaagatgaaaaggaggaaaagcggaggaaaaccactcctaaggagcccaccgagaaaaaaatggctcgtgctaaaacagtcatgaattccaaaactcacccaccgaagtgtattcaatgcggtcagtatctggacgaccccgacctcaagtacggacagcatccaccagacgctgtggacgaaccacagatgctgaccaatgagaaactttccatcttcgacgcaaacgagagcggctttgagtcatatgaggccctgccacagcacaagcttacctgcttttccgtttactgcaagcacgggcatttatgcccaattgatactggtctaatcgagaaaaacatcgagctgttttttagtggctccgcaaagcccatctacgacgatgaccctagtctagagggtggcgtaaacgggaaaaacctcggaccgattaatgaatggtggattacaggctttgacggaggcgagaaggcactgattggattttccacgtcatttgctgaatacatcctgatggatccttcccccgagtatgcgccaatttttggcctgatgcaggagaaaatttacatcagcaagatagttgtggaatttctacagtcgaattctgacagtacctatgaggatctcataaataagattgagactaccgtgccaccttctggtctgaacctcaatcgctttacagaggactctctgctcaggcatgctcagttcgtggtcgaacaggtagagtcgtatgatgaggccggagattcagacgagcaaccaatctttctgacgccctgcatgcgcgacctcatcaaactggcaggcgttacgttaggccagcgcagagcccaggctagacggcaaaccatccggcactctacccgagagaaggaccggggacccactaaagccaccacaacaaaactggtttaccaaatcttcgacacattcttcgccgagcagatcgaaaaggacgaccgagaggacaaggaaaacgccttcaaaaggaggcgctgcggcgtttgtgaagtatgccagcagcctgaatgtggcaaatgcaaggcctgtaaggatatggtaaaattcgggggaagcggtcggtcaaaacaagcctgccaggaaagacgttgccctaacatggcaatgaaagaggccgacgatgacgaggaggtggatgataatattcccgagatgccctcccccaaaaagatgcaccagggaaaaaagaaaaaacagaataaaaaccggatttcatgggtgggagaagctgttaaaaccgatggaaagaagtcttactacaagaaggtgtgcatcgacgccgagactttagaggtgggagattgcgtgagcgtcattccagacgattcttcaaagcccctgtaccttgctagagttaccgcactgtgggaagattctagcaatggccagatgttccatgcccactggttctgcgcgggaacagacaccgtgttaggtgccacctccgatcccctggaactgttcctggtggacgagtgcgaagacatgcagttgtcttacatccacagtaaggttaaggttatctataaagctccatcagagaattgggcgatggagggcggtatggacccagaaagcctgcttgaaggcgatgatgggaagacctacttctaccagctgtggtatgaccaagactacgcacggtttgagtccccaccgaagacacagcctaccgaggacaataagttcaagttttgcgtgtcctgcgctaggctggccgagatgaggcagaaggagattccgagggttcttgaacaactggaggatctggacagtagagttctctattactctgccacaaaaaatggaatcctatatcgggtgggggacggtgtttaccttccgcctgaagcttttacctttaacattaagttgtcttcccctgtgaagcgacctaggaaagagccagtggacgaagatctgtatcccgagcactatagaaagtattccgattacatcaaaggctcaaatctggacgcaccggagccataccggattggacgcattaaggaaatcttttgtccgaagaagtctaacgggaggcccaacgaaaccgatattaaaatcagggtgaacaagttctacaggccagagaacactcacaaatcgaccccagccagctatcacgctgatatcaacctcttatattggagtgacgaagaggccgtagtggatttcaaagccgtccagggtcggtgtactgtggagtatggcgaggacctccccgaatgtgtccaggtgtactcaatggggggtcctaacaggttttattttttggaagcctacaatgcaaagtctaagagcttcgaggacccgcctaatcacgctcgctcacccggaaacaagggtaaaggcaagggaaaaggcaaaggcaagcccaagtcacaggcctgcgaacctagtgaacctgagatcgagatcaagctgccgaagctgcggactctggatgtcttcagtggttgcggcggtctgtccgagggcttccatcaggcagggatcagcgacacgctgtgggctattgaaatgtgggatccggctgctcaggcctttcgcctgaataatccaggttcaaccgtgttcaccgaggattgcaacatcctgctaaagctggtcatggcaggtgagactaccaacagtcgtggacagcggctgcctcagaagggtgatgtagaaatgctatgcggaggccctccatgccaaggcttcagcgggatgaatagatttaacagtcggacctatagtaagttcaaaaatagtttagtcgtgtcatttctgtcatattgtgattattatagacccaggttctttctgctagagaatgttcggaattttgtgtcctttaagcggtcaatggtgttaaagctgaccttacgctgtctggtccggatgggttaccagtgtacgtttggcgtgctccaggccggacaatatggcgtcgcgcagactaggcggcgagcaattatccttgctgctgcgccaggagagaagttgcctttatttccagagcccctgcatgtcttcgcgcctcgagcctgccagctgtcagtcgtggtggatgacaagaagtttgtttctaacatcacgaggctgtctagcgggcctttcaggacgatcacagtcagggacaccatgtctgacctgccggaggtcaggaatggggcttctgctttggagatctcctacaacggcgagccccagagctggtttcagcgccagctcaggggcgcacaatatcagccaatccttagagaccacatctgtaaagacatgtccgcccttgtggccgcacgcatgaggcacatccctcttgcgcctggcagcgactggcgggacctgcccaacattgaagtgcgattaagcgatgggacgatggccagaaagcttcggtatactcaccacgaccgcaagaacgggagatcaagttccggagcgctgaggggcgtgtgctcatgtgtggaggctgggaaggcatgcgaccccgctgccagacaatttaatacactgattccttggtgcttgccccatacaggcaacagacataaccattgggccggactttacggtcgcctcgagtgggacggattttttagcacaaccgtcacgaacccagagcctatgggcaagcagggtagagttctgcaccccgaacaacaccgtgtggtgagcgtgcgggaatgtgctcgctcccaagggttcccagatacttatcggcttttcggcaatatcttggacaaacacaggcaagtgggcaacgcggtgcccccaccacttgccaaggccatcggactggagatcaagctctgtatgctggccaaagctagggaaagcgccagcgccaagattaaagaggaagaggctgcgaaggactag

SEQ ID NO: 221044 - DNA, 4860 bp, Artificial Sequence
  Description of Artificial Sequence: Synthetic coding sequence
atgcccgctcgcaccgcccctgctagggtgcccacccttgctgtgcccgctattagcctgcctgacgatgtgaggcgcaggctgaaagacctcgaacgcgactctctaaccgaaaaagaatgcgtgaaggaaaaacttaatctgctccacgagtttctgcaaactgagatcaagaaccaactttgcgacttagagacaaagctgcggaaggaagaactctcagaagagggatacctcgctaaggtgaagagtctgctcaataaagacctctcactggagaacggcgcacatgcttataatcgagaggttaatggcagactggagaatggcaatcaagcccgttccgaggccagaagggtcggaatggctgatgccaatagcccacctaaaccgctgagcaaacctagaactcctaggaggtctaagtcagatggcgaggccaagcctgagccaagcccctccccgaggatcacacggaaaagcaccagacagactactattacgtcccactttgcaaagggacccgcaaaaagaaagccccaagaagagtccgaacgcgctaagtcagatgagtctattaaggaagaagacaaagatcaagatgaaaaacgcaggagagtcaccagccgcgaacgggtggccagacccctgcctgccgaggaaccagaaagggctaagagcggtacaagaactgagaaggaggaggaacgtgatgaaaaggaagaaaaacgcctgcggtcacaaaccaaggagcccaccccgaagcaaaaactcaaggaggagcctgacagagaggcacgggctggtgttcaggccgatgaagacgaggacggtgacgagaaagatgagaagaagcatagaagccaacctaaggatctcgcagcaaaacgaagacccgaagaaaaggaacccgaaaaagtcaacccacagatcagcgatgaaaaagacgaggatgaaaaggaagagaaaagacgaaagacaactccgaaggagcccacagagaaaaaaatggccagggcaaagaccgttatgaactccaaaactcatccaccaaaatgcatccagtgtggacagtacctggacgaccctgacctcaagtacggccagcatccacccgacgccgttgacgaaccgcagatgctgaccaatgagaaactctcaatttttgacgcaaacgagagcggatttgagtcatacgaagccttgccgcagcataagcttacctgtttcagcgtctattgtaaacacggacacctttgtcctattgataccggactgattgagaagaatattgaactgttcttttcgggtagcgcgaagcctatctatgacgatgaccctagcctcgaaggcggtgtgaacgggaagaatttgggcccaatcaatgaatggtggattactggattcgatggcggagagaaagcactaataggcttctctacgagcttcgccgagtacatcctcatggaccccagtcctgagtatgccccaatcttcggactcatgcaagaaaaaatttacatctccaaaatcgtagtggagtttctgcagtcaaattccgacagcacatacgaagacttgattaacaaaattgaaactacggtgcccccttccgggctgaatttgaatcgcttcacggaagattcgctgctgcgccacgcacagtttgttgtggagcaggtggaatcgtatgatgaagcaggcgatagcgacgagcagcctatctttctcactccgtgcatgcgagatctcatcaaactcgctggcgtgaccctcgggcaacgcagagcgcaggcacggcgtcagaccatcagacacagcacacgggagaaggatcgtggccctacgaaggctacaacaactaagctagtgtaccagatcttcgatacattcttcgcagaacaaatagagaaggatgaccgcgaggacaaggaaaatgcgttcaagaggcggcgttgcggggtctgcgaggtgtgtcaacagcctgaatgtggtaagtgtaaagcatgcaaggacatggtcaaattcggtggatcaggtcgttctaagcaagcctgccaggagcgaagatgtcctaatatggcgatgaaggaggccgacgatgatgaggaggtggacgataatatccccgagatgccgagcccaaaaaaaatgcaccagggtaagaaaaagaaacagaacaaaaatcggattagttgggtgggtgaggcagtgaagaccgacggaaaaaaatcatattacaagaaagtatgcatagatgcggagaccctggaggtgggcgattgtgtgtctgttatccccgatgattcctctaagcctctctatttggccagagttacagccctgtgggaggattcatcaaatggccagatgttccacgcacactggttttgcgccggtaccgacacggtcttgggagcaaccagcgaccccttagagctttttctggtcgatgagtgcgaggacatgcagctgagctatatccacagcaaagtaaaggttatttataaggcaccatcagaaaattgggccatggaaggaggaatggaccctgagagtctgctggaaggggacgacggcaagacctacttctaccagttatggtacgatcaggactacgctcggttcgagtctcctccaaagacgcaaccaacagaggacaacaagtttaagttttgcgtgagctgcgctcgactggctgaaatgcgacagaaagagatccctcgtgtcctagagcaactcgaggatctcgacagtagagtgctctactattccgctacaaagaatggcattctttatagagttggcgacggagtgtatctgccacccgaggctttcaccttcaatatcaaactctcttcccctgtcaaacgaccgagaaaggaacctgtcgacgaggatctgtacccagagcattacaggaagtattctgattatatcaaaggcagtaatttagacgctcccgaaccctaccggatcggccgtataaaagaaattttctgtccgaaaaagagcaatggcaggcctaacgagacggacatcaaaatcagagtgaacaaattctatcgccctgagaatacacacaaatctacccccgcaagctatcacgccgatatcaacctcttatattggagcgacgaagaggccgtggtggactttaaggcggtccagggccgatgtaccgtagagtacggcgaggacctaccagagtgcgtgcaggtctactctatgggagggcctaacagattctatttccttgaggcgtacaatgcaaagtccaaatcattcgaagacccacctaaccacgctcggtcccccggaaacaagggaaagggcaaagggaaaggcaagggcaaaccaaaaagccaggcctgcgaaccttctgagcccgagatcgagattaaactgccaaagttgagaacactcgatgtattctccggttgtggcggtttaagtgaaggatttcaccaggccggtatctccgataccctctgggccattgagatgtgggaccccgcagctcaggcctttaggctgaacaatccaggcagtacagtgttcacagaagactgcaacattctgcttaaactagtcatggccggtgagaccaccaacagcagaggccagagactgcctcaaaagggcgatgtggaaatgctctgtggcggaccgccatgccagggattcagcggcatgaatcgattcaatagccggacatactctaagtttaagaattcactcgtggtgtccttcctctcatattgcgactactatcgaccaaggttcttcctgctagaaaacgtgaggaactttgtctcttttaagcggtcaatggtgttgaagctgacgctgaggtgtctcgtgaggatggggtaccaatgtacatttggcgtcctgcaggctgggcaatatggagtcgcgcagacccggaggcgggctatcatcctggcagccgcacccggagagaaactgcctctcttccctgagccactgcatgtatttgcaccgcgagcttgccagctctctgtcgtagtcgacgacaagaagttcgtgtctaacataactagattaagtagcgggccattcagaacgatcactgtacgggacaccatgagcgatcttcccgaagtccgcaatggcgcaagtgcccttgagatttcctacaatggcgagccccaaagctggttccagaggcaactgcggggagctcaataccagcctatcttgagagaccacatttgcaaagatatgagtgccttggtggcagctcgcatgagacatatacctctggcccctgggagtgattggagagacctgcctaacatcgaagtcagactatcagacggaaccatggcccgaaaactgcgctatacccatcatgaccgaaagaatggacgcagcagttcaggagctctccgtggggtatgttcctgtgtcgagggcggttcttccgggaaagcctgcgatccagccgctagacagttcaatacactcatcccctggtgcctcccgcatacgggaaacaggcacaatcactgggccggattatatggtaggcttgagtgggacggcttttttagcactactgtgaccaaccctgaaccaatgggcaagcagggacgcgtcctgcatcccgagcagcacagagtggtttcagttcgggagtgtgctcgatcccagggtttccccgatacttatcggctttttggaaacatcttggataagcatcgtcaggtgggcaacgccgtccccccaccattggctaaggccattggcctggagatcaaattgtgcatgctggccaaggctcgagaatccgcgagtgccaagatcaaggaagaagaggctgcaaaggattag

SEQ ID NO: 221045 - DNA, 4455 bp, Artificial Sequence
  Description of Artificial Sequence: Synthetic coding sequence
ggaagttgtcactcaccggcaagcgcctctcaggttgctggtaccacagctgagcctagtccttcccccaggataaccaggaagagcactcgacagaccactattacttcacacttcgcgaaagggccagcaaaaaggaaacctcaggaggagagcgaacgggcaaaatcggatgagtctatcaaggaggaagacaaagatcaggacgaaaagcgccgaagagtgacatcacgtgaacgcgtcgcaaggcctctgccagcagaggagcctgaaagagcaaagtctggcacaagaaccgagaaagaggaggagcgagacgagaaggaagaaaagcgactgcgcagccagacaaaggaacccacccccaagcaaaagctcaaggaagaaccagaccgagaggccagggccggagtccaggccgatgaagatgaggatggtgacgagaaggatgagaaaaaacaccggtctcagccaaaagacttggcggcaaaaagacggcctgaagaaaaagagcctgagaaagtgaatccccagattagtgatgaaaaagatgaggacgagaaagaggagaaacgtcggaagaccaccccaaaggagccaaccgaaaagaagatggctcgcgctaagacagtcatgaacagcaagacccatcctccaaagtgcatacagtgtggtcagtacttggatgaccccgacctaaaatatggacaacacccccctgatgccgtcgacgagccccagatgctgaccaacgagaagctctcgatctttgatgccaatgagtccggattcgaatcatacgaggctttgccccagcacaaactgacgtgtttcagcgtatactgtaagcacgggcatttatgtccgattgacacgggccttatcgagaagaacatcgaattattcttctcagggagcgcaaaacctatctacgacgacgatcccagcttagaggggggtgtgaatgggaagaaccttggacccatcaatgagtggtggatcacaggatttgatggcggagaaaaggcgctgattggcttctcaaccagcttcgctgaatacatactcatggatccctccccggagtacgctcccatctttgggttgatgcaggagaagatttatatctccaagattgtggtggaattcctccagagcaacagcgatagtacctacgaggacctgataaataaaatcgaaacaactgttccaccatccggactgaacttgaaccgcttcacagaggattccttgctgcggcatgctcagttcgtagtcgaacaggttgagtcttacgatgaagccggagatagtgatgaacagcccatattcctgaccccctgcatgcgtgatctcatcaagctcgcgggagtgaccttaggccagcgacgcgcacaggcgagacggcagaccatccggcactctacgcgcgaaaaggaccggggacccaccaaggccacaaccacaaagctggtttatcagattttcgacactttttttgctgagcagatcgagaaagatgatcgtgaggacaaggaaaatgctttcaagcggcgtagatgtggtgtttgcgaggtatgccagcaacccgagtgcggaaaatgtaaagcatgcaaggacatggtaaaattcggaggtagtggtcggtctaaacaagcctgtcaggagaggcggtgtcccaatatggccatgaaggaggcggatgacgatgaggaagtcgacgacaacatacccgagatgcctagccccaagaagatgcaccagggcaagaagaaaaaacagaataaaaacaggataagctgggtcggcgaagctgtgaagactgatggcaaaaaaagctattacaagaaagtttgcatcgacgctgaaacactcgaggtgggcgattgcgtaagcgttattcccgatgatagcagcaagcccctgtacctcgcaagagtcaccgccctgtgggaagattcaagtaacggccagatgttccatgcccattggttttgtgctggaacggatacggttttgggtgcaacaagcgaccccctcgaactttttctggtcgatgagtgcgaagatatgcaactttcttacatacactccaaggtgaaggtcatttataaagcgccttccgaaaactgggccatggaaggcggaatggatcccgagagcctgcttgaaggagacgatggaaaaacctatttttaccaactttggtatgatcaggattacgccagattcgaatcaccaccaaagacacagcctacagaggacaacaaatttaaattctgcgtgagctgcgctcgcttggcagagatgcgccaaaaagaaattcctcgagtgttggaacagctggaagacctagactcccgagttctctactactccgctaccaaaaatggcattttgtaccgggtaggggatggtgtctacctacctcctgaggcctttacgttcaatatcaagctgagctcacccgttaaaaggccacggaaggagccggtagacgaggacttatatcctgagcactatcgaaagtattccgactatattaaaggctctaatttggacgcacccgagccatacaggattgggcgtatcaaggagatcttctgtcccaagaagtcaaacggaaggccgaatgagacagatatcaaaatccgggtgaacaaattctatagaccagagaatacacacaagagtacacctgccagttaccacgccgacatcaatctcctctactggtccgacgaggaggctgtagtggatttcaaggctgtccagggaaggtgtactgtggaatacggagaagaccttcctgaatgtgtgcaggtgtacagtatggggggacctaaccgattctatttcctggaggcctacaatgcgaaatctaaatcctttgaggacccacccaatcacgcacgctctcctggcaacaaggggaagggcaaaggaaagggaaagggtaagccaaaatctcaggcctgtgagccgtctgagcccgagatagagatcaagctccccaagctcagaactctggacgtgttttctggctgtggaggactgtctgagggcttccaccaagccggtatcagcgataccctgtgggcaattgaaatgtgggacccagctgctcaggccttcaggctaaataaccctggcagcactgtgtttactgaagattgcaacatcctgttgaaactggtcatggctggcgagaccacgaactctcgagggcagcgcctgccccagaagggagacgtggagatgctctgcgggggacccccttgccaaggtttttcaggcatgaaccgtttcaattctaggacgtactctaagttcaagaattcacttgtagtgtctttcctgtcatattgcgactactatcgcccacggttcttcctcctggagaacgtacgtaattttgtgtccttcaagaggagcatggttctcaaactgaccttacgctgtttggtgcgcatgggatatcaatgcacatttggagtgctgcaggcaggacagtacggagtcgctcagactcgaaggagggcgatcatcctggccgcagccccaggggagaagctacctctgttccctgaacctctgcatgttttcgctcctagggcctgtcagcttagtgtcgtggtggatgataagaagtttgtctcaaatatcaccagactgtcttcgggtccgtttagaactatcacagtgcgggataccatgtcggatctcccagaggtgcgaaacggggcatctgcgcttgagataagctacaatggcgaaccccagagttggttccagcgtcagctgagaggcgcacaatatcaacccattctgcgcgatcatatctgcaaagacatgtcagccttagtcgccgcaaggatgcgacacattccgctcgcccctggcagtgactggagggatctgccaaatattgaggttcggttgagtgatggtacaatggcccgaaagctccggtacactcatcatgacaggaagaatggaagaagcagttcaggtgccttgcgcggtgtgtgctcatgtgttgaagccggaaaagcttgcgatcctgcagctaggcagttcaatacgctgattccatggtgccttccccataccggaaatagacataatcactgggctggactttacgggcgtcttgaatgggacggtttcttttcaactacagtgacaaatccagagccaatggggaaacaggggcgagttctgcaccctgaacagcaccgggtggtgagcgtgcgtgaatgtgcgagatcacagggatttccagacacctaccgactgtttggcaatatcctggataaacaccggcaggtcgggaatgcggtgcccccacccttggccaaagcgatcgggttggaaatcaaactttgtatgctggctaaggcacgagagagtgcctccgccaaaatcaaggaagaagaggcggctaaggattag

SEQ ID NO: 221046 - DNA, 2739 bp, Artificial Sequence
  Description of Artificial Sequence: Synthetic coding sequence
atgcccgctatgccaagctcaggccctggagacactagtagctccgctgctgaaagagaggaagatcgcaaggacggagaggagcaagaagaaccgagagggaaagaggaacgccaggagccatcgaccaccgccagaaaggtgggaagacccggacggaaaagaaagcatccccctgtcgaatccggcgacactcccaaagatcctgctgtgattagcaagtcccctagcatggcccaggatagcggggcttccgagttgttgccaaacggcgatttggagaagcggagtgagccccagccagaagagggatccccagccggaggacagaagggcggtgccccagccgagggggaaggagcagctgagactttacctgaagcctctagggctgtggagaatggatgctgcacgccaaaggagggccgaggggcacctgcagaggctgggaaggaacagaaggagacaaacattgagtctatgaagatggaggggtctaggggtaggctgagaggagggctgggctgggagtcctcactgcgacagagaccgatgccgagactgacttttcaagctggtgatccatactacatctcaaagaggaaaagggatgagtggttagctcggtggaaacgagaggccgaaaagaaagctaaagtcattgcgggtatgaacgccgtggaagagaaccagggccctggtgagtcccagaaagttgaagaggcatctccacccgcagtgcaacagccaaccgatcctgcatccccaacagtggcgacaactcccgaaccggtgggaagcgacgccggagataagaacgccactaaggctggggacgacgagcctgaatacgaggatggtcgaggtttcggaataggcgaactggtgtggggcaagctgagaggcttcagctggtggccagggcgtatcgttagttggtggatgaccgggaggtcaagggcggctgaggggactcgctgggtcatgtggttcggtgacggaaagttctccgtggtgtgtgtcgagaaactgatgcccctgtcttccttttgtagcgctttccaccaagcaacctacaacaagcaaccaatgtaccgaaaggccatttatgaagtgctacaggtggccagcagtcgggcaggcaaactgtttcccgtctgtcatgactctgatgagagcgatacagcaaaggctgtggaagtgcaaaacaaacctatgattgaatgggccctggggggatttcagccgtctggtccaaaagggctcgagccacccgaagaagaaaagaatccctacaaggaagtctacacagacatgtgggtcgaacccgaggctgctgcttacgcccctccgccacccgctaaaaagccgagaaaaagcaccgcagaaaagccaaaggtgaaggaaattattgacgagcggacccgcgaaaggttggtgtacgaggtacgtcagaaatgcaggaacattgaggatatatgtatcagttgtgggtccctgaatgtcacattagagcatcccctatttgtcgggggtatgtgtcagaactgcaagaattgctttctggagtgcgcataccagtacgatgatgacgggtaccagtcttactgtacgatatgttgtggcggacgcgaagtgctgatgtgcgggaacaacaattgctgccggtgcttctgcgtagaatgtgtggacctgctcgtcggcccaggagctgcccaggccgcaatcaaagaagatccatggaactgctacatgtgcggacacaaaggcacctatgggctgctgcggaggagggaagactggccttctcgactgcagatgtttttcgccaataaccatgatcaagaatttgacccacccaaggtgtatccgccagttccagccgagaagcgcaaacccattcgagttctgtccttgtttgatggaattgcaacgggcttgcttgtgctcaaggaccttggtatccaggtggaccggtacatcgctagcgaagtgtgtgaggatagcataacggtgggaatggtcagacaccaggggaaaataatgtatgtaggcgatgttaggagtgtgacacagaagcatatacaagagtggggaccgttcgatctggtgattgggggatcaccctgtaacgatttgtccattgtgaatcctgcccgtaaaggcctgtatgaaggcacaggacggcttttttttgagttctatcggctgctccacgatgccagacccaaggagggtgacgaccggcctttcttctggctgtttgagaatgtagtggccatgggtgtaagcgacaaacgcgacattagtagatttttggagagcaatccagtaatgattgacgctaaggaagtgagtgccgctcacagggcccgatacttctggggaaatctgccaggtatgaaccgtcccctcgcgtccaccgtgaatgacaagttagagctgcaagaatgtcttgaacacggtcgcatagcaaagttcagtaaagtcagaacaattacaacaaggagtaactccatcaagcaaggaaaggaccagcacttcccggtctttatgaacgagaaagaagatatactgtggtgcaccgagatggagagggtcttcggtttccccgtccactatacagacgtgagtaatatgtctcggctagccagacagaggttgcttggccgttcttggagcgtgcccgtcatcagacacctattcgccccactcaaagagtattttgcatgcgtttag

SEQ ID NO: 221047 - DNA, 2739 bp, Artificial Sequence
  Description of Artificial Sequence: Synthetic coding sequence
atgccagcgatgccctcttccggccctggggacacatcctcatccgcagccgagcgcgaggaagatagaaaggatggggaagagcaggaggaaccccgagggaaagaggaaaggcaggagccctcgactacggcccgaaaggtgggcagaccaggccgaaagagaaaacacccaccagttgagtccggagatactcccaaagatcctgcagtgatctctaagtcccccagcatggcgcaggactcaggcgctagtgagctactgccaaatggtgatctggagaagagatctgagccacagccggaagagggatctcccgctggaggccaaaagggaggagccccagcagagggtgagggagccgctgaaacattgcccgaggcctcacgggcagtggaaaacgggtgttgcacaccaaaggaggggagaggcgctccggcagaggccggaaaggagcaaaaggaaaccaacatcgaatccatgaagatggagggctcacggggacgcttaaggggcggactgggctgggagtctagtctgagacagcgtcctatgccacgcctgacctttcaagccggagacccctattacatatcaaagcgcaagcgcgacgaatggttggccagatggaaaagggaggctgaaaaaaaagccaaagttatagcaggaatgaatgctgtcgaggagaatcagggcccaggtgaaagtcaaaaggtcgaggaagctagtcctcctgccgttcagcagcccaccgacccggcaagtccaaccgtcgctaccaccccagagcccgtggggtctgacgccggtgataagaacgctacaaaggccggagacgacgagcccgaatacgaggacggcagggggtttggtattggggaactggtatggggtaaattgcggggatttagctggtggcctggccgaatcgtcagttggtggatgactggtagatcgagagcagccgaaggaaccagatgggtgatgtggtttggagacgggaagttttctgttgtctgcgttgagaaacttatgccgctgagctcattctgcagtgcattccatcaagctacctacaacaagcaaccaatgtaccgcaaagctatttacgaagtgctccaggtcgcgtcatctcgcgcaggaaaattatttccagtgtgtcatgacagcgacgagtctgacaccgccaaagcagtggaggtccagaataaacccatgatcgagtgggctctgggcggatttcagccaagtggcccaaaaggtctcgagcctcccgaagaagagaagaatccctacaaagaggtgtataccgatatgtgggtggagcccgaggccgctgcctatgcaccgcctcctcctgctaaaaaacctaggaagtcaacagcggagaaaccaaaggttaaggaaattattgatgagcgcacgagggaaaggcttgtgtacgaagtgcgccaaaagtgtcggaacattgaagacatctgcatctcctgtgggagcctcaatgtgactttagagcaccctctttttgtgggagggatgtgccagaactgcaagaattgcttccttgagtgtgcgtaccagtacgacgacgacgggtatcaaagctactgcaccatctgttgcggtgggagggaagtgctcatgtgcggcaacaacaattgctgtagatgtttttgcgtcgagtgtgtggaccttctagtaggacccggtgccgctcaggccgctattaaagaagacccatggaattgctacatgtgcggccataaggggacttatgggctgctccgaaggcgggaggactggccgagtcgactccagatgtttttcgccaataatcatgaccaggagttcgaccctccaaaagtctaccccccagtcccagctgaaaagcgcaagcctatccgtgttctttcattatttgacggcatcgcaacaggtctgctggttctcaaagatttaggaattcaagtcgacaggtacattgctagcgaggtgtgtgaggatagtattactgtgggtatggtcagacaccagggaaagattatgtatgtgggggatgtaagaagcgtaacacaaaaacacatccaggagtggggcccttttgatctggtcatagggggatcaccttgcaatgacttgtcaatcgttaatcctgcccgaaagggactctacgagggcaccgggaggctgtttttcgaattttaccggctcctgcacgacgcgaggcccaaggaaggcgacgatagacctttcttttggttgtttgagaacgtggttgctatgggcgtcagcgacaagcgcgatatatcaaggttcctggagagtaaccctgtaatgattgatgcaaaggaagtgtctgccgcacaccgagcccgatacttttggggcaacctgccaggaatgaatcgacccctcgcctcaacagtcaacgataaactggaattacaggaatgtctggaacatggccgaattgccaagttttctaaggtgcgaacaattaccacacgcagtaacagtatcaaacagggtaaggaccagcactttcctgtgttcatgaacgagaaggaggacatactgtggtgtacagagatggaacgcgtcttcgggtttcctgtgcattacaccgatgtgagcaatatgagtcggctagcaagacagcggttactcggacgtagctggagcgtaccggtgattcgccacctgtttgcccctctcaaagaatacttcgcttgcgtgtag

SEQ ID NO: 221048 - DNA, 2172 bp, Artificial Sequence
  Description of Artificial Sequence: Synthetic coding sequence
atgggtattttggagcgtgtggtccggcgaaatggtagagtcgatcgctcactcaaggatgaatgtgatacagcagaaaagaaagccaaagtgattgccggaatgaacgccgtcgaagagaaccaggggcctggagaatctcaaaaagtggaggaggcttcacccccagcagtgcagcagccgacagaccctgcctcccccactgtggcaaccacgcctgagcctgtggggtccgatgccggagataagaatgctacgaaggccggagatgacgaaccagagtacgaggacggcagaggatttggtatcggtgagctggtgtggggaaaactgagggggtttagttggtggcccggacggattgtgtcttggtggatgactggcagaagtcgggcagctgagggcacaaggtgggtcatgtggtttggcgacgggaaattttccgtggtgtgcgtggagaagcttatgccccttagctctttttgctccgcctttcaccaggcaacctacaataagcagcctatgtatcggaaagccatatacgaagtgctccaagtggcgtccagtagagccggaaaactgtttcccgtgtgccatgacagtgacgagagtgataccgccaaggccgtggaggtccagaataaaccgatgattgaatgggcactggggggtttccagcccagcggtccaaaaggcctggagcccccagaggaggaaaagaacccgtacaaagaggtttacacagacatgtgggtcgaacctgaggcggcagcctatgccccaccgccaccagccaaaaagcccaggaaatccactgccgagaagccaaaggtaaaggagattattgacgaacgaactcgggaaaggctcgtgtatgaggtacgtcaaaagtgccggaacatcgaggatatctgtatttcttgcggctcgttgaatgtaaccctggagcacccattattcgttgggggaatgtgtcagaactgtaaaaactgcttccttgaatgcgcttatcagtatgacgacgacgggtaccagtcttattgcactatctgttgtgggggtagggaggtactcatgtgtggtaacaataattgttgtagatgcttctgtgttgaatgcgtggatttactggtcggaccaggagccgctcaggccgctataaaggaggacccttggaattgttacatgtgtgggcacaaaggaacatacggtctactgcggagacgggaggactggccttcacgattacaaatgttttttgctaataatcacgaccaggagtttgaccctccaaaagtgtatcctccagtccccgctgaaaaacggaaaccaataagagtgctcagcttatttgacgggatcgcgacaggtctgctggtcctgaaagacctcggaatccaggtggatagatatattgccagcgaggtatgtgaggatagcataacagttggaatggtgcgacatcagggtaagatcatgtatgtcggcgatgtgcgcagtgtcactcagaaacatatccaggagtggggaccattcgacctcgttatcggtggctctccatgcaacgacctcagcatcgtcaatccagcgagaaaagggctctatgagggcacgggacgcttattcttcgagttttacaggctgctccatgacgcaagaccaaaagagggagatgaccgcccattcttttggttgttcgagaatgtggtggcaatgggcgtatccgacaagcgggacatctcccgctttcttgaatcaaacccggttatgatcgatgccaaggaggtgtccgctgcgcaccgagctcggtatttttggggtaaccttccaggtatgaacagacctctcgccagtaccgtgaacgataagcttgaactccaggagtgtctcgaacacggacgaattgctaaattcagtaaggtcaggaccattacaacccgcagcaactcaataaagcagggaaaagaccagcattttccagtgttcatgaatgagaaggaggatatcctctggtgcaccgagatggaacgggtctttggctttccagtacattataccgatgtgagcaatatgtcccgcctcgccaggcaacgtcttttagggcgatcatggtcggtgcccgtgattcgccacctattcgccccactaaaagagtatttcgcttgcgtttag

SEQ ID NO: 221049 - DNA, 2070 bp, Artificial Sequence
  Description of Artificial Sequence: Synthetic coding sequence
atgaatgcggtggaagagaaccaggggccaggcgaaagccaaaaggtcgaagaggcatccccgcctgctgtgcaacagccaaccgaccctgcatctcctacagtagcaacgactcccgaaccagtgggctctgatgccggagacaaaaacgcgacgaaagccggtgacgacgagcctgaatatgaagacggcaggggctttggtataggcgagctcgtatgggggaaactccggggattttcctggtggccgggacgcattgtcagttggtggatgactggtagatcaagggccgcagaaggtaccaggtgggtcatgtggttcggtgatggtaagttctccgttgtttgcgtcgagaagctgatgccactttcgtcattctgttcagccttccatcaggcaacctataataaacaaccaatgtatcggaaagccatttacgaggtgctgcaggtggcttcttcccgggcaggtaaactcttccccgtctgccacgatagtgacgagagcgatacagcgaaagccgtggaagtccagaacaagccaatgatcgagtgggctcttgggggattccagccttccggacctaagggcctggagcctcccgaggaggagaaaaacccgtacaaagaagtctacactgacatgtgggttgagccagaggctgccgcttatgcccctccacccccagctaagaaaccaagaaagtctaccgccgagaagcccaaggtcaaagagataatagacgaaagaacaagggagcgactcgtgtacgaggtacgccagaaatgccggaacatcgaagacatctgtatttcgtgcgggagcctgaacgtgactctggagcaccccctttttgtggggggaatgtgtcagaattgcaagaactgtttcttggaatgcgcataccagtatgacgatgatgggtatcagtcgtactgcaccatctgctgtgggggtcgagaggttctcatgtgtggcaacaacaattgttgtcgctgcttttgcgtggagtgtgtggatttactggtggggccaggcgcagcccaagcagctataaaggaggacccctggaactgctatatgtgtggccacaagggcacctatggtctcctcaggaggagagaagattggccttccaggctgcaaatgtttttcgcaaataaccacgatcaggaattcgatccacctaaggtgtatccccctgtgcccgcagagaaaaggaaaccaataagagtcctcagtctctttgacggcattgctactggcttgctggtactaaaggatctgggaattcaagtcgaccggtatattgcctctgaagtttgtgaagattccatcacagtcggcatggtgcgccaccagggaaaaataatgtatgtgggggacgttagatctgtgacccaaaaacacattcaggagtggggtcctttcgatctcgtcatcggagggtcaccctgtaacgacctgagcatagtaaaccccgctaggaagggactctatgagggcacgggacgcttattttttgagttctacagactgttgcacgatgcacggccaaaggagggagacgatcgcccattcttttggcttttcgaaaatgtcgttgcgatgggagtgtcagacaaacgcgatatatctcggtttttggaaagcaacccagtaatgattgatgctaaggaggtatcagctgctcatcgagccagatatttctggggaaatctgcctggaatgaaccggccacttgcctccacagtgaatgacaaactcgaactgcaagagtgcttggaacacggacggattgccaaattttcgaaagtacggactattacaactcgttctaactcaatcaaacagggcaaagatcagcatttcccagtgttcatgaatgagaaagaagacatactctggtgtactgagatggagagggtgttcggttttccagtgcactacactgatgtgtccaatatgtccagactagcacgccagcgcttattgggaaggagttggtccgtcccagtgattaggcatctgttcgcacctctgaaggagtatttcgcatgcgtgtag

SEQ ID NO: 221050 - DNA, 501 bp, Artificial Sequence
  Description of Artificial Sequence: Synthetic coding sequence
atgcctgccatgccttctagtggaccaggggatacaagctcttcggcagccgagcgcgaggaagacagaaaagacggcgaagagcaagaagaaccaagaggcaaggaggaacggcaggagccatccaccaccgccagaaaggttggtagaccaggccgtaaacgtaagcacccacccgtggaatccggcgatacacccaaagatcccgctgtgattagtaagtccccctccatggcacaggactccggagcgagcgagctgttgcccaatggcgacttggaaaagaggtctgagccccaacctgaagaaggatcccctgctggcggacagaagggaggagccccagccgagggggagggagcagccgaaactctgccggaggcctccagggcggtggagaatgggtgctgcacacctaaggagggcaggggcgctcccgctgaagcaggggagtcaagcgctccaggcgcagcttcatcaggccctacatccatcccatag

SEQ ID NO: 221051 - DNA, 2538 bp, Artificial Sequence
  Description of Artificial Sequence: Synthetic coding sequence
atggagccaagtccagagccaccttccttggagtctatgaaaggagacacgcggcacctgaatggcgaggaggacgctggtgggagagaggattccatcttggtgaatggcgcttgttcggaccagagctctgacagtcccccaatactggaggccattcgaactcctgagatacgaggaaggaggagttcttcccggctatctaagcgcgaagtctccagcttgctgtcgtacactcaagatctgactggcgatggcgacggagaggatggggatggaagtgatacaccggtcatgccaaagctattccgtgagacccggacccggagcgaatctccggctgttcgcactcgcaacaataactctgtatccagtcgggaacggcacagaccctcccctcggtccacccggggtcggcagggcagaaaccacgtcgacgaaagcccagtcgagtttccagccacacggagcctgagaagaagagcaactgcttccgccggtacaccctggcctagccctccaagctcatacctaacgatagatctaaccgacgacactgaagacacacacggaactccacagtccagttccaccccctacgccagactggctcaggactctcaacaagggggtatggaatccccacaagtcgaagctgattccggcgacggggatagcagtgagtatcaggatgggaaggagtttggcatcggcgatttggtgtggggcaaaattaagggctttagttggtggccagccatggtggtgagttggaaagctaccagcaagcggcaggccatgtccggcatgcgatgggtccagtggtttggcgacggcaaattctccgaggtctccgctgacaaattagtggctcttggcctgtttagccagcacttcaatcttgcgacattcaataaactcgtgtcatacaggaaagcaatgtatcatgcactcgagaaagctcgagtacgtgccggtaagacctttccctcttctcccggtgactcccttgaggaccagcttaagcctatgctggaatgggctcacggcggatttaagccaacggggatcgagggacttaaaccaaataacacacagccagaaaataagacacgcagacgcacagcagatgactcagccacttctgactactgtcctgcaccaaagcgcctcaaaactaattgttacaataacggcaaagatcgcggagacgaggatcagagtcgtgagcagatggcctctgacgtggctaataacaaatccagcctcgaggatgggtgcctcagctgcggacggaagaatcccgtgtcctttcacccactgttcgagggagggctgtgccagacatgccgggacagatttctggagctattttacatgtatgatgacgacggttatcagtcatactgtacggtttgctgtgaaggcagagaactccttctgtgttcaaacacaagttgctgtcgctgtttttgtgtggagtgcctggaggtcctagtggggacagggaccgcagccgaagccaagctccaagagccatggtcttgttatatgtgtctgcctcagcggtgtcatggagtgctccgaaggagaaaggattggaatgtgcggctccaagcgtttttcacatctgacaccggcctggaatatgaggcacctaagctctaccccgcaatacccgcagcaaggcggagacctattcgggttttgagtctttttgacggcatagcaactgggtatttggtccttaaagaactgggcataaaggtcggtaaatacgtagcatccgaggtgtgcgaggaatctattgctgtggggaccgtgaaacacgaggggaatattaagtatgttaacgatgtgaggaacattaccaaaaagaacatcgaagagtggggaccatttgatctcgtaattgggggtagcccttgcaatgatctgtccaacgtgaaccctgcgaggaagggactgtacgaggggactggtaggctatttttcgagttctaccacctgttaaactactcaaggcctaaggagggtgacgacaggccctttttctggatgttcgaaaacgtggtggcaatgaaagttggcgacaagagagacattagccggttcctggagtgcaaccctgttatgatcgatgcgataaaagtctccgcggcacacagggcccgttacttttggggcaacctccctggaatgaatcgccctgttatagcctccaagaacgacaagctcgagctgcaggactgcctggaatataacagaattgcaaagctgaaaaaggtccagacaattactacaaagtcaaactctatcaagcagggcaaaaaccagctgtttccggtggtgatgaatgggaaagaagatgtactctggtgtacagaactggagcggatctttggctttccagtgcactacacagatgtgtcaaacatgggacgcggtgctcgtcaaaaactgctgggcagatcttggtcagttcccgtgatccggcacctgttcgcacccctcaaggattactttgcatgtgagtag

SEQ ID NO: 221052 - DNA, 2562 bp, Artificial Sequence
  Description of Artificial Sequence: Synthetic coding sequence
atgaaaggtgatacccgtcatctgaatggcgaagaagacgccggaggacgtgaggattcaatactcgtcaatggggcttgctcagatcagagctccgattctccacccatcctagaggcgatacgcacacccgaaattcgcggacgcaggagctccagtcggttaagcaagcgcgaggttagtagcctgttatcttatacccaggatttgacgggcgacggcgacggtgaagacggtgatggaagcgatactcccgtcatgcctaagctgtttcgggaaacaaggaccagatcagaatcccctgcggtgcgaactcgtaataataacagcgtttctagccgagaacggcaccggcctagcccacgaagtacccgcggaaggcagggccgaaaccatgtggatgagtccccggtcgaattccctgctactcgatcactcagacgtagagcaaccgccagcgccggtaccccatggccgtcaccgccttcatcttacctgactatcgatctgaccgacgacacggaggacacacacggtaccccgcagtcaagcagcaccccctacgctcgactcgcccaggacagccagcagggtgggatggaatccccccaagtcgaagcagatagcggagacggtgatagcagcgaataccaagacggaaaggaattcggcatcggtgacctagtgtggggcaaaatcaaaggtttttcgtggtggcctgctatggtagtctcttggaaggcaacctcgaagcgtcaggcgatgagtggaatgagatgggtgcagtggttcggcgacggcaagttttccgaggtgtctgccgataagttagtcgctctgggacttttttcccaacattttaatctcgccacattcaacaaattggtgagttatcgtaaagcaatgtatcatgctctcgagaaggccagagttcgggcaggcaaaacatttccgagttctcccggagatagtcttgaagatcagttaaagcctatgcttgagtgggcccacggcggtttcaagcctaccggtatcgaaggcctgaaaccaaacaacacccagccagttgtgaataaatccaaggtccgaagagccggatcgcggaagttggagtccagaaaatacgagaataagacaagaagacggactgccgacgactctgctacaagcgactattgtcccgctcccaagcggttgaagactaattgctataacaatggaaaggacaggggcgacgaagaccagagtagagaacagatggccagcgacgtggcaaacaataagagttcgctcgaggatggctgcctcagctgtggtaggaagaaccccgtctcctttcatcccttgtttgagggaggtctatgtcagacatgcagggacaggttcctagagctcttttatatgtacgacgatgacggctatcagagctactgtacagtgtgctgcgaggggagagaactactgctgtgtagtaatacctcatgttgtcgctgcttctgtgtggaatgcctggaagtactggtgggtacaggcaccgcggcagaggctaagctccaggaaccatggtcttgctacatgtgcctgccacagcggtgtcacggagtgctacgtcggaggaaggactggaatgtcaggctgcaggcatttttcacctctgacacggggcttgagtacgaggcgcctaaattgtacccagccattcctgccgcaagaagacgtcccataagggtcttatccttgtttgacgggatcgcaactggatatttagtcttgaaggagctgggaattaaagttggcaagtatgtggcctcggaggtgtgtgaggaaagcattgccgtgggtaccgttaaacacgagggcaatatcaaatatgtcaatgatgtgaggaacattactaaaaaaaatatcgaagaatgggggccattcgatttggtgattggcggatctccttgtaatgacctgagtaacgtaaacccagcgaggaagggactgtacgaaggcacagggagactcttttttgaattttaccatttgttaaactacagtcgtccaaaggagggggatgatcgccctttcttctggatgttcgaaaatgtggttgcgatgaaggtgggagataaacgcgacattagccgtttcttggagtgtaatccagttatgattgacgcgatcaaagtctctgccgctcacagagccagatatttctggggtaacctcccagggatgaatcgccctgttattgcctccaaaaacgataagttggaactacaagattgtctcgagtataaccgaattgcgaagttaaagaaggtccaaaccattaccaccaaatctaactcgattaaacaaggtaaaaaccaactgttcccggtggttatgaacggcaaagaagacgtcctgtggtgtacagagttagaacgtatttttggcttcccagtccactatacggacgtttcaaacatgggccgtggcgcaaggcaaaaactgttgggccgaagttggtctgtcccagtgataaggcacctttttgccccactcaaggactacttcgcatgcgagtag

SEQ ID NO: 221053 - DNA, 2379 bp, Artificial Sequence
  Description of Artificial Sequence: Synthetic coding sequence
atgaagggggacactagacacctgaacggcgaagaggatgccggaggcagagaggacagcatcctggtaaatggtgcctgctccgaccagagctccgacagccccccaatactcgaggccatcagaacccccgagattcgaggaaggaggtcgagctctcgcctgtcaaagagggaggtttccagcttactatcttacacacaggaccttacaggagacggggacggcgaggacggggatggatctgacacacctgttatgcctaaactcttcagggagacaagaacgcgctctgaaagcccggcagttagaaccagaaacaacaactctgtgtcttccagggaacgccatcgccctagtcccaggtccacacggggaagacagggcaggaaccacgtagacgagtcacccgtggagtttccagccactcgaagtctccggagaagagccactgcctccgcaggtaccccttggcctagtccacctagcagctatctgaccatcgatttgactgacgacacggaagatacccacggcacaccccaatcctccagcacaccttatgcccgactagctcaagactcccagcaaggcggaatggaatcccctcaggttgaggcggactctggcgatggtgacagctctgaatatcaggatgggaaagagtttggaattggcgatttggtctggggaaaaataaagggcttttcttggtggcccgctatggttgtctcttggaaggcaacttccaaaaggcaggccatgagtggaatgagatgggtccagtggttcggggacgggaaattctcagaagtgagtgcagacaagttggtcgccttaggcctcttcagtcaacattttaaccttgcgacttttaataagcttgtgtcataccgaaaggccatgtatcatgctctggagaaggcgcgagttcgagcaggaaagacattcccctcttcacccggtgatagcctggaagatcaacttaaacccatgctggagtgggctcatggtggttttaaaccgactggaatagagggactcaagccaaacaatacccagcctgaaaataagaccaggcgtcgcacagccgatgatagcgccacatctgactactgtcctgctccaaaacggttgaaaactaactgttataataatggaaaagataggggcgatgaagatcagtcccgagagcagatggctagcgacgtcgctaacaacaaatcctccttagaagatggatgcttgagctgtggtagaaagaacccagtgtcgtttcatcccttattcgaggggggtctgtgtcaaacatgcagagataggttcttagaactcttctatatgtatgacgatgacggataccaaagctattgcacagtatgttgtgagggacgtgagttattgctgtgttccaacacctcatgttgtcggtgtttttgtgtagaatgccttgaagtgctggtcggtactgggaccgctgctgaggctaaactgcaggagccatggtcttgctacatgtgcttgccacagagatgtcatggtgtgttgcggagaaggaaggattggaatgttagactgcaagctttctttacaagtgacactggtcttgagtatgaggctcccaagctctacccagcaatacctgcagccagacggcgacctatccgagtgctctcactgtttgacgggatagccaccggatacctggttctcaaggagctgggcattaaggtgggaaaatacgtcgcgtctgaagtatgtgaagagagtatagctgtggggaccgtgaagcatgaaggcaatataaagtatgtgaacgacgttaggaacataactaagaagaacatcgaggagtgggggccttttgacctcgtaatcgggggttccccgtgcaacgatctctccaacgtgaaccctgctagaaagggcctgtacgaaggcacggggcgattgttctttgagttttatcatctactgaattactcccgacccaaagaaggtgacgacagaccatttttctggatgttcgagaatgtagtggcaatgaaagtgggagataagcgagacatatctaggtttttagagtgcaacccagtgatgatcgacgcaatcaaggtctctgcagcccaccgcgctaggtacttttgggggaacctccctggtatgaatagaccagttattgcttccaagaacgacaagctggaacttcaggattgcctagagtataaccgcattgctaaagacttgtggttgtcatgcgcacttcatcgccgagtacagcacggtccttggtgtccccctgaggctgcaggcaaggtcctggaaagagcatgccacccaacccctctgcgccctagcgagggattactttgcatgtag

SEQ ID NO: 221054 - DNA, 2313 bp, Artificial Sequence
  Description of Artificial Sequence: Synthetic coding sequence
atgaagggcgacacccggcatctgaacggcgaggaggacgcagggggacgggaagattccattctagtaaatggggcttgctcagatcagagctctgacagtccccctatcttggaggcaattcgaacccccgaaattcgcggacgccgatcctccagccgattgagtaagagagaggtgagctcactgctgtcctacacccaagatttgaccggagatggtgacggcgaagacggcgatggctcagacactccagttatgcccaagcttttccgagaaacccgaacgcgatcggaaagtcctgccgtgcgaaccagaaacaacaattccgtctcatcccgagagcggcacaggcccagccccagaagcacaaggggcaggcagggcaggaatcacgtggacgagtcacccgtggaatttccggcaacgagatccctacgcagaagggccacggcatcagccggaacaccttggccatccccccctagcagttatctgaccattgatcttactgacgataccgaagacacacatggaactccgcagtccagtagcactccatatgccagacttgctcaagatagtcaacaagggggaatggaatcccctcaggtcgaggctgacagtggtgatggggactcaagtgagtaccaggacggcaaagaattcggaattggggacctagtctggggcaagatcaagggcttctcttggtggccagctatggtggtctcatggaaggcgacatccaagcgtcaagccatgagcggtatgaggtgggtccagtggttcggggacggaaaatttagcgaggtctcagcagacaagttggtggcactgggcctgttctcccagcactttaatctggccacatttaataagctggtgtcctatcgaaaagctatgtaccacgcactggagaaagcaagagttagagcaggcaaaacattcccttcctcgcccggagatagcctcgaagaccagctgaaacctatgctggaatgggctcatggcggtttcaagcccaccggtatcgaggggctcaaacccaacaatacacagccagagaacaaaaccaggcgaagaactgccgatgactccgctacatctgactattgtcccgcacccaagcgattgaaaactaactgttacaataacggcaaagaccgaggagatgaagatcagtctcgggaacagatggcctccgacgtggctaataacaaaagttctctcgaagacggttgccttagctgcggaagaaaaaaccctgtttcatttcacccactgttcgaaggaggcctgtgccagacctgccgcgataggttcctagaattgttttatatgtacgatgatgacggctatcagtcttactgcactgtctgttgcgagggtcgcgagctgctgctttgtagtaatacatcttgctgccgctgcttttgcgttgagtgcctagaggtgctggtgggcaccggtacagctgccgaggctaagttacaggaaccatggtcttgctatatgtgtctgccccaacggtgtcatggcgtcttacgacgcaggaaggactggaacgtgcgactgcaagctttttttactagtgacacaggactggaatacgaggcaccaaagctttacccggctattcccgcagccagaaggcggcctattcgggtgctgtcactttttgatggaattgcaactggctatctggtgctgaaagaactcggcattaaggttggaaagtatgtggcctcagaagtttgcgaagagagcatcgccgtcggtacagttaagcatgagggcaacattaaatatgtcaatgacgtgaggaatatcaccaagaagaacattgaggaatgggggccattcgacctggtaattggcggatcaccttgcaacgacctcagtaatgtaaacccggcacgcaaaggactctatgagggtaccggcaggcttttcttcgagttctaccacctgctcaactactcgaggcccaaggaaggagacgatcggccatttttctggatgttcgagaacgttgttgcaatgaaggtgggagataaacgcgatatttctcgattcctcgaatgcaatcctgtgatgattgatgccatcaaagtctctgccgctcatagagcccgatatttttggggaaatctgcccggtatgaacagaatttttggtttccctgtgcactatacagacgtttccaacatgggcagaggagcccgacagaaactcctgggacgaagctggagcgttcccgtgattcgccacctgtttgctccactcaaggactattttgcctgtgaatag

SEQ ID NO: 221055 - DNA, 2502 bp, Artificial Sequence
  Description of Artificial Sequence: Synthetic coding sequence
atgaagggtgatactagacacttaaacggggaggaggatgccggtggtcgcgaggacagcattcttgtgaacggggcatgttctgatcagtcatcagatagcccgcctatcctagaggctattaggacacccgaaattcgtggccgtcggtcctcttctagattatctaagcgtgaggtgtcaagcttgcttagttatacacaggatctgaccggtgatggcgatggggaagacggcgatggatccgacactccggtcatgccaaagctattccgagaaaccagaaccaggagcgagagtcccgcagtgcgaactcggaataacaattccgtttcttcgcgcgagaggcaccgtccatcacccaggtcgacaaggggtcggcaagggcgaaaccacgtggacgaatccccagtcgagtttcctgccaccagatcactgagacggagggctaccgcatccgctggcactccctggcctagtccaccgtcctcctacctgacaatagacctgacagatgacaccgaagacacccacggcacacctcagagctcgtcgacgccctatgcacgcctggcgcaggactctcagcaaggtgggatggagtcacctcaggttgaggccgatagtggagacggagactctagtgaataccaggatgggaaggagttcggcattggcgacctggtttggggcaagatcaagggtttctcttggtggcccgctatggtagtgagctggaaagccacgagcaaaagacaggccatgtcaggaatgcgctgggttcagtggttcggtgacggtaagttcagtgaagtttcagcagataagttggtggctctgggtcttttcagccaacattttaacctggctacatttaacaaacttgtttcttacagaaaagccatgtatcacgctctagagaaggcccgtgttcgcgctggtaaaacatttccttcgtcaccaggtgactctctggaggaccaacttaaaccaatgctcgagtgggctcatggtggcttcaagccgaccggaatcgagggcctcaaaccgaataacacccagcctgagaacaaaacaaggaggcgcactgcagacgacagcgcaactagtgactattgcccggcaccaaaaaggctcaagacaaattgttacaataatggcaaggaccgaggcgatgaggatcagagcagagagcagatggctagtgacgttgctaataataaaagttccttagaagatggatgtctgtcttgtggccgaaaaaatcccgtctccttccacccattatttgagggtggtctatgtcagacttgtcgcgatcgtttcctagagctgttttatatgtatgacgatgatggataccagtcgtactgcaccgtgtgttgcgaagggcgtgaactcttgttatgttccaatacctcctgttgtcgttgcttctgcgtggagtgcctcgaagtccttgtggggaccggcacagcagcagaagcgaagctgcaggaaccatggtcatgctacatgtgcttgccccagcgttgtcacggagtgctgcgcagaagaaaagattggaatgtgcggcttcaggcctttttcacaagtgatactgggcttgagtacgaggctccaaagttgtatccggctatccccgctgcaaggcgcagaccaattagagtgctatcgctgttcgacggcatagccactggctatctggttctgaaagaactgggtattaaggtgggaaagtatgtagcaagcgaggtgtgtgaggaatcaatagcagtgggtaccgtgaaacacgagggtaatattaagtatgtcaatgacgtcaggaatataacaaagaagaacatcgaagagtggggtccattcgatctagtgatcggaggaagtccttgcaatgatctcagtaacgtaaatcccgcaagaaaagggctgtacgagggcacgggcaggctgttcttcgaattctatcatcttctgaattactccaggcccaaagagggtgatgaccgccctttcttctggatgtttgagaacgtggtcgctatgaaggtgggtgataagcgcgatatctccagattcttagagtgcaatcctgttatgatcgacgcaatcaaggtttctgccgcacatagagccagatatttctggggtaatctccctggaatgaatcgccctgtaattgctagtaagaatgataagctcgaactgcaggactgtctggagtataacaggatagcaaagcttaagaaggtccagacaattacaaccaaatcaaacagcatcaagcaaggtaagaaccagctgtttccagtcgtcatgaatggtaaggaagatgttctctggtgcacagaattggaacgtatatttgggttcccagtgcactacacagacgtctcgaacatgggaaggggcgcaaggcagaagctgctggggagaagctggtcagtcccagttatccgtcacctgttcgcgcctttgaaagactattttgcatgcgaatag

SEQ ID NO: 221056 - DNA, 999 bp, Artificial Sequence
  Description of Artificial Sequence: Synthetic coding sequence
atgaagggagatacacgacacttgaacggcgaagaggacgcagggggacgcgaggacagtatactggtcaatggcgcatgtagcgaccagagcagcgattcacccccaattctggaggccatccggactcctgaaatcagagggcgtcggtcctcttctcgactctccaaaagggaagtcagctccctgctatcctacacgcaggatctgacaggcgatggggacggagaggatggagatggcagcgatactccggttatgcccaaactattccgcgaaacaagaacacgctctgaatcaccagcaagtcttcgtcgcagggccactgcaagtgctggaacaccctggcccagtcccccttcttcctacttaactatcgacctgacagacgatacagaggacacgcacggcacaccccagagcagttcaacgccatatgctcgcttggcacaagatagtcagcaagggggtatggagagcccccaggtcgaagctgactccggcgatggtgattccagtgaataccaggacggcaaagagttcggtattggcgatctcgtgtggggaaaaataaagggcttttcttggtggcccgctatggttgtgtcttggaaagccacgtccaagcggcaggccatgagcggcatgagatgggtccagtggtttggggacggcaaattctctgaagtgtctgctgataagttggtggctctgggcctgttttcccagcacttcaatctggcaacttttaacaagctggtgagttatcgcaaagcaatgtaccacgctttggaaagaacaagactagaagacgcgcagttgaccacccaaccacccctcaccacagcccctcatccaagcgcctctaggcagatcgctatcacaacagccaaaaccgagggcatgaaaattagagcagagaacaaatggctgcagatgctacccaccacccgggcagcttggaaggagaagccacgagttctcccccctagcctatag

SEQ ID NO: 221057 - DNA, 2187 bp, Artificial Sequence
  Description of Artificial Sequence: Synthetic coding sequence
atgaagggcgatacaagacacctgaacggagaagaggacgcaggcggacgggaagacagtattcttgtgaatggcgcatgctccgaccagtcctcggatagcccgcctattctggaggccattaggacgcccgaaattcgaggacgacgatcttcgtcccggttgagcaagcgggaggtgagttctttgctgtcttacacccaggatcttaccggggacggcgacggagaagatggcgacggatccgacacaccagtgatgcctaaactgtttcgcgagacacgcactcgctccgaatctcccgcaagcctgagacgcagagcaacagcctctgccggaacaccctggccatcacctcccagttcctatttgacaatcgacctgaccgacgacacagaggatacccacggaacccctcagagctccagtacaccatacgcaagactggcgcaagacagccagcaaggcggaatggaatccccgcaggtggaagctgattctggagatggcgactcatcagaataccaggacggaaaagaatttggtatcggagacctcgtttggggaaagattaaaggtttctcatggtggccagctatggttgtaagctggaaagccacgtcaaaacgtcaggcaatgtctggaatgagatgggtccagtggttcggcgatgggaagttctccgaagttagtgccgacaagctggtggcactgggactctttagccaacacttcaatcttgctaccttcaataagctagtatcgtataggaaggcgatgtatcacgccctagaaaaagctcgggtgcgcgctggtaagactttcccaagctcgccaggagactctctcgaagatcagctaaagcctatgctggagtgggcacacggaggttttaagcctactggcatcgagggactgaagcctaataatactcagcccgaaaacaaaacacggagacgcaccgcagacgactctgccacatccgactactgccccgctccaaagagattgaaaactaattgctataataacggcaaagacaggggagacgaagaccagagccgggagcagatggccagtgacgtggccaacaacaagtcttctttggaggatggatgtctgagctgcggcagaaagaaccccgtctcattccaccccttgtttgagggcggactgtgccagacttgtagggacagattcctggagctgttctatatgtatgacgatgatggatatcaaagttattgcaccgtgtgttgcgaaggccgagaactgttgctctgcagtaacaccagctgttgcaggtgcttctgcgtggaatgccttgaggtgctggtgggcacaggcaccgcagctgaggctaagctgcaggaaccctggagttgttatatgtgtctgccacagcggtgtcacggagtgctgaggcgccgaaaagactggaatgtgcggctccaggcgttcttcacctccgacactggactggaatatgaagctccaaagctctaccctgctataccagctgcaaggcggagaccgatccgggtcctgagcctttttgacgggatagccaccggttatctggtactgaaggaacttggaataaaggtcggtaaatatgtggccagtgaagtctgcgaggaatccattgctgtgggcacggtaaagcatgagggaaacattaagtatgtcaatgacgtacgaaatatcacaaaaaaaaacatcgaagaatgggggccattcgacttagtgatcggagggtctccctgtaacgacctgtcgaatgttaaccccgctcggaaaggtctgtatgaaggaaccgggcgactgttcttcgagttttaccacctgctcaactacagcaggcctaaagaaggagacgaccggccattcttctggatgttcgaaaacgtagtggccatgaaggtgggcgacaaacgggatatctctagatttttagagtgtaaccctgttatgatcgatgcaatcaaagtctcagccgctcatcgcgctaggtatttttggggaaatctgccaggaatgaatcggatttttggattccccgttcactatacggacgtgtccaatatgggccgaggggctcgtcagaagctgctgggcaggtcttggtccgtacctgtaatccgccacctcttcgctcctttgaaagattactttgcctgcgaatag

SEQ ID NO: 221058 - DNA, 2085 bp, Artificial Sequence
  Description of Artificial Sequence: Synthetic coding sequence
atgaaaggtgatacccgccatttaaacggggaagaagatgcgggaggcagggaagattccatcctggtaaatggggcttgctccgaccaatcctccgactcacctccgattctcgaggccataaggactcctgagatcaggggccgacgctcctccagtcgcttgtcgaagagagaagtttcttcactcctgtcatacacgcaatccctgcgaagacgcgctaccgctagtgctggtaccccctggccatctccgccaagctcttatctgaccatcgaccttacagacgacacggaggacacccacggaaccccccaatcctcttccactccctacgccaggctggcccaggatagccagcagggcggtatggagagcccccaggtcgaggccgactcaggagacggagatagcagcgagtaccaggatggaaaagagttcggtatcggggatttggtttggggtaagattaaaggcttcagttggtggcctgcaatggtggtgtcatggaaagctacgtccaagagacaggcgatgtccggaatgaggtgggttcagtggttcggagacgggaagttctccgaggtctccgctgataaacttgtggcgcttggcctgtttagccagcacttcaatctcgcaactttcaacaaattagtgagctaccgcaaggcaatgtaccacgcgctggagaaggccagggtgcgtgctggcaagaccttccccagctcacctggcgacagcctagaggaccaactaaaacctatgctggaatgggcgcacgggggttttaaacccacagggatcgaagggcttaagcccaacaacacccaaccggaaaacaagacccgacggaggaccgcagacgatagcgcaacgagcgactattgccctgccccaaagcgcctcaaaacaaattgctacaacaatgggaaagaccgtggggacgaggaccagagtagagagcagatggccagcgatgtagcaaataataagtccagtctggaggacgggtgcctgtcctgcggtcgcaagaacccggtttcctttcaccccctctttgagggcggattatgccagacttgtcgagatcgattcttggaactcttttacatgtacgacgacgacgggtatcagtcttattgcactgtgtgctgtgagggcagagaactacttctgtgcagcaacacttcatgttgcaggtgcttctgcgtggagtgtttagaagtgctggttggtaccggcacagctgccgaagctaagctgcaagaaccttggtcctgctatatgtgcctgcctcagcgctgtcacggggtgctgcggaggaggaaagattggaacgtcagattgcaggctttttttacctccgatactggattagagtacgaggcgccaaagctataccctgcgatacctgccgctaggaggagacccatcagggttctcagcctcttcgacgggattgcaacagggtacctggtcttgaaagaactgggaatcaaggttggcaaatatgtggcaagcgaggtttgcgaggaaagcattgccgtggggacagtgaaacatgagggaaacattaaatatgtgaatgatgtacgcaacatcacgaagaagaacatcgaggagtgggggccatttgacttggtaatcggcggaagcccatgtaacgacctgtctaacgtgaaccctgctaggaaagggctgtatgaagggaccggccgtctgttctttgagttttatcatttactgaactactcacgaccaaaggagggagatgacagaccatttttttggatgtttgaaaatgtggtggctatgaaggtgggcgataagcgggacatatcccggttcctggaatgcaatcccgtaatgatcgatgccatcaaggttagtgccgctcaccgggctcgctacttttggggcaacctcccaggaatgaatcgcatcttcgggtttccggttcattacacagatgtgtctaatatgggccgtggtgcacgtcagaaactgctggggagatcatggagtgttcctgtaatcagacatctgtttgcccctctgaaagactactttgcctgcgaatag

SEQ ID NO: 221059 - DNA, 1701 bp, Artificial Sequence
  Description of Artificial Sequence: Synthetic coding sequence
gggcgtagtccacggggtcggtctgaacgcccacccaccgatggcaccggctcactcgctgtgggtcgtgcaggcggtaacgccgctaggcccgcagccctcgggctctctggcccatcaaagccgagtagcgcgatcggagccggagatagccgggcacaaagaccagcacgccctccagccggactgccccctgcgtctccagacccccgactgagacgccctgccgctccccaaccagcactacggcaagagagtatgaaaggtgatacccggcacttaaatggagaggaggacgctggcggaagggaggactctatattagtcaacggggcttgcagcgaccagagcagtgattccccccctattctggaagctatccgaacacccgagatccgcggacggcgaagctcaagcagactgtccaagcgggaggtctcatccctgctgtcctatacacaggacctgacaggcgacggggacggggaggacggcgatggctccgacactccagtgatgcccaagctgttccgtgagacccgcactcggagtgagtcacctgccgttcgaacgcgcaacaacaatagcgtgtcttcccgcgagagacataggcccagccctagatctacacgagggcgacaagggaggaatcacgtagacgagagtcctgtggagtttcccgctacacgctcactccgtaggagagccaccgcctccgctggtaccccttggccctcgccaccatcctcctacctcactattgatctgaccgacgacactgaagacacgcacggaacaccacaatcaagcagcactccatacgcacgcctggcccaggatagccaacagggaggtatggaatccccacaggttgaggccgattccggagacggggactcatcggaatatcaagacggtaaggagtttgggatcggggatctggtgtgggggaaaatcaagggttttagctggtggcccgcaatggtggtgtcttggaaggccacatccaagagacaggccatgtcaggaatgagatgggttcagtggtttggggatggcaagtttagtgaagtatccgcggacaagttagtggccttgggcctgttctcacagcattttaacttggcaacattcaacaagctcgtgtcatatcggaaagctatgtaccatgctctcgaaaaagccagagttagggcaggtaagaccttcccctccagtccaggcgactctctggaggatcagctcaagccaatgctggaatgggctcatggcggattcaagccaacaggtattgagggcctaaagccgaacaatactcagccagaaaacaaaacccgccgtcgtacagctgacgactcagccaccagtgattattgtcccgctccaaagagattgaagactaactgttacaataacggtaaagatagaggcgacgaggatcagtcacgggaacagatggcttccgatgtcgccaacaataagagctccctggaggacgggtgcctcagctgtggacgtaaaaacccagtatcttttcatcctttgttcgaggggggactgtgccagacatgtaggcacctgtgtggtgactctgtgaagcccacccacccatcttgcctggcgctgtgcctatggggacgaatgggcgacagttgtcatagggggcagtggcacgccggacacagccagctcagtttctag

SEQ ID NO: 221060 - DNA, 1164 bp, Artificial Sequence
  Description of Artificial Sequence: Synthetic coding sequence
atggcggcaatcccagcactggatccagaagctgaaccttcaatggatgtgattttggtcggatcatcagaactatcctcaagcgtatccccaggtacgggacgagacctcattgcttatgaagtaaaggcaaatcagcgcaacatagaagacatttgtatttgttgcgggtcacttcaggtgcacacacagcaccctctgtttgaagggggtatctgcgctccatgtaaggacaagtttctggatgctctgtttctgtatgatgacgacggttatcagagttattgttccatctgttgttccggggagaccctgctcatatgtggaaaccctgattgcactaggtgttattgtttcgaatgtgttgacagcctggttggtccaggaaccagtgggaaagttcatgcaatgagtaactgggtatgttatctgtgcctgccctcttcacggtctggcctgctccagcgtaggcgaaaatggcgctctcagctgaaagcattctacgaccgagagagcgaaaaccccctggagatgttcgagactgtaccggtatggagacggcagcccgtgcgcgtcctgagtctttttgaggacatcaaaaaggagctgacatcactcggattcctagagtcaggctcagatcctggtcaacttaaacacgtggtcgatgttaccgataccgtgcgcaaagacgtggaagagtgggggccttttgatttggtgtacggtgctacccctcctttagggcatacttgcgatcgccctccgtcctggtacttgttccagtttcaccgtttactgcagtatgcaaggccaaaacccggtagcccccgaccattcttttggatgttcgtcgacaatcttgtcctgaacaaagaggatctcgatgtcgcgagcaggtttttagagatggaaccggtgaccattccagacgtccatggcggtagcttacagaatgcagtccgggtgtggtccaatatcccagccatccgttcctcacggcattgggccctggtaagtgaggaggaactctcccttctcgcacagaataaacagtcctccaaattagccgctaagtggcccacgaaactggtcaagaattgcttcctgcctcttagagagtacttcaagtatttctccaccgagcttacctcttcattatag

SEQ ID NO: 221061 - DNA, 1161 bp, Artificial Sequence
  Description of Artificial Sequence: Synthetic coding sequence
atggctgctattcccgcattagaccctgaggcagagccgtctatggatgtgattctggtgggttcgtccgagctgagcagtagcgttagcccaggaacaggacgcgacctgatagcttacgaagttaaggccaatcaacgaaacatcgaggatatctgcatctgttgtggatcacttcaggtccatactcaacacccactgttcgaaggaggcatctgtgcaccgtgtaaagataagtttcttgatgccctgtttctttacgacgacgacggttatcagagctattgtagtatctgctgtagtggagagaccctgctgatttgtggaaaccccgattgcaccagatgttactgcttcgagtgtgtggactctctggtaggcccaggcacttccggcaaggtgcatgccatgtccaactgggtctgttacttgtgcctgccgtcctctcgctctggtctccttcagaggaggcggaaatggcgcagccagctgaaggcgttttacgacagggagtccgaaaaccctcttgagatgttcgagaccgtgccagtctggcgcaggcagcccgtgcgggtacttagcctgtttgaagacatcaagaaggaactgacttcacttggctttctggagagcggatccgaccctggacaactgaagcacgtcgtagatgtgaccgacaccgtgagaaaggatgtcgaagaatggggacctttcgacctggtctacggagccaccccacctctggggcacacctgcgacaggcctccctcctggtatctgttccagttccataggctgctgcaatacgctagaccgaagcctggttcccccaggcccttcttctggatgtttgtcgataatttggttctgaataaagaggatctggacgtagcatcacgcttcttagagatggagcctgtgacgatacctgacgtgcacgggggttccttgcagaatgccgtccgcgtgtggagcaacatcccggcaatccgctcccgtcactgggctctcgtatctgaggaagaacttagccttcttgcccagaataaacagtccagtaagcttgcggctaagtggccaacaaagctggtgaaaaactgctttctccctcttcgggagtactttaagtacttttctaccgagctgacttcttctctgtag

SEQ ID NO: 221062 - DNA, 3123 bp, Artificial Sequence
  Description of Artificial Sequence: Synthetic coding sequence
atgttagaggacatcagtgaagaggatatttgggagtacaagtcaaagagaaagccaaaacgtgtagaccctaataatggtagcaagaatattctaaagtcagttgagaaggcaacagacggcaagtatcaatcaaaacgcagtcggaaccggaaacgggcagctgaagctaaagaagtaaaggatcacgaggtgcccctaggcaatgccggttgtcagacctcagtcgccagcagtcaaaactcctcatgcggggatggcatccagcagacccaagataaagaaaccactccagggaagctatgccggacccagaaatctcagcacgtttctcccaaaatccgccctgtttacgatgggtactgtcccaactgtcaaatgccattttcttccctcattggccagaccccccgttggcatgtttttgagtgccttgattctccgcctcgctcagaaaccgaatgtcctgacggtttgctgtgtacttccacaattccatttcactataaacgttacactcactttctcttagcacagtcccgagctggcgaccaccccttttcttctcccagcccggcaagcggcggaagcttcagcgaaacgaaatcaggggtgttgtgtagcctggaggaaaggtggtcttcctaccagaaccagacagataatagtgtctctaatgatcccctgctgatgacccagtacttcaagaaatctccttccctgaccgaggcctccgagaaaataagcacccacattcaaacgagccagcaggccctgcagttcaccgatttcgtcgaaaatgataaactggtaggcgttgccctgaggcttgcaaataatagcgaacacattaatctccccttgccagaaaacgatttttccgactgtgaaatttcctactccccattgcagtctgacgaagatacccacgacattgatgagaagccagacgactctcaagagcagctgttttttacagagtcatcaaaagacggtagcctggaagaggatgacgattcctgtgggtttttcaagaagagacatggtccactgttgaaggaccaggatgagtcttgtccaaaagttaactcttttctgactcgcgataagtatgatgagggactatacagattcaattccctcaatgatctatcccagcctatttctcagaataatgagtcaactttgccgtacgatttggcctgtaccggaggcgatttcgtgctttttcccccagcactagcaggaaaacttgccgcaagcgtgcaccaagcaaccaaggctaaacctgatgagcccgaattccatagtgcgcagagtaataagcagaaacaggttattgaggaatccagtgtctataaccaggtttccctcccactggtgaagtctctgatgcttaagccatttgaatcccaggtcgagggatatctctcttcacagcccacccagaatacaattaggaagctgtcatccgagaaccttaatgccaaaaacaatactaattcggcatgcttctgcagaaaagccctggagggcgtgccggtgggaaaggccactatcttaaatactgagaaccttagctctacgcccgctccgaagtaccttaaaatcctgcccagcggtctcaagtataacgcccgtcacccttccaccaaggtcatgaagcagatggatataggcgtatactttggactgccccctaagaggaaagaggagaagctgctcggtgaaagcgcactggaaggaatcaatctcaaccccgtgccctcccccaatcagaagcgcagcagccagtgtaagaggaaggcagagaagtcactctcagacctcgaattcgatgcctctaccctgcatgagagtcagctctcagtggagctttcaagtgagcgttctcaacgtcaaaaaaagcggtgcagaaaatctaactccctgcaggaaggcgcttgtcagaaaaggtcagaccatctgataaacacagaaagcgaagcagtcaatctcagtaaggtgaaagtgttcacaaagtctgcacacggcggactccagagaggaaataagaaaatccctgaaagcagcaacgttggcggatccagaaagaaaacctgcccgttttacaagaagattccaggcacagggttcactgtggacgccttccagtatggcgtcgtagaaggatgcacggcttactttcttacccacttccattctgaccactacgccggtctctcaaaacactttacgtttccagtgtactgcagcgaaatcactggtaatctgctcaagaataaacttcacgtgcaggagcaatacatccaccctcttccacttgacacagaatgcatcgtaaacggtgtgaaggttgttctgcttgacgctaatcattgtcctggcgcagtcatgatactgttttaccttcccaatggcacagtaatcctgcacactggagactttcgggcagacccctccatggagaggtcactccttgcagaccaaaaagttcacatgctgtatttggacaccacgtattgctcccccgagtacacctttccatctcaacaggaggtcattagattcgcaatcaacactgctttcgaagccgtcacactcaatcctcacgccctagtagtttgtggtacgtattccatcgggaaggagaaggtgtttcttgccattgcagacgtcctaggatccaaggtgggtatgtctcaggagaagtacaaaaccttgcaatgtctcaacattcccgaaattaacagcctcatcactactgatatgtgcagctcactagtgcacttgttgcctatgatgcagattaatttcaaaggactgcagtcacatcttaagaagtgcggcggaaagtataaccagatcctcgcatttcgccctaccgggtggactcactctaataaatttactagaatagcagacgtgatccctcagacaaagggcaacatttctatctacggcatcccttattctgaacacagctcttacttggagatgaagcgcttcgtgcagtggctgaaacctcaaaagattataccaactgtgaatgttggcacgtggaaatctcgctcgacaatggaaaaatattttcgggaatggaagctagaggcagggtactag

SEQ ID NO: 221063 - DNA, 3123 bp, Artificial Sequence
  Description of Artificial Sequence: Synthetic coding sequence
atgctagaggacatttccgaagaagatatatgggagtataaatccaaacgaaagcctaaaagggtggatcctaataatggcagcaaaaacattttgaagtcggtagagaaagctaccgatggaaagtaccagtcaaaacgatccagaaaccgcaagagggctgcggaagccaaagaagtgaaagatcacgaggttccgctcgggaatgccggatgtcagacgagtgtcgcgtcttctcaaaacagctcttgcggcgatggaatccaacagacgcaggacaaagaaactactccgggaaagttatgtcgcacacagaaaagccagcacgtgtcgccaaaaattagacccgtctacgatggttattgtccgaactgtcaaatgccatttagcagcttgattggccagactccgaggtggcacgtgttcgagtgcctggacagccctccgcgaagtgaaactgagtgccctgatggactactgtgcaccagcacaattcctttccactacaaacgttacacacactttttacttgcccagagcagagcaggggaccaccccttttctagtccatcacccgctagcggagggtcattttccgagaccaagagcggtgtcctctgttctcttgaagagcggtggagctcataccaaaaccaaaccgacaacagcgtctccaatgatcccttgctgatgacccaatatttcaaaaagtccccatctctgacggaggccagtgaaaaaatctctacccatattcaaacatcacaacaggccctgcagttcaccgattttgttgaaaatgataagttggtgggtgtagccctgaggcttgcaaacaactcggagcatatcaatctgccactgcctgagaacgatttctctgattgcgagatctcatactccccactgcagtctgacgaggacactcatgatatcgatgaaaagccagacgacagccaggaacagttgttcttcacagagtcaagcaaagacgggagtctggaggaagacgatgatagctgcggattttttaaaaaaaggcacggccctctgcttaaggaccaggacgagagctgtcccaaggtgaacagctttcttactagagacaagtacgatgaagggctgtatcgcttcaactcacttaacgacctgtctcagcccatatcccagaataacgagtccacactcccttacgatctcgcatgcaccggaggcgattttgtgttgttcccaccagcacttgccggaaagttggctgcctctgtacatcaagcaacaaaggccaagcctgatgaacctgagttccatagtgcacagtctaataaacaaaagcaagttattgaggagagctcagtctacaatcaggtgtcgttgcctctggtgaagagtctgatgcttaagccctttgaatcccaggtcgaaggttatttatcgtcacagcccacccaaaatacgatcagaaaattgagttctgaaaatctgaacgccaagaataacaccaattcagcctgcttttgtcgaaaggctctcgagggtgtgcctgtgggaaaggctactatcttgaacaccgagaatctgtctagcaccccagcgcctaaatacctgaagattctgcccagtgggcttaaatacaatgcgcgtcatccgtccaccaaggttatgaaacaaatggacattggggtttactttggcttaccaccaaagcggaaagaggaaaaactgctaggtgagtctgctctggagggcatcaatctcaatcccgtcccatcccccaaccaaaaacggagttcacagtgcaagaggaaggccgaaaaatcactgagcgacctggaattcgacgcatctactctgcatgaatctcaacttagcgtggaactatcctccgaacgcagtcaacgccagaagaagcggtgtcggaagtcaaattctcttcaggaaggagcctgccagaagaggtcagatcacttgataaacacagagtcagaggccgtgaatttatccaaggttaaagtcttcaccaagagtgctcacggaggtctgcagcggggtaataagaaaataccagagtcttcaaacgttggaggatctcgcaagaagacttgcccattctacaaaaaaatccctggcacgggtttcacagtcgatgctttccagtatggcgtggtcgaaggctgtaccgcttacttcctgactcacttccactcagatcactatgcaggcttgagcaagcacttcacatttccggtttattgctcggagatcaccgggaacctgctgaagaacaaacttcatgtacaggagcaatatatacatcccttgcccctcgacacagagtgcatcgtgaatggagtgaaagtagtacttctggacgcaaatcactgtccaggagccgtcatgatattattttacctgccaaacggaacagtgattttgcataccggggactttcgagcggatccttctatggagcgttccctcctcgccgaccagaaggttcatatgctgtaccttgataccacttactgctcaccagagtacacctttccctctcagcaggaagtgattcgctttgctatcaacaccgcctttgaggctgtgacactcaaccctcatgcacttgtggtgtgcgggacctatagtatcggcaaggaaaaagtgttcctcgcgatagcagacgttctgggatccaaggttggcatgagccaggagaagtataaaactctgcagtgtctgaacatccctgaaattaattccctgatcactactgatatgtgcagctctctggtgcacctgttgcccatgatgcagattaattttaagggactgcagtcacatttaaagaagtgtggaggaaaatataaccagatcctcgcttttcggcctactgggtggacccattcaaataagtttacacgcattgcagacgttatcccccagactaagggaaacatctctatctatggcatcccctatagtgaacactcctcatatctggaaatgaaacgcttcgtgcagtggctgaaaccccagaagattattcccacagtgaacgtggggacgtggaaatccagaagcaccatggagaaatactttcgcgagtggaagctggaagctgggtactag

SEQ ID NO: 221064 - DNA, 813 bp, Artificial Sequence
  Description of Artificial Sequence: Synthetic coding sequence
atgctgcagaaacccaagagtgttaagttacgggctttgaggagtcctcgtaagtttggtgtggccggacgctcctgtcaggaggtcttgagaaaggggtgtctgagatttcagctgcctgaacgaggatctagactctgcctatacgaggatggcaccgaactgacagaagattatttccccagcgttcctgacaacgctgaattggtgctcctgacactgggtcaggcctggcagggctatgtgtctgacatccgcaggtttctcagtgcgttccacgagcctcaagtgggcctgatccaggccgcacaacaactgctttgcgacgaacaggccccacagaggcagcggctgctggcggacctcctgcacaacgtcagccagaacattgccgcagagactagagcagaagacccaccttggttcgaaggcctcgagagcaggttccagtctaaaagtggatacttgcgttattcctgtgaatcaagaatccggtcctatctgcgcgaggtaagctcctacccaagcacagtgggggctgaggcccaggaggagtttttacgtgtcctgggtagcatgtgccagcgtctaaggtcaatgcaatataacggctcctatttcgacagaggtgccaagggcggttccaggctttgtaccccagaggggtggttttcatgtcagggaccttttgacatggacagctgtctctcaagacactctatcaacccatatagtaacagggagagcaggatccttttctccacatggaatcttgaccacattgatggggtcctactatgtggcccaggctag

SEQ ID NO: 221065 - DNA, 825 bp, Artificial Sequence
  Description of Artificial Sequence: Synthetic coding sequence
atgtgccttctgcttgacagacatcttctctttgttcctctggtggccgatgtaagcgacattcggcgattcttgtccgccttccatgaaccccaagttggcctgattcaagccgcacagcagctgctgtgtgatgaacaagccccacagagacagcggctgctggcggacctcctgcataacgtgtctcagaacattgcggctgaaactcgggcagaagatccgccatggttcgaagggctcgaatcaagattccagtcaaagagcggatacctgagatattcctgcgagagtaggatcagatcctacctacgcgaggtgagtagctatccttccaccgtgggcgctgaggcccaggaagagtttttgagagtactcggaagcatgtgccagcgcttgcggtccatgcagtataatggaagctatttcgaccgaggcgcaaagggcggatcgcgtttgtgtacgccagagggctggtttagctgccagggccctttcgacatggattcttgcctgtctcggcactccataaatccttattcgaatagagagagtagaattcttttttccacatggaacttggaccacattattgagaagaaacggactatcatcccgactctggtggaagccatcaaggagcaggacggacgcgaggtggattgggaatacttttacggtctgctgtttactagtgagaaccttaaacttgtgcacatagtctgccacaagaaaaccactcacaaattaaattgtgatcccagcagaatttataagccacaaacacgcctaaagagaaagcagcccgttagaaagaggcaatag

SEQ ID NO: 221066 - DNA, 312 bp, Artificial Sequence
  Description of Artificial Sequence: Synthetic coding sequence
atgctgcagaagcctaaatctgtcaagctgcgggctctgagatcgcccagaaagttcggcgtggcgggacgatcctgtcaggaggtgctgcgaaagggctgcttacgcttccagctccctgaacgcggaagccgcctttgcctgtacgaggacggcacagagcttaccgaagactactttcccagcgtcccagacaacgcagagctagtcctcctgactctcgggcaggcctggcaggggtggtttcgccatgtcagccaggatagcctgacacttctgggcagctcctgtcccccagcgttggtctcatag

SEQ ID NO: 221067 - DNA, 825 bp, Artificial Sequence
  Description of Artificial Sequence: Synthetic coding sequence
atgtgtctgctgttggaccgacacctgctcttcgtgccactggtggccgacgtttctgacatacggcgtttcctctcagccttccacgaaccacaggtgggtttaatacaagcagcccagcagctcctctgtgacgagcaagcaccccagcgccagcgccttttggcggacctcctgcacaatgtatcgcaaaacatcgcagccgagactcgtgcagaagaccctccatggtttgagggcctcgaatctagatttcagtctaaaagcggttatctgcgatatagttgcgaaagtcggatcaggtcttatctgcgcgaggtcagcagctaccccagcaccgtgggagccgaggcccaggaggaattcctgcgcgtgctggggagtatgtgtcagaggctcaggagtatgcagtacaacggatcctactttgaccgtggtgctaaaggtggcagtaggctgtgtacaccagagggatggttttcttgccaaggtccatttgatatggatagctgtcttagcagacactctattaatccttactctaacagagagagtaggatactgttctcgacatggaacttagatcatattatagaaaaaaagcgcactataattcctaccctcgtcgaggccataaaggaacaggacggacgcgaggtcgattgggagtatttttatggattactgttcactagcgagaaccttaagctggtgcacattgtatgtcataaaaagaccacccataaactgaattgcgatccgtctcgaatatataaaccgcagacccggctcaagagaaaacagcccgtgaggaagcggcagtag

SEQ ID NO: 221068 - DNA, 1017 bp, Artificial Sequence
  Description of Artificial Sequence: Synthetic coding sequence
atgctgcagaaaccaaagtcggtaaaactaagggccctcagaagcccacggaaatttggagtagctgggagatcttgccaggaggttctgcgcaagggctgtctgcgcttccagctgcctgagagaggtagcaggttgtgtctgtatgaggacggcaccgaactgacagaggactatttccctagcgtccccgataacgctgaacttgtactgctcactctgggtcaggcctggcagggctacgtgtctgatatccggcgtttcctgtcagcattccacgaacctcaggtgggtctgatacaggcagctcaacaattgctgtgtgacgaacaagcccctcagcggcagagactcctcgctgatctgctgcataatgtctcccagaacatagctgcggagactagagccgaggaccctccttggtttgagggcctcgaatcacggttccaatcaaaaagtggctacctccggtactcctgcgagtcccggataaggtcctacctccgcgaagtgagtagctacccttctaccgtgggggctgaggctcaggaagaatttctccgggtcctgggctccatgtgtcagagactccggtcaatgcagtataacggcagctacttcgaccgcggagctaaagggggttcccggctgtgtacgcctgagggatggtttagctgccagggacctttcgatatggatagttgtctctcccgccactcaattaatccgtactcgaatcgggagtcccggattctcttttccacctggaacctggaccacataattgagaagaagcgaaccataattcccactttagtggaagcgattaaagaacaagatggcagggaggtagactgggagtacttctacggccttttgtttacttctgaaaatcttaagctggttcacattgtgtgtcacaaaaaaacaacgcataagcttaactgtgatcctagtcgtatctacaaaccgcagacgcggctaaagcgtaagcaacctgttagaaagcgtcagtag

SEQ ID NO: 221069 - DNA, 351 bp, Artificial Sequence
  Description of Artificial Sequence: Synthetic coding sequence
atgctgcagaaacccaagagcgtgaagctcagagcgctgcgtagccctagaaaattcggtgtagcgggtagaagctgtcaggaagtgcttcgcaaaggttgtctgcgattccagctacctgagagaggttcccggttatgtctttatgaggatggcaccgaactgacagaggattacttcccgtccgttcctgacaatgcggagctcgtgctcctcactttggggcaggcttggcaaggcagcgtgggtgtgcgcgctcgaacaaagacgcgagacacttcatctctcagcccaggcgattgccaggccctgggcaacgggggacgatgtgggcagcggctgtttctgtag

SEQ ID NO: 221070 - DNA, 261 bp, Artificial Sequence
  Description of Artificial Sequence: Synthetic coding sequence
atgcttcaaaagccaaaatcagtgaagctgcgcgctttaaggtcacctcgcaagttcggggtcgctgggagatcttgccaggaggtgctgcgcaaaggctgcctcaggtttcagttaccggaacgcggatcgcggctctgcctctatgaagatgggaccgagctgacggaagattacttcccaagtgtcccagataacgcagaacttgtgctgttgaccctggggcaggcctggcagggatgttggagtgccgtcgcatag

SEQ ID NO: 221071 - DNA, 249 bp, Artificial Sequence
  Description of Artificial Sequence: Synthetic coding sequence
atgttacagaaacctaaatccgtcaagctgcgggcacttagaagccccaggaagttcggtgtcgccggtagaagctgtcaggaggtccttcgcaaagggtgtctgcggttccagcttcccgagcgaggcagccgcctttgcttgtatgaggatggtactgaattgacggaagactacttcccctcagttcccgacaatgcagagcttgtgctgttaactctggggcaggcgtggcaggggtgcgagtag

SEQ ID NO: 221072 - DNA, 813 bp, Artificial Sequence
  Description of Artificial Sequence: Synthetic coding sequence
atgctccagaagcccaaatccgtcaaattaagagctttgaggtcccccagaaaatttggtgtagcaggtcggtcttgtcaggaagtcctgcggaaagggtgcctccgtttccagctgcccgagcgcggaagccgcctgtgcctgtatgaggatggtaccgagttgaccgaagattatttcccatctgtgccagacaacgctgagctggtacttcttactctcggccaggcttggcaaggatacgtgtctgacataaggcgcttcctttctgcttttcacgaaccacaggtgggcctgatacaggcagcccagcagctgctgtgtgatgaacaggctccccagaggcagcgtctccttgccgacctgctccacaatgtgagtcagaatatcgctgcagagactcgcgcagaagacccaccctggttcgagggattggaatcccgattccagtccaaatctggctacctgaggtacagctgcgaatctaggatccgcagctatctgcgcgaggtgtcgtcctaccctagtactgtgggagccgaggcacaggaagagtttctgcgcgtgttagggtctatgtgccaacgcctgcgcagcatgcagtacaatggcagctacttcgaccgaggcgcaaaaggcggtagtaggctgtgcacaccagagggatggttcagctgccaaggcccttttgatatggattcttgcctctcacggcattctatcaacccttattcgaatcgggagagcaggatactgttctcaacctggaacctggaccacatcgacggcgtcttgctctgtggtcccggatag

SEQ ID NO: 221073 - DNA, 3183 bp, Artificial Sequence
  Description of Artificial Sequence: Synthetic coding sequence
atggagcagctgaacgaactcgagctgttaatggagaagtctttctgggaggaggccgagctcccagcagaactgttccaaaaaaaggtagtggcatcctttccccgtactgtgttgagtacgggaatggataaccgctacttggtcttggctgttaatacggttcagaataaagaagggaactgcgagaaacgcctagtgattacagctagccagagtctagaaaataaagaactgtgtatcctgcgtaacgattggtgtagcgtgcccgttgaaccgggtgacattatccacctggagggtgattgcacatccgatacctggataatcgacaaagattttggctacctcatactgtacccagatatgctgatcagtgggacgtccatcgccagctctatccgatgtatgaggagagcggtactgagcgagaccttcagaagtagtgatcctgctacccgccagatgttaattgggactgtcttgcacgaagttttccagaaagcaatcaacaactcctttgccccagaaaagctccaagagctggcttttcagactatacaggagatccgtcacctcaaagagatgtacaggttgaacctgtcccaggacgagataaaacaggaagtggaggattacctgccaagcttttgtaagtgggctggcgattttatgcacaagaacacaagcaccgacttccctcaaatgcagctgtcacttcccagcgacaattccaaggataatagcacttgtaatatcgaggtcgtgaagccaatggacatcgaggaaagtatctggtcccccaggtttgggctgaaggggaaaatcgacgtaactgtcggggtcaagattcacagggggtacaagactaagtacaagatcatgccattggaactcaaaacaggtaaagagagcaacagtatcgaacatcgatcacaggttgtactatacaccctcctctcgcaagagcggagagcagatccagaggccggattgttactgtatctcaaaacaggacaaatgtatcctgttccggcaaatcacttagataagcgcgaactcctgaagctgcgcaaccagatggcctttagcctgttccatcgtatttcaaaatccgctacaaggcagaagactcagctggcttccctgcctcagatcattgaggaagaaaaaacttgcaaatactgctctcagattgggaactgcgccctgtactcccgtgcagtagagcagcaaatggattgctccagcgtgccgatcgtaatgctaccgaaaatagaagaggaaactcaacacctgaaacaaacccacctcgagtatttcagcctctggtgcctaatgttaacgctggaaagccaatccaaagataataagaaaaaccatcagaatatatggctgatgccggcatctgaaatggaaaagagcggcagttgtataggcaacttgatccggatggagcatgtgaagattgtatgtgacggccaatacctgcacaatttccaatgtaaacacggcgctatcccagtaacaaacctcatggccggagaccgggtaattgtgagcggagaagagcggtctctgtttgcactctcacgcggttacgttaaagagatcaatatgactacagtaacatgcctgttggatcgcaacctgagcgtgctgccagaatcaacactctttagacttgaccaggaagaaaaaaattgcgacattgacacacctttgggcaatttgagtaagctgatggagaatacattcgtgtctaaaaagctccgggaccttatcatcgattttcgggaacctcagtttatctcctatctgtcctctgttcttccgcatgacgctaaggacaccgtggcatgcatattgaaaggcctgaataagcctcaaaggcaggctatgaaaaaggtactcctgagcaaggattacacactcattgttggcatgccgggaactggtaaaacaactaccatctgtaccctggtgcgcattctctatgcctgtggcttctccgtgctgttaaccagctacacccatagcgcagtagataatatactccttaagctagctaaattcaagataggcttcctccgtctggggcagatccaaaaggtgcacccagctattcaacagttcacagagcaagaaatctgtagatctaaatctattaagtccttggctcttttggaggaactgtacaacagccagttgatcgttgcaactacgtgtatggggattaatcaccctatctttagtcgaaagatcttcgacttctgtattgtggacgaggctagccaaatctctcagccaatctgcttgggacccctgttcttcagccggcgattcgttctggtgggagaccatcagcagttaccgccactggtactcaacagggaggctcgggctctgggtatgtcagagagcctctttaaacggcttgaacagaacaagtctgccgtggtacaacttacagtccagtacagaatgaacagcaaaatcatgagcctgtccaacaagctcacttatgagggcaagttagagtgcgggtctgacaaggtggctaatgcggtgatcaaccttcgccacttcaaagacgtgaagttggagctggagttctacgccgactatagcgacaatccttggctcatgggagtgttcgaacctaataaccccgtttgtttccttaacaccgataaggtgcctgcccctgagcaggtggaaaaaggcggtgtgtctaatgtcaccgaggccaaactgatcgtctttctgacatccatctttgtcaaagccggatgtagcccgtccgatattggaatcatagcaccgtacagacagcagctcaagataataaacgacctgctggcccgaagtattgggatggtagaagtcaatacagtcgataagtatcagggcagagacaagagtattgtccttgtgtctttcgtccgctctaataaggacggcactgttggagaacttctgaaggattggagaagattaaacgtggccataacacgagctaagcacaagttaattctgttaggatgtgtaccttctctcaactgctaccctccgctagagaagttgctgaatcatttgaacagtgaaaaactgattattgacctcccttcaagagagcacgaatcactgtgtcacatcctgggagattttcagagggagtag

SEQ ID NO: 221074 - DNA, 2469 bp, Artificial Sequence
  Description of Artificial Sequence: Synthetic coding sequence
atggaacagttgaacgagctggagttgctgatggagaagtcattctgggaggaagctgagctccccgcagagttgttccagaaaaaagtcgtcgctagctttcccaggactgtcctgagtacagggatggacaatcgctatctggtcttagcagtaaatacagtccagaacaaagaaggcaactgcgaaaaaagattggtgattaccgcttctcagagcctggagaacaaggaactgtgtatcctacggaacgactggtgttccgtgccggtggagcccggagacatcattcaccttgagggagattgtacctctgatacctggataattgataaggattttggctatttgatcctgtatcccgatatgctgattagcggcacttcaatcgccagctccatccgctgtatgagacgggcagtccttagtgagactttcaggtcctcggaccccgctacacgtcaaatgcttattggcaccgttttgcatgaagtctttcagaaagccataaataacagctttgcccctgagaagctgcaggaattagcatttcagacaattcaagaaattcgccatctgaaggaaatgtatcgcctaaatttatcccaggacgaaattaaacaggaggtcgaggactacctgccttctttctgcaaatgggcgggagactttatgcataaaaacacaagtacagattttccacaaatgcagctctccctgccttctgacaacagtaaagataattccacctgtaacatcgaggtggtgaagcctatggacatagaagagtccatatggtccccacgctttgggctgaagggaaagattgacgttacagtgggggtgaaaatccacaggggttacaagactaagtacaagattatgccactggaactcaagactggaaaagaatcgaacagcattgagcataggagccaggttgtcctgtacacactcctttcccaagaacgcagggccgatcctgaagctgggttactgctgtacctgaagacaggtcagatgtatccagtaccagcgaatcacctggacaaacgggagcttctaaaactacggaaccagatggcgttctcactttttcatcggatctctaagtctgccacacggcagaaaacacagcttgcatctctgccgcaaattattgaagaggaaaagacctgcaaatattgctctcagattggaaattgcgctctgtactctcgcgcagtggagcagcagatggattgcagctctgtgcccattgttatgctacccaagatcgaggaggaaactcagcacttgaaacagacccatctggagtacttctccttgtggtgtctaatgctgaccttagagtcgcagagtaaggataataagaaaaaccaccagaatatctggctgatgcccgcttctgagatggagaagagcggtagttgcattgggaatctgatccgaatggaacacgtaaaaatcgtctgtgacggccagtacctgcacaattttcaatgtaagcatggtgccatcccggtaacgaacctgatggctggtgatcgagtgatcgtgtctggcgaagaaagatctctgtttgctttatctagaggctacgtaaaagagattaacatgacaactgtgacctgtctgctagatcggaatctctccgtgctgcctgaatctactttgtttaggctcgaccaggaagaaaagaactgcgacatagatacacctctggggaatctttccaaattgatggaaaatacgttcgtgagcaagaagctccgcgatctgatcatcgacttccgggaaccacagttcatcagctacttgtccagcgtcctcccacatgacgctaaggatacagttgcctgtatcctcaagggactcaataagccccaacgacaagctatgaaaaaagtccttctgagcaaggactatacccttatcgtggggatgccaggcacgggcaagaccacaacgatctgtactttggtgcccgctcccgaacaagtggagaaaggaggagtgagtaacgtcaccgaggctaagctgatcgtctttttgaccagcatcttcgtgaaggctggctgctctccgtctgatatagggatcattgcaccttacagacagcagctgaaaattataaacgatttactcgcccgttccatcggcatggtagaagtgaatacggttgataagtatcaaggacgggacaagtctatcgtactggtgtcatttgtgagatccaataaagatggaacagtaggagaactcctgaaggattggaggaggctgaatgtggcgatcactcgggctaagcacaaattgattttgttaggctgtgtgccttcactcaactgttatcccccactcgagaaactcctgaaccacttaaactccgagaagttaattattgacctcccaagtagagagcacgaatccctttgtcacatcttgggtgatttccagagagaatag

SEQ ID NO: 221075 - DNA, 3441 bp, Artificial Sequence
  Description of Artificial Sequence: Synthetic coding sequence
atgaaaacgccttgcataccatcaccaaagcaggggtcaaagggcagaggccaatcaccagccgctcaagttcgaggcccaacgtggaatgcccctgctcgcgaaggacgacccggtgctgggcatctgggtcacctgcgggtgggcgcttgtgcaagaggcgctcaggcccgagcatttttcccgttcttgagtttcctttgttatcctaggtttcggtgcttgttctgccttcagttcgctattcctgcctcgaggatggagcaacttaatgaacttgaactcctgatggagaagagcttttgggaggaagctgagcttcccgctgagctctttcagaaaaaagtggttgcctcttttccaaggacagtgctgagcacaggaatggacaaccgttaccttgtacttgcagttaacaccgtccagaataaagaaggcaactgtgagaagcgactggtcataaccgcaagtcagtcactggagaataaggagctgtgtattctacgtaatgattggtgctcagtgcccgtcgagcctggggatattattcacctggagggggactgtacctctgacacctggatcattgataaggatttcgggtatctaatcctgtatcctgacatgctcatcagcggaacctccatcgcgtcgtcaattaggtgtatgcgcagggccgtgctttcggagacctttagaagcagcgatccagcgacccggcagatgctaatcgggactgtgctgcacgaggtgttccagaaagccatcaataacagttttgcccctgagaagctccaggagctcgcttttcagaccatacaggagattcgccaccttaaagagatgtatagactgaacctcagccaggacgagatcaaacaagaagtggaggactatctcccttctttttgcaagtgggcaggcgactttatgcacaagaatacctccacggattttccccagatgcaactgagcctcccatccgataatagcaaggataatagtacctgtaatattgaggtagtcaagcccatggacattgaggagagcatctggagccccagatttggtctgaaggggaagatcgatgtcaccgtcggtgtcaagattcaccggggttacaaaaccaagtataaaatcatgccattagaactgaagacaggaaaagagtctaattctattgagcatcggagccaagtcgtgctttatactctgttaagtcaggaaagacgtgccgatccagaggcaggcctgttattatacctgaagacaggccaaatgtaccccgtaccggcaaaccacctggacaaacgggagttactaaaactccggaatcagatggcgttttccctctttcataggattagcaagtctgcaacccggcaaaaaacccagttggcatctttgcctcagattattgaggaggagaaaacctgtaaatattgctctcaaataggtaattgtgcgctgtactcacgtgccgtcgagcagcagatggactgttccagcgtgcccatcgtaatgctgccgaagatagaggaagaaacacaacatctgaagcagacacatctggaatattttagtctttggtgcctgatgttgactctggagagccagagtaaagataataagaagaaccatcaaaacatctggctcatgcctgcctctgaaatggaaaagtcaggctcatgcattggaaacttaattagaatggagcatgttaagatcgtctgcgatggacagtaccttcacaacttccagtgtaagcacggtgcaatccccgtcacaaacctcatggctggcgacagagtgattgtgtctggtgaggaacgttccctttttgctctttcccgcggttatgttaaggagatcaatatgaccacggtgacatgtctgcttgacagaaatctgagcgtactacccgagagcacactgtttagactcgatcaggaggaaaagaactgtgacatcgacacccccttaggcaatcttagtaaacttatggagaatacctttgtctctaaaaaactacgtgacctaataatcgactttcgcgaacctcagtttatcagctatctctcctccgtgctgccccacgacgcaaaagataccgttgcatgcatcctgaaggggttaaacaagccacagcgccaggctatgaagaaggttctgctttctaaagactataccctgattgtcgggatgcccggaacaggaaaaacaaccactatctgcacactcgtccggatcctctacgcttgtgggttttccgtactattgactagctatactcacagtgcagtggataacatcctactgaaacttgccaagtttaaaattgggtttttgcggctcggccagatccaaaaggtgcacccggcaatccagcaattcaccgagcaggaaatctgccggagcaagtccattaaatccctggcactcctggaggaactgtacaattcccagttgattgtggcaacgacctgtatggggataaatcatccaatcttctctcgaaagatcttcgatttttgtatcgttgacgaagcgtcccagatctcccagccaatctgtctgggtccattattcttttcccgcagatttgtgctcgtgggcgaccatcagcagctgccccctctggtcctgaatcgcgaggctcgagctttgggcatgagtgagagcctattcaaaagactcgagcagaataagagcgctgtggtgcaacttacagtgcagtaccgcatgaactcaaagatcatgagcctgtcgaacaaactgacttacgagggcaaactcgagtgtggatccgataaagtagcaaacgcagtgatcaatctccgccatttcaaggacgtgaaactggagctcgaattttatgctgattactcagacaacccttggttaatgggggtcttcgagccaaacaaccccgtttgctttctgaataccgataaagtgccggcaccagagcaggttgagaaggggggagtgagtaatgtcacagaggctaaattaatagtgttcttgacttcaatcttcgtgaaagcagggtgttcgccatcagacattggcattatcgccccatatcggcagcagctgaagatcataaacgatctcctggcgcgtagtataggcatggtcgaggtcaacaccgtagataaataccagggtagagacaagagcattgtcctggtgagctttgttcggtctaacaaggacggcaccgtgggggagcttctgaaggactggagacgccttaatgtcgctataactcgcgcaaagcataagcttattctgctcggatgcgtgccaagcctcaactgttaccctcctctggagaaattgttgaaccatctgaactcagaaaaactcattatcgaccttccatcacgcgaacacgagtccctctgtcatattttaggggacttccaaagggaatag

SEQ ID NO: 221076 - DNA, 717 bp, Artificial Sequence
  Description of Artificial Sequence: Synthetic coding sequence
atgctgtgctttctcaggggcatggcctttgttccgttcttgttagtcacgtggagctcagcggctttcatcataagctacgtcgtggccgtgctgtcaggtcacgtcaatccttttcttccttacattagcgacaccggaaccacacctccggagtctggtatttttgggttcatgattaatttcagcgcatttctgggcgctgccacaatgtacactcgctacaaaatcgtgcagaagcagaaccagacatgttacttctccactccagtgttcaacttggtgagtctcgttctcggtttggtagggtgcttcgggatgggcatcgttgccaattttcaggaactggctgtgccagtggttcacgacggaggcgctctgctggcattcgtatgcggcgtcgtatacacccttctgcagagtataataagctataagtcatgcccccagtggaactccctctcaacctgccacataaggatggtcatcagtgccgtatcctgcgctgcagttatcccgatgattgtgtgtgccagcctgattagcatcactaagctcgaatggaaccccagagaaaaagactacgtttatcacgtggttagcgctatttgtgagtggacggtggccttcgggtttattttttactttctgaccttcatacaggacttccaaagcgtgactctgcgcataagtaccgagattaacggggatatctag

SEQ ID NO: 221077 - DNA, 801 bp, Artificial Sequence
  Description of Artificial Sequence: Synthetic coding sequence
atgtggtggtttcagcagggtctctcattcttgccttcggcgctagtgatctggacctcagctgcattcatattctcatacatcacagctgtcacattacatcacatcgacccggcactgccatacatctccgacacagggacggtggctcctgaaaaatgcctttttggcgctatgctcaacatcgccgctgtactgtgtatagccacaatctatgtgaggtacaaacaggtgcacgccctatcacccgaggaaaatgtgataattaaattaaataaggccggtctcgtactgggcatcttatcttgtctcggtttatcaatcgtggcgaattttcagaagaccaccctgtttgcggctcacgtttcaggtgccgtgctgacatttggaatgggatctctgtacatgttcgttcagacaatcctgtcttatcagatgcaaccgaagatccacgggaagcaggtgttttggattagactgctactcgtgatatggtgcggggtgtccgccctgagcatgctgacctgcagtagcgttctacattctggtaattttgggaccgatctggaacagaagctgcactggaatcctgaggacaaaggttatgtgctgcacatgataacaacagccgctgagtggagtatgagcttttctttttttggattctttctgacttatatccgggatttccagaagattagcttgagagtagaagccaatcttcacggcctcacattgtatgacacggccccatgtccaatcaacaacgaacggacccgtttactgagtcgcgatatctag

SEQ ID NO: 221078 - DNA, 801 bp, Artificial Sequence
  Description of Artificial Sequence: Synthetic coding sequence
atgtggtggtttcagcagggactgagtttcttaccttctgctcttgtgatctggaccagcgctgcttttatcttctcttatattacggctgtcacactgcatcacattgacccagccctcccttacatcagcgatacaggcacggtagctcctgaaaaatgtctgtttggggcaatgttaaacatcgccgctgtgttatgcatcgccacaatatatgtgcgttacaagcaggtgcacgctctgtcccccgaggagaacgtcatcattaaactgaacaaagcaggactggtcctgggcatactctcctgcttgggcctgtcaatcgtggccaatttccaaaagacaacgctgttcgctgcacacgtgtcaggagcagtgctcacattcggcatgggttcactctatatgtttgtgcagacaatccttagttaccaaatgcagcccaaaatccacggaaaacaagtcttttggatccgcctcctgttagtgatctggtgcggggtctccgccttatctatgttgacatgctcatcggtattgcactctggaaacttcggaacagatctggagcaaaaactgcactggaaccctgaggacaaggggtacgtcctccacatgattacaaccgctgccgaatggtccatgtccttttcatttttcgggttctttctgacttatattcgcgactttcagaaaatttctctgcgcgtggaagctaatctacacggactgacactgtatgatacggccccatgccccatcaataatgagaggaccagactgctatcacgggacatctag

SEQ ID NO: 221079 - DNA, 699 bp, Artificial Sequence
  Description of Artificial Sequence: Synthetic coding sequence
atgccatctttatgggatcgcttttctagtagctctacatcaagtagcccttcttctctccccaggacacctactcccgataggcccccaaggagcgcgtggggctccgccacccgcgaagagggctttgatcggtctaccagtcttgaaagttccgactgcgaatccctggattcttcaaattccggcttcggacccgaggaggatactgcttacctggatggcgtatctctgcccgacttcgagttgttgtcggatccagaggatgagcacctgtgcgccaacttgatgcaacttcttcaggaaagtttggcacaagcgagactgggatctcgaagaccggcacggctccttatgccttcgcagttagtgagtcaggtgggcaaagagctactccggctggcctactcagaaccctgcggcctccgcggtgccctgctggatgtgtgcgtcgagcagggcaagtcttgccacagtgtcgggcagctcgcactggatccctccctggtgcctacatttcagctaactcttgtgctgagattggactctaggctgtggccaaaaattcaaggactgttctcaagtgctaacagccccttcctgccaggattctcacagtcactcacactgagcaccggatttagagtgattaagaagaagctctacagttcagaacagttgctgattgaagagtgctag

SEQ ID NO: 221080 - DNA, 582 bp, Artificial Sequence
  Description of Artificial Sequence: Synthetic coding sequence
atggtggccacaggctccttgtctagcaagaatccggcttctatttccgagctcctggattgtgggtaccatccagaatctctcctgtcggacttcgactactgggactatgtggttcctgagcccaatctgaatgaggttatcttcgaagaaagcacttgccaaaacttggtgaaaatgctggagaactgtctgtccaagtcgaagcagaccaaactgggctgcagcaaagttttggtgcctgagaaactcacacagagaatcgcacaggacgtgctaagactatcgtcaactgaaccctgcggactgaggggatgtgtgatgcatgttaatctcgagattgaaaacgtttgtaaaaaattggaccgaatcgtctgcgatagcagcgttgttcctaccttcgagctaacactggtatttaagcaggaaaactgctcctggacctcattccgggatttctttttcagccgcggaaggttctcaagcggtttcagaagaacgctgatattgtcatcaggatttcggctcgttaagaaaaaattgtactccctgattggaaccacggttatcgagggctcctag

SEQ ID NO: 221081 - DNA, 534 bp, Artificial Sequence
  Description of Artificial Sequence: Synthetic coding sequence
atggtcgccacggggagcctctctagcaaaaaccccgcttccatcagcgaactgctggattgtggatatcaccccgaatctctcctgagcgactttgactactgggattatgtggttccggaaccaaacttaaacgaagtgattttcgaggagtccacctgccagaatctcgtcaagatgttggaaaattgtctgtcaaagagcaagcagactaagcttggctgctctaaagtgctggttcctgaaaagctcactcagaggatcgcgcaggatgtcctgagactgtcatcgactgagccctgcggccttcggggatgcgtgatgcacgtaaacctggaaattgagaacgtgtgcaagaagttagacaggattgtgtgcgactcatctgtggtgcctaccttcgagcttactctcgtgttcaagcaggagaactgctcatggacctcattccgggatttctttttttccaggggcagattttcaagcggtttcagacgaactctgatcctcagttcaggtttccggttggtgtag

SEQ ID NO: 221082 - DNA, 387 bp, Artificial Sequence
  Description of Artificial Sequence: Synthetic coding sequence
atggtagcaaccggctcgttgtcctcaaaaaatcctgcttccatttcagagcttttggactgcggctatcacccagagagtctcctcagcgatttcgattactgggattacgtggtgccagagcctaacctcaatgaagtgattttcgaggagtccacgtgccagaacttggttaagatgctggaaaattgcctgtcgaagagcaaacaaaccaagctcggatgttccaaggtgctcgtgcccgaaaaattgacgcagcgcattgcccaggacgtgctcaggctctcaagcacagaaccatgtgggctgagggggtgcgtgatgcatgtcaatctggagatcgagaacgtgtgcaagaagctggacaggatagtgtgcgacagctag

SEQ ID NO: 221083 - DNA, 1239 bp, Artificial Sequence
  Description of Artificial Sequence: Synthetic coding sequence
atggctaatgtcgcagacaccaagctgtatgacattctgggagtcccacccggtgcatctgaaaacgagctcaagaaggcatataggaaactggccaaggagtatcaccctgataagaacccaaacgcaggcgacaagtttaaagagatcagtttcgcgtacgaagtcctcagtaaccccgagaaacgtgagctttacgatcgctacggcgaacaaggtctgcgcgaggggagcgggggtggcggtggaatggatgatatcttctcacacattttcgggggtggcctgtttggctttatgggcaaccaaagtcggtcccgaaatggccgaagacgaggagaggacatgatgcaccccctgaaggtgtctttggaggacctgtacaacggcaaaacgacaaaactccagctttccaagaacgtgctatgttccgcctgtagcgggcagggtggaaaaagtggtgccgtccagaagtgttcagcatgtcgcggtcgcggtgtacggatcatgattcggcagttagctcctggcatggtacagcaaatgcagtctgtctgctctgattgtaatggtgaaggtgaagtgataaacgagaaggacaggtgtaaaaaatgtgagggcaaaaaggtgataaaggaggtcaagatactggaggttcatgttgacaagggtatgaagcacggccagcgcatcacatttacaggcgaagccgaccaagccccaggcgtagagcccggagacattgttctcttgctccaggagaaggagcacgaggtttttcagcgcgatggaaacgacttacatatgacctacaagatcgggctggtggaggccctgtgcgggttccagttcacattcaagcatttggatggacggcaaattgtggtgaagtatcccccaggcaaggtgattgagcctggctgtgtgcgagtggttcgtggagagggtatgcctcagtacaggaatccctttgagaaaggggacctttatattaaatttgacgtccagtttccagaaaataattggattaaccccgacaaacttagcgagcttgaggatcttcttccctcaagacctgaagtgcctaacataataggagagactgaggaggtagagcttcaggagtttgactctacacgtggcagtgggggtgggcagcggagagaggcatacaatgattcctccgatgaagagagcagcagtcaccacggaccaggcgttcagtgtgcccatcaatag

SEQ ID NO: 221084 - DNA, 1443 bp, Artificial Sequence
  Description of Artificial Sequence: Synthetic coding sequence
atggctgcaaggtgttctacccgatggctgctcgtggttgtaggcactccccgtctgcccgctatttctgggaggggggctcggccaccacgagaaggtgtggtgggtgcctggctgtccagaaagctcagtgtccccgcatttgcgagctctcttacttcttgtggtcccagggccctgcttactctccgacccggtgtgtctctgacaggcacaaagcacaacccatttatttgtacagccagtttccacacatcagctcccttagctaaggaggattactaccagattctgggagtcccaaggaatgcctcgcaaaaggagataaagaaagcttactatcaacttgcgaagaagtaccacccagataccaacaaagatgacccaaaggccaaggaaaagttctcccaactagccgaggcctacgaagtactgagcgatgaggtgaaaaggaagcaatacgacgcctacgggtctgctggttttgatcccggagcatcaggctcccaacacagctattggaaaggtgggccaactgtggatcccgaagaactgttccgaaaaatttttggggagttttcttcgagctcgttcggagacttccagactgtgttcgatcagccccaggagtacttcatggaattaaccttcaaccaggcggctaagggggtaaataaggagttcaccgtgaatatcatggatacttgcgagagatgcaacgggaaagggaacgagccagggaccaaggtgcagcactgccattattgtggcggttcgggcatggaaaccattaacaccgggccattcgttatgcggtctacctgtcgcagatgtggcggacggggatccatcatcatttccccttgtgtggtgtgcagaggagccggacaggcaaaacagaaaaagagagtcatgattcccgtgcctgctggtgtagaggatgggcagactgtcagaatgcccgtagggaagcgggaaatcttcattacctttcgggtccaaaagtcccctgttttccgaagagatggtgcagacattcactcagatctgttcatatcaatcgctcaggcactgttgggaggcactgcacgcgcacaggggttgtacgaaaccatcaatgtcacaatcccgccaggtactcaaactgaccagaagatccgaatgggtggtaaaggcattcccagaattaactcctacgggtacggggaccattatattcacatcaaaatccgcgtgcctaagcggctgaccagccgccagcaatctctgattctttcttacgcagaggatgagaccgatgtagagggcacagtgaacggagttactctcacgtccagtgggggatctaccatggacagctccgctgggagtaaggcccgaagagaagccggtgaagacgaagaaggtttcctctcaaagctgaagaaaatgttcactagctag

SEQ ID NO: 221085 - DNA, 1362 bp, Artificial Sequence
  Description of Artificial Sequence: Synthetic coding sequence
atggcagcccgatgttcaactagatggctgctcgttgtggtcgggacacctaggctgcccgcaattagtgggagaggggctcggcctccaagagaaggtgtggtcggtgcctggctctctcgcaagctgtcggtccctgcttttgcgtctagcctgacctcttgcggaccccgagcgcttctgacacttcggcctggagtttccctgaccggaacaaaacacaatccctttatttgcaccgcaagtttccacacttccgcacccctggcgaaagaggattactaccaaattttgggcgttcctcggaatgcatctcagaaggagatcaagaaagcttactaccagctggctaagaagtaccacccggatactaacaaggacgatcccaaagccaaggagaaatttagccagctggctgaggcatacgaagttctttcagacgaggtgaaaagaaaacagtatgatgcgtacggctctgccggattcgaccctggagcttccggatcccaacatagctattggaaagggggtcccacagtggatccagaggaactgttccggaagatcttcggagaattcagctcaagctccttcggcgattttcagactgtcttcgatcaaccccaggaatactttatggagttgactttcaaccaagctgccaagggagtgaataaggagtttaccgtcaacataatggatacctgtgagcggtgtaacggtaagggaaatgagcccggaacaaaggtccagcattgtcactactgtggtggctccggtatggaaacaattaataccggccctttcgtgatgagatccacttgcagaaggtgcggtggtcggggtagtatcattataagcccttgtgttgtgtgccggggagcagggcaagccaagcagaagaaaagggtcatgatacccgtgccggcaggggtggaagacggacagaccgtaaggatgccagttggtaagagagagattttcattaccttccgggtgcagaagtcccctgtatttagaagggacggggcagacatccacagcgacctattcatcagcattgcccaggccttgttaggcggaactgcacgggcacagggcttatacgagactattaatgtgaccattcccccaggaacccagaccgatcagaaaatacgaatgggcggaaaaggcatccccagaattaattcttacggatacggggatcattacattcacatcaagatccgggttcccaagcggctcactagcaggcagcagtcgctgattttgagttacgctgaggacgagaccgatgtggagggcacagtgaatggggtcactctgaccagcagtggaaaacgcagcacaggcaattag

SEQ ID NO: 221086 - DNA, 903 bp, Artificial Sequence
  Description of Artificial Sequence: Synthetic coding sequence
atggcagaaccccaggcggaacggcctaggctctgtgtctttcccgacctgctgagacccccttccgctgccgatatcgaaacctggtgtcaaccatacagaaaaatcttcggagaattttcttccagcagtttcggcgatttccaaactgtctttgaccagccacaggaatacttcatggagctgacgtttaatcaagctgccaagggagtcaataaagagttcaccgtgaatatcatggatacctgtgagaggtgcaatggcaagggcaacgaacctggcaccaaggtgcagcactgccactattgtggtgggtccggcatggagaccattaataccggaccattcgtaatgcggagtacatgtaggcgctgcggtggcaggggaagcatcattatctcgccttgtgtcgtatgcaggggtgctggccaggccaaacagaaaaaaagagtcatgattccagtcccagcaggtgtagaagatggccagaccgtccggatgcccgttgggaaaagagaaattttcatcactttccgggtccagaagtctccggttttccgccgagacggcgctgacatacactccgatttatttatatcaatcgctcaggctctcctgggcggaacggccagggcccagggactgtatgaaacaatcaacgttaccatcccccctgggacccaaacagatcagaaaataagaatgggcggtaaggggatacctagaatcaattcatacggatacggcgatcattacatccatatcaagatacgggtgccaaagcggcttacctccagacagcagtccctgatcctgtcttacgcggaggatgaaacagatgtagaaggtacagtgaacggggtcacgctcacaagttccggcaagagatccacaggcaattag

SEQ ID NO: 221087 - DNA, 1023 bp, Artificial Sequence
  Description of Artificial Sequence: Synthetic coding sequence
atgggtaaggattactaccagactcttgggttggcccgaggggcttccgatgaggaaattaagagagcgtaccgtagacaggcacttcggtaccaccctgataaaaacaaggaacccggagccgaggagaaattcaaggaaatcgctgaagcttacgatgtcctgagcgatccaagaaaacgcgagattttcgataggtatggcgaggaaggtcttaaaggaagcggcccatccggcggtagtggtggtggcgctaatgggacttccttctcttatacttttcacggtgacccgcacgctatgttcgccgagttctttggcggacggaatccatttgatacatttttcggccagcgtaacggtgaagaggggatggacatagatgacccgttttctggatttccaatgggcatgggagggttcactaatgtcaattttggcagatctcggagcgctcaggagccggctaggaagaagcaagatccccctgtgacacacgaccttcgcgtgagcctggaggagatctatagcggatgtactaaaaaaatgaaaatctcccataaacgcctgaatccagacggcaaatctataaggaacgaggataaaattctcacgatcgaggtaaaaaagggttggaaagaggggaccaaaataacttttcccaaggagggggatcagaccagtaataatattcccgctgacatcgtgtttgtcctgaaggataaaccccacaacatcttcaagagggacgggagcgatgtgatatatcccgctaggattagcctgcgggaggccttgtgcgggtgcacagtcaatgtccctactctcgacggacgtacgattcctgtggtgttcaaagatgtcattcgccctggaatgcgacgaaaggtccctggagaaggcttgcccttgcccaagacccctgagaaaagaggcgacttgatcattgaattcgaagtcatttttcccgagcggatacctcagacaagcaggactgtgctggaacaggtgctgcccatttag

SEQ ID NO: 221088 - DNA, 723 bp, Artificial Sequence
  Description of Artificial Sequence: Synthetic coding sequence
atgtttgcagagttttttgggggtcggaaccccttcgacacattctttgggcaacgcaacggtgaggagggaatggatattgatgaccccttctctgggttcccgatgggtatgggcggttttacgaatgttaacttcggaagatcaagaagcgcgcaagagcctgcacgtaaaaagcaggatcccccagtgacgcatgatctgagggtgtcactggaggagatctactctggctgcaccaaaaaaatgaagattagccataaaaggctaaaccccgatggaaaatccattcggaatgaggacaaaatactgaccatcgaggtgaaaaagggatggaaagaggggactaaaataactttccctaaggagggcgatcagacatccaataacatccctgctgacattgtgtttgttctgaaggacaagcctcataatatcttcaagcgggacggcagcgatgtgatttacccggctcgcattagtctcagggaagcactatgtggctgcacagtgaacgtgccaacactcgatggtcgcactataccagtggtatttaaagacgtgatcagacccggaatgcggcgtaaggttccaggggaggggctgccactccccaaaacgcccgaaaagcgcggagacctcatcattgagttcgaggtcattttccctgaaagaatacctcaaacgtccagaaccgtactggaacaggtacttccaatttag

SEQ ID NO: 221089 - DNA, 1230 bp, Artificial Sequence
  Description of Artificial Sequence: Synthetic coding sequence
atgtcatccctccgcgcacggctccctgccactcggaggagggtggcacaaccttttgccaggcccgcttccccgagccttgtgccacgttcaggctcggctatggaatctaacaaagatgaggcagaacgctgcatctcgattgctctgaaggcgattcaaagtaatcagccggacagggctctccgattcctagagaaagcgcagcgtctgtaccccactccaagagttagagccctcatcgagtcgctgaatcagaagccacagactgccggagatcaaccacctcctacagacacaacccacgctacccatcgcaaggcaggtggtactgacgctccatcagctaatggtgaggctggcggtgagagtaccaagggttatacagccgaacaggttgctgcagttaagagggttaagcagtgcaaggactattacgagatcctgggggtatcccgtggggcatctgatgaggaccttaagaaggcctacaggcgacttgctctgaaatttcatccagacaagaaccacgcacctggggctaccgaagccttcaaggccatcggaaccgcatatgctgtgctcagtaaccccgagaagcgcaagcagtacgatcagtttggagacgacaaatcacaggctgccagacacggtcacgggcatggggacttccatcggggtttcgaagctgatatttctccagaagatttgtttaacatgtttttcggtggcggattccctagttccaacgttcacgtgtactctaatggcagaatgcgctacacctaccagcagcgccaggataggcgggacaaccaaggggatggaggcttgggcgttttcgttcagctcatgcctattctgattctaatcctagtttctgctttaagccagttgatggtttcgtcacccccttacagcttgagcccccgtccaagcgtcggacatattcacagaagggtgacagaccacctgggcgtcgtgtattacgtaggggatactttcagtgaggaatatacaggaagctcactgaaaaccgtggaacggaatgttgaggatgactatattgcgaacctccgaaacaactgctggaaggagaaacagcagaaggagggactgttgtaccgggctagatatttcggtgacactgatatgtaccatagagcccaaaagatggggacaccatcgtgttctcggctctcagaggtgcaggccagcttgcatggatag

SEQ ID NO: 221090 - DNA, 1230 bp, Artificial Sequence
  Description of Artificial Sequence: Synthetic coding sequence
atgtcatccttgcgggcacgactgcctgctacgcgtaggagggtggcacaacccttcgcgaggcctgcctctccaagtcttgtacctaggtccggatctgccatggaatcaaacaaggatgaagctgaaaggtgcatttctatcgccctaaaggcaatccagagcaaccagcccgacagggccctgcgcttcctggagaaggcgcagcgtctgtatcccacacccagagttcgcgctctgatcgagagtctcaaccagaagccacagaccgcaggagatcagccacctccgacagacacaactcatgccacacatcgcaaggcaggtgggaccgacgctccctctgctaacggcgaggcagggggagaaagtaccaaaggctatacagcggaacaggtggcggctgtgaagagggttaaacagtgcaaagactattatgagatccttggagttagccgcggtgcctcagatgaagacctcaagaaggcctatcgtcggctggctctgaaatttcatccagacaaaaaccatgcccctggggcaacggaggccttcaaagccattgggacagcttatgccgtcctctctaatcccgagaagaggaaacagtacgatcagttcggcgacgataagagccaggccgcacgacacggccacggccacggggatttccaccggggattcgaggctgacatttctcctgaggacttgttcaacatgttctttggcggtggcttccccagttctaacgtccacgtgtactcgaacgggaggatgaggtatacgtaccaacaacggcaggacagacgtgacaaccagggggatggtggactcggcgtgttcgtgcagttgatgccaattctgatcctaatactggttagcgcactaagtcagttgatggtatctagtcccccatactccctttccccgaggccgtcagtcggccatatccaccggcgagtgactgaccacctgggggtggtgtattatgtcggtgatacctttagcgaggagtacactggatcaagcttaaagaccgtggagcgaaatgttgaggacgattatatagccaacctcagaaacaactgctggaaggagaagcaacagaaagaaggactcctgtacagagctagatactttggagacactgatatgtatcaccgtgcacagaagatgggaaccccctcgtgtagtcgcttaagcgaggtgcaggctagccttcatggctag

SEQ ID NO: 221091 - DNA, 1128 bp, Artificial Sequence
  Description of Artificial Sequence: Synthetic coding sequence
atggagtccaacaaggacgaggctgaacgctgcatatccattgccttgaaggctattcaaagcaatcagcccgatagggcgctgagatttcttgagaaggcccagcgcctgtacccaaccccacgcgttcgggcactgatcgagtccctgaatcagaaaccacagacggcgggagaccagccacctccgaccgatacaactcatgcgacccacagaaaagccggtgggaccgacgcaccctcagccaatggtgaagctggcggagaaagtacaaaagggtatacagctgagcaagtggctgcagtgaaacgagtcaagcagtgcaaggactattacgagatcctgggggtttctcgaggagcctccgacgaagacctgaaaaaagcatatagacgtttagccctcaaattccacccggataagaatcacgcccctggggctacagaagcctttaaggccatcggtaccgcctacgcagtgctgagtaatcccgagaagcgcaaacagtatgaccagttcggggacgacaagtcacaggccgctcggcatgggcacgggcatggggacttccacagaggcttcgaagctgacatttccccagaggatttgttcaacatgttcttcggtggcggattcccatccagcaacgtacacgtatatagcaacggtaggatgcgatacacctaccagcaacgccaggatcgtcgcgacaaccagggagacggcggactgggggtgttcgtacagctcatgcccattttgatcctgattctagtttcagctttatcacaactgatggtgagctcaccaccatacagtctctcacctcgcccttctgtgggccacatacaccgccgagtaacggatcatcttggagtggtctattacgtgggtgacaccttttctgaagagtacaccggctcatccttaaaaactgtggagcgcaacgtggaggacgattacatcgccaacctacgcaataactgctggaaggagaaacagcagaaggagggattattataccgcgctcgatactttggcgataccgacatgtaccaccgtgcacaaaagatggggactccctcctgcagtcgcctttcagaggtgcaagcctcgttgcatgggtag

SEQ ID NO: 221092 - DNA, 975 bp, Artificial Sequence
  Description of Artificial Sequence: Synthetic coding sequence
atggccagctattatgaaatactcgatgtacccaggtcagcgtctgcagatgatatcaaaaaagcgtatcggagaaaagctctgcaatggcacccagataagaaccccgataacaaggagttcgcggagaagaaatttaaagaagtcgctgaagcatatgaggtgctgtccgacaaacacaaacgcgagatatatgacagatacggccgagaaggcctgaccggtacggggactggaccaagccgggcagaggctggtagcggcggaccgggattcacattcactttccggtctcccgaggaagtgttcagagaattcttcgggagtggcgaccctttcgctgaactgttcgatgacctcggcccattctccgagctgcagaaccgcggtagcagacatagtggcccattctttacattttccagctcctttccagggcactcagatttcagcagctcttctttttccttctcgcctggggcaggtgcattcagaagtgtgtcaaccagtacaacttttgtccaggggagaaggatcaccaccaggcgcattatggaaaatggacaggagagggtggaggtggaagaggacggccagctcaaatctgtgaccatcaatggggtgcctgatgaccttgctttgggccttgagcttagtcggagagaacagcagccaagcgtaacgagcagaagcgggggaacacaggtgcagcagacaccagcatcctgccctctcgacagcgacctatcagaagatgaggacctgcagcttgcgatggcatactctctgagcgagatggaggctgccggaaaaaaacccgcaggaggacgcgaagctcagcatcgccgacagggaaggcccaaggctcagcatcaggaccccggactcggcggaacacaggaaggcgcaagaggggaagccactaagcggagtccaagcccggaggagaaggctagccgctgtctcattttgtag

SEQ ID NO: 221093 - DNA, 834 bp, Artificial Sequence
  Description of Artificial Sequence: Synthetic coding sequence
atggcctcatattatgagatactggacgttcctaggtcagcttctgctgatgatattaagaaggcctaccgccgaaaggccctccagtggcatcctgacaagaaccctgacaacaaagaatttgccgagaagaaattcaaggaggtagccgaggcctatgaagtgttatccgacaagcataaacgggagatctatgacaggtacggacgcgaaggactcaccggcaccggtacgggtccgagccgcgcagaggctgggtcaggcggaccgggattcacatttactttccgtagccccgaggaagtgttcagagagttttttgggagtggagatccctttgctgagctctttgacgatcttggacctttctcagagttgcagaacaggggctctcgtcattcaggcccattctttacttttagctcatctttccctggccattctgattttagcagttccagcttttccttttcacccggtgccggagctttcaggtccgtcagtacgtcgacgacattcgtgcaagggaggaggatcaccactcgccgtattatggagaatggtcaagaaagagtggaggtggaggaggatggtcagctgaagtctgtgaccatcaacggggtgcccgatgatttggcgctcggactggagctttctaggagagagcaacagcctagcgtcacctcccgcagcggtggcactcaggtgcagcaaactcccgcaagttgtcccctggattctgatctcagtgaggacgaggacttgcagttggccatggcatactcactgagcgaaatggaagcagccggtaaaaaaccagctgacgtgttctag

SEQ ID NO: 221094 - DNA, 687 bp, Artificial Sequence
  Description of Artificial Sequence: Synthetic coding sequence
atggctagttattacgaaatcctggatgtccccaggtccgctagcgcagatgatattaagaaagcctaccgcaggaaggctttgcagtggcacccagacaaaaacccagacaacaaggaattcgccgaaaaaaagttcaaggaagtcgctgaggcgtacgaggtactgagtgacaaacataagcgggagatctacgacagatacggcagagagggccttacaggtacaggtactgggccttcacgggctgaggcagggtcgggtgggcctggctttaccttcacctttcgcagccctgaggaagtgttccgcgagttcttcgggagcggagacccttttgccgagttgtttgatgacttaggaccattcagcgagctgcagaaccgtggatcccgtcattcgggtcccttttttacctttagttcgagcttcccaggccactctgacttttcctccagttcattttcttttagccccggtgccggagcctttcggtccgtgtccacttctaccacatttgtgcaggggaggaggatcaccacacggaggatcatggagaacgggcaggaacgggtggaggtcgaagaagacggacaactgaaatccgtaacgataaacggagtgccagacgacttggctctaggcctggaactgagcaggcgagaacaacagccaagtgtgacctag

SEQ ID NO: 221095 - DNA, 447 bp, Artificial Sequence
  Description of Artificial Sequence: Synthetic coding sequence
atggcttcatattatgaaatcctagacgtgccacgtagtgcttctgcagatgacataaaaaaagcctatagaagaaaagcactccagtggcatcctgataaaaatccagacaacaaagagttcgccgagaaaaaattcaaggaggtggctgaggcatacgaggtcctgtctgataagcataagagagagatctatgacaggtacggacgcgaaggcttgaccggaactggaaccggcccatcgcgggcagaggctggctctgggggacctgggtttacctttacatttcgctcccccgaggaagtcttcagagagttcttcggaagcggcgatccgttcgcagaactattcgatgatctggggccatttagtgagctgcagaaccgaggttctcgacactctggccctttctttactttttcctcttcgttcccaggccactcgtag

SEQ ID NO: 221096 - DNA, 369 bp, Artificial Sequence
  Description of Artificial Sequence: Synthetic coding sequence
atggcctcctactacgaaattttggatgtgcccagatctgccagtgcggatgatatcaagaaagcgtacagacgaaaggcactgcagtggcaccccgataaaaaccccgataacaaagagttcgccgaaaaaaaatttaaagaagtggcggaagcttatgaagtcctctcagacaagcacaaacgcgaaatctatgatcgatacgggcgtgagggccttactgggacagggaccgggcctagtagagcggaggcagggtctgggggtccaggctttaccttcacattccgctcacccgaagaggtcttccgggaattctttggatctggggatccatttgccgaactgttcgacgacctgggaccgtag

SEQ ID NO: 221097 - DNA, 981 bp, Artificial Sequence
  Description of Artificial Sequence: Synthetic coding sequence
atggtggattactacgaagtgctcggcgtccagagacacgcatctcccgaggacattaagaaggcgtatagaaagttagcactgaagtggcacccagacaagaaccccgagaataaagaagaggcggagagaaagtttaaacaagtggccgaggcgtacgaggtgctgagcgacgcaaaaaagagagatatttatgataaatacgggaaggaggggctcaacgggggtggcggaggcggatctcacttcgacagtcccttcgagttcggttttacatttaggaaccccgacgatgtattcagggagttctttggcggaagagacccatttagttttgatttcttcgaagatccttttgaggatttctttggcaatagacgcggacccaggggatcccgttcccggggaacagggtcttttttctcagcttttagtggatttccctccttcggatcagggtttagtagctttgacacagggttcacctcatttggcagcttagggcatgggggtctcaccagcttttcgagcacatcattcggagggtccggcatggggaactttaagtccataagcactagcactaagatggtaaacggcagaaagatcaccaccaagagaatcgtggagaatggacaagagcgcgtggaagtggaagaggatggtcagctaaaatcactgaccataaatggggttgcagacgatgatgccctcgcggaagagcggatgcgccgtgggcagaacgctttgcctgcacagccagccggactacggccacccaaaccacccagacctgcgtctcttcttaggcacgcacctcactgcctgtccgaggaagaaggagagcaggatcgccctagggcacccggtccttgggatccacttgcttctgctgcagggctcaaggaaggagggaagagaaagaagcagaagcagcgagaggagtcaaagaaaaaaaagtctacgaagggtaaccattag

SEQ ID NO: 221098 - DNA, 378 bp, Artificial Sequence
  Description of Artificial Sequence: Synthetic coding sequence
atggtggactattatgaggtgttaggcgtgcagaggcacgcaagtccagaagacatcaaaaaagcatacaggaaactggcactcaaatggcaccctgacaagaatcccgaaaacaaagaagaggccgagcgtaagttcaagcaggttgccgaggcttacgaggttctgagcgacgctaagaagagggacatatacgacaaatatggtaaagaaggacttaacggtgggggaggaggagggtcccatttcgactctccattcgagttcggcttcacattccggaatcccgacgacgttttccgggagtttttcggcggaagagatcctttttccttcgatttctttgaggatccattcgaggactttttcgggaattag

SEQ ID NO: 221099 - DNA, 687 bp, Artificial Sequence
  Description of Artificial Sequence: Synthetic coding sequence
atggtcgactactacgaggtgttgggggtgcaaaggcatgcatcacccgaggacatcaaaaaggcttatagaaaactggctctgaagtggcatccagacaaaaaccctgaaaataaggaagaggccgagaggaaatttaagcaggttgccgaggcctacgaagtactgtccgatgctaagaagagggacatttatgataaatatggcaaggaaggcctcaacggtggagggggtggcggaagtcactttgactcccctttcgaattcggctttaccttcagaaaccctgacgatgtttttcgtgagttcttcggtggcagggatccgttctcctttgacttctttgaggacccatttgaagatttttttggcaaccgcagaggtccaagagggtcaagaagtagagggacaggaagcttcttcagcgccttttccggtttccctagctttggctcggggtttagtagcttcgatacaggatttaccagcttcgggagtttaggccacggtgggctgacaagtttcagttcgacctcttttggtgggtccggaatgggtaacttcaagtccatcagcacctcaactaaaatggtaaatgggaggaagatcactactaagaggattgtagagaatggtcaggagcgggtggaggtcgaagaggacggccagctcaagtctctgacttag

SEQ ID NO: 221100 - DNA, 648 bp, Artificial Sequence
  Description of Artificial Sequence: Synthetic coding sequence
atggtggactactacgaagtgctgggcgtgcaaagacacgctagcccggaggacatcaagaaagcctatagaaagctcgcccttaaatggcaccccgacaaaaaccctgagaacaaggaggaggccgagaggaaatttaagcaggtcgccgaagcttacgaggtgctctccgatgctaagaagcgcgacatctacgataaatacggcaaagagggcctgaatggaggcggtgggggaggtagccactttgactccccttttgagttcggctttactttccggaaccctgacgatgtcttcagagagttctttggaggaagagatcctttctccttcgacttttttgaggacccattcgaagacttctttggcaatcgcagaggtcctagaggcagccggtctcgcggtacggggagctttttctccgccttttccggcttccccagttttggttcggggttttccagctttgacaccggtttcactagttttggaagcctggggcacggcggacttacgagcttcagctccaccagcttcggcggatctggcatgggtaactttaaatcaatcagcactagcacaaagtggctgatggccgagaaatccctccagcgggaactgagtagaacagtgaagaaggaatag

SEQ ID NO: 221101 - DNA, 726 bp, Artificial Sequence
  Description of Artificial Sequence: Synthetic coding sequence
atggtggattactatgaagtcctgggggtccagcgccacgcctcaccagaagacatcaaaaaagcatacaggaaactggccctaaaatggcacccggacaaaaacccggaaaacaaagaagaggccgagagaaagttcaagcaggttgccgaagcatacgaggtgctctccgacgccaaaaaacgcgatatatatgataaatatggtaaggagggactgaacggaggcggtggagggggttcccactttgattccccttttgaatttggctttaccttccgtaacccagacgacgtgttcagggaattcttcggaggaagagatccttttagtttcgacttctttgaggatccgttcgaagacttcttcggcaatagacgaggacctagaggctcacggtccagagggactggctcattcttttcggctttctccggatttccatcattcgggtccggcttctcttcatttgacacaggcttcacatcattcggcagcctgggccacggagggctcacatccttctcatccacttccttcggcggatctggcatgggtaatttcaaaagcatcagcacgagtacaaaaatggtgaatggtaggaagattactactaagaggatcgtcgagaacggacaggagcgggtggaggtcgaggaggacggacagctaaagtctctgactatcaacggcaaggagcaactcctgagactggacaataagtag

SEQ ID NO: 221102 - DNA, 201 bp, Artificial Sequence
  Description of Artificial Sequence: Synthetic coding sequence
atggtcgactattacgaagtgctgggcgttcagcgccatgcttcccccgaggacattaaaaaagcataccgaaaactcgccctgaagtggcatccagacaaaaatcccgagaataaggaggaagccgagcgtaagtttaagcaggtcgccgaagcctacgaggtgttaagcgacgctaagaagagggacatctacgattag

SEQ ID NO: 221103 - DNA, 138 bp, Artificial Sequence
  Description of Artificial Sequence: Synthetic coding sequence
atggtggactactatgaggttttaggagtgcagaggcatgcctctcccgaagatattaaaaaagcttaccggaaacttgccctgaagtggcatcctgacaagaatcctgagaataaggaggaggccgagcgcaagtag

SEQ ID NO: 221104 - DNA, 441 bp, Artificial Sequence
  Description of Artificial Sequence: Synthetic coding sequence
atggtagattactacgaagtgttgggagtgcaaaggcatgccagccccgaagatatcaagaaggcctaccgcaagctggccctgaaatggcacccagataagaaccccgaaaacaaggaggaagctgaaaggaaatttaaacaggttgctgaagcctatgaagtcctatccgatgccaagaagagggacatatatgacaagtacgggaaggagggtctgaatggcggtgggggaggtgggagtcattttgactctccgttcgagttcggctttacattccgcaacccagatgacgtttttcgtgaattctttggcggaagagacccattctcttttgactttttcgaggatcccttcgaagatttttttggtaatcgcaggggccctcgagggagtcgcagtaggggcaccggttcctttttttccgccttctcagggtag

SEQ ID NO: 221105 - DNA, 636 bp, Artificial Sequence
  Description of Artificial Sequence: Synthetic coding sequence
atggtggactattatgaggtcctgggagtgcagcgtcatgcttcccccgaagatataaaaaaagcttacagaaagttggcactgaaatggcatccagataagaatcccgaaaataaagaggaggccgaaagaaaattcaagcaggtggccgaagcctacgaggtgctctcggacgccaaaaagcgcgacatatatgacaagtatggcaaggaggggttgaacggcggtggcggaggagggtctcacttcgactccccatttgaattcgggtttacgttccggaatcccgacgacgtctttcgagagttctttggagggagagatcccttttccttcgacttttttggagtggccgacgatgatgccctggctgaggagcgcatgaggaggggccagaacgccttgccagcccagcctgccggtttaagacccccaaagcctcccagacctgccagtctgctgcgacatgcgccacattgtttatcagaggaggagggggagcaggatagaccgagggcccctggcccatgggatccgctcgcatctgccgctggcctgaaggaaggaggcaagaggaaaaaacagaagcagcgcgaggaaagcaaaaagaagaagagtaccaaaggcaatcactag

SEQ ID NO: 221106 - DNA, 834 bp, Artificial Sequence
  Description of Artificial Sequence: Synthetic coding sequence
atgccacatcccagaatacttaaacgacctaagaagcgcgatatttacgataaatatgggaaagagggcttgaacgggggtggaggtggtggctctcacttcgattctccattcgaattcgggttcactttccggaacccagatgatgtgtttcgggagttctttggaggaagagatcccttttctttcgacttttttgaggaccctttcgaagatttttttggaaatcgtaggggcccacgaggttctcgatcgagaggcacgggctcttttttcagcgcttttagtggtttcccgtcttttggatctggcttctcaagttttgacacaggattcactagctttggctcactcggtcacgggggtctcacgtcctttagcagcacgtcttttggtggatccgggatgggcaatttcaaatcaatctcaacctccactaagatggtaaatgggcgaaaaattactactaagcgcatagtggaaaatggacaagaaagagtcgaagtggaagaagacggacaactgaagtccctgaccatcaatggcgtcgcagacgacgatgcccttgctgaagaacggatgcggcgtggccaaaacgcactccctgcacagcctgctggcctgaggcctccaaaaccacctcggccagcttctctgctgaggcatgcaccacattgccttagcgaggaagaaggagagcaagacaggcccagagcccctggcccatgggaccctctggctagtgctgcgggacttaaggagggcggtaaacggaaaaagcagaagcagagggaagaatctaagaagaagaagtcaactaaaggcaaccactag

SEQ ID NO: 221107 - DNA, 297 bp, Artificial Sequence
  Description of Artificial Sequence: Synthetic coding sequence
atggtggactattacgaggttctgggggtccagcgtcatgcatctccagaagatattaaaaaggcttacaggaagctcgccctaaagtggcacccagataagaaccctgaaaacaaggaggaagctgaacgaaaattcaaacaggtagcagaagcttatgaggtgctctctgatgcaaaaaagcgcgatatttatgacaagtacgggaaggaaggactgaacgggggaggcggtggaggctctcactttgactctccatttgagttcggctttacttttagaaacccggatgactag

SEQ ID NO: 221108 - DNA, 672 bp, Artificial Sequence
  Description of Artificial Sequence: Synthetic coding sequence
atggcaacaccacagtctatcttcatttttgccatatgcattctgatgatcaccgagctgatccttgccagtaagagctactatgatattctgggtgtgccaaaatccgcttctgagcggcagatcaagaaggcgtttcacaaactcgccatgaagtatcatcctgacaagaacaagtcgccagacgcagaagcaaaatttcgggaaatcgcagaagcctatgagaccctgtcagacgctaatcgaaggaaagaatatgatacactcggccactccgcattcacaagtgggaaggggcagcggggttccgggtcgtctttcgaacaatctttcaattttaactttgatgacttgttcaaggacttcggatttttcggacagaatcagaatactggttctaagaaacggttcgagaatcattttcagactaggcaggacgggggttcctcacgtcagcggcaccatttccaggaatttagtttcggcggtggcctgtttgatgacatgttcgaggatatggaaaaaatgttttctttttccggatttgactctaccaaccagcacactgtacaaaccgaaaacagatttcacggatcaagtaaacactgccggaccgtgacccagcgacgcggaaacatggtcaccacttacaccgattgttcaggacaatag

SEQ ID NO: 221109 - DNA, 2382 bp, Artificial Sequence
  Description of Artificial Sequence: Synthetic coding sequence
atgggggtgtggctgaataaagatgattacataagagaccttaagcggatcatcttatgttttctgattgtgtatatggccatcttggtcgggaccgatcaggatttttattcactgctgggcgtcagtaagacagcatctagccgcgaaatccgacaggcattcaaaaagctcgctttgaagctgcatcctgataagaatcctaataatccaaacgctcacggcgattttctcaagattaatagggcatatgaagttttgaaggacgaagatctaaggaagaagtacgacaaatacggcgaaaagggtctcgaagataaccagggcggtcagtatgaatcttggaattactaccggtatgactttgggatatacgacgatgacccagaaatcattactctggagagacgggagtttgacgccgcagtcaactcaggagagttgtggtttgtgaacttttattcacctggatgttctcactgccatgatctcgccccaacatggcgggactttgctaaagaggtagacggactgctccgcattggagcggtgaactgcggagacgataggatgctgtgccgtatgaaaggtgtcaacagctacccctcactgttcatctttagatccggcatggcgccagtgaaatatcacggagacaggagcaaagagtctcttgtgtcattcgccatgcagcacgtcagaagcacagtcaccgaactgtggacaggcaatttcgttaattctatccaaacagcttttgctgcaggcatcggatggttgattacattttgtagtaagggcggtgactgtcttacctctcagaccagactgcgactgtctgggatgctcgacggtcttgtgaatgtggggtggatggattgtgccacacaagacaacctatgcaaaagcttagatattaccactagtacaacggcctactttcctccaggagcgacactgaacaataaggagaaaaacagcatacttttccttaacagcctggatgctaaggagatctacttggaagtcatccacaacctgcctgacttcgagctgctgagcgctaatacgcttgaggatcggcttgcccaccatcgctggcttctgttttttcattttggcaagaacgaaaactccaatgacccagagctgaaaaagctgaaaacgctgctcaagaacgaccacatccaagttggcaggttcgattgctctagcgctcccgatatatgttccaatctgtacgtgttccagccctctctggccgtgtttaagggccagggcacaaaggagtatgagatccatcacgggaaaaagatcttgtacgacatactggcatttgcaaaggagtccgtcaactcccacgtgaccacactggggccacaaaatttccccgcaaacgacaaagaaccttggctagtggatttctttgcaccctggtgtcccccatgcagagctctactgccggaacttcggcgtgccagtaacctgctttatggacagctgaagtttggcactttggattgtactgtgcatgaagggctatgcaatatgtataatattcaagcttatccaacaactgtggtattcaaccagtccaacatccacgagtatgagggccaccactccgctgagcagatcctggagttcattgaggatctcatgaacccctctgtggtctccctcacccccacaaccttcaacgaactggtcacccaaagaaaacacaacgaagtgtggatggtggatttttactctccgtggtgccacccctgccaagtgctgatgccggagtggaagagaatggcacggaccctgaccggcctgattaacgtgggctccattgattgccagcaatatcactctttctgcgcccaggagaacgtgcagcggtatcccgagatacgattttttccccctaagtccaacaaggcctaccactatcattcctataatggctggaatcgggatgcttattccctcagaatatgggggctaggtttcctgccacaggtatctactgacctcactcctcagactttctcagagaaggtgttgcaggggaaaaatcattgggttattgacttttacgcaccttggtgcgggccttgtcagaatttcgcgccagagttcgaattgctcgcacggatgatcaagggaaaggtaaaagctggtaaggtcgattgccaggcatacgctcagacttgccagaaggccggaataagggcatacccaacagtgaagttctacttttacgaacgggcaaagagaaatttccaggaggagcagatcaatacacgcgatgccaaagctatcgctgcactgataagtgagaagctggagacactcaggaatcaggggaaaaggaacaaggacgagctctag

SEQ ID NO: 221110 - DNA, 2244 bp, Artificial Sequence
  Description of Artificial Sequence: Synthetic coding sequence
atgggagtctggctgaacaaagacgactatattagagaccttaagcgaatcatcttatgctttttgattgtatacatggcaatcctggtcgggaccgatcaggacttctattcactgctgggggtcagtaaaacggccagctcccgggagattaggcaggcttttaaaaagttggctttgaaacttcatccggataaaaatcctaacaatccaaacgctcacggggattttctgaagatcaatcgtgcctacgaagtgcttaaggatgaggatctgcggaagaagtacgacaaatacggagaaaagggactagaggacaatcagggaggccagtacgaaagctggaattattatagatatgacttcggcatttatgatgatgaccccgagataataacgctggaaaggcgagaattcgatgcggcagtgaattcaggcgaactgtggttcgtgaacttctactctccaggatgcagccattgccatgacctggcacctacctggagggacttcgcgaaggaagtggacggactgttgcgcataggggctgtgaattgtggagatgacagaatgctctgccggatgaaaggggttaatagttacccctctttatttatatttcgaagtgggatggcacctgtaaaatatcacggcgacaggtcaaaagaatccctggtgtcattcgcaatgcagcatgtgcgttccacagtgacagaattgtggacaggaaattttgttaactctattcagaccgcatttgcagctggtattggttggctgattactttttgtagtaaggggggagattgcctcacatcacagactcggctcagactgagcggaatgctatttcttaactctctggatgctaaggagatctatctggaggttatccacaacttgcccgacttcgagctcctttcagccaataccctcgaagaccgactcgcccatcatcgctggctgctgtttttccacttcggtaagaatgagaacagcaacgacccagaactgaaaaagcttaagacattactgaagaatgatcacattcaggttggaagatttgactgctccagcgcaccagacatatgttccaatttgtacgttttccagccttcactggccgttttcaagggccaggggacaaaggaatatgagattcatcatggaaaaaagattctctatgatattctggctttcgccaaagagtcggtgaatagtcacgtcaccaccttggggcctcagaattttcctgctaatgataaggagccttggctggtcgacttctttgccccatggtgccccccttgccgggctctcctgccagagctgagaagggcatcgaatctactctacgggcagctgaaattcgggacactggattgcacagtgcatgagggcctgtgtaacatgtacaacatccaagcctatccaaccacagtagtgtttaaccaatctaacatccatgagtacgagggtcatcactccgccgagcagatcttggagttcatagaggacctgatgaacccgagcgtggtctcactcacacccactactttcaacgaattggtcacgcagcgaaagcataacgaggtctggatggtcgacttctactcaccctggtgccacccatgccaagttctgatgcccgaatggaagcggatggcacggaccttgaccggactgatcaatgtgggtagcattgactgccaacagtaccactcattctgcgcacaggagaacgttcagcggtatcctgagattaggtttttcccccctaagagtaacaaggcataccactatcactcttacaatgggtggaaccgtgacgcctactccctcaggatctggggactcggctttctaccacaggtgagtaccgaccttactccgcagactttctctgaaaaggtgctccagggaaagaatcactgggttattgatttctacgccccttggtgcggtccgtgccagaactttgccccagaattcgagctgctcgcacggatgatcaagggaaaagttaaagctggtaaagtggactgtcaagcctatgctcaaacctgccagaaagccggaatcagggcctacccaaccgtgaagttttacttttacgagagggctaaaaggaatttccaggaggaacagataaacaccagagatgcaaaggctatcgccgcacttatatctgaaaaattggaaacacttcgtaaccaggggaaaaggaacaaggatcacttgtag

SEQ ID NO: 221111 - DNA, 534 bp, Artificial Sequence
  Description of Artificial Sequence: Synthetic coding sequence
atgggggtatggctgaacaaggatgattacatcagagatttgaaacggattattttatgttttttgatagtgtatatggccatcttggtcggcaccgaccaggatttttactccctgctcggggtcagtaagactgctagctctagggaaataagacaagctttcaaaaaactcgcactcaagctccaccccgacaaaaatcccaataatccgaatgcccatggagactttctgaagattaaccgcgcatatgaagtgctgaaggatgaagatcttcgtaagaaatacgataagtatggagagaaaggtctggaagacaaccagggaggacagtatgagagctggaattactacaggtatgacttcggtatatacgacgatgatccagaaattattactctggaaaggcgcgaatttgacgccgcagtgaactctggcgagttgtggtttgttaacttctatagccccggatgttcccattgtcacgatttagctcccacatggcgcgacttcgccaaagagtctctccggtag

SEQ ID NO: 221112 - DNA, 999 bp, Artificial Sequence
  Description of Artificial Sequence: Synthetic coding sequence
atgggtgtgtggttgaacaaggatgactacatccgcgaccttaaacggatcattctctgttttctaatcgtctacatggccattcttgtaggcactgatcaagatttctactctttactcggagtgtccaagactgccagctccagggagatccgccaggcttttaagaagctcgctctgaagctccaccccgacaaaaaccccaataaccccaacgctcacggtgactttctgaagataaatcgggcatacgaagtattgaaggatgaagacctgagaaagaagtatgacaagtatggggaaaagggcctggaggacaatcaggggggacagtacgagtcctggaactactaccgctatgactttgggatttatgatgacgacccagagatcatcaccttagaaagaagggagtttgatgctgcagtcaactcaggagaactttggtttgtaaatttttacagccctgggtgttcacattgccacgacctggccccaacatggagggactttgcgaaggaggtggatgggctcctgcggattggggctgtcaactgtggagatgatagaatgctttgtagaatgaagggtgtcaattcctacccctcacttttcatcttcaggagcggaatggcccctgtgaagtaccacggggatagatccaaagaaagcctggttagcttcgcaatgcagcacgtgcggtctactgtaaccgagctgtggactgggaatttcgtcaactccatccagaccgcatttgccgcagggattggatggctcatcaccttttgttcaaaggggggagattgcctgacctcccagactagacttagactttctggaatgctggatgggttggtgaacgtaggatggatggactgtgcaacccaagataatctgtgtaagtcactcgatatcacaacgagcaccaccgcctacttccccccaggggctacgttaaataataaggaaaagaactccattctgctcctacattag

SEQ ID NO: 221113 - DNA, 6732 bp, Artificial Sequence
  Description of Artificial Sequence: Synthetic coding sequence
atgaatatcatacgagagaacaaagacttggcgtgtttttacacaaccaagcatagctggcggggaaagtataaaagagtgttctctgttggaacgcacgcgatcactacctataatccaaacacattggaggtgacgaatcagtggccatatggagatatctgttcgatcagtccagtcgggaaggggcagggaaccgagttcaacctcacctttaggaaggggagcgggaagaaatccgaaacactgaagttctccaccgaacaccgaaccgagctgcttactgaggctctgcgtttcaggactgattttagtgagggcaagattacaggacgacggtacaattgttacaagcatcactggtccgactcacgcaaaccagtcatcttagaagtcacacccggaggatttgatcagatcaatcctgctaccaacagggtcctctgctcatatgactaccgcaatattgaaggctttgtagacttatccgattaccaggggggtttttgcattctgtacggagggtttagcaggttgcatttgtttgcctccgaacaaagggaggagatcatcaagtctgccatcgatcatgctgggaattacattggcatcagcctgcggattcggaaggaaccactagagttcgagcagtacttaaatctgcgtttcgggaaatacagcacagacgagagcataacatctttagccgagtttgtggtgcagaaaatcagccctagacattccgagccagtcaaacgcgtcctggcactaacagaaacatgtctagttgagcgcgatccggctacatacaatatagcaacactgaagcctttaggcgaggtgtttgctctggtgtgtgacagcgaaaacccccagctctttacaatcgagttcatcaagggccaggttcgtaaatactctagtacagagagagacagtctgcttgcatcattgttggacggtgtgcgtgcatctggaaacagggacgtatgcgtgaaaatgacaccgactcacaaaggtcaaagatgggggcttctctccatgcctgttgacgaggaggttgagtccctacacctgagatttctggcgacacctcccaatggaaacttcgccgacgcagtgttccgctttaatgctaacattagctattccggagtcttgcacgccgtgacccaggatgggcttttctctgaaaataaggaaaaactcattaacaatgctataacagccctcctgagtcaggagggtgacgtcgttgcgtctaacgccgaactggaaagtcaatttcaggccgtgcgcagacttgttgcctccaaggcaggctttctcgcattcacacagctgcccaagttcagagagcgcttgggcgttaaggtcgtgaaggccctaaagcgaagcaataacggcatcatccacgccgctgtggatatgctgtgcgcccttatgtgtccaatgcatgacgactatgatctgcgtcaggaacaactgaataaagcctccctgctctcgagcaaaaagtttctggagaacctgctggagaagtttaactcccacgtggatcatggcactggagctctggtgatcagctcactccttgattttctgacattcgcattgtgcgccccttactccgaaacgacagagggccaacaattcgatatgctcctggagatggtggcatctaacggcagaactctgtttaagctgttccagcatcccagtatggcaataattaaaggggctggcttggtgatgaaagccattatcgaagagggtgacaaagagatcgcgacaaagatgcaagaacttgccctcagcgaaggcgcactgccgaggcatttgcataccgccatgtttacaatcagttcagatcagcgaatgcttaccaaccggcagctgtcccggcatttagtgggcctgtggaccgcagataacgctacagcaactaatcttctgaagcggatcctgcctccaggtttactcgcgtacctggagtcgagcgatctcgttccagaaaaggacgcggatcgtatgcacgtgcgggataatgttaaaatcgctatggaccagtacggcaagtttaataaggtgccagagtggcagcgcctggctgggaaagccgcaaaggaggtggagaagtttgcgaaggagaaggtcgatcttgtgcttatgcactggcgggatcgaatggggatcgcccagaaggagaatatcaaccagaagccagtggttttacgtaagagacgacagcgaattaagattgaggctaactgggacctgttctattatcggtttggacaggatcacgcccgaagcaatctgatctggaatttcaagacccgtgaggaacttaaggacacactggaaagcgagatgcgcgctttcaatattgaccgggaactaggcagcgctaacgtcatctcttggaatcaccacgaatttgaggtcaaatatgaatgcctggctgaggaaattaagatcggcgattactacctgagactccttttggaggaggacgagaacgaggaatctggctctatcaagaggtcctacgagttctttaatgagttataccatagattcctcctgacaccaaaagtgaacatgaaatgtctgtgcctgcaggcgttggccatcgtatacgggaggtgccacgaagagatcggtccatttaccgacacacggtatatcattgggatgctggaacgctgtaccgataaacttgaaagagataggctgatacttttcctgaacaaattgatcctgaataagaagaatgtgaaggacctgatggatagcaatggtatcaggattctggtggatctgctcacgcttgcccatttacatgtctctagggccacagtcccgctccagagcaacgtaattgaggctgctcctgatatgaaacgagagtctgagaaagagtggtattttggcaacgccgataaagaaaggtctgggccttacggcttccacgagatgcaggaactctggacaaagggcatgctcaatgccaaaacacgttgttgggcacagggaatggacggctggcgcccactgcagtctatccctcagctgaaatggtgcttgctggctagcggacaagccgtcctgaatgagacagatctggccacgttgatcctgaatatgcttatcacgatgtgcggctactttccaagcagggaccaggataacgctatcatccgacccttacctaaggtcaaacggctgcttagcgactccacctgtctcccgcatatcatacaactgctgttgactttcgatcctatcctggtcgaaaaagtggcaatcctcctgtatcacatcatgcaagacaacccacagttgcctcgactctatctgagtggggtgttcttcttcatcatgatgtataccggaagtaatgtcctgccagttgctagatttttgaagtacacacacaccaaacaagcattcaagagcgaggaaactaaaggccaggacatattccaacgcagcattttaggtcatatcctaccagaggccatggtgtgctacctggaaaattatgaacctgagaaattttcggagatttttctcggcgagttcgatacccccgaggcgatttggagttctgaaatgcgtagactgatgatcgaaaagattgcagcacatttggccgatttcacacctaggctgcagtctaacacaagagcgctttatcagtactgtcccatccccatcatcaattacccccagctcgagaacgagctattttgcaatatttactacctgaagcaactttgcgacaccctgagatttcccgattggccgattaaagaccccgtgaaattgctgaaggacactctggatgcttggaaaaaagaagtggagaagaaaccaccaatgatgagcattgacgacgcttacgaggtattaaatcttccacagggccagggacctcacgacgagagcaaaatcaggaaggcctattttaggctcgcacaaaagtaccatcctgataagaatcctgagggcagagatatgttcgagaaggtcaataaagcctatgagttcctttgtacaaagagcgcaaaaatcgtcgacggccctgatccggagaacatcatcttaatcttgaagacccagtcaatccttttcaacagacataaggaggacttgcaaccatacaaatacgccggataccctatgctgatccgcaccatcacgatggaaaccagtgacgacctgctcttctcaaaagagagccctctcctgcctgctgctacggaacttgcattccatacagtgaattgctcggccctcaatgcagaagagttgcgtagagagaatggcttggaggtgctccaggaagcattcagccgctgtgtcgccgtacttacaagagcaagtaaacccagcgacatgtcggttcaggtttgcggatatatctcaaagtgctattccgttgccgctcagtttgaagagtgccgagaaaaaattaccgaaatgccctccatcatcaaagacctctgtagggttttgtatttcgggaagtccattccacgagtggcggcattgggagtcgaatgtgtgtcgagtttcgctgtggatttctggctccagacccacctgtttcaagcgggaatcctgtggtatttattaggattcctttttaactacgactataccctggaagagagcgggatccagaagagcgaggaaacgaatcagcaggaggtggcaaattccctggcaaaattgtctgtccacgctctgagccgcctgggtggttacctggccgaagaacaggccacccccgagaatccaacaatcaggaaatcccttgctggcatgcttactccctacgtggcccgaaagctcgccgtggcctcagtgaccgagattcttaagatgctgaattcaaacaccgaaagtccatacctcatctggaacaattctactagggccgagctgctcgagttcttggagtctcagcaggaaaatatgatcaagaagggcgactgtgataaaacttacggcagtgaattcgtttacagcgatcacgccaaggaactaatcgttggcgagattttcgtccgtgtgtataacgaggtgcccacttttcagcttgaggtgcccaaggctttcgcagccagcttgttagactatattgggagccaggcccaataccttcacacctttatggccattacacacgctgcaaaggttgaatcagagcagcatggcgaccgtcttcctagggtggaaatggcactggaggccttgagaaacgtcatcaagtacaatccgggatctgaatctgaatgcatcggccattttaaactgatattcagcctactgcgtgttcacggagcaggccaggtacagcagctcgcgctggaggtggtgaacattgtgacctcaaaccaggactgcgtaaataacatcgcagagtctatggtcctgtccagcctgctcgcactgcttcactcgctgccaagctccaggcaactcgtactcgaaacgctgtatgccctgaccagctctaccaaaatcatcaaagaagccatggctaaaggggctttaatctatctactcgatatgttttgtaacagcactcatccgcaagtgcgggctcaaaccgccgagctgttcgccaagatgacggcggacaaacttatcgggcctaaagtgagaataaccctaatgaaattcctgcccagtgtattcatggacgccatgcgtgataatcccgaggctgcagtccatatcttcgaaggaactcatgaaaaccccgagctgatatggaacgataattctagagataaagtttctaccactgtgagagaaatgatgctggagcactttaaaaaccagcaggataatcctgaggctaactggaagctccccgaagattttgctgtggtgttcggggaggcagaaggagagctggctgtcggtggcgtgttcttgcgcatttttatagctcagcccgcttgggtccttcggaaaccccgagaattccttattgccctgctcgagaagttgaccgaactgctcgagaagaacaatccacacggcgagaccctggagaccctgaccatggcgactgtatgtctcttcagcgctcagccacagctcgctgatcaggtacctcctcttggccatctgcctaaggtgatccaggctatgaatcaccggaacaatgcaatacctaagagcgcaattcgagtgatacatgcactcagtgagaacgaattgtgcgtgcgggcaatggccagcctcgagaccatcggccctcttatgaacggcatgaagaagcgggctgatactgtgggcctggcctgcgaggccatcaaccgcatgtttcagaaagaacagtccgagctggttgctcaagcactcaaggcggatctggtcccttatctgttgaaacttttagagggtatcggactcgaaaatttggactcccccgctgctaccaaggctcagatagtaaaagcattgaaggcaatgacgcggagcctccaatatggcgaacaggtcaacgaaattctttgtaggagcagcgtgtggagtgccttcaaggatcagaagcacgatctgttcatttccgaaagtcaaacggctggctatctgactggccctggggtggccggatacctcacagcaggaactagcacctccgtcatgagtaatctgcctcctccagtggatcatgaggctggtgacttggggtatcaaacatat

SEQ ID NO: 221114 - DNA, 2673 bp, Artificial Sequence
  Description of Artificial Sequence: Synthetic coding sequence
atgtaccagatttcaaagaattcaggctgggccaggagtcgggagtataattttaacctgaagacccaatctatactctttaacagacataaagaggacctccaaccctataaatacgcaggctatccaatgctgattaggacgatcacaatggagacaagcgatgacctgctcttttctaaggaatcacctttactaccggctgctaccgagctcgcgttccacaccgttaattgctcagccctgaatgctgaggaactgcggagggagaacggcttagaagtgctgcaggaagctttttcgcgctgcgtcgcggtgctcaccagagcctccaagccatcagatatgtccgtccaagtatgtggctacatttctaagtgctatagcgtggctgcccagttcgaggagtgccgcgaaaaaatcacagagatgcccagcatcattaaagatctatgcagggtgctgtatttcgggaaatcgatccctcgagtggccgctctgggagttgaatgcgtcagctctttcgccgttgacttctggctgcaaactcatctctttcaggccggaattttgtggtacttgctaggcttcctattcaactacgattacactctggaggaatcaggtattcagaaatctgaagaaaccaaccagcaggaggttgccaacagtctggccaaactctccgttcatgctttatcccggctagggggatacctggccgaggagcaggcaacaccagagaaccccaccattcggaagtcgctggctggaatgttgactccatacgtcgcgaggaaacttgcagtggcctcagtgaccgaaatacttaagatgctcaactcaaacaccgaatctccctacctgatctggaacaactcaacacgcgctgaactgctggagttcctagagagtcagcaagagaatatgatcaagaagggagactgcgacaaaacatacggtagcgagttcgtttactctgatcacgcaaaagagttgattgttggcgaaatcttcgtgcgcgtctacaacgaagtgcctactttccagctggaggtaccaaaggctttcgccgcttcactactcgactatatcggcagccaggcccagtatctccatacctttatggctattacacatgctgcgaaggttgagtctgagcagcacggggatcggctgccgagagtcgaaatggctctggaggctctccggaatgtgattaaatacaaccccggtagcgaatccgagtgcatcgggcatttcaaactcattttctccttgcttcgcgtacacggcgcaggtcaggtccagcaactagccttggaggttgtgaacatcgtcacatctaaccaggactgtgtgaacaatatcgccgagtctatggtgctgtctagcctgttagcgctgctgcattctcttccatcatcacgtcagttagtcctggaaactctttacgccctgacaagttccacgaaaattatcaaagaggccatggctaaaggagcactcatctacctgctggacatgttctgcaactctacgcatccccaggtccgagctcaaaccgctgagctgttcgcaaagatgacggcagataagcttattggccctaaagttcggatcacattgatgaagtttctgccctccgtgtttatggacgctatgagggacaatccagaggccgcagtgcatatatttgagggtacgcatgaaaatcctgaactgatctggaacgataattctagggacaaagtcagtacgactgtgcgtgagatgatgctggagcactttaaaaatcagcaagataatccggaagcaaactggaaattgccagaggactttgccgttgtgtttggggaagctgaaggggagctggccgttggcggagtgttcctgcgaatcttcatagcccaacccgcttgggtgctgcgcaagccgagagagtttctaatcgcccttctggagaagctcactgaactgcttgagaagaataaccctcatggagaaacactggaaaccctcaccatggctacagtgtgtctttttagcgctcagccacaactggcagatcaggtcccacctctgggccatctaccgaaagttatccaggcaatgaatcaccgaaacaatgccattcctaagtccgccatccgcgtcatccatgcactgtccgagaatgagctgtgtgttagggccatggcatcgctcgaaacgattggacccctgatgaatgggatgaaaaagcgcgcagacaccgttggcctggcctgcgaggccatcaacagaatgttccagaaggagcagtcagaactggtggcccaggccctgaaggcagacttagtgccttacttgttgaagctgctggagggcattgggctggagaaccttgacagccctgcggcaacaaaggcacagattgtcaaggcgttaaaggctatgacaaggtcattgcaatacggtgaacaggtgaacgagatactttgtcgcagctccgtctggtcggctttcaaggaccagaagcacgacttatttataagcgaatcgcaaactgcaggatatcttacgggtccgggtgtcgccggatacctgaccgctggcacttcgacttcagtcatgtccaacctgccacctccagttgatcacgaagccggtgacttaggctatcaaacctag

SEQ ID NO: 221115 - DNA, 351 bp, Artificial Sequence
  Description of Artificial Sequence: Synthetic coding sequence
atggcgagcaccgtggtggctgtgggattaactattgccgcagctggctttgctggacggtacgtgttgcaggcaatgaaacacatggaaccgcaggtgaagcaagttttccagtctctcccaaaatccgcgttcagcggaggatattaccgaggtggcttcgagccgaagatgaccaagcgggaagctgctcttattcttggcgtgtcacccaccgccaacaaggggaagattagggacgcgcatcggagaatcatgctgctgaaccatcctgataagggagggtcgccctacatcgccgcaaagatcaacgaggccaaagatctcttggaaggccaagccaagaagtag

SEQ ID NO: 221116 - DNA, 1707 bp, Artificial Sequence
  Description of Artificial Sequence: Synthetic coding sequence
atgcttctgctccccagcgcagccgacggacggggaacagccatcacacatgcactgacctcagcatccacgttgtgccaggtggagccagtcgggagatggtttgaagctttcgtcaaaaggcgcaatcggaatgccagtgcttcctttcaggagctcgaggataagaaagaattgtcagaggagtccgaggatgaagaactgcagttggaagagtttcctatgctgaaaacactcgaccccaaggactggaaaaaccaagatcactatgccgtgcttgggttggggcatgtgagatataaggcaacccagcgacagatcaaagccgctcacaaggcaatggtactgaagcatcatccagataaacgtaaggccgcaggggaacccattaaagagggggataatgattactttacctgtatcaccaaggcctacgagatgttgagtgacccagtgaaaaggcgtgcattcaattccgtcgaccctacattcgacaactctgtgcccagtaagtccgaagctaaggacaatttttttgaggtttttactccagtttttgagaggaacagccgctggtccaacaagaaaaatgtccctaagctgggtgatatgaatagtagcttcgaggacgtggatatcttctacagtttctggtacaatttcgacagctggcgggaattttcatacctggatgaggaggaaaaggaaaaggcggagtgcagggatgagcggagatggattgagaagcagaacagggccactcgcgctcaacgcaagaaagaggagatgaacaggattcgaacactggtagataatgcatattcttgcgatcccaggatcaagaagttcaaggaggaagagaaagcaaagaaagaagcggagaagaaggccaaggccgaagcaaagagaaaagaacaggaggccaaggaaaaacaacgccaggcagaactggaggcagcgagattagccaaggagaaagaggaggaagaagtccggcagcaggctctgctcgctaagaaggaaaaagacatccaaaagaaagctatcaagaaggaacggcagaaactgaggaattcatgcaaaatagaggaaataaacgagcagatacggaaagaaaaggaagaagccgaagcacgcatgagacaggcttccaaaaacacagagaaatctaccggaggcggagggaatggctccaagaattggagtgaagatgatctccaactgttaatcaaggccgtgaatctcttcccggcaggtaccaactctaggtgggaggtaatagccaattatatgaacattcatagttctagtggagtgaaacgcactgccaaggacgtcatcggcaaggccaaaagccttcagaaactggaccctcatcagaaggatgatatcaataagaaagctttcgacaagtttaagaaagaacacggtgtagtgccccaagcggataatgccactccgtctgaacggtttgagggcccttatactgatttcacgccttggactacagaagagcagaaacttctggagcaagcactgaaaacgtatcccgtgaacacacccgaaaggtgggagaaaatcgccgaagccgtcccaggcaggaccaagaaggactgcatgaagagatacaaagagctggtggaaatggtgaaggccaaaaaagcagcgcaggaacaggttttgaatgcaagccgtgcaaagaaatag

SEQ ID NO: 221117 - DNA, 1866 bp, Artificial Sequence
  Description of Artificial Sequence: Synthetic coding sequence
atgttattgcttccttctgccgctgacggcagaggaacagcaattacacatgctctgacctcagctagcactctttgtcaagtagagcccgtgggccgatggtttgaagctttcgtgaagcgcaggaatagaaatgcatctgcctccttccaggaacttgaggacaagaaggaattgtcagaagagtctgaggatgaggaactgcagctggaggagttcccaatgttgaaaaccctggatcctaaggattggaaaaatcaggatcattacgccgttttgggtctgggacatgtacgctataaagcgacccagcgccagattaaggctgcccataaagccatggtgctaaagcatcacccagacaagcggaaggctgccggagagcccatcaaagaaggtgataatgattactttacatgcatcaccaaagcctatgaaatgctttctgacccagtgaagaggagggcctttaacagcgtggaccctaccttcgacaactccgttcccagtaagtcggaggcgaaggataatttttttgaggtgttcaccccagtgtttgagagaaactcccggtggtctaacaagaaaaatgtgcctaagctaggcgatatgaatagctccttcgaggacgtggatattttttattccttctggtataacttcgattcgtggagggaattctcctatcttgatgaggaggagaaagagaaggctgagtgtcgcgacgaacgtaggtggatcgagaagcagaatcgagccactagagcgcaaagaaaaaaggaggagatgaataggatccggacgttggtcgataacgcatattcatgtgatcccagaatcaaaaagttcaaagaggaagagaaagctaaaaaagaggctgagaaaaaggccaaggccgaggctaagagaaaggaacaggaggcgaaagaaaagcagaggcaggccgagctggaggctgccagactcgcgaaggagaaggaggaggaggaggttagacagcaagcattgctggctaagaaggaaaaagatatccagaagaaagctataaaaaaggaaaggcaaaaactccgtaattcatgtaaaacctggaaccacttctccgataacgaggcagaaagagtaaagatgatggaagaggtcgagaaactgtgtgacagactggagctagcaagcttacaatgtctgaacgagaccctcacaagttgcactaaagaggtagggaaggcagccttggagaagcagatcgaggaaatcaatgaacaaatccgcaaagagaaggaggaggcggaggctaggatgaggcaagcctctaagaacaccgagaagtccactgggggagggggtaatggaagcaaaaactggagcgaggatgatcttcagctgctgatcaaagccgtcaacttgttccctgcagggactaattcacgatgggaagtgatagccaattatatgaacattcactccagtagcggcgtgaaacgaaccgcaaaagatgttatcggaaaagctaagtctctgcaaaaactggatcctcaccaaaaagatgatattaacaagaaggcgttcgataaatttaagaaagagcacggcgtggtccctcaggcagacaatgcaacaccaagcgagcggttcgaaggcccttatactgattttaccccttggaccactgaggaacagaaattgctggaacaggctctgaagacgtaccctgttaacacccctgaaaggtgggagaagattgccgaagccgttccgggacggactaagaaagactgtatgaaacgttataaggagctggtggaaatggtcaaagctaagaaagccgctcaggagcaggtgcttaacgccagtcgtgccaagaagtag

SEQ ID NO: 221118 - DNA, 609 bp, Artificial Sequence
  Description of Artificial Sequence: Synthetic coding sequence
atgctcctgttgccaagcgcggctgacggccgaggaacggcgatcacccatgctctgacgtccgcctccaccttgtgccaggtggaaccggttgggcgatggttcgaggccttcgtcaagcgccgaaacaggaatgcatcagccagctttcaagagttggaggacaagaaggagctgtccgaggaaagcgaagacgaggaattgcagctggaagagtttccgatgttaaagacccttgaccctaaggactggaagaaccaagaccactacgccgtgctgggacttgggcacgttcgatataaggccacccagagacagattaaggcagctcacaaggccatggtgttaaagcatcatcctgacaagagaaaggccgctggcgagccaatcaaggaaggggataatgattatttcacctgcatcaccaaagcctacgagatgttgagtgacccggtgaaacggcgtgcctttaattctgtcgaccccacgtttgacaattccgtcccctcgaaatccgaggcaaaggacaacttttttgaagtgtttactcccgtgttcgaacgaaactcacgtgtgagcatctcaaagaagaagaagaaaaagcggtag

SEQ ID NO: 221119 - DNA, 822 bp, Artificial Sequence
  Description of Artificial Sequence: Synthetic coding sequence
atggaagccaacatgccaaaacggaaggaacctggcagatctcttcgcattaaggtaatctcaatgggaaacgctgaagtcggcaagtcatgcataataaagcggtactgcgagaaacggttcgtgagtaaataccttgccaccatcggcatagattacggggtgacgaaagtccatgtgcgggaccgagagatcaaggtaaacatttttgacatggccggacaccctttcttctacgaggtccggaatgaattttacaaggacacgcagggagtgatcttagtttacgatgtgggtcaaaaagattcctttgacgccctggatgcttggctggccgagatgaaacaggaattggggccacatgggaacatggaaaatattatcttcgtggtgtgtgcgaacaaaatagactgcactaaacacagatgcgtagacgaaagtgaaggcaggctctgggccgagagtaaaggatttctatactttgaaaccagcgctcagaccggagaaggtattaacgaaatgtttcagaccttctatatcagtatcgtggacctttgcgaaaatggtggaaagcggccaacgaccaatagctccgcctccttcaccaaggagcaggctgacgccattcgcagaatccgcaatagcaaggatagctgggacatgctcggggtcaaaccaggtgctagtcgtgatgaggtgaataaagcctataggaaacttgccgtgttactccaccccgataagtgtgttgctcctggcagtgaggacgcctttaaagcggtcgtgaacgcccgtaccgccctgttgaaaaatataaaatag

SEQ ID NO: 221120 - DNA, 609 bp, Artificial Sequence
  Description of Artificial Sequence: Synthetic coding sequence
atggcgggtcacccattcttttacgaagtcagaaatgaattctataaagacacccaaggcgtgatactcgtgtatgatgtaggccaaaaggatagttttgacgcactggacgcctggcttgccgagatgaagcaagagctgggtccccatgggaacatggaaaatattatatttgtggtttgcgctaataaaatcgactgtactaagcacaggtgcgtggacgaatctgaaggccgtctgtgggcagagagcaagggcttcctctacttcgagacgtcagcccagactggtgagggaattaacgagatgttccagaccttctatattagcatcgtggacctttgtgagaatggagggaaacggccaacaactaactcaagcgccagcttcactaaggagcaagccgacgcgatacgcagaataaggaatagcaaggactcctgggatatgttgggagtcaagcctggagcctcgcgcgatgaggtgaataaggcctaccgtaagttggccgtgctcctgcacccagacaaatgtgtcgcacccggtagcgaggacgcgttcaaagccgtggtgaatgccaggacagccttactcaaaaacattaagtag

SEQ ID NO: 221121 - DNA, 1515 bp, Artificial Sequence
  Description of Artificial Sequence: Synthetic coding sequence
atggtcgcgccaggcagcgttacttcgagattaggcagtgtgtttccttttctgctggttctcgtcgatttgcagtatgaaggagctgagtgcggcgtcaacgccgacgtagagaagcacttggaactcggtaagaagctgttggccgcagggcagctcgccgacgctttgagccagttccacgccgctgtcgatggggatccagataattatatagcatattatcgacgcgctactgtgtttttagcaatgggaaaaagtaaggccgcactccctgacctaacaaaagtcattcagctgaagatggactttactgctgccaggctgcagagggggcacctgctcttaaagcaagggaagcttgacgaggcagaggatgatttcaaaaaggtgctaaaatctaacccaagcgagaacgaggagaaggaggcgcagagtcagctgatcaagtctgatgaaatgcagcgactcaggtcacaagccctgaacgctttcggcagcggcgattatacagcagctatcgcttttttagacaagattctggaagtgtgcgtgtgggacgccgaactgcgtgagttaagggcagagtgtttcatcaaggaaggtgagcctcgtaaagcaatctcagatctaaaggcagcgagtaaactaaagaacgataacaccgaggctttctacaagatctccaccctatattatcagctgggagaccacgaactgagtctgagcgaggtgcgagaatgtctgaaactggaccaggaccataagcgctgctttgcccactataagcaggtgaagaagctgaataagttgatcgaaagcgccgaggaacttatccgggacggcaggtacactgacgcgacatctaagtatgaatctgtcatgaagactgagccaagcatcgccgagtataccgtgcgctctaaggaacgaatctgtcattgtttctccaaggacgagaaacccgtggaagctattagggtgtgtagtgaggtgcttcagatggagcctgacaatgtcaatgccctcaaagaccgagctgaagcctacctgatcgaagaaatgtacgatgaagccattcaagattacgaaactgcgcaggaacataacgagaacgatcagcaaattcgcgaagggctcgagaaggcacagaggctgctgaaacagtcacagaagagagactattataagatcctcggcgtgaaacggaatgccaagaaacaggaaatcatcaaagcttacaggaagctggcactgcaatggcaccccgataattttcagaatgaagaggaaaagaagaaggctgagaaaaagtttatagacatcgcggcagcgaaggaggtcctatctgacccagaaatgcgtaagaagtttgatgacggggaggaccctctggatgcagagtcccaacagggtggcggagggaacccgtttcatcgatcttggaatagctggcagggcttcaatccattttcttctggaggacccttccgcttcaaatttcatttcaactag

SEQ ID NO: 221122 - DNA, 597 bp, Artificial Sequence
  Description of Artificial Sequence: Synthetic coding sequence
atggcagatcagaggcagcgttcactgagtacatcaggggagtcgttgtatcatgtactgggcctcgacaagaacgcaacttctgacgacatcaagaagtcctataggaaactggccctcaagtatcaccctgataaaaacccagacaaccctgaagccgctgacaaatttaaggaaataaataatgcccatgctatcttaacagacgccactaaacgcaatatctatgacaaatacggtagcctggggctttatgtggccgagcagtttggagaagaaaatgtgaatacatatttcgtgctgagcagctggtgggccaaggctctgtttgtattttgcggtctgcttacatgctgttactgctgctgttgcctgtgctgctgttttaactgctgctgcggaaagtgcaaaccaaaggctccggaaggtgaagagactgaattctacgtgagtcctgaagatttggaggctcagctacagtcggatgagagagaggccaccgacactcccatcgtgatacagccagccagtgcgactgagacaactcagctgactgctgattcacatccatcttaccatacagatggctttaattag

SEQ ID NO: 221123 - DNA, 504 bp, Artificial Sequence
  Description of Artificial Sequence: Synthetic coding sequence
atggccgaccaacggcaacggtcgctctctactagcggcgagtcactttaccacgtattagggctggataaaaacgcaacttccgacgacatcaaaaagagttacagaaagctggctctgaagtaccacccagacaagaatcctgacaatcccgaagccgctgataagtttaaggaaatcaataacgcccatgcaatcttaacagacgccaccaaaaggaatatttacgacaaatacgggagccttggcttgtatgtagcagagcagttcggagaagagaacgtgaatacttactttgtgcttagttcatggtgggccaaggccctatttgtgttctgtggactgcttacatgttgctattgttgttgctgtctctgttgttgctttaactgttgctgcgggaaatgcaaacccaaagcacctgaaggcgaggagacagagttttatgtcagcccggaagacctggaggcacagcttcagtctgatgagcgcggaggccattag

SEQ ID NO: 221124 - DNA, 600 bp, Artificial Sequence
  Description of Artificial Sequence: Synthetic coding sequence
atggcgtgtaatattcctaaccaacggcagcgcacactgtctaccactggtgaggcactgtacgagatcttgggactccataaaggcgctagcaatgaggaaataaagaagacatacagaaaactggcgttgaagcatcacccagataagaatcctgatgatccagcagcgaccgagaagtttaaggagataaacaacgcccatgcgatcctcacagatatttcgaaacgaagcatttacgacaagtacggatcgctggggctgtatgtggctgagcagtttggagatgagaacgttaacacttactttatgttgtcatcctggtgggccaaagctctgttcgtgatcgtcggtcttctgactgggtgctacttttgttgctgcctgtgctgttgctgcaattgttgctgcggacactgtagaccagaatcaagcgtacccgaggaggatttttacgtctctccagaagacctggaggagcagatcaagtctgatatggagaaggacgtggacttccctgtctttttacagccaaccaatgctaacgagaagactcagttgatcaaagaagggagcagatcttattgtactgactcttag

SEQ ID NO: 221125 - DNA, 570 bp, Artificial Sequence
  Description of Artificial Sequence: Synthetic coding sequence
atgagcaccgtgaaggaggccgctcatagactgtccaagtcagagatgtcactgtatgccgtactagacctcaaaaagggcgctagcccagaagattttaagaaatcgtacagtcactcagccctcctgccacatcccccattcgagtatcacttgggcagaaagctcgcgctgcgatatcaccctgataaaaacccaggtaacgcacaggccgctgaaatctttaaggaaattaacgctgcccatgccatactctcggactctaaaaagcggaaaatatatgaccagcatggaagtctggggatctatctgtatgatcactttggcgaggaaggcgtgcggtactactttattctgaacagttgctggtttaaaaccctggtcatcttgtgcactcttctgacttgctgttgtttctgttgttgttgctgtttttgttgtggcgctctcaagcctccccctgaacaggactccggccgtaaatatcagcagaatgtgcagagccagcccccaagatcaggagcaaagtgcgactttcgatccgaagagaactccgaagatgacttctag

SEQ ID NO: 221126 - DNA, 570 bp, Artificial Sequence
  Description of Artificial Sequence: Synthetic coding sequence
atgagcaccgtgaaggaagccgctcatcggttgtccaagtccgagatgtccctgtatgctgtgttagacctgaagaaaggggcttcccccgaggatttcaaaaagtcttattctcactcagctctgctgccacaccccccttttgaataccaccttggccgaaagctggccctgaggtaccaccctgataagaacccaggtaacgcccaggctgccgaaatcttcaaagaaatcaacgccgctcacgctattctcagtgactcaaagaaacggaaaatctatgatcaacatggctccttgggcatttatctgtatgaccattttggagaagagggcgttcgctactatttcatcctcaactcttgttggtttaagacgttggtcattctgtgcactctgctcacgtgctgctgtttctgttgctgctgttgcttttgctgcggtgcactaaaaccccctccagagcaggatagtggccgtaaataccagcaaaacgtgcagagtcaacccccacggagcggagcaaagtgtgattttaggtccgaagagaattctgaggacgacttctag

SEQ ID NO: 221127 - DNA, 2703 bp, Artificial Sequence
  Description of Artificial Sequence: Synthetic coding sequence
atggaaccttcgtatggcggagggctctttgacatggttaagggcggtgctgggagactgttctctaatttgaaggataacctcaaagacacccttaaagatacctcgtcgcgggtgatccagagcgtcacatcgtacactaagggtgacctcgactttacatacgtcaccagccggatcatcgtgatgagcttccctctggataacgtggacataggcttccgcaaccaggtggatgatattaggtctttcctcgactcacggcacctcgaccactacacagtgtataacttgagtcctaagagttatagaacggctaaattccactcacgcgtgtccgagtgcagttggccaatccgccaggccccttcacttcataacctgttcgccgtctgtagaaacatgtacaactggctacttcagaatcctaagaatgtatgtgtggttcattgccttgacggtcgcgctgcctccagcatactggtaggggcaatgtttattttctgtaacttgtattctacccctggaccagcaatcaggctcctgtacgcaaagagacccggaataggactgtccccatctcaccgtagatacctggggtacatgtgtgatctgctggctgacaagccttatcgtccccactttaaacccttgaccattaaatcaattactgtgtcaccaattccgttcttcaacaaacagcggaacggatgcaggccatattgtgacgtcctgattggtgaaacaaagatttactctacgtgtaccgatttcgagcgaatgaaggaatacagagtgcaagacggaaagatctttatacctctgaatattaccgtgcaaggcgacgtggtagtgtctatgtatcacctccgtagcacaatcggtagcaggctacaagccaaggtaacaaacacacagatcttccagttgcagttccacactggattcatccccttagatactacagtgctcaagttcacaaaacctgagttggatgcctgtgacgtgccagagaagtatcctcaactattccaagtcactctggacgttgagctccagccacacgacaaagtgatcgacttgacaccaccctgggagcactattgcactaaagatgtgaacccatctatactgttctccagtcaccaggagcaccaggacactcttgcattgggagggcaagctccgatagacattccacctgataatccaagacactatggccagagcggcttcttcgccagcctgtgttggcaggatcagaaaagcgaaaagagcttctgtgaagaagaccatgccgctctagtcaatcaagagagtgaacagtcagatgacgagctgctcactttgtccagcccgcatgggaatgcgaatggggataaaccacatggagttaagaagccatctaaaaagcaacaggagccagccgctcccccacctcccgaagacgtagatcttctaggcctagaaggttccgccatgtctaactcattctccccccctgccgcacctcccacaaacagcgaactgttaagtgacctgtttgggggaggcggagccgctgggcctacccaggctgggcagagtggtgtggaagacgtgttccatcccagtggaccagcgtcaacacagtcaacgccgcgaagatctgcgacctccacatccgccagcccaacactgagagtgggcgagggcgctacattcgaccccttcggcgctccttcaaaacctagtgggcaggacctcctgggatcattccttaataccagttccgctagctctgacccctttctgcaacctacaagaagcccctcccccactgtccatgcttctagcacacctgctgttaacatccagcccgacgtttccgggggatgggactggcacgccaagcctggagggttcggaatgggatcaaaatctgcagctacatcgcctacaggcagctcacacgggacccccacgcaccagtctaagccacaaaccctcgatcccttcgcagatctcgggaccctggggagttcttctttcgcttctaagccgacaacacctacgggcctcgggggaggattcccgccattgtcctctccacagaaagcctctcctcagccgatgggcggagggtggcaacaaggcggtgcatacaactggcagcaaccacaacccaagccccagccatccatgccccatagctctcctcagaatcggccaaattacaatgtgagcttcagcgccatgccaggtggccagaacgaacgcggaaaaggaagctctaaccttgagggcaagcagaaggcggctgacttcgaagacctgctatcaggccagggtttcaatgcacataaagacaagaagggaccaagaactatcgctgagatgaggaaggaagaaatggctaaagaaatggatcccgagaagctgaagatcctggagtggatagagggcaaggagcgtaacatacgggcactccttagtacgatgcatacagtcctgtgggctggagagactaagtggaaacccgttgggatggcagacctggttactccagaacaagtcaaaaaggtttataggaaggcggtgctggtggtccatcccgacaaggctacgggccagccctacgagcagtatgcaaagatgatattcatggagttaaatgacgcatggtcagagtttgaaaaccaggggcagaaacctttatactag

SEQ ID NO: 221128 - DNA, 2913 bp, Artificial Sequence
  Description of Artificial Sequence: Synthetic coding sequence
atgtctttgctcggcagctatagaaaaaaaacatccaacgatggatacgaatctctgcagctggtagattctaatggcgatttgagcgcaggatctggaggtgtaggcggtaaacagcgcgtgaacgcgggtgcagctgcgaggagtcctgcaaggcaacctcccgaccgcgcatccaccatggactccagtggagcctctagtcccgacatggagccgagctatgggggtgggctgttcgatatggttaaaggaggcgctggtagactgttctccaatcttaaagacaatctgaaagacacactgaaggatacctctagccgcgtgatccagagtgttaccagctataccaagggtgatttagactttacatacgtgactagcaggattatcgtcatgtcgttccccttggacaacgtggatatcggctttcggaaccaagtggatgatatcaggtcctttctggacagcaggcaccttgatcactacaccgtgtacaatctgagtcccaagagttacaggactgccaaatttcattcccgggtcagtgagtgttcgtggccaataagacaggccccttcactccataacctcttcgccgtatgcagaaacatgtacaattggctgttgcagaacccgaaaaacgtctgtgtggttcattgtcttgatggcagagctgccagctctatcctagtgggcgcaatgttcattttttgcaatctgtacagcactccaggcccagctattaggcttctgtacgcaaaaagaccaggaatcggattgagcccttctcaccggcgatatctgggctatatgtgcgacctgttggctgacaagccttaccgccctcatttcaaacccctaacaattaaaagcatcacggtatctccaattccatttttcaacaagcagagaaatgggtgtcgaccatactgcgacgtactgattggcgaaaccaaaatttatagcacttgcacggactttgaacgaatgaaagagtacagagtgcaggacggaaagattttcataccgctaaacatcactgtccagggtgatgtggtcgtgagcatgtaccacctcaggtctacaatcggctcccggctccaggcaaaggtcactaatacacagatattccagctccaattccacaccgggttcatcccacttgacaccacagtgcttaaattcacaaagccagagctggatgcgtgtgacgtgcccgagaagtatccgcaactttttcaggtcactttggacgtggaactacagcctcacgataaggtcatcgatctgactcccccttgggaacactactgtacaaaggacgtgaatccttctatcctgttttcaagtcatcaggaacaccaggatactttagccttggggggtcaggcacccatcgatatcccacccgacaacccacgacattacggacagtcgggtttctttgcttctttgtgttggcaggaccaaaagagcgagaagtccttctgcgaagaggatcatgctgctctggtgaatcaagaaagcgaacagagtgatgacgaactgctcaccctgtctagccctcatggaaatgccaacggggacaagccgcacggggttaaaaagccttccaaaaaacagcaggagccagctgcacccccaccccctgaagatgttgacttgctgggactcgaggggagcgctatgtcgaactctttttcaccccctgctgcgcctcccacaaattcagagctgctgtccgatctcttcggaggcggaggtgctgctggccctactcaagctgggcagagcggggtggaggacgttttccacccaagcggaccagccagcacacagtcaacacctaggcggtccgccacatccacatctgcttcaccaacattaagggtgggcgagggagccacttttgaccccttcggtgctccctctaagccttcaggccaggatttgttggggagctttctgaatacttcgtccgccagttcagatcccttcttgcagcctacgcgcagcccgtcaccaaccgttcacgcttcaagtacccctgccgtaaacatccaacctgatgtttctggaggttgggattggcacgcaaaaccaggcggtttcgggatgggttctaagagcgctgccactagccccaccggtagttctcatggcacgcccacccaccaaagcaaaccacagactctggacccgtttgctgacctcggaacgcttggctcctcttcttttgcaagcaaacctactaccccgaccggactcggcggagggttcccccctctgtcctcaccccagaaggcttctcctcagcccatgggcggtggttggcaacaagggggagcctacaactggcaacaaccacagccaaagccccagccatctatgccccatagctctccccagaacagacctaattataacgtctccttctctgccatgccagggggacagaatgagcggggtaaggggtcttcaaatctggaaggtaaacagaaagcggctgacttcgaggatctcctgtctggtcagggcttcaatgcccataaagacaaaaagggcccacggactattgcagagatgaggaaggaagagatggctaaggagatggaccctgaaaagttgaaaatcctggagtggatcgagggaaaggaaagaaatatccgtgcgctcctcagcaccatgcacactgtgctctgggcaggcgaaactaagtggaagcctgtcggtatggctgacctggtcactccagagcaggtgaagaaagtctataggaaagctgttctggttgttcatccagataaagccacaggtcagccatatgagcaatacgctaaaatgatcttcatggagttgaacgacgcctggtccgaattcgaaaaccagggccaaaagcctctctactag

SEQ ID NO: 221129 - DNA, 2742 bp, Artificial Sequence
  Description of Artificial Sequence: Synthetic coding sequence
atgaaggatagtgaaaataagggggcttccagcccagacatggaaccctcttatggaggcggactgttcgacatggtaaaagggggagctggacgcctcttctccaatctgaaggataacctgaaagacactctgaaagacaccagtagtagagttatacaaagcgtcacctcgtatacaaaaggcgatctggacttcacgtacgtgacaagtaggataattgttatgtcattcccactggacaacgtggatatcggtttcagaaaccaggtcgacgacatcaggtcctttttagactctaggcatctagatcactacacggtatataatttgtctccgaagagctacagaacagccaaatttcattctcgcgtatctgagtgctcctggccgattcggcaggctccttcactgcataatctcttcgctgtgtgtcgtaacatgtacaactggctgctccagaaccctaagaacgtgtgtgtggtacactgtctcgacgggcgagccgcatctagcatccttgtgggcgctatgtttattttctgtaacctgtacagcacccctggacctgctatccggctgctgtatgctaaaaggcctggcattggtctttcacctagccatagacgctacctcgggtacatgtgtgacctgctcgccgataagccttaccgtccacactttaagcccctcacaattaagtctataaccgtcagtccgatccccttcttcaacaaacaaaggaacggatgtaggccttactgtgacgttctgatcggggaaactaaaatttactccacttgtacagacttcgaaaggatgaaggagtatagagtgcaagacggcaagatttttattccattgaacatcaccgtgcaaggcgacgtcgttgtctctatgtaccatctcagatccaccatcggcagcagacttcaagccaaggtaacaaacactcaaatctttcagctgcagtttcacacaggcttcatccctctggatacaactgtcttaaagtttacaaaacccgaattagacgcttgtgatgtgcccgaaaaatatcctcagctgttccaggtcacccttgatgttgaactgcagccccacgataaagttatcgacctaacccctccctgggagcattactgcacaaaagatgttaaccctagcatactgttcagttcccatcaggagcaccaggataccctggctctgggaggccaggcaccgattgacatacctcccgacaatccaaggcactacggtcagtccggcttttttgcatctttatgctggcaggaccagaaatctgagaaatctttctgcgaggaggaccacgctgctctggtgaaccaggagtcagaacaaagcgacgacgaactgcttactcttagcagtccacacggcaatgcaaacggcgacaaaccgcacggggtaaaaaagccatccaagaagcagcaggaaccagccgcaccacctccaccagaggatgtggacctactcggccttgagggctctgccatgtctaactccttctctccacccgctgcccctcccaccaattctgaattactctcagatctgtttgggggaggcggagccgctggccctacacaggccggacagagtggcgttgaggatgtgttccacccttctggacctgcaagtacacagagcactccaaggcgttccgcaacatctaccagcgctagtcctacactgcgcgtaggcgaaggggctacttttgacccatttggagctccatctaaaccatcaggacaggaccttttaggttcctttctaaacacctcttctgccagcagtgacccgtttctgcaacccacaagatctcccagccctactgtccatgcctcctccactccagctgtgaacattcaacccgacgtgtctggcggatgggattggcatgcaaagcccggaggattcggaatggggtcaaagagtgccgctacatcccccactggatcgtcccacgggactcccactcaccagtctaagcctcagacactggaccctttcgccgatctcgggacactcgggtctagttcattcgcgtctaaacctacgacccccactgggctgggcggaggtttcccgcctttaagttccccccagaaggcttctcctcaaccaatgggtggcggatggcagcagggcggagcatataactggcagcagccccagccaaaaccacaaccaagcatgccccattcctctccccagaacagacccaattataatgtaagtttcagcgcgatgccaggtggacagaacgagaggggcaaagggtctagcaacctggagggtaagcagaaagcagccgatttcgaggatttactctcaggacagggatttaatgctcacaaggacaagaagggccctcggacaattgccgagatgcgtaaggaggagatggcaaaggagatggatcccgagaagctcaagattctcgaatggatagaggggaaggagagaaatattcgtgcactgctctctacgatgcacaccgtcctgtgggcaggcgaaaccaaatggaaacctgtcgggatggccgaccttgtgactccagagcaggtaaaaaaggtgtatagaaaggctgtcctagttgtacatcccgacaaagccaccggccagccatacgagcagtacgctaagatgatattcatggagctgaacgacgcctggtctgagtttgagaatcagggccagaagcccctttactag

SEQ ID NO: 221130 - DNA, 783 bp, Artificial Sequence
  Description of Artificial Sequence: Synthetic coding sequence
atgggtctacttgacctctgtgaagaggtctttggtacagccgacctgtatcgagtcctgggggtcagacgggaggcatccgatggagaggtgagacgaggctatcataaggtgagcctgcaagtacacccagatcgcgttggcgagggggacaaggaggacgccacccgcagattccaaattctggggaaagtgtactcagtcctgtctgacagagagcagagggccgtgtatgacgagcaagggactgtggacgaggacagccccgtgctgacacaagaccgcgactgggaagcttattggcggctgctcttcaagaaaataagcttggaagacatccaggctttcgaaaaaacatataaaggaagtgaagaggagctggctgacattaaacaggcctacctggatttcaagggggacatggaccaaatcatggaaagtgttctatgtgtgcaatataccgaagaaccccgtataagaaatatcattcagcaagctatcgacgcgggtgaagtcccctcttacaacgcattcgtgaaggaatctaaacagaagatgaacgcgaggaagaggagggcacaggaggaagctaaagaagccgaaatgagcaggaaagagctcggcctggatgaaggtgttgattcactgaaggcggctattcagagccggcagaaggaccgacaaaaggagatggataacttcctggcccaaatggaagcgaagtattgcaagagcagtaaaggtggagggaaaaaaagtgcactgaaaaaagagaaaaagtag

SEQ ID NO: 221131 - DNA, 1029 bp, Artificial Sequence
  Description of Artificial Sequence: Synthetic coding sequence
atgctggagaacagcctgtactcaccaacgtgggaggggagccagttttgggtgaccgttcagcgtaccgaggctgccgaacggtgcggactgcacggatcctacgttttgagggtcgaggccgaacggctgacactcctgacagtcggcgcacaaagtcaaatactggagcccctgctgagctggccatacacgttgcttcgcagatatggaagggataaggttatgtttagcttcgaggccggtaggagatgtccttcaggcccaggtacatttaccttccagacagcccagggcaatgatattttccaggctgtggaaactgcaatccaccgccagaaggctcaagggaaagccggacagggacatgatgtgctccgcgctgactctcacgagggcgaagtggcagaggggaagctaccctctcctccgggaccacaggagctgctcgatagcccacccgctctttacgctgaaccattggacagcctgcgaatagctccttgtccgagccaggacagcctttactcagacccgctggattctacctctgcgcaggctggagaaggcgtacaacgaaaaaagcctctttactgggacctgtatgagcacgcacagcagcagcttctcaaggcaaaactgactgacccgaaagaagatcccatctatgacgaaccggaaggtctggcgccagtccccccacaagggctgtatgacctgccccgtgagcctaaagatgcctggtggtgccaggcacgggtgaaggaagagggatatgagctgccttacaaccctgccacggatgactacgcagttcctccccctagaagcacgaaaccactgttagcgcctaaacctcagggtccggctttccccgaacctgggactgccaccgggtctggtattaagagccataactctgccctgtatagccaagtacagaagagcggcgcaagtgggagctgggactgtgggctctccagagttggcacggacaagacaggagtcaagtcagaggggagtacctag

SEQ ID NO: 221132 - DNA, 855 bp, Artificial Sequence
  Description of Artificial Sequence: Synthetic coding sequence
atggaacccggaatgttagggccacacaatctacctcatcatgagcccatcagtttcgggatcgaccagatcttatccgggcctgagacgcccggtggcggtctgggcctcggccgagggggtcaaggccacggggaaaatggcgctttctccggtggttaccatggtgctagcgggtatggccctgcagggtccctggccccactgcccggatcatcaggagtcggacctggaggcgttattcgagtacctgcacaccggccactccccgtgccccctcctgcaggtggcgcacccgcagtgccaggcccatccggcttgggtggtgcagggggactagctgggctgacttttccatggatggacagcggcaggcgcttcgcgaaggacagactgactgcagcgctgtccccattctcaggtactaggagaattggccacccctaccaaaatcggacaccgcctaagcgcaagaaaccgaggacctccttttctcgaagccaggtgctggaactagaacgcagatttctaagacagaaatatttggcttccgctgagcgcgctgcactcgccaaagctctgcgcatgacagacgctcaggtaaagacatggtttcaaaaccggagaacgaagtggaggcgtcaaaccgctgaggaaagagaagctgagagacaccgggctggtaggctgctgctccaccttcagcaggacgctttaccgagaccactgcgaccacccctcccgccagatcctctctgcttacacaactccagtctgttcgctctccagaatttgcagccttgggccgaagataacaaagttgcttccgtgagcggcctggcatcagtcgtctag

SEQ ID NO: 221133 - DNA, 1239 bp, Artificial Sequence
  Description of Artificial Sequence: Synthetic coding sequence
atgggtgatggcgctgttaagcagggttttctgtacctccagcaacagcagacttttggaaagaaatggagaaggtttggagccagtttgtacggaggatcggactgcgccttagctagactggagcttcaggaaggacccgagaagcctagaaggtgcgaagcagctaggaaggtcatccggctgagtgactgtctcagagtggccgaagccggtggggaagcttcaagtccaagggacacatcagccttcttcctcgaaacgaaagaaaggctatacctgctcgccgcacctgcagctgagagaggagactgggtccaggcaatctgcttgttggcctttccaggtcagcggaaggaactgtccgggccagagggaaagcagtctcggccttgcatggaagagaacgagttgtattcaagtgccgtcacagttggccctcataaggaattcgccgtcactatgcgcccaacagaggcatccgagaggtgccacctcagggggtcatataccctacgggcaggggaaagcgctctcgagctctggggcggtcccgaaccaggtactcagctttacgattggccctacaggttcctccggcgatttggcagagataaggttacattttcatttgaagcgggacggaggtgtgtcagtggtgagggcaactttgagttcgagacacggcaggggaacgagatctttctggccctggaggaagccatttctgcgcagaagaacgctgcccctgccactccccagccccagcccgcaacaatccctgcttctttacccagacctgacagcccatatagtagaccccacgacagcctgcccccacctagccctaccaccccggtgccagctcccaggccacggggtcaggagggcgaatacgccgttccattcgacgctgtcgccaggtctctgggcaagaacttccgcggtattttggctgtgccacctcagttgctggccgatccactctatgatagtattgaggaaactctccccccaagacctgatcacatctacgacgaacctgaaggcgtggccgctctgagtctatacgactcccctcaggagcccagaggagaggcatggagaaggcaggccacagctgatagagatccagccggactgcagcacgtgcagccagctggacaggacttttcggccagtggttggcaaccgggtacagaatatgataatgtcgttctcaagaagggtcccaaatag

SEQ ID NO: 221134 - DNA, 777 bp, Artificial Sequence
  Description of Artificial Sequence: Synthetic coding sequence
atgagaccaacggaagcaagcgagaggtgccatttgcggggatcttacactctcagggcaggagaatccgccctggaactttggggtggacctgagcctggcacacagctctacgactggccgtatcggtttctccgccgattcggaagagacaaagtcaccttctccttcgaagctggtagaagatgtgttagtggtgaaggaaatttcgagttcgagacccgccagggaaacgagatctttcttgctttagaagaggctattagtgcccagaaaaacgctgcaccagccacgccacagcctcagcctgccacaatccccgcttccctgccaaggcccgatagcccatattctagacctcacgattccctgccacccccatctcctaccactcctgtgccagctcctcgcccacggggacaggagggagagtatgccgttcctttcgatgccgtcgccagaagtctgggaaagaactttcgcggtatcttggcagtgccaccccaactgcttgcagatcctctgtatgatagcattgaggagacactgccacccaggccggaccacatatacgacgagcctgagggagtagccgctttatccctttacgattcaccccaggagcctaggggcgaggcctggcgacgccaggctacagccgacagggatccagctgggctacaacacgtgcaaccagctggccaggacttttctgcctctggctggcagcccggaacggaatacgataacgtagtactgaaaaagggcccaaaatag

SEQ ID NO: 221135 - DNA, 993 bp, Artificial Sequence
  Description of Artificial Sequence: Synthetic coding sequence
atggaccccctggagactccaatcaaggatgggatactctaccagcagcacgtgaagttcggtaagaaatgctggcggaaagtttgggctttgctgtacgcaggcggaccttcaggcgtggcgagactcgaatcatgggaggtccgggacggcggactcggcgcagccggagatagaagtgcgggacctggacgaaggggcgagagacgcgtcatccgcctggcggattgcgtatccgtgctgcccgctgatggcgagtcttgccccagggatacaggtgccttccttctaaccactaccgagaggtcccacctgctcgcagcccaacatcgacaggcgtggatggggcctatatgccagcttgcatttcctgggacgggtgaggcctcctctggtagtaccgacgctcagtctccaaagagagggttagtccccatggaagaaaatagcatttactcaagctggcaggaagttggcgagttcccagttgtggtgcagagaactgaagctgccacacgctgtcagttaaaaggcccagcgctcctcgtgctgggaccagatgccatccagcttagggaagccaagggcactcaggccctctactcttggccgtaccactttctaagaaagttcgggtccgataagattcttctgggaacccctggtgtgagtctcctgatatgcaaaggtgagaggactgacgacgtatccgggataatcctggacgaaagcttgcttcgagcgtactctgtcccaggggctggcggacactcaagggtgcaagactctctggggccagtgttacgggaacccaccttccaaggggagcgctcgtttctcaaaacttcaatgctcagaagccttctgtgcagttgtagctggcgacatcctcggtctcaaccgagaacgcaagcctcttgcctgcaagggagcgattgtcccgcaccccacagaaactccacaagcgctgcacacacactcggtacgtcttag

SEQ ID NO: 221136 - DNA, 1491 bp, Artificial Sequence
  Description of Artificial Sequence: Synthetic coding sequence
atgactcgcggagccaggttacgcagcgacgctagggcccagctaaaccaactctcccttgacgggggaaccggtagcggccagaagggcaagtgcgaagaatttccgagctctcttagctcggtttcacccggactggaggccgctgcattgctccttgctgtgacaatggaccccctggagacccccattaaagacggaattctctatcaacagcacgtgaagttcgggaaaaaatgttggcgcaaagtctgggctctgctatatgccggagggccttccggagttgcaagactggagtcctgggaggtacgggatggcggtcttggggctgcaggggaccgcagcgcaggccctggcaggcgcggagagaggcgcgtgatccggctggccgattgtgttagtgtgctgccagccgacggggagagttgcccccgagacaccggcgcatttttgctgaccacgaccgagcgctcacacctgctcgcagcccaacacagacaggcctggatgggacctatttgtcagctcgcttttcccggtactggagaggcctcaagtggatctacagacgcacaatctcccaagcggggtctcgtgcccatggaggagaattccatttactccagctggcaggaggtgggagagtttcctgtagtcgtacagcgaaccgaggccgctacacgctgccagctgaaaggacccgctctcctagtcctaggtcctgatgccattcaactgagggaagccaaggggacacaggcactatactcctggccctatcacttcctacggaagttcggatcggataagggagtcttcagtttcgaagccggacggcgatgtcattccggggaagggctgtttgcattttccacaccatgcgctccggatctctgcagagccgtcgcaggggcaatagctcggcagagggaacgcctccccgagctcactcgcccacaaccttgtcctctgcctcgagctacaagcctgccctctctagacacgcccggagaactcagggaaatgcccccaggtcccgaaccccctacatctcggaagatgcacttggctgagccaggtcctcagtcattacctctgctcctgggccctgagccgaatgacctggcttccgggctatacgccagcgtctgcaaaagagccagcgggcctccaggcaatgagcatctgtacgagaatctgtgcgtgctggaggcatctcctaccttgcatgggggagaacctgagcctcatgagggccctggctccagatctcctaccacgtccccgatctaccacaacggtcaagatctctcatggcctggccctgcaaacgattctactctcgaggcccaatatcgcagactactcgagttggatcaggtggaaggcactgggaggcctgaccctcaggctggatttaaagcaaaattggtgaccctgctctccagggagcgtcggaaaggcccagcaccttgcgacaggccatag

SEQ ID NO: 221137 - DNA, 687 bp, Artificial Sequence
  Description of Artificial Sequence: Synthetic coding sequence
atggacccactggagacccccataaaggatggcattctctaccagcagcacgtgaagtttgggaaaggaacgggcgaggccagctctggatccaccgacgcccagagtcctaaacgaggacttgtccccatggaggaaaattcaatttacagtagttggcaggaggtgggtgagttccccgtcgttgtgcagcggaccgaagccgctacccgctgccagttgaagggccctgccttgctggtgctgggccctgatgcaatccaattaagagaggccaaggggacccaggcactctactcctggccttatcattttctgcgtaagtttggaagcgataaaatccttcttggaactcccggagtgtctctcctcatctgtaaaggcgaacggaccgacgacgtgtctgggatcattctggacgaatctctcctgcgggcttatagcgtaccgggtgctgggggtcactctcgggtccaggactctctgggccctgtgttacgggaaccaactttccaaggagaacgctcattcctgaagaccagcatgctgaggtcattgttatgtagctgtagttggcgtcatcctaggagtcaaccacgtacgcaagcgtcttgtctgcaaggcagcgattgccctgctcctcatcggaactctacctctgccgctcatacgctcggcacctcctag

SEQ ID NO: 221138 - DNA, 435 bp, Artificial Sequence
  Description of Artificial Sequence: Synthetic coding sequence
atggacccactggagacaccaatcaaggatggaattctgtatcaacagcatgtgaaattcggcaagaagtgctggagaaaagtgtgggccttgttgtatgctggaggtccaagcggtgtcgctaggctcgagtcgtgggaggtgagggacgggggtctgggagcagcgggagatcgcagtgcaggacccggtagacgcggtgagaggcgtgtcattcggctggccgattgtgtctctgtgctgcccgcagacggggagtcatgcccacgggacacaggcgcttttctgctgactaccacagaacgcagccacctcctggccgctcagcacagacaggcatggatggggcctatctgtcagcttgccttcccaggtacaggcgaggcgtcttctggatccactgacgcacaatcaccgaagaggggccttgtttag

SEQ ID NO: 221139 - DNA, 471 bp, Artificial Sequence
  Description of Artificial Sequence: Synthetic coding sequence
atggaccctttggaaactcctatcaaagacggcattctataccagcagcacgttaagtttggaaagaagtgttggcggaaagtctgggcactcctctacgctggaggcccttcgggcgtcgctcgcttagagtcatgggaagttcgtgacggtggactgggtgctgcaggcgaccgaagtgccggtcctggtcggagaggggaacgcagggtcattagattggccgactgtgtatctgtcctcccggctgacggcgagtcctgtccaagggacaccggcgcattccttttaacgacaactgagcgtagtcacctgctggctgcacagcaccgccaggcctggatggggccaatttgccagcttgcattccccggaactggcgaggcctctagtggttccaccgatgctcagtctccgaaaagagggctggttcccatggaggaaaactctatctattctagctggcagtag

SEQ ID NO: 221140 - DNA, 132 bp, Artificial Sequence
  Description of Artificial Sequence: Synthetic coding sequence
atggacccactagagacccccatcaaggacggtatcctttaccaacaacatgtcaagtttggcaaaaaatgctggcgaaaggtgtgggcactgttatatgctggtggcccttctggcgtcgcacgactgtag

SEQ ID NO: 221141 - DNA, 642 bp, Artificial Sequence
  Description of Artificial Sequence: Synthetic coding sequence
atggacccactcgagacaccgattaaagatgggatcctgtaccagcaacacgtgaagttcggcaagaaatgttggcgaaaagtatgggccctcttatacgctggaggaccgtcaggcgtagcacgcctggagagctgggaggtgagggatgggggtctgggggctgcgggtgatagatcagcaggaccaggcagacggggagagaggagggtcatcagacttgcagactgcgtctcggtattgcctgcagatggggaatcctgccctcgggatacaggcgctttcctacttaccactactgaacggagccatctgcttgctgcccagcatcgacaagcctggatgggtccaatctgtcagcttgccttccctggcaccggagaggcctcctccggtagtaccgacgcccaaagtccgaaacgagggctcgtgcctatggaggaaaactccatttacagttcttggcaggaggtaggcgagttcccagtcgtggtccagcgcactgaggccgcaactagatgccaactgaaaggacctgccttactcgtactgggcccagatgcgatccagcttagggaggcaaagggtacacaagcactgtactcttggccctatcactttctgcgcaagtttgggagctag

SEQ ID NO: 221142 - DNA, 42 bp, Artificial Sequence
  Description of Artificial Sequence: Synthetic coding sequence
atggacccactggagacaccgatcaaggatgggatactttag

SEQ ID NO: 221143 - DNA, 258 bp, Artificial Sequence
  Description of Artificial Sequence: Synthetic coding sequence
atggatcctctagagacaccgatcaaagacgggatactgtaccaacaacatgtgaagttcggcaagaagtgttggaggaaggtgtgggcactcctgtatgccggaggtccgtcaggtgtagccaggttagagagttgggaggtgcgggatgggggactgggggctgctggtgatagaagcgctggtcccggacggaggggggaaaggcgagtcatccgactggctgattgtgtgagcgtacttccagccgatgggtag

SEQ ID NO: 221144 - DNA, 981 bp, Artificial Sequence
  Description of Artificial Sequence: Synthetic coding sequence
atggcaacaaatttctctgacatagtgaagcaggggtacgtgaaaatgaagtcacgtaaattggggatataccgccgttgctggcttgttttccgcaaaagctcatctaagggaccacagcgtctcgaaaaatatcctgatgagaaatccgtgtgcctgcggggatgtcccaaagtcactgaaatcagtaacgtcaagtgcgtaaccaggctcccaaaggagaccaaaagacaggcagtggccattatatttaccgacgacagcgcaaggacttttacttgcgactctgagttagaagctgaagagtggtacaagaccctgtccgtagaatgcctgggctcacggctaaacgatatctcactgggcgaacctgacctacttgcccctggtgtgcagtgtgaacagactgacagattcaacgtcttcttgctcccctgcccaaatctggacgtgtatggggagtgtaagctccagattacccatgagaacatttacctgtgggacatccacaatcctagggtgaagcttgtcagctggcctctgtgttcactgcgaagatacggacgtgatgccaccagattcacatttgaggcgggtcggatgtgcgatgcaggcgaaggactatacacattccagacacaggagggggagcagatctatcagcgggttcactccgccacactggcgatcgctgagcagcataagagggttttgctcgagatggagaaaaatgtgcggctgctcaataaggggaccgagcattattcatatccctgcacacctaccacaatgctgccgcgatcggcctactggcatcacataaccggaagccaaaacatcgctgaggcttcctcatacgctggagagggttatggagctgcccaagcctcttccgagaccgacctgcttaaccgcttcatcctcctcaagccgaaacctagccagggggacagtagcgaggccaagaccccatctcagtag

SEQ ID NO: 221145 - DNA, 921 bp, Artificial Sequence
  Description of Artificial Sequence: Synthetic coding sequence
atggcatccaacttcaatgatatcgtcaaacagggatatgtgcgcattaggtcccggaggctgggcatttatcaacgctgttggctggtgttcaagaaagcctctagtaaaggacccaaacgtttagagaagtttagcgacgagcgagccgcttatttcagatgctaccacaaggtgaccgaactgaacaacgtgaagaatgtcgcccgactgcctaagagcactaagaaacacgcgatcggaatttatttcaacgacgatacctcaaaaacctttgcatgtgaatccgacctcgaggccgacgaatggtgtaaggtgctccaaatggaatgcgtcggcacacggattaacgacatttctcttggtgagccggacctgcttgctacgggcgttgagcgggaacaatctgaaagatttaatgtctacctcatgccctcccccaacctggacgtccacggcgagtgcgctctccagattacttatgagtacatttgtctttgggacgtccaaaatcccagagttaagctgatctcctggccgctgagcgccttgagacggtatggcagagatacaacgtggttcaccttcgaggctggtcggatgtgtgagacgggcgagggtctgtttattttccagacccgcgacggagaggccatctatcagaaagtacacagtgccgctctggcaatagccgaacagcatgaaaggctactgcagagtgtgaagaactctatgctccagatgaagatgtccgagagggccgcatccctgagtacaatggtacctctgccacgcagcgcatattggcagcacatcacccgccaacacagcaccgggcagttatacaggctccaggacgtgtcctcccctctgaagttgcatagaacagaaaccttccccgcttatcggagcgaacattag

SEQ ID NO: 221146 - DNA, 1515 bp, Artificial Sequence
  Description of Artificial Sequence: Synthetic coding sequence
atgactgaggcagctctggtcgagggccaggtgaagctgcgcgacgggaaaaagtggaagtctagatggctggtgctgagaaagccttcaccggtagcagactgtctattgatgctcgtgtataaggacaagagcgaaaggatcaagggccttagagaaagaagctctctcacactagaagatatctgcggtctggaacccggattgccctatgaggggctcgttcatactcttgccatcgtatgcctcagtcaggccatcatgctgggctttgacagccacgaagctatgtgcgcgtgggacgcgcgtatacggtatgccttgggcgaagttcaccgcttccacgttactgtggcgcctggcaccaagttagaatccggccctgcaacccttcatctgtgcaacgacgtcctggtattggccagggacatcccacccgcagtcactggtcaatggaagctgtccgatctgagacgctacggtgccgtgcccagtgggtttattttcgaaggagggacccggtgcggttattgggcaggggtttttttcttatccagtgccgagggggagcagataagttttctattcgattgcatcgtgagaggaatcagcccaactaaggggccttttgggctcaggcctgttttgccagatcccagcccccctggtccatccacagttgaagaaagagtcgctcaggaggccctggaaacactgcagttagaaaagcggctgagcctcctcagccacgctgggcgacccggaagcggcggtgatgacagaagtctgagctcgagctctagtgaggcctcacacctcgatgtgtccgcatcatcacgcttgaccgcatggcccgaacaatcctcaagctccgcgtctaccagtcaggaggggcctagaccagctgctgcccaggccgctggcgaagccatggtgggggcaagcaggccacccccaaagcccctgcggccacggcagctccaggaggtggggcgacagagctcctctgactccggaattgcaacagggagtcactccagttattcgtcctccctgtcctcctacgccggatcaagtctggacgtgtggcgagccactgacgagctggggtccctgctgtccttgccggcagccggtgcccctgaaccatcattgtgtacatgcctgcccggtacggtggaataccaagttcctacatcgctccgcgctcactatgataccccgcgatcactgtgcttggcaccgagggatcacagccctccatcccagggctcacctggtaactccgcagccagagactccgggggacagactagcgctgggtgtcctagtggttggctgggaaccaggagaagaggcctcgtgatggaagcaccgcagggtagcgaggccaccctgccgggacccgcacccggagagccatgggaggccggagggccacacgctggacctcccccagcatttttttctgcatgtccagtgtgcggagggctcaaggtgaaccccccaccctag

SEQ ID NO: 221147 - DNA, 1827 bp, Artificial Sequence
  Description of Artificial Sequence: Synthetic coding sequence
atgacagaggccgcactggtggagggccaggttaagctcagagatggaaaaaaatggaaatcccgctggttggtccttaggaaaccgtcacctgtagctgactgtctgcttatgcttgtgtacaaagacaagtccgagagaattaaagggctgagggagcggtcatccttgacactcgaagatatttgtgggctggaacccggactgccgtatgagggtctagtgcacaccctggctattgtttgcctaagccaggcaattatgctgggcttcgatagccacgaagccatgtgcgcatgggacgcccgaattcggtacgcccttggtgaggtgcatagattccacgtcaccgtggcaccgggaacgaagctggagagcggcccagccaccctgcatctctgtaacgatgtgcttgtgttagctcgtgatataccacctgccgtgactggccagtggaagcttagcgacctaagacgatatggagctgtgccttctggatttattttcgaagggggaacgcgatgcggctactgggccggagtatttttcctgagctcagcagagggagagcagatcagcttcctttttgattgcatcgtgcgagggatatcacccaccaaagggccttttggtctgaggccggtgctccctgacccctctcctccaggaccgtcaaccgtggaagaaagagtcgcccaagaggcacttgaaactctacagctggagaagaggcttagcttgctgtcccacgctggacgcccaggatcaggaggtgacgatagatcactgtccagcagtagcagcgaagcgagccacctggacgtttccgcatcttctcggctgacggcgtggccagagcagtcgtcatcctcagcgtccacctcgcaggaaggccctagaccagccgcagctcaggctgcaggcgaggcaatggtcggcgcttctcggccaccgcctaaacctctgcggcctcggcagctgcaggaagtgggtagacaaagcagctccgattccggcatcgccactggaagccattcatcttattcctcaagtctgtccagttacgctggatcgtctctggacgtatggcgggcaaccgatgagttaggaagcttactatctcttccagccgctggagcgccagagcctagcttgtgcacatgcctacccggaacagttgaatatcaagtgccaacatctcttagagcccattatgacacaccacgcagcctttgtctagcacctcgcgaccattcacccccatcccagggaagccccggaaattccgctgcacgggactccggtggtcagacctctgccggatgtccatcggggtggctggggacccggagaaggggtctggttatggaggccccacaggggtcggaggccacactacctggcccagcgcctggcgaaccctgggaggccggtggtcctcatgctgggcctccacccgcttttttctccgcctgtcctgtgtgtggcggtctcaagggcgctgctgcctccgcgcctggacctgccacggcacattcgggcagccctgggccagtcgctgtcgactcacctggacccgaacgtcccagaggcgaatctcctacttacgtgaatatacctgtctcaccatcctcccgcaagcaactgcactatatgggcctagagctgcaggaggcttccgaaggcgtgaggggcgctggcgcaagcctgtacgcccaaattgacatcatggcgacagagaccgcccaccgcgttggggtgcgccacgcgcgtgcgcgtgaggagcagctcagcgaattggagcagcgaaaagccgcaccgcagtag

SEQ ID NO: 221148 - DNA, 768 bp, Artificial Sequence
  Description of Artificial Sequence: Synthetic coding sequence
atgaccgaagcggctttggtggagggacaggtgaagctgagagatggcaagaagtggaagtcgcggtggctcgtcttaaggaaaccttcgcccgtggcagactgcttgttgatgttggtgtacaaagataagagtgagagaataaaagggttaagggagaggtcaagtttgaccctcgaagatatttgcggcctggaaccaggactgccatatgaagggctagtgcataccttggccatagtgtgtctctctcaggcaattatgctcggatttgactcacacgaagccatgtgcgcctgggacgcgaggatacgctatgccctgggcgaagtgcataggttccacgtgactgttgcccctggcacgaagctcgagtcaggaccagcaaccctacacctgtgcaatgacgttctcgtgttggctagagacatcccccctgcagtgaccggccaatggaagctctctgatttgcggcgttatggtgccgttcccagcgggtttatctttgaggggggaactaggggctggagactcctccctgtgctggggagaggtggggctgatcagcttccagttcgcttgcataggcctagacatctgcctcatcagggaccactatgggcagctgctgggtcaacccggcctaagtctccaggtacactcgattgtggaggggcatgtggtcctggaagtccgggaaatccaactgccggagaagccgctgaaccccctctgacatgcggccaagcagggcagtggcgaggttag

SEQ ID NO: 221149 - DNA, 1371 bp, Artificial Sequence
  Description of Artificial Sequence: Synthetic coding sequence
atgggatatttccgctgcgctagagcgggaagcttcggcaggcggcgaaagatggaaccttccacagcagctcgagcctgggctttattttggctcctgttaccgctgctgggggctgtgtgcgcctcgggcccaagaacactggtacttctagacaacttgaacgtgagggaaacacacagcctcttctttcgttctctgaaagaccggggatttgagttaacctttaagaccgctgatgacccttcgctgtctctgatcaaatacggggaattcctttacgataatcttataattttttccccaagcgttgaagacttcgggggaaacattaatgttgagactatttctgcttttatagatgggggaggcagcgtactggtggccgcaagctccgatattggtgatcccctgcgtgagctggggtcagaatgcggcatcgagttcgatgaggagaagactgccgtcattgaccaccataattacgatatctctgacttagggcagcatactctcatcgtggctgacactgaaaaccttctcaaggccccaacaatcgtggggaaaagttccttgaatcctatcctgtttagaggtgtaggaatggttgcagatccggacaaccccctggtgctggatatcttaactggctctagtacatcctactctttttttccggacaaacccatcacacagtacccccatgcagttggcaagaacactctcctgatcgccggattacaggccaggaataacgccagggtgatcttcagcggctctctggatttcttcagcgacagcttttttaatagcgctgtacagaaggccgctccaggctcccagcggtattcccagaccggtaactacgaactggctgtcgcccttagccgctgggtgttcaaggaggagggggtgctaagggttggtcctgtatcacatcatcgggtaggggaaacagccccacccaatgcatataccgtcactgatcttgtagaatatagtatcgtgatccagcagttaagcaatggtaagtgggtgccattcgacggggatgatatccaactcgagttcgttaggatcgatcctttcgtccggaccttcctgaaaaagaagggcggaaagtactctgtacagtttaagttacctgatgtctacggcgtttttcagttcaaggttgactacaacagactcgggtacacccatctatactcttctactcaggtctctgtgagacctctgcagcacacacagtatgagcggttcattccaagcgcatacccctactatgcttccgcattctccatgatgcttggactgttcatcttctctattgtgttcttgcacatgaaggagaaggaaaagtcagattag

SEQ ID NO: 221150 - DNA, 1260 bp, Artificial Sequence
  Description of Artificial Sequence: Synthetic coding sequence
atgggctattttcggtgcgcccgagccggatcattcgggcgaagacgcaagatggaaccatccacagcagctcgagcttgggccctgttctggctgctgcttcctcttttaggcgctgtatgcgcctccgggccacgaacgttagtgttactggataaccttaacgtaagagaaacacattctctcttcttcagatccctgaaagatttcggaggaaatatcaatgtggagaccatctctgcttttattgatgggggtggatctgtgctggtcgctgcatcgagtgacatcggcgatcctctacgcgagctcggatcagagtgcggtatcgaattcgatgaggaaaaaacagcggtaatagaccaccataactacgatattagcgaccttggtcaacacacacttatcgtggcagataccgagaatctgctcaaggcgccaaccatcgttggcaaaagctcgctcaatccaatcttattccgcggtgttgggatggttgccgaccctgacaaccccctcgtcctggacatcctgactggctcctctacgtcttactccttctttccagacaagccgatcacacagtaccctcacgccgtcgggaagaatactctcctgatcgcaggcctgcaggccaggaacaacgctcgcgtgatctttagcggcagcctcgactttttctcagactctttcttcaactctgctgtgcagaaggcagcaccgggaagtcaacgctattcacagacaggaaactacgagttggctgtcgcactctcccggtgggtctttaaagaagaaggtgttctgagggttggtccggttagccatcaccgcgtgggtgagacagccccacctaacgcctacacagtgaccgatctggtggaatactccatcgtgatacagcagctgagcaatgggaagtgggtccctttcgatggcgatgatatccagcttgagttcgtccgcattgaccctttcgtaaggacatttctgaagaaaaaggggggtaagtactcggtacagttcaaactgccggacgtgtatggggttttccagttcaaggttgactacaataggctgggctatacgcatctgtattcatccacgcaggtgtccgtgcgtcctctccagcacactcagtatgaacgcttcatccctagcgcctacccgtattacgcctctgctttcagcatgatgctcggcttgttcatcttcagcatagtcttcctgcacatgaaggaaaaggagaaatccgattag

SEQ ID NO: 221151 - DNA, 279 bp, Artificial Sequence
  Description of Artificial Sequence: Synthetic coding sequence
atgacaaagctggcccaatggctgtggggtctggctatccttggaagcacgtgggtagcccttacaacaggggcattgggccttgaattgcctttgagctgtcaggaggtgctctggcctctccccgcttacctcctcgtgtccgcgggttgctatgccctaggtacagttggctatagggtggccacattccacgattgtgaggacgctgcgagagaacttcagtcccaaatccaagaagctagagccgatctggccaggcgcggactcagattttag

SEQ ID NO: 221152 - DNA, 369 bp, Artificial Sequence
  Description of Artificial Sequence: Synthetic coding sequence
atgctgagtgttggagggctccgcttgagtttagtccgattctcattcctcttgctgagaggggctctactgccatcacttgccgttaccatgaccaaactggcgcagtggctctggggtctggccattctgggctctacatgggtggccctcactactggggctctggggttggaactacctctgagctgccaggaggtcctgtggcctttgcccgcatacctcctggtgtcagcgggatgttatgctctgggcaccgtggggtaccgggtagcaacttttcacgattgtgaagacgccgcaagggaactgcaatcccagattcaggaggcccgagccgatctagctcgcaggggccttcgattctag

SEQ ID NO: 221153 - DNA, 279 bp, Artificial Sequence
  Description of Artificial Sequence: Synthetic coding sequence
atgacaaagctggcgcaatggctgtggggactcgccatccttgggtccacttgggtcgcactcacaactggtgccctcggattggaactgccgctctcatgccaagaagtgctctggcctctgcctgcatacctcctggtgagcgccggatgctacgccctgggaactgtgggataccgggtggctaccttccacgactgtgaagacgcagccagagagctccagagccagatacaagaggcgcgtgcggatcttgcgcgacgaggcctgaggttctag

SEQ ID NO: 221154 - DNA, 1191 bp, Artificial Sequence
  Description of Artificial Sequence: Synthetic coding sequence
atggatcctcgtggcactaagaggggcgcagaaaaaacggaagttgctgagcctcgcaataaactgcccaggccagctccttcactccccacagacccagcactgtacagtggccctttcccattttacagacgcccttccgaacttggttgtttttcactggacgctcaacggcaataccacggagatgccagggcactgcgctactactctccaccgcctacaaacgggccaggcccaaatttcgatctgcgcgacggatatccagaccgataccagcctagagatgaagaagttcaggagcgcctggaccatctgctttgttggttgctggaacaccgagggagactcgaaggcggacctggctggctagccgaggctatcgtgacctggcggggtcatctgaccaagctactgactaccccctacgagaggcaggagggctggcagttggccgctagcaggttccagggaacactgtacttatccgaagtggaaacacccaacgccagagctcaaagattagcgcgtccacctttgctgcgtgagctaatgtacatgggatacaaattcgaacagtacatgtgcgccgacaaacccggaagctctccagatccttctggtgaagtcaataccaatgtggctttttgcagcgtgctgaggagccggctgggctcccatcccctcctcttctcaggtgaagtggactgtaccgatcctcaagctcccagtactcaaccgcctacctgctacgtggaattaaagacttcaaaggaaatgcattctcctggacagtggcgctcattttaccgacacaagctgctcaagtggtgggctcagtctttcctaccaggggtgcccaatgtcgtggccggttttcgcaaccctgatggctttgtgtcctcactgaagacctttcccaccatgaaaatgttcgaatacgtcagaaatgatcgtgacggttggaacccatcagtgtgtatgaacttctgtgcggcattcctgagtttcgcccagagcacagtagttcaagatgacccccgactggtgcatcttttctcctgggagcctggcggaccagttactgtttccgtccatcaggatgcgccatacgccttcctgcccatatggtatgtagaggctatgacacaggatcttcccagcccgcctaagactccctcaccaaaatag

SEQ ID NO: 221155 - DNA, 1191 bp, Artificial Sequence
  Description of Artificial Sequence: Synthetic coding sequence
atggatcctagggggactaagagaggcgctgagaagactgaagtggccgagcctagaaataagctccctcgacctgctccaagcctgcccacagatccagcactgtactctggccctttccctttttatagacgcccatccgaactaggctgcttctccctcgacgctcagcggcagtaccatggcgatgcccgagcactgcgctactattcccccccaccaactaatgggcctggccctaacttcgatctgcgcgacggctatccagacagataccagccacgggatgaagaagtacaggagcgccttgaccatctgctgtgctggctgttggagcaccgaggaagacttgagggtggaccaggttggttggcagaggctattgtgacatggcggggtcacctgaccaaactgcttaccaccccctacgagcggcaagaggggtggcagctggcagcttctcgcttccaaggaaccctttacttgagcgaggtggaaaccccgaatgccagagcccagcggctggcaaggccacccctgctccgggagctgatgtatatgggatacaaattcgagcaatatatgtgtgcggacaaacctggctctagcccggacccaagcggggaagtgaatactaacgtggcattctgctctgtgctgaggtcacggcttgggtcacacccgctgctttttagcggcgaagtcgattgcacagacccacaagccccttctactcagccaccaacctgctacgtggagctgaaaacttccaaagagatgcactcgcccggacaatggagaagcttctatcgccacaaattacttaagtggtgggctcagagttttctgcccggagttcccaacgtggttgcaggattccgtaaccccgatggcttcgtctccagtctgaagacttttcctactatgaagatgttcgaatacgtaagaaacgaccgggatggctggaacccctctgtgtgtatgaatttctgtgcagcgttcttatcttttgcccagtctactgttgttcaagacgatccaagactcgtgcatctgttttcctgggagcccggtggccctgttaccgtcagcgtccaccaggacgctccatatgcgttcctaccaatctggtatgtcgaagcaatgacccaggatctgccgtcacctcctaagaccccctcacctaagtag

SEQ ID NO: 221156 - DNA, 1191 bp, Artificial Sequence
  Description of Artificial Sequence: Synthetic coding sequence
atggatccacgtggcaccaagcgtggggctgagaagaccgaggttgcagaacccagaaacaagctgcccaggccagcccctagcctacccaccgaccccgcattatacagtgggcctttccctttctaccgtagaccaagcgagctagggtgctttagcctcgacgcacagcgtcagtaccatggagacgctcgggcactgcggtactactctcccccacccaccaacggtccaggtccgaatttcgatctgcgtgatggctatcctgacagatatcagcccagggacgaagaagtgcaggagcgtttagaccatttgctgtgttggttacttgaacatcgcggtcgtctagaagggggtccaggctggctggctgaggctattgtgacttggagaggccacctgaccaaactcctcactacaccctatgaacggcaagaaggatggcaactggccgcatcgaggttccagggaacgctctacctctcggaagtcgagacccctaatgccagagcacagagattggcaagaccccctctcctgcgggagctgatgtatatgggctacaaatttgaacaatacatgtgtgctgacaaacccggaagctcgccagaccccagtggagaggttaacacaaacgtcgcattctgttctgtcttgcggtcacgcctgggcagccaccccctcctcttttcgggtgaggtagactgcactgaccctcaagctccatctacccaaccccctacctgttatgttgagttaaaaacatctaaggaaatgcactctccgggacagtggcgctccttttatcggcacaagttgctcaagtggtgggcccagtctttccttcccggagtgccaaatgtggtggcgggatttcggaatcctgatggctttgtgtcctctctgaagactttccctactatgaagatgtttgagtacgtgcggaacgaccgagatggatggaacccctctgtctgcatgaatttctgtgccgcttttctctcttttgcccagagcaccgtggtgcaagatgacccgcgactcgtgcacttattcagttgggagcctggtggacctgtcacggtgtctgtccatcaggatgcaccatacgccttccttccaatctggtatgtggaggccatgacccaggatcttccatctccacccaaaacaccctctcccaaatag

SEQ ID NO: 221157 - DNA, 1191 bp, Artificial Sequence
  Description of Artificial Sequence: Synthetic coding sequence
atggatccgagaggcaccaagcgcggagcggaaaaaaccgaggtcgctgaacccagaaataaactgcccaggccggcacctagcctcccaaccgacccggctctttactccggaccgttccctttctaccgcaggccttcagagctggggtgtttctcactggacgctcagagacagtaccacggagatgccagggctctgcgatactacagcccacccccaacgaacggccctggtccaaactttgatctgcgggatgggtacccagatcgataccaacctagggatgaggaagtgcaggaacgcttagaccacctgctgtgttggttattggaacacagaggcagactggaaggagggcctggatggctggcggaggcaattgtgacctggagaggtcatttgactaagctgctgaccaccccatatgagagacaggaaggatggcagctggcagcatctcggtttcagggaacattatatctcagtgaagtagagacccctaacgcaagagctcagaggctggctcgcccaccattgctccgggagctgatgtacatgggctataaattcgaacagtatatgtgcgcggataaacccggtagcagtccggacccctccggcgaggtcaacacaaatgtggcattctgtagtgtgcttcggtctcgccttggttcccacccactgctattctctggcgaagtggattgcacagacccgcaggccccatcaacgcagccacccacatgttatgtggaactgaaaacttcaaaagagatgcactcaccagggcagtggagaagtttctacagacataaactccttaagtggtgggcccagtccttcctgcccggagttcctaatgtggtcgcaggcttccgtaacccagacggattcgtgtccagcttaaagaccttccccacaatgaagatgttcgaatacgtgcgcaacgatcgggacgggtggaatcctagtgtgtgtatgaacttctgcgccgcatttttaagctttgctcaaagtacagtcgtccaagatgacccccgactggtgcatctgttttcttgggagccgggagggccagtgacggtttctgtacaccaggatgccccttacgctttcctgcctatctggtatgtggaagcaatgacacaggatctaccttcccccccaaaaacacctagtccaaagtag

SEQ ID NO: 221158 - DNA, 1191 bp, Artificial Sequence
  Description of Artificial Sequence: Synthetic coding sequence
atggatccgcgtggaaccaaacggggagccgaaaaaacagaagtggcggagccacggaacaaattaccgagacccgcacccagcctgcccactgaccccgcactctactctggaccctttcctttttacaggcgtccctctgagttgggctgcttctctctggatgcacagagacaataccacggggatgcccgagctttaagatattattcacctccacccaccaatggccctgggccaaatttcgacctccgagacggttacccagatcgatatcaaccgcgagacgaggaagtgcaggaacggcttgatcatttactatgttggctgctggaacatcgtggtcgtctagagggcggacctggctggctggccgaagccattgtcacctggaggggtcacctgactaagctactgaccacaccctacgagcgccaggagggatggcaactcgctgcgtcccgatttcagggaaccttgtacctgagcgaggtggagaccccaaatgcgagagcccaaaggttggctcgacccccactcttgagagaattgatgtatatgggttataagttcgagcagtacatgtgcgcagacaagccaggtagctccccggatccctctggcgaggtaaacaccaatgtggcattttgctccgttctgcgcagtagactgggatctcatcctctgctctttagcggcgaggttgactgtaccgatccccaggccccaagtacccaacctccgacatgttacgtcgaactgaaaacctccaaagaaatgcacagccctggtcagtggcggtcattctaccgccataagctgttgaagtggtgggcccagagctttctgccaggggtaccaaatgtggtagcgggatttcggaatccagatggcttcgtatcctccctgaaaacttttccaaccatgaaaatgttcgagtatgtgcggaatgacagggacgggtggaatccatcagtgtgcatgaacttttgtgctgctttcttatcatttgctcagagcactgtcgtacaggacgacccaagactcgttcacctcttttcttgggagcccggtggaccagtgaccgtgtcggtacaccaagacgcaccctatgcgtttctacccatatggtatgtcgaggccatgacccaagatctgccatcgcctcccaagactccaagtcctaagtag

SEQ ID NO: 221159 - DNA, 1191 bp, Artificial Sequence
  Description of Artificial Sequence: Synthetic coding sequence
atggaccctcgaggcaccaaacggggagctgagaagaccgaggtggcggagcctcgaaacaagctgcctaggccggctcctagtctgcccactgaccctgcactgtactccggcccttttccgttctatcgcaggccgagcgagctggggtgtttcagcctggacgctcagcgccagtaccacggggacgctcgcgcactccggtattacagcccaccccctaccaacggtcctggcccaaattttgatctcagagacgggtaccccgaccggtatcagcccagagacgaggaagtgcaggagagactggaccaccttttgtgctggcttctggagcaccgcggacgcctggaaggaggaccaggatggctcgccgaagccattgtcacgtggagagggcatctaaccaagctattgaccaccccatatgagcggcaggaaggttggcagctcgcagcaagcagatttcagggaacactgtatctgtcggaggttgagactccgaatgctcgggcacagagactcgcccgtccacctctgctcagggagcttatgtacatgggatataagtttgaacagtacatgtgcgccgacaagcctggatccagcccagacccatccggggaggtgaacacgaatgtcgcgttttgtagcgttcttagaagtagactcggttcccatcctctgctcttctctggcgaagtggattgcactgatccgcaagctccttccacccaaccgcctacctgctacgttgaactcaagacctcgaaagagatgcattctccaggccaatggcgctctttctaccgacataaactgctcaaatggtgggcccagagcttcctgcccggtgtcccaaacgtggttgcagggttccggaaccctgatgggtttgtctccagcttgaaaacctttccaaccatgaagatgttcgagtacgtaagaaacgacagagacgggtggaatcccagtgtgtgcatgaacttctgtgctgcatttctgagtttcgcacagagcacggtagtgcaggacgacccccgactcgtgcaccttttttcctgggagcccggaggccctgtcacagtcagcgtccatcaggacgccccatacgccttcctccccatatggtacgtggaggccatgacgcaggaccttccaagtccacccaaaactccctcccccaaatag

SEQ ID NO: 221160 - DNA, 1191 bp, Artificial Sequence
  Description of Artificial Sequence: Synthetic coding sequence
atggatccaaggggaaccaaacggggtgcggagaagacggaggtggccgaaccacggaacaaactccccagacctgctccctcactgcccaccgatcccgcactttactccggtccctttcccttctataggcgcccatccgagctgggttgctttagtctcgacgcccagaggcaataccatggtgatgcccgagctctgagatattattcccctccccctaccaatggaccagggccaaactttgaccttagggacgggtatcccgacaggtatcaaccacgggacgaagaggtgcaggagaggctcgatcaccttttgtgctggcttttggagcacaggggtcgcctggagggaggacctggatggctggctgaagcgattgtgacttggagaggacacctcactaaactgcttaccactccgtatgagcgacaagaggggtggcagctggcagctagcaggtttcaaggcacactctatctcagcgaagtcgagactcctaacgctcgagcacagcggcttgcaagaccacctctgttacgagagttgatgtatatgggatacaaattcgaacagtatatgtgcgctgataaacctgggtctagtcccgacccatccggcgaagtaaatactaatgtggccttctgctccgtgctgcggtccagactgggctcccaccccctccttttcagcggggaggtcgactgcacggatccacaggccccatctactcagcctccgacatgctacgtcgaactaaagaccagtaaggaaatgcaatcacccggacaatggaggagcttctaccgccataaactattaaaatggtgggcccagtcttttctgccaggcgtcccgaatgtggtcgcgggttttcgaaaccccgatgggttcgtgagctcactcaagaccttccctactatgaaaatgttcgaatatgtacgaaacgaccgggacggctggaatccatcagtctgcatgaatttttgcgccgcatttttatcctttgctcagtcaacagttgtgcaagacgatccacgccttgtacacttgttttcatgggagcccggtggaccggttaccgtctccgttcaccaggacgccccttatgcatttctgcctatttggtacgttgaggctatgacacaagatttacccagccccccaaaaacacccagtcccaagtag

SEQ ID NO: 221161 - DNA, 1191 bp, Artificial Sequence
  Description of Artificial Sequence: Synthetic coding sequence
atggatccacggggaactaagagaggcgctgagaaaacggaggtggctgaaccacgcaataaactcccgaggcccgctccttcactccctaccgatcctgccctgtatagtggacctttccctttctatagacgaccctcagaattaggatgcttctctctagacgcacaacgtcagtatcatggcgatgcacgcgcattgcggtattattcccctcctcccactaatggcccaggacccaatttcgacctaagagacggataccctgatagatatcagcctagagacgaggaagtccaagagcggctcgaccaccttctgtgttggcttttggaacatcggggacgtctagaaggaggacccggttggctcgcagaagccatagttacgtggcggggacacctgacaaagttgctgactacaccttatgaaagacaagaaggatggcaactagccgcttctcgtttccagggaactctctatctcagcgaggtggagacacccaacgccagggcgcaacgccttgccaggccaccgttgctgcgagagctaatgtacatggggtacaaattcgaacaatatatgtgtgcagacaaaccaggctccagccccgacccctcgggcgaggtgaataccaacgtggcgttctgttcagttcttcggagtagacttggctcacaccctctgctgttctccggcgaagtggattgcaccgaccctcaggccccaagtacccagcctcccacatgctatgtggagctcaagacatcgaaagagatgcactcacccggtcagtggaggagcttctaccgccataaattactgaaatggtgggcgcagtcatttctgcccggagttcctaatgtggttgcaggttttaggaatcccgatggatttgtgtcctctctgaaaaccttccccacaatgaaaatgtttgaatacgtgcgcaatgacagagatggctggaacccgtccgtatgtatgaacttctgcgctgctttcttgtcctttgcccagagtacagtagtccaggacgaccctcgcctagttcatttattcagttgggaacccggaggacccgtaactgtgagcgtccaccaggatgctccgtacgcctttctccctatctggtacgtggaggccatgacacaggacttgccatctcccccaaaaacaccatcgcccaaatag

SEQ ID NO: 221162 - DNA, 1191 bp, Artificial Sequence
  Description of Artificial Sequence: Synthetic coding sequence
atggaccctagagggaccaagcgcggtgctgagaagactgaagttgctgagccaagaaacaagctccctcgtcccgctccttcgttgccaaccgacccggctctctattctggtccatttcctttctacagaaggccaagtgaacttggttgcttttcattggacgcccagagacaataccacggagacgccagagctctccgctactattcgccaccccctactaatgggccagggccaaattttgatctgagggacgggtacccagacaggtatcagccccgtgatgaggaggttcaggagcggttggaccaccttctgtgttggttgttagaacacagaggaagactcgaaggagggccaggttggctggccgaggcaatcgtaacctggagggggcacttgacaaagctcttgacgacaccatatgagcgccaggaaggttggcagctcgccgcttctaggttccagggtacactttatctgagtgaagtggagacccctaacgcaagggctcagcggcttgctcgcccaccgcttctgcgggagctgatgtatatgggctataaattcgagcagtacatgtgcgctgataaacccggaagcagccccgatccgtccggcgaggtaaacaccaacgttgcattctgctcagtacttcggagtagactgggaagccatccccttctgttcagcggggaggtcgactgtacagacccacaagcgccaagtacccagcctccgacttgttatgttgaactgaagacatctaaagaaatgcactccccaggacagtggcgatcattctatagacacaagttgctcaagtggtgggcccagagttttctcccgggtgtgccaaatgtggtcgccggtttccgtaatcccgacggtttcgtgtctagtctgaaaacattccccacgatgaaaatgttcgaatacgttcgaaatgatcgggatggttggaaccctagtgtctgcatgaacttctgcgctgctttcctctctttcgcacagtcgaccgtggttcaagacgatccgagactggtgcacctgttctcgtgggagccgggaggacctgtgaccgtgtccgtccaccaggatgccccttacgcattccttcctatttggtacgttgaggctatgactcaagacctcccttctccacccaaaacacccagccctaaatag

SEQ ID NO: 221163 - DNA, 1191 bp, Artificial Sequence
  Description of Artificial Sequence: Synthetic coding sequence
atggaccctcgaggtaccaaacgaggcgcagaaaagaccgaggtcgctgaaccaagaaacaagttgccgaggccagcaccatcgcttccaacggacccggctctgtacagcgggccattcccattttataggcgtccctctgaactcggatgtttttctctagatgcacagaggcaatatcacggcgacgcaagggcccttaggtattattctccccctcctactaacgggccaggtccgaacttcgatttacgcgacggttacccggatcgctatcagccacgagatgaagaagtccaggaacgtctggatcatctattgtgctggctcctcgagcaccggggtcgcttagaagggggaccaggctggctcgccgaagccatagttacatggcggggacacctgaccaagttgctgactacaccttacgagagacaggaagggtggcagctggcagcaagcaggttccaaggcaccctgtatttatctgaagttgagacacccaatgccagagcccagcggctcgctcggcctcctttactcagggagctgatgtacatgggttacaagttcgagcagtacatgtgcgccgataaacctggctcaagcccagatccaagcggcgaggttaacacaaatgttgctttttgttccgtgcttcgatcaaggcttggatcacatcctctactgttttctggcgaggtcgattgcactgatccacaggcacccagcactcaaccgccaacgtgttatgtggagctgaagacttcaaaggagatgcacagcccaggacaatggaggagcttctatcgccacaaattactcaagtggtgggcccagagcttcctgcctggggtgccaaacgtggtggccggttttcggaatcctgatgggtttgtgtctagcttaaaaacatttcctacgatgaagatgttcgagtatgtgcgaaatgatcgggacggctggaacccatccgtgtgtatgaatttctgcgcagcctttctgagctttgcacaatctacggtcgtgcaggacgatccacggttagtgcacctctttagctgggaacctggcggaccagtgaccgtgtccgtgcatcaggacgcgccttacgcttttctcccaatctggtatgtagaggctatgacacaagatttacccagtccaccaaaaactcctagtcctaaatag

SEQ ID NO: 221164 - DNA, 1191 bp, Artificial Sequence
  Description of Artificial Sequence: Synthetic coding sequence
atggacccacggggtacaaaacgcggagcagaaaagacagaggttgcggaacccagaaacaagcttccaagacctgccccatctctgcccacagaccctgctttgtattccggccctttcccattctatagacggccatccgagctagggtgtttctctctggatgcccaacgccaataccatggcgatgccagagcgctacgttactactccccaccacctaccaacgggcctggcccaaattttgacctgagggacggataccccgacagatatcaaccgcgagatgaggaagtgcaggagagactggaccatctcttgtgttggctccttgagcacagaggtcggctggaggggggacccggatggctggccgaagccatagtgacctggcgcggacacctgacaaagctgttgacaaccccttacgagcgccaggagggctggcagctggctgctagcaggttccagggcactctgtatctgtctgaagtcgaaactcccaacgcaagggctcagcgactggccaggcctccacttctcagagaactgatgtatatgggctacaaattcgaacagtacatgtgcgccgacaagcctggctctagtcctgatccctctggcgaggtaaacactaatgtagccttctgttcggtgctaaggagtagactgggctctcatcctctgttattctcaggtgaggtcgactgcaccgatccgcaggctccttctacccagccacctacctgctatgtggagttaaagacaagcaaggagatgcatagccccggacagtggcggagtttctacaggcacaagctgttgaagtggtgggcccagtcctttcttccaggtgtacccaacgttgtggccggattccgaaatccagacggcttcgtctcctccctgaaaacatttccaaccatgaaaatgttcgagtacgttcgaaacgacagggacggctggaatccaagtgtgtgtatgaacttttgcgcggctttccttagctttgcgcagtctacagtggtgcaggacgatccacgccttgtccatctgttcagctgggagcctggaggtccggtcacagtctcagtacaccaagacgctccctatgcattcctgccaatctggtacgttgaggccatgacccaggatttgccgagccctcctaagactccatcccccaaatag

SEQ ID NO: 221165 - DNA, 1191 bp, Artificial Sequence
  Description of Artificial Sequence: Synthetic coding sequence
atggatccaaggggaacaaaacgcggtgcagaaaagaccgaagttgccgagcccagaaataagctgcctcgtcctgccccaagcttgcctacggatccagccctgtacagtggaccatttcccttctacaggcggccaagcgagttgggatgcttctcattagatgcccaaaggcagtatcatggggatgcgagagccctgaggtattacagccccccacccaccaacggtccaggaccaaattttgatctccgtgacgggtaccccgatcgctaccagcctagagacgaggaggtacaggagagacttgaccacctgctttgttggctgcttgagcatagggggcgattagaagggggacccggttggttagctgaagcaattgtcacttggcggggtcatctcacaaagctgctgacaaccccctacgaaagacaggaaggctggcagttagccgctagtcggtttcagggcactctctacttatccgaagtggagacacctaatgcaagggcccagcgtctcgcgagaccaccccttctcagagaactcatgtacatgggctacaaattcgaacagtatatgtgcgccgataagcccggaagttcaccggaccctagtggcgaagtgaacacaaatgtcgcgttttgttccgtgctgcgctcacgactaggctctcacccactgttatttagcggtgaggtagattgcaccgacccccaagctcccagtacccaacccccaacctgttacgtcgagctgaaaactagtaaagagatgcaatctccaggccagtggcgcagtttttatcgtcataaactgctgaagtggtgggcgcaatccttcctgccaggcgtcccaaacgtagttgccggattccgaaatcctgacgggtttgtatcatcactgaagactttccccacgatgaagatgttcgagtatgtgcggaatgatcgtgatggctggaatccaagcgtctgcatgaacttctgtgctgctttcctatcttttgctcagtcgacagtggtgcaggatgacccacgactagtacacttgttctcttgggagcccggtggccctgttaccgtgtcagtgcaccaggacgccccatatgcattccttcctatctggtacgtggaggcgatgactcaggatctgccctcgcccccaaagacaccctcccctaagtag

SEQ ID NO: 221166 - DNA, 1191 bp, Artificial Sequence
  Description of Artificial Sequence: Synthetic coding sequence
atggacccccgtggcaccaaacgtggcgctgagaaaaccgaagtggcggagcccagaaataagttgccaagaccagccccttccttaccaaccgacccggcactgtactcgggtcccttcccattctacaggagacctagtgagctcgggtgtttcagtttagatgctcagaggcagtatcacggagacgcacgggctctgagatattattcaccccctcctactaacggacctgggcctaactttgacctacgagatgggtatccagaccgatatcagccacgagatgaggaggtccaggaacgactagatcatcttttatgctggcttttggagcaccgaggcaggctggaaggaggtccgggttggcttgcagaggccatcgttacctggagaggtcacttaacaaagctgctcactactccctacgaacggcaggaaggctggcagcttgccgcaagtaggtttcaggggaccctctacctcagtgaagtggagaccccaaacgccagggcccaacgtctggctagacctcctctgctgcgagaattaatgtatatggggtataaattcgaacagtacatgtgcgccgataagcccggatcaagccctgacccatctggtgaggtgaatactaacgtggccttctgctcagtgctgcgtagccgcctcgggtctcaccctctcttgttctcaggagaagtggactgcaccgacccacaggccccaagcacgcagccaccgacatgctatgtggaactcaagacatcgaaggaaatgcacagccccggtcaatggcggtctttttacagacacaagcttctgaagtggtgggctcagtcttttctgccgggtgtgcctaacgttgtggcagggtttcggaatcccgatggttttgtcagcagcttaaaaacatttcccactatgaaaatgtttgagtatgtgcgcaacgatcgagacggatggaatccttcagtctgtatgaacttctgcgcagcttttctgagctttgctcagtcaaccgttgtccaagatgacccacgactggtccacctcttcagctgggaaccaggcggaccagtgaccgtctcagtccatcaggacgccccttacgcgttcctgcccatttggtatgttgaggcaatgactcaggacttacctagcccccctaagacacccagtcctaaatag

SEQ ID NO: 221167 - DNA, 1191 bp, Artificial Sequence
  Description of Artificial Sequence: Synthetic coding sequence
atggacccgaggggaaccaaacggggagccgagaagactgaggtcgcagaaccacgcaacaaactgcccagacccgcaccctcgttaccaactgaccccgcactgtactccgggccttttcctttctacagaagaccatctgaactgggatgctttagcctagatgctcaacgccaataccacggcgacgccagggcactgaggtactacagcccgcctcccacgaacggccctggcccaaacttcgacctcagagacgggtacccggacagatatcagccacgggacgaggaggtgcaggaaagattagatcatcttctttgttggcttttggagcaccggggacgcttggaaggagggccaggatggcttgccgaagcaattgttacgtggcggggtcacctcactaaactgttgaccactccatacgagagacaagaaggctggcaattagcggctagccgcttccaaggtacactgtacctgagcgaggtggagactccgaacgccagggcacagcgcctggctcgccctccattgttaagggagcttatgtatatgggctacaaattcgagcaatatatgtgtgcggacaagcccggatcaagtcccgacccctcaggcgaagtaaacacaaacgtggcattttgtagcgtgctgcgctcgcgccttggatctcacccgctgctgttctccggcgaggtggattgtacagatcctcaggccccttctactcagccccctacttgttacgtcgaactcaagacatccaaggaaatgcattcacccggacagtggcggagcttctaccggcacaaactattgaaatggtgggcccaatctttcctgccaggtgtgccgaatgttgttgcaggctttaggaaccctgatggcttcgtatcatccctgaagacatttcccaccatgaaaatgttcgaatacgtccgcaatgacagggatggttggaatccatcggtctgtatgaatttctgtgcagcatttcttagcttcgcccaatcaacagttgttcaggacgacccaagactggtgcatttgttttcttgggagccaggaggacccgtcacggtttcagtacaccaggacgccccttatgccttcctcccgatttggtatgtcgaagccatgacccaagaccttccgagcccgccaaaaacaccctctcccaagtag

SEQ ID NO: 221168 - DNA, 1191 bp, Artificial Sequence
  Description of Artificial Sequence: Synthetic coding sequence
atggaccctcgcggaacaaagaggggagctgagaagaccgaggttgctgagcctcgcaacaagcttccaagacctgcaccctccctcccaaccgacccagcactgtattcaggtccatttcctttctacagaagaccatctgaattgggatgctttagtctcgatgctcagcgacagtaccatggggatgccagagctctgaggtactacagtccaccacctacaaacggaccaggccctaatttcgacctgcgcgacggatatcctgaccgatatcaacccagagatgaggaggtgcaggagcggctcgaccacctcctgtgctggctgctggagcatcgcggaagacttgaaggtggtcctggatggctggcagaggcgatcgtgacgtggcgcggtcacctcaccaagttgctcacaacaccttatgaaaggcaggaggggtggcaactggccgcttcccggttccagggaactctgtatctgtcggaggtcgaaacccctaacgcaagggcccagcgactggcacgccctcctctcttaagggaactcatgtatatgggctacaaattcgagcagtacatgtgtgccgacaagcctggatccagccctgatccgtctggcgaggtgaataccaacgtggcattttgctctgtcctgcgctctcgactgggcagtcatcccctcctgtttagcggtgaagtcgattgcaccgatcctcaggccccttctacgcagcctccaacctgctatgtagaactgaaaacaagcaaagaaatgcattcacccggtcagtggcgaagcttttatagacataagttgttgaagtggtgggcacaaagttttctgccgggtgtcccaaacgtggtagccggattccgaaaccccgatgggttcgtatcttctctgaagacatttcctacgatgaagatgtttgagtatgtacggaacgaccgggacggctggaacccctccgtgtgcatgaatttctgcgcagcttttctttcctttgcccaatctacagttgtgcaggacgatcctcgcctggtacacctgttcagctgggagccagggggtcccgttacagtgtcagtgcaccaggacgctccatacgcattcctgccaatctggtatgtggaagcaatgacacaagatcttccaagtccgcctaaaaccccctctcccaagtag

SEQ ID NO: 221169 - DNA, 1191 bp, Artificial Sequence
  Description of Artificial Sequence: Synthetic coding sequence
atggatcctcgcggtaccaaacgcggtgccgaaaaaacagaggtggctgagcccagaaataaactgcctcgccctgcaccttccctccccaccgatccagccctgtattcaggccctttccctttttataggcgaccctccgagttgggctgcttctccctcgatgcccagcgacagtaccacggagatgccagggcactccggtactacagccctcctccaactaatggtccgggtccaaacttcgatctacgcgacggctaccctgacaggtatcagcctcgagacgaggaagttcaggagcgtctggatcaccttttatgttggctcttggaacacagggggagactcgaagggggtcccggttggctggcggaagccattgtcacgtggcgtgggcacctgaccaagcttttaacgaccccatacgaaagacaagaaggctggcaattggctgcctctaggttccagggtacactttacctctcagaagtcgaaacgccaaatgcccgagcccaacgcttggcgaggcccccactactcagagagctgatgtacatggggtataaatttgaacagtatatgtgcgccgataagcccggtagtagccctgacccctccggcgaggtcaacaccaacgtcgcattctgtagcgtccttaggtcacggctggggtctcaccctttactattctccggcgaggtcgattgtactgacccccaggcgccttcgacacagcctccaacctgttatgtggagctgaagacaagtaaagaaatgcacagccctggacagtggcgatccttctacagacacaaactgctgaagtggtgggcacagagttttctccccggtgtgccaaacgtggtagcaggttttcgcaaccccgatggcttcgtctctagcctgaaaactttccccacaatgaaaatgtttgagtacgtgaggaatgacagggacgggtggaatccttcagtgtgcatgaacttctgcgcagccttcctgtcgtttgcccaatccaccgtggtgcaggatgatcctagactggtgcatctcttcagctgggaacctggaggtcctgtgaccgtttccgtacatcaagacgctccttatgctttcctcccaatctggtatgttgaagccatgactcaggatctgccctcaccacctaaaacccccagcccaaagtag

SEQ ID NO: 221170 - DNA, 1191 bp, Artificial Sequence
  Description of Artificial Sequence: Synthetic coding sequence
atggaccctcgcggtactaagaggggagccgagaagacagaagtagcagaacccaggaataagctgcctcggcctgccccttccttgcctacggaccctgccctatactctggaccttttccattctatcgacgcccttctgaactcggttgttttagtcttgatgcccagaggcaatatcatggagatgcccgagccctacgatattattctccaccccctacaaacggcccaggtcccaactttgacctccgcgacggataccccgatagataccagccacgggatgaggaagtgcaggaacgactggaccacttgctgtgttggctgcttgagcatcgcggaagactggagggcggtcctggatggcttgctgaggccattgttacatggaggggccatctgactaagctgctgaccacaccttatgaaaggcaggaagggtggcagctggccgctagtcgcttccagggcacgctttacctaagcgaagtggaaacccctaatgcccgagcccagcgccttgctcggcctcccctgctccgggaacttatgtacatggggtataaattcgagcaatacatgtgcgctgacaagccaggttccagtccagacccgagcggtgaggtgaacacaaatgttgccttctgcagtgtgctcagaagtagactcggctcccaccctttactgttttccggggaagtggattgcactgacccccaagccccaagcacccagccacccacatgctacgttgaactcaagacgagcaaggaaatgcactcgccagggcagtggcgatctttttatcgccacaaactcttgaaatggtgggctcagtcgtttctccccggagtgcccaacgtcgtagccggattcagaaatcctgacggatttgtgtcttcccttaaaacgtttcctaccatgaaaatgtttgagtatgtcagaaatgatcgggacggctggaaccccagcgtctgtatgaacttttgtgccgcttttctgagctttgctcagtccactgtcgtgcaggatgaccctcgtctggttcacctgtttagttgggagcccggaggcccagtgactgtatccgtacatcaagacgctccatatgcctttcttcccatttggtacgtcgaagccatgacacaggatctcccttctccaccgaaaactcccagtcctaagtag

SEQ ID NO: 221171 - DNA, 1191 bp, Artificial Sequence
  Description of Artificial Sequence: Synthetic coding sequence
atggatcctagaggtaccaaaaggggcgcagaaaagactgaagtcgcggagccgagaaataaactaccacgaccagcgccttcgctgcccacagaccctgcactgtattccggccctttcccattctacagacggccatcagaactggggtgttttagcttagatgcccaaagacaatatcatggagatgccagagccctgagatattatagccctccacctactaacggacccggtcctaattttgacctgagggatggctatccagataggtatcagccccgtgacgaggaagtgcaggagcgcctggaccatctcctctgctggctactggaacatagaggaaggcttgaggggggtcccggttggctggctgaggctatcgtcacatggcgtggccacctgacaaaactgcttactacgccctacgagcgccaggaagggtggcagctggcggcatcgaggttccaagggacattgtacctctctgaggtcgaaactcccaatgctagggcccagagacttgcaagaccaccccttcttagggagcttatgtacatggggtataaatttgagcagtacatgtgtgcagacaagcccggttctagtccggatccatcaggcgaggtgaatacaaacgtcgcattttgctccgtgctccggtccagactcgggagtcatccactgctgttctccggagaggtggactgcactgacccccaggccccatccacccagcctcctacttgttacgtcgaacttaagacctctaaggaaatgcagtcccctgggcaatggcggagcttttaccggcacaaactccttaaatggtgggcacagtcttttctcccaggagtacccaacgtcgttgcgggtttcagaaatcctgacggctttgtatcttctctcaaaaccttcccgaccatgaaaatgttcgaatacgtcaggaacgacagagacggttggaatccttcagtgtgcatgaacttctgtgccgcattcttgagcttcgcacagagtacagtggtccaggacgacccgagacttgtgcatcttttctcgtgggagcccggaggcccagtcactgtgagcgtgcatcaggatgctccttatgcctttttacccatctggtacgtagaagccatgactcaagatttgccctcacctcccaagacgcctagcccaaagtag

SEQ ID NO: 221172 - DNA, 1443 bp, Artificial Sequence
  Description of Artificial Sequence: Synthetic coding sequence
atgaacgcatcagaattccgaaggcggggaaaagagatggtggattacatggccaattatatggaggggatcgaaggaagacaagtgtaccccgacgtggagcccggatatctgcgtccacttatcccagccgcagcaccacaggaacctgacactttcgaggacataattaatgatgttgaaaaaatcattatgcctggcgtgactcactggcatagcccttacttctttgcctacttcccaaccgctagtagctatcctgctatgttagccgatatgctttgcggtgcaatcggttgtatcggcttctcctgggccgcatcacctgcttgcactgagctggagactgtgatgatggactggctgggaaagatgctggaattgcccaaagccttccttaacgaaaaggcaggcgagggaggtggggtgatccagggctccgcatctgaggccactctagttgccctgttggctgccaggaccaaggtcatccacagattacaggccgcatcaccggagctgacccaagccgctattatggaaaagctcgtggcttatagcagcgatcaggcccactcatctgttgagcgcgctgggttgatcgggggagtgaaactgaaggccattcctagcgacgggaatttcgctatgagggcgtcagcgctgcaggaagcactggagagagacaaagctgccggtctcattcccttcttcatggtcgctaccttggggacaacaacatgctgctcattcgacaatctgcttgaggtgggcccaatctgcaataaagaggacatttggctgcatgtggacgccgcttacgcagggtcggcctttatctgcccggaattcagacacttactgaatggggtagaattcgctgactcgttcaatttcaatccccataaatggcttttggttaatttcgattgcagcgccatgtgggtcaagaagcgcacagacttgaccggcgctttccgcttagatcccacctatctaaagcatagtcatcaagactccgggttaatcactgactaccgccactggcagatccccctaggcaggcgattccgatcccttaagatgtggttcgttttccgaatgtatggagtgaaaggtctgcaggcctatattaggaaacatgtacagctttcccatgaattcgaaagtctggtgaggcaggatccgaggttcgagatctgtgttgaagtcatcttaggtttagtatgcttcagactcaagggctccaataaggtgaacgaggcactactgcaacgtattaattcagctaaaaaaatccacctggtgccctgtcacctccgggacaagttcgtgctgcggttcgctatctgcagtaggactgtcgaaagcgctcacgttcagagggcatgggaacacatcaaggaacttgcagccgatgttctgcgggcagagcgggagtag

SEQ ID NO: 221173 - DNA, 96 bp, Artificial Sequence
  Description of Artificial Sequence: Synthetic coding sequence
atgaacgccagcgaatttcgccgaagggggaaagagatggtggactatatggccaattacatggagggcatcgaggggcgacaagtctacccttag

SEQ ID NO: 221174 - DNA, 51 bp, Artificial Sequence
  Description of Artificial Sequence: Synthetic coding sequence
atgaacgcatcagaattccgtagaaggggcaaggaaatggtggactactag

SEQ ID NO: 221175 - DNA, 1443 bp, Artificial Sequence
  Description of Artificial Sequence: Synthetic coding sequence
atgaacgcaagcgagttccggagacgagggaaggagatggtggattatatggccaattacatggaagggattgaggggaggcaggtatacccagacgtggaacccggatatctccggccactcattccagctgcagctccccaggagcctgatacctttgaagatatcattaacgatgtggaaaagatcatcatgccaggggtgacccattggcattccccatatttcttcgcatactttccaaccgcctccagttatcccgcaatgctggctgatatgctctgcggtgctataggatgtatagggttttcctgggcagccagcccagcctgcaccgaactcgaaaccgtgatgatggattggttaggaaagatgctggaactccccaaggcctttctcaacgagaaggctggagaaggcggtggagtgatacaaggatcggcgtccgaggctacccttgtcgctcttctggctgctcgaactaaggtgatccatcggctacaggcagcatctcccgaactcactcaggccgcaataatggagaaactggtggcttacagcagtgaccaggcccactcaagcgttgagagggctggcctgatagggggtgtgaagttaaaagcaataccatccgacggtaatttcgctatgcgtgccagcgccctgcaggaggccctcgagcgcgacaaggcagctgggttgattccgttcttcatggtggccaccctcggtacgaccacttgttgctcattcgataacctgctcgaggtcgggccaatctgcaataaagaggacatctggctgcacgtagatgccgcttacgccggaagcgccttcatctgtcccgaattccgccatctcctcaacggagtggagtttgccgatagcttcaattttaatccccacaagtggttgctggttaatttcgactgtagcgcaatgtgggtaaaaaaacgcaccgatttaaccggagcatttcgcctggatccaacgtatctaaaacactcacaccaggattcagggctcatcactgactaccgccattggcaaataccactgggcaggcgattccgtagtctgaaaatgtggtttgtgtttagaatgtacggcgtgaaagggctgcaggcctatattagaaaacacgtgcaactaagccatgagttcgagtcgctggtacgacaggaccccaggttcgagatttgcgtggaagtcatcctgggactcgtgtgtttccggttaaagggttccaacaaggtgaatgaggcgctgttgcagcgaattaacagcgcaaaaaaaatccatcttgtgccctgtcacctcagagacaagtttgtgctaaggttcgcaatttgctcccggactgtggaaagcgcccacgtgcagcgtgcctgggagcacattaaggagctcgccgcagacgttttaagggccgagagggagtag

SEQ ID NO: 221176 - DNA, 1017 bp, Artificial Sequence
  Description of Artificial Sequence: Synthetic coding sequence
atgaatgcctccgagtttcgaagaaggggcaaagaaatggttgattacatggctaattacatggaaggaatcgagggacgccaggtctatcccgatgtggaaccaggatacttgcgcccactcattcctgccgcagccccacaggaacctgatacattcgaggatattatcaacgatgttgaaaaaattatcatgcccggtgtgactcactggcactccccttattttttcgcctacttccctacagcatcctcctaccctgcaatgcttgctgacatgctgtgcggagctattgggtgtatcgggttttcttgggccgcttcccccgcttgtaccgagctggagaccgttatgatggattggctgggcaaaatgctcgaacttccaaaggcctttctaaacgaaaaagccggtgagggaggcggtgtgatccaggggtcagccagcgaagctacactggtggcgctgctcgcagccaggacaaaagtgatccatagattacaagccgcatctcctgagctgactcaggctgcaatcatggagaagctcgtggcgtacagttcagatcaggcccattcttcagttgaacgtgcaggacttattggcggtgttaagttgaaggcaattccaagcgatggcaatttcgccatgcgggcatcagccctccaggaggccctagagcgcgataaagccgcagggctcatcccgtttttcatggtggctaccctgggcacaaccacttgctgctctttcgacaacctgctggaggttggcccaatctgcaacaaggaggatatatggctgcacgtggatgcagcctacgctggatctgcctttatttgccccgaatttcgtcatctgctgaacggcgtggagtttgccgattcttttaattttaatccccacaaatggctactggttaatttcgattgtagtgctatgtggagtcgtcagcctgtgcggatgctacgcctgaaaaagacatgcctagtgtctgccgttgtccgcaggtcctag

SEQ ID NO: 221177 - DNA, 1209 bp, Artificial Sequence
  Description of Artificial Sequence: Synthetic coding sequence
atgaatgcctccgagtttagacgacgcggaaaagagatggtagactacatggcaaactatatggaaggaatcgaaggacggcaggtgtatccagacgttgagcccggatatttgaggcctctcatccccgctgctgcccctcaggaacctgacacctttgaggacatcataaacgatgtggaaaaaatcattatgccaggcggttccgctagcgaagctacgctcgttgccttgctcgcagctaggacgaaggtgatccaccggctgcaggctgcttcacccgagttgacacaggcagccatcatggagaagctagtggcgtacagctcagatcaggcccactcctccgttgagagggccggactgataggaggagtgaagctgaaagcaattccaagcgacgggaatttcgccatgagagcatcagccttgcaggaggcgctcgaaagagataaggcagccggactcattccattttttatggtagccactttgggcaccacaacttgctgcagctttgacaacctgctggaggtcggaccaatctgcaacaaggaggacatttggttacacgtggacgcagcgtatgccggatcagcctttatctgcccagagtttcgtcacctgctcaatggcgtggaatttgctgattccttcaactttaacccccacaagtggctgctggtcaatttcgattgctcagcaatgtgggtcaaaaaaagaaccgatctaaccggcgctttcagactcgaccctacatatctcaaacacagccatcaggacagcgggttgatcaccgactaccggcactggcagatcccattaggaaggcggttccgcagtctgaaaatgtggttcgtcttccgtatgtatggagttaaaggcctgcaggcgtatatccggaagcatgtacagttgagccatgagttcgagtccctggtccggcaggatccacgcttcgaaatttgcgtggaggtcatacttggcctggtgtgttttcggctgaaggggagcaataaggtaaatgaagccttacttcaaagaataaattctgctaagaaaatccatctcgtgccctgccacttaagagataagttcgtgcttagattcgctatttgctctaggactgttgaatccgcacacgtgcagagagcctgggaacatataaaggaattagcagctgacgtcctcagagctgagcgcgagtag

SEQ ID NO: 221178 - DNA, 1164 bp, Artificial Sequence
  Description of Artificial Sequence: Synthetic coding sequence
atgaatgcatctgaatttcgacgcaggggcaaagaaatggttgattacatggcaaattatatggaggggatcgaaggcaggcaagtttatcccgatgtggaacctggctatctacggcctctgatcccagctgctgccccacaagaacccgacacttttgaggacatcataaacgacgtcgagaaaatcataatgcccggagtaacacactggcacagcccatattttttcgcctattttccaaccgcttcatcgtatcccgcaatgctggccgatatgctgtgtggtgctatcggctgcatcggctttagctgggcagcatcccccgcatgcacagagctcgagacagtgatgatggactggttagggaagatgctcgagcttccgaaagcctttttgaacgagaaggccggtgaaggcggtggcgtgatccagatggtggccacgctagggaccactacatgttgctccttcgataatctcttggaggtaggcccaatctgtaacaaggaagacatctggttgcacgtagacgcagcttacgcaggctctgccttcatctgtcccgaatttcggcacctgctcaatggcgtggagttcgctgattcctttaatttcaaccctcacaaatggcttctcgttaacttcgattgttccgccatgtgggtgaaaaagcggaccgaccttaccggcgcttttcgcctagacccaacctacctcaaacattcccaccaggactctggattgatcactgactatcgccattggcagatccctctggggcgacggttccggtccttgaagatgtggttcgtatttagaatgtatggcgtgaaggggctccaggcttatataagaaagcacgttcagctgtcacatgagttcgagagtctggttcggcaagatccacgctttgaaatctgtgttgaggtgatattgggcctggtgtgtttccgcctcaaaggctccaataaggtgaatgaggccctgctccagaggattaattctgccaaaaagattcacttggtaccatgtcatctgagagataagtttgtgctccggttcgcgatctgcagtaggaccgtcgaaagcgctcatgtacagcgcgcatgggagcatatcaaagagttagccgctgacgtgcttagagccgagcgcgaatag

SEQ ID NO: 221179 - DNA, 735 bp, Artificial Sequence
  Description of Artificial Sequence: Synthetic coding sequence
atgcgggaggccgcttttatgtatagcacagctgttgctatttttctggtcatccttgtggccgcattgcaagggagtgcgccaagagagagtccgctcccctaccatataccccttgacccagagggcagcctcgagctgagttggaacgtaagttacacccaggaggccatccactttcagctgttagtgcggagactaaaggctggcgtgctattcggcatgtctgatcggggtgaactagaaaatgctgacttagtcgtgctgtggaccgacggagacacagcctactttgccgatgggaccgtccatctggtctacggcattctcgaagagccatttcggtctctggaagctatcaatggttcaggtcttcagatgggtctccaacgcgtgcagctgctgaagccaaatatacctgagcccgaactacccagcgacgcgtgtacaatggaggttcaggccccaaatattcagatcccgtcccaggagaccacttactggtgttacattaaagagctgccaaagggattctcccgacatcatattattaaatatgaaccgatcgtaacaaaggggaatgaagccctcgttcaccatatggaagtttttcaatgtgcccctgaaatggacagtgttccacacttcagtggaccatgtgacagcaagatgaaacctgaccggctgaattattgtagacatgtcctggccgcttgggctctcggggcaaaatag

SEQ ID NO: 221180 - DNA, 1854 bp, Artificial Sequence
  Description of Artificial Sequence: Synthetic coding sequence
atgcccgcactatcccggtgggccagcctcccaggaccctctatgcgtgaggctgcatttatgtacagcacggcagtcgccattttcctggtgatcctagtggccgcactgcagggtagcgcaccacgcgaatcccccctgccttaccacatcccactcgaccccgaaggctcccttgagttgtcctggaatgtcagttatactcaggaggccattcacttccagctgttggtccgcagattgaaagccggagtgctcttcggtatgtcagaccgaggggagcttgaaaatgctgatcttgtggtgctatggactgacggagacaccgcatacttcgccgacgcctggtccgatcagaaggggcaaatccatctggacccccagcaggattatcagctgttacaggtccagcgcaccccggaaggcctgaccctgctttttaaaaggccttttgggacttgtgaccctaaggattaccttatcgaagatggaaccgtgcatttggtgtacggaatactcgaagaaccgtttcgttcacttgaggctatcaacggcagcggattgcagatggggttacagcgtgtgcaattattaaaacccaacatacctgagccagagttgccttcagatgcttgtactatggaggtgcaggcccctaatatccagatcccaagccaagaaaccacatattggtgctatatcaaggaactgcctaagggattctctcgccaccacattatcaagtatgaacctattgtgactaagggcaacgaagctctagttcatcatatggaagtattccagtgtgctcctgagatggacagtgtaccgcatttctcaggaccgtgcgactcgaagatgaagccagatcgtctcaattattgcaggcacgtcctggcagcttgggctctaggcgctaaggcgttttactatcctgaggaggccggtcttgcctttgggggacctggctcctctcggtatctgaggctggaagtgcactatcacaaccccctcgtcatcgagggtcgaaacgactcgtccggtatccggctgtattacactgctaagctgcgaaggttcaatgccggtatcatggaactgggtttagtctatacccctgtgatggctattcctccccgtgaaaccgcatttatcctgactggatattgcactgataagtgcacgcagcttgcgctgcccccatctggcattcatatcttcgcctcacagctgcacacacacctcactggccgaaaggtagtgaccgtactggtgcgagacgggagagagtgggagatcgtgaaccaggataatcactactcccctcacttccaagagattagaatgttaaaaaaagtggtttccgtgcacccaggggacgtcctgatcacatcctgcacctataacacggaagatcgcgagctcgctactgtgggtggattcgggatcctcgaggagatgtgcgtcaactatgtacactactacccccagacacagctcgagctatgcaaaagcgcagtggacgcgggatttctgcaaaagtatttccacttgattaatcgatttaacaatgaagatgtgtgtacatgtcctcaggcctctgtctcacaacagttcactagtgtgccctggaacagctttaacagggatgtgctcaaggctctgtatagctttgctccaatctccatgcactgcaacaagtcatcggcagtgcggttccaaggagagtggaacttgcagccactgccgaaggtgatctctacgcttgaagagccgaccccccagtgtcctacctctcaggggcgatcccccgctggccctacagtagtcagtatcggcggaggtaaggggtag

SEQ ID NO: 221181 - DNA, 1341 bp, Artificial Sequence
  Description of Artificial Sequence: Synthetic coding sequence
atgcgaacattaaatacctccgccatggacggaacaggattagtggtggaacgtgattttagcgtgaggatcctcacagcctgttttttgagccttttaatactgtctactcttctgggaaatacactcgtgtgtgccgctgtaatcagatttaggcacctcaggagtaaggtaacaaactttttcgtaatttctctggcagtcagcgacctgctagtggccgtgctggttatgccatggaaagccgttgcagaaattgctggattttggccgtttggctcattctgtaatatttgggtcgcatttgacataatgtgtagtacggcaagcatcctgaatttgtgtgtgatctcagtcgaccgctactgggcaatctcttccccatttagatacgaaagaaaaatgacgcccaaagcagcctttattttgatttccgtagcgtggacactatccgtgctgatttctttcattcccgtacagctgtcctggcacaaagccaaacctaccagccctagcgacggaaatgcgaccagcctggcagagacaatcgataattgtgatagttcgctgtcacggacctacgctatatcatcctccgttattagcttctacataccagtggccatcatgattgtcacgtatacaaggatttaccgaatagcacaaaaacagattaggcggattgcggcattagagcgagccgctgtgcacgccaaaaactgtcagaccacgactggaaatgggaagcctgttgagtgttcccaacctgaatcctcttttaagatgtcctttaagcgcgagactaaggtgttaaagactctcagcgttatcatgggggtgttcgtttgttgttggctgcccttcttcattctgaattgcatcctccccttttgcggcagtggggaaacacagcccttttgtatagattctaacacctttgatgtgtttgtgtggtttggatgggcgaacagcagcttgaaccctattatatatgcctttaatgcagattttcgcaaagcattttcgactctgctgggttgttaccgactatgcccagctactaataacgctatcgaaaccgttagcatcaataataatggggcagctatgttttccagtcaccacgaacctcgcggatcgatttcaaaggaatgtaatctggtgtacctgatacctcacgccgtgggtagctccgaagacctgaaaaaggaagaggctgccggtatcgcacgacctctcgaaaagctttctccagcactaagcgtgatccttgactacgataccgatgtatcgctggagaagatacaacctatcactcagaatgggcagcatcctacgtag

SEQ ID NO: 221182 - DNA, 1341 bp, Artificial Sequence
  Description of Artificial Sequence: Synthetic coding sequence
atgcgcaccttgaatacttctgcaatggacggaactggcctggtcgtggaacgcgactttagcgtgcgtattctgacagcttgcttcctgtctctgctgatactgtctacacttctgggaaacactcttgtctgcgccgctgtgattcggttccggcacctgagaagcaaggtgactaacttcttcgtgataagtcttgctgtgtctgatttactggtggctgtcctggtgatgccctggaaggctgtagcagaaattgccggattctggccattcggctctttctgcaacatctgggtggctttcgacatcatgtgcagcaccgccagtatcctcaacctatgcgtgatcagtgtagacagatattgggcgatttcttccccatttcgatacgaacgcaaaatgaccccaaaggctgcattcattctaattagcgtggcctggacattgtcagtactgattagtttcatcccagtgcaacttagttggcacaaggctaagcctacctctccaagcgatggaaatgctactagcctcgcggagaccatcgataactgcgatagcagcctgagtaggacctatgcgatctcttcatccgtgatcagcttctatatcccggtcgcaattatgattgttacctacacccggatttaccggatcgctcagaagcaaatccgcagaatcgcagctttggagagagctgctgtgcacgctaagaactgtcagactaccactgggaacggcaagcctgttgaatgctctcagcccgagtcatctttcaaaatgtccttcaagagggagaccaaggtccttaaaacattaagcgtcattatgggcgtgtttgtctgctgctggcttcctttcttcatactgaattgcatcctgcccttctgtgggagtggcgaaactcaaccgttttgcatcgactccaacacctttgacgtgttcgtatggttcggttgggccaacagttctctcaacccgatcatttacgcgttcaatgccgacttcaggaaagcttttagcaccctcttaggatgctaccgactctgcccggctaccaataacgctattgaaaccgtgtcaataaataataacggcgcagcgatgtttagctcccaccacgagcctagggggagcatcagcaaagagtgcaacctggtctatctcatcccccatgcagttgggagtagtgaagacctgaaaaaggaagaagccgcaggaattgctaggcctctggagaagttgagcccggcactgagtgtgattctggactacgacaccgatgtgagccttgaaaaaattcagcctatcacacagaacggacaacatcctacgtag

SEQ ID NO: 221183 - DNA, 1245 bp, Artificial Sequence
  Description of Artificial Sequence: Synthetic coding sequence
atggaccctttgaatttgtcttggtatgacgatgatcttgagaggcaaaattggtccaggccatttaacgggtccgacggcaaagccgataggccgcactataattactacgccacactcctcacacttttaatcgcggttatcgttttcggcaatgttttagtgtgcatggcggtcagtcgggagaaagcactgcagaccaccactaattacctgatcgtgtccctggcggtggcggacctgctcgtggcaactctggtgatgccctgggtcgtctacctggaggtagtgggagaatggaagttctcaaggattcactgcgatatctttgtaaccttggatgtaatgatgtgtacagcatcaattttgaatctctgtgcaataagcatcgataggtacacagcagtcgcaatgcctatgctttacaacactcgctatagttccaaacggcgagtcacagtgatgatctctattgtctgggttttgtcttttactattagttgtcccttactgttcgggctaaacaatgccgatcagaacgaatgcatcattgccaatcctgcctttgtggtgtatagttccattgtaagcttctatgttccattcatcgtgaccctgctggtctatataaaaatttatatcgtgctaaggagaagaagaaagcgtgtgaacactaaacggtcctctagagcattccgtgcgcacctccgggcacctctaaaagaggctgctagaagggcccaggagcttgaaatggagatgctatcctctacctcaccgcctgaaagaaccaggtactcccctatacctccctcccatcaccagctcacactgccggacccctcccatcatggcctccactccaccccggatagtcccgctaaacccgagaagaacgggcacgccaaggaccaccccaagatcgccaaaatctttgaaattcagaccatgcctaacggcaaaacaaggacaagcttaaaaacaatgtcccgtcgtaagcttagccagcagaaagagaagaaggccacacaaatgcttgccatcgtcctgggcgtgtttatcatctgctggctgcccttttttattacgcacatactgaatatccactgtgactgcaatatacccccagtcctgtattccgctttcacctggctgggctacgtgaattctgcggtgaatccaatcatctacacgacgttcaatatcgagttccgcaaggccttcctaaagatcttacactgctag

SEQ ID NO: 221184 - DNA, 1338 bp, Artificial Sequence
  Description of Artificial Sequence: Synthetic coding sequence
atggaccccctgaacctcagttggtatgacgacgatctggagcggcagaactggtccaggccatttaacggatccgatggtaaagccgatcgaccccattataattactatgccactctattgactctcctgatcgccgtcatcgtctttggaaacgtgctggtttgtatggctgtgtcacgcgagaaggccctgcaaacaacaactaattatcttatcgtgagtctggcagtagccgacctgctagtggccactctggtaatgccttgggtggtttatctggaagttgtgggcgaatggaagttctcccgcattcactgcgatatttttgtgacactggatgtaatgatgtgtactgcctctatcctgaatctgtgcgctatcagtatcgacagatatacagcagtggcaatgccaatgctgtataatacacgttattcttcaaagaggcgagtgactgtgatgatctcaatcgtttgggtgctgtcttttacgatctcgtgtccactcttgtttgggctcaacaatgctgatcaaaacgagtgcataattgctaatcccgcattcgtcgtgtacagcagcatcgtcagcttttatgtgccctttatcgtgacactgctggtctacataaaaatctatatagtattgagacgcaggagaaagagggtgaatacaaaacgtagcagtcgggcattcagagcacatttgcgtgctccactaaagggtaactgcacacaccccgaggacatgaagctttgtaccgtcattatgaaatctaacggttcgttccccgtgaatcgacgccgagtcgtacaggaggcagcgaggcgggctcaggagctagagatggaaatgctgtcctcgacctccccccctgaacgcaccagatactctcccattccgcctagccaccatcaactgaccctcccagacccctcccatcatggcttacatagcacccctgattctcccgcaaagcccgaaaagaatggacatgcgaaggatcaccccaaaatagccaagattttcgagattcaaacaatgccgaatggaaaaacgaggactagtctgaaaacaatgagtcggaggaagctgtcacagcaaaaggaaaagaaagctacccagatgcttgccattgtcttgggtgtgttcatcatctgctggcttcccttctttatcacacacatccttaatattcactgtgactgcaatattccaccggtgttgtactcagcctttacgtggctgggttatgtaaactccgccgtcaatccaattatctacacgacctttaacatcgagtttcgtaaagcctttttgaagattctccattgttag

SEQ ID NO: 221185 - DNA, 1332 bp, Artificial Sequence
  Description of Artificial Sequence: Synthetic coding sequence
atggaccctctcaatttgtcatggtatgacgatgacctggagcgccagaattggagtcgaccattcaacgggtcggacggaaaggctgataggcctcattacaactactatgccaccctgctgacactcctgatcgccgtcatcgtcttcgggaatgtcctagtttgtatggccgtcagtcgggagaaggctcttcaaaccacaaccaattatctgatcgtctcactggctgtagccgacctgcttgtggcgaccttggtaatgccctgggtggtgtaccttgaagtggttggcgagtggaaattttccaggattcactgcgacatcttcgtcaccttggatgtgatgatgtgtactgcttccattctaaacctctgcgccattagcattgacagatatactgccgtggccatgcctatgttgtataatactcgctatagcagcaagagaagggtcacagtgatgatatccatcgtctgggtgttaagtttcacaatctcctgcccacttttgttcgggctcaataatgcagatcagaacgaatgtatcatcgctaaccccgcattcgtcgtgtattcttccatcgtttctttctatgtgccgttcattgtgactctgctggtgtatattaaaatctacatcgtgttacgcaggcggagaaagcgggtgaataccaaaagatcaagccgggcattccgggctcacctgcgggcaccattgaagggcaactgcacccatcctgaggatatgaaactgtgcacggtcataatgaaatccaacggctcgtttcccgttaacagacgcagagttgaggccgcacggagggcacaagagttggagatggagatgctgtcatcaaccagtcccccagagcgcacgaggtactcgccaatcccaccctctcaccaccagctgactctgccagaccccagtcatcacggcctgcatagtacccccgattccccagccaaaccggaaaagaacggtcacgctaaggatcaccccaaaatagcaaagatattcgaaatccagaccatgcctaacggcaagacaagaaccagcctgaagacaatgtctcgcagaaagctgagccagcagaaagaaaaaaaagccacgcaaatgctcgctatcgtcttgggggtattcattatttgctggctccctttctttattacacacattctgaacattcactgtgattgcaacatccccccagtcctgtactccgcatttacatggctcggctatgtgaattcggccgtgaatcccattatctacacaacctttaatatcgaattcaggaaggcctttttgaaaatcttacactgttag

SEQ ID NO: 221186 - DNA, 1338 bp, Artificial Sequence
  Description of Artificial Sequence: Synthetic coding sequence
atggaccccctcaatctttcttggtacgatgatgatctagaaaggcaaaactggtcccgcccatttaacggatccgatgggaaagccgataggcctcattacaattattacgccacgttgctgacattgctgattgccgttattgtcttcgggaacgtgttggtgtgtatggctgtgtcgcgggagaaagccctccagaccactacaaactacctgatcgtgtcactggctgtcgctgatcttctggtcgccacgttagtgatgccttgggtggtctaccttgaagtcgtgggcgaatggaaatttagccgcatccactgcgatatttttgtaactcttgatgtgatgatgtgcacggcttctatcctgaacctttgtgccatttccatcgaccggtataccgcagtggctatgcctatgctgtacaatactcgatattccagtaagaggcgcgtgacagtgatgatctccatcgtgtgggtactgtcttttaccatatcctgcccactgcttttcgggctgaataatgcagaccaaaacgagtgcattatcgctaaccctgcatttgtggtgtactccagcattgtgtcgttctacgttccttttattgtcaccctgctggtatacattaaaatctatattgtccttcgacgtcgcagaaagcgggtcaacacgaagcgctcgagccgtgcgttccgcgcacatttgcgcgctccccttaaagggaactgtacacaccctgaagacatgaagctctgcaccgttattatgaagtccaatggcagcttccccgtgaaccgcaggcgagtggtgcaggaagcagcaagaagagctcaggagcttgagatggaaatgttgtcttctactagtcccccagagcggacacgctacagtcccatccccccttcccaccaccagcttactttacccgacccatcccaccatggcctgcattccactcccgatagtccggctaaacccgaaaagaacggccatgccaaggatcatcccaagatcgcgaagatcttcgagattcagaccatgccaaatggtaagacaaggactagtctaaaaactatgtccaggcgcaagctctctcaacagaaggaaaagaaggccacccagatgctggccatcgtgctcggggtatttataatatgctggctgcccttttttatcacacatatcttgaatattcattgcgactgtaacatcccaccagttctctattctgcattcacctggttagggtatgtgaacagcgctgttaaccccatcatctatactacctttaacatcgagttcagaaaagctttcttgaagatattgcactgctag

SEQ ID NO: 221187 - DNA, 24 bp, Artificial Sequence
  Description of Artificial Sequence: Synthetic coding sequence
atggaccctctcaatctctcctag

SEQ ID NO: 221188 - DNA, 1332 bp, Artificial Sequence
  Description of Artificial Sequence: Synthetic coding sequence
atggacccacttaatctgtcttggtatgacgatgacctggagaggcagaactggtccagaccttttaatggcagtgacgggaaggcagatcgaccgcactacaattattatgccaccctgctgaccctgctgatcgcggtcatcgtgttcgggaacgtgctggtttgtatggccgtaagtagggagaaagccctgcagaccacaacgaactatctcatcgtgtcattggccgtggcagacctgctggtagccactttggtgatgccatgggtggtgtacctcgaggtcgttggtgagtggaagtttagtaggatacactgtgatatctttgtcaccctcgacgtaatgatgtgcaccgcgtccattctaaatttgtgtgcgatttcgattgatcggtataccgcagtggcaatgcccatgctgtacaacacacggtactcctcaaaacgcagagtcactgtgatgatttcaatagtgtgggtgctgagttttacaatcagctgcccactactgttcggtttgaacaatgcggaccaaaatgaatgcatcatagctaatcccgctttcgtggtttattcctctatcgtgagcttttatgtcccttttatagtcacgcttttggtttatatcaagatttacattgttctgcgacgtcgccgtaagcgggtgaatacaaaacggtcttctagagcatttcgggcacatcttcgggcaccccttaaagggaattgcactcacccagaggatatgaaactgtgtaccgtgatcatgaagtcaaacggttcatttcccgtaaaccgcagacgtgtagaggctgccaggcgcgcacaagaactggagatggagatgctatcctccacttctcccccagaaaggacccggtactctccaattcctccctcacaccaccagcttaccttacctgatccctcacaccacggcttacactccacacctgatagtccggctaaaccggaaaagaacgggcacgccaaggatcaccctaaaatcgccaagatattcgagattcagactatgcccaatggaaaaactcgcaccagcctcaaaacaatgagcaggcggaagctgtcccagcaaaaggaaaagaaagccacgcagatgctcgccatcgtgctcggggtctttatcatctgttggcttcccttcttcattacacacatactgaacatccactgcgactgtaacattccccctgttctgtattcagcattcacctggcttggttacgtgaatagcgctgttaaccccatcatctacactacgttcaacatcgaatttcgcaaagccttcctcaaaatcctgcattgttag

SEQ ID NO: 221189 - DNA, 534 bp, Artificial Sequence
  Description of Artificial Sequence: Synthetic coding sequence
atggacccgttgaacctgagctggtacgacgacgacttggaaaggcaaaactggtcccggccatttaacggtagcgacggcaaggccgatcggccacactataattactatgccaccctgctcacactgctgattgcagtgattgtcttcgggaacgtgttggtgtgtatggcggtgagtcgagagaaagccttgcagacaaccaccaactacctgattgtgagcctcgcagtggcagatctccttgttgctactctggtgatgccatgggtcgtgtaccttgaggtcgtgggtgaatggaaatttagcagaatacactgcgatattttcgtaactttggatgtcatgatgtgtactgcttccatcctaaacctatgcgccatttcgattgacagatataccgctgttgcaatgcctatgttatacaacacccgttactcctcaaaaagacgcgtgacagtgatgatttcaattgtctgggtgctttcattcacaatctcttgccctctcctatttggactgaacaacgcctag

SEQ ID NO: 221190 - DNA, 1329 bp, Artificial Sequence
  Description of Artificial Sequence: Synthetic coding sequence
atggacccactcaacttgagttggtacgatgacgatttagagaggcagaactggtctcggccttttaacggctctgatggaaaggccgatcgaccccactacaattactatgccactctacttaccctcctgattgctgtaatcgtgttcgggaacgttctggtatgtatggcagtttccagggagaaagcactgcagaccacaaccaactacctgatcgtgtctctggccgtggccgatctgttagtggctactttagtgatgccatgggtggtgtacctggaggtgggagagtggaagttttctaggatccattgcgacatctttgttactcttgatgtaatgatgtgtaccgcgtccatactgaacctctgcgccatctctattgacagatataccgccgtggccatgccaatgctgtataacacacgatacagctcgaaacgacgggttactgtgatgataagcatcgtgtgggtgctgagctttaccatttcctgcccactgcttttcggactgaataatgcagatcagaacgaatgcataatcgctaacccagcattcgtcgtttacagcagcattgtgtcgttctatgtgccattcattgttactctcctggtgtacattaagatctatatcgttctgagaagacggaggaagagagtgaacaccaaacggtcctcacgcgcttttcgcgcacacctaagggccccactgaaaggcaattgcacacatccagaggacatgaagctttgtaccgtcattatgaaatcaaacgggtcattcccagtaaaccgacgcagagtggaggccgctcgtagagctcaggagttggaaatggaaatgctctccagtacatccccccctgagcgcacacgatacagccctattcccccttcacaccaccagctgactctccctgacccaagccaccatggtttgcacagtacacctgatagtccagccaagcctgagaagaatggacacgccaaagatcacccaaagatcgctaaaatctttgagattcagacaatgccaaatggaaaaacaagaaccagcttaaagactatgtccaggagaaaactgtcccaacaaaaggagaagaaggcgactcagatgctggccatagtcctgggcgtcttcataatttgctggcttcctttcttcatcacacatatcttaaacattcactgcgattgtaacattcctcccgtgctgtatagtgccttcacctggttgggatatgtaaacagcgctgttaatcccattatttacaccaccttcaatatcgaatttcggaaggcattcctcaagattctgcattgctag

SEQ ID NO: 221191 - DNA, 1029 bp, Artificial Sequence
  Description of Artificial Sequence: Synthetic coding sequence
atggcctccctgtcgcagctatcagggcacctaaactatacatgtggcgcagagaactcaaccggtgcttcacaggctaggccccacgcttactacgccctgtcctactgtgccctgatcctggcaatcgtttttgggaatggccttgtgtgcatggcagtcctgaaagagagggcacttcagaccactacgaactatctggtagtgagtttggccgttgccgacctgcttgtggccacactggttatgccctgggtggtgtatctagaggtgaccggcggagtttggaatttttcgagaatttgctgcgatgtctttgtgactctggacgtgatgatgtgtaccgcttcaatcttgaacctttgtgctataagtatcgaccgatacaccgcggttgtaatgcccgtgcactaccagcacggcaccgggcaaagcagttgtcgcagagtggccttgatgataactgcagtatgggtgttggccttcgccgtctcatgcccacttctgtttggcttcaacacaacaggcgatcccaccgtctgcagcatcagcaacccagacttcgtgatctatagtagtgtagttagcttttacctaccgttcggagtaactgtgctggtatacgccagaatatacgtggtgctcaaacaacggaggagaaaacgtatccttaccaggcagaattctcagtgtaactccgtgcggcctggctttccccagcaaacactcagtcctgaccctgctcatctcgagctcaaaaggtactactccatttgccaggataccgccctgggaggcccaggctttcaggagcgcggtggtgagcttaaacgcgaagaaaaaactagaaattccctgtcagctaccagtggcgaggaaggaaatcctaatggaggccattgcgcttggggattgcactgcctcctggctgcattactgttggatccatgtagccagtatccccttccagatatgcccagggtgccccgagccctccagtgtcacgacatggccggactgagggaatag

SEQ ID NO: 221192 - DNA, 1104 bp, Artificial Sequence
  Description of Artificial Sequence: Synthetic coding sequence
atggcttcactgtcccagctgtcggggcatctgaactatacttgtggcgcagagaactccaccggagcatcccaggctcgaccccatgcatattatgcattatcctattgcgcactgatccttgccatcgtgttcgggaatggtttagtgtgcatggcagtccttaaagagcgagcattacagaccaccacaaactacctggtagtgtcgttggcggtggcagaccttctagtggctacattagtgatgccctgggttgtatacttagaagtgaccggaggtgtatggaatttcagccgcatttgttgtgacgtgtttgtgactcttgacgttatgatgtgtactgcaagcatcctcaatctctgcgctatatccatcgacaggtatacagcagtcgtcatgcccgtccattaccaacatggaaccgggcagtccagttgccgacgagtcgccttaatgatcaccgccgtatgggttctggcctttgccgtatcttgcccactcttgtttggattcaacaccaccggggatcctaccgtctgctctataagtaatccagatttcgtgatctattcttctgtagtgtcattctatttgccttttggtgtcactgtgcttgtttacgctcgtatctacgtggtccttaaacagagaagacggaaacgcatcctcacacgacagaatagccaatgcaatagcgtacggcctggattcccccagcagacactgtctccagacccagctcatctggagctaaaacggtattatagcatttgtcaggacacagccttaggtggacctggcttccaggagagggggggagagttaaagcgggaggaaaagacccgaaatagcctcatgcctcttcgggagaaaaaggcaacgcagatggtggcaattgtcttaggcgcattcatagtctgctggctcccattcttccttacgcatgtgttgaacacgcactgccagacctgccatgtttctcccgaattatatagcgccacgacttggctgggatatgttaactccgccctgaacccagttatatatacaacattcaacatcgagttccgtaaggcatttcttaaaatacttagctgttag

SEQ ID NO: 221193 - DNA, 1203 bp, Artificial Sequence
  Description of Artificial Sequence: Synthetic coding sequence
atggcctcgttatctcagctgtccggccacctgaattacacctgtggagccgaaaattccaccggagcctcccaggccagaccacatgcatattatgcgctttcttattgcgcgctaattctagcgatcgttttcggtaacgggctcgtttgtatggccgtcctaaaggaaagagcactccaaacgacgaccaattacctggttgtgtctctcgcagtcgccgatctgctggttgctacacttgtgatgccgtgggtcgtgtacctggaggttactggaggagtatggaacttctcacgtatctgctgtgatgtcttcgttacattggacgttatgatgtgcaccgcttcaattcttaacctctgtgccatttcaatcgaccggtacacagctgtggtgatgccggtgcactaccaacatggaactgggcaaagcagttgcagacgcgtggcgctgatgattactgccgtctgggtgctggccttcgctgtgtcgtgccccttgctctttggttttaatacaaccggcgatccaactgtttgctctattagcaacccagattttgtgatctattcgtccgtggtgtctttctatctgccttttggggtaaccgtgctggtttatgctagaatttacgtggtgcttaaacaacgacgccgtaagagaattctgactaggcagaatagccagtgtaatagtgtacggccaggatttccgcaacaaaccttgtcacctgaccctgctcatctcgagctgaagcgctattactccatctgccaggatactgcactcggcggtcccggattccaggagcgcggaggcgagctcaaacgcgaagagaaaacaaggaatagtctctctccaaccattgccccaaaattatcactagaggttcggaaactgtccaatggccgactcagtacgtctctgaagctgggccctctgcagccccgtggagtcccactgcgcgagaaaaaggccacacaaatggtggctatcgtgcttggagccttcattgtctgttggctgcccttttttctgacccatgtgttgaatacacattgtcagacctgccacgtcagcccagaattgtacagtgcaacgacttggctgggttatgtgaactccgctctcaaccctgttatttacacgacctttaatattgaattcagaaaagcattcctgaaaattttatcgtgttag

SEQ ID NO: 221194 - DNA, 1203 bp, Artificial Sequence
  Description of Artificial Sequence: Synthetic coding sequence
atggcgtccctcagccagctgagcggacacctcaattatacctgtggggctgagaatagtacaggcgcatctcaggcgaggccccacgcctactacgccctgtcgtattgtgccctgatcctagctatcgtctttgggaatggtctggtgtgcatggccgttctgaaagagagagcccttcagaccacgaccaactacctggtggtgagtctggccgtggcggacctgcttgtggcaactttggtgatgccctgggtcgtttatttggaggtcactggaggtgtatggaatttctcccgaatttgctgtgacgtcttcgtgacattggacgtgatgatgtgtaccgctagcatcctgaatctttgtgccatttcaatcgatcgatacacagccgtagtgatgcctgtgcattaccagcatggcaccgggcaaagcagctgccggagagtagcattgatgataactgccgtgtgggtgctggcctttgcagtatcctgccctctgctcttcgggtttaatacaacaggagaccctactgtgtgtagtattagtaacccggacttcgtcatctactcgtccgtcgtgagcttctacctgcctttcggcgtcaccgtactcgtgtatgctcgtatttacgtggtgttaaagcagagaaggagaaagaggatcctcacccggcagaatagtcagtgtaacagcgtaaggcctggctttcctcagcaaaccctgtctccggatcctgcgcacctggagctgaaaagatactacagcatctgtcaggacaccgcactggggggacccggattccaggagcgcggaggcgaactgaagagggaggaaaagaccagaaacagcctctctcccactatcgcgcctaaactgtccctcgaggtcaggaagcttagtaatggcagactgtcaaccagcctgaagttgggaccgctccagccacggggagtgcctctgagggagaagaaggctacccagatggtagccatcgtgctgggagctttcatagtgtgctggctgcccttcttccttacacacgtcctgaacacccactgccagacatgtcacgtcagccctgagctttacagtgccacaacctggttagggtatgtgaattccgccctgaatccagtgatctatacaacgttcaatatagaatttaggaaggctttcttaaagatcctgtcctgctag

SEQ ID NO: 221195 - DNA, 1203 bp, Artificial Sequence
  Description of Artificial Sequence: Synthetic coding sequence
atggccagtctcagccagctgtcagggcacctgaactacacttgcggtgctgaaaactctacaggagcgagccaggccaggccccatgcttattatgctctgtcttattgcgctctcatcttggccatagtttttgggaacggacttgtgtgcatggctgttctaaaagagagggctctgcagactacgacaaattatctcgtggtttcccttgccgtcgctgacctgctcgtggcaactctggtcatgccttgggttgtatatttggaagttaccggcggtgtctggaatttttctcggatctgttgtgatgtgtttgtgactctggatgtaatgatgtgcacggcctctatcctgaatctgtgcgccataagtattgatcgatacacagccgttgtcatgcctgtgcactatcagcatggaacgggacagtcctcttgtcggagggtggctctgatgatcacagctgtgtgggtactggctttcgcagtaagttgtccgctactgttcggcttcaacactaccggcgaccccacagtgtgctctatatccaatccagattttgtgatctattcctctgtggtgtctttctacttaccattcggcgttacagtgcttgtgtacgcacgtatctacgtcgtgctgaaacagcgcagaagaaagagaattctgactaggcagaactcacagtgcaattctgttcgaccgggtttcccacagcaaaccttatctccggaccctgcgcacctcgaactcaagcggtactattcgatatgtcaagacactgccctgggaggaccgggattccaagaacgcggtggcgagctaaagagagaggagaagactaggaattccctgagccctaccattgctccgaaactgtccctggaggttcgaaagctgtccaacgggaggctgtcaacttcactaaaactggggcctctccagccacgcggagtgccactccgagaaaagaaggcaactcagatggtggcaatcgttttaggagcttttatcgtttgttggctaccgttttttctgactcacgtactcaatacccattgccagacctgccacgtttcccctgaactgtattccgctacaacatggctgggctacgtgaactcagctcttaaccccgtgatttacaccaccttcaacatcgaattccggaaggcctttcttaagatactgagctgttag

SEQ ID NO: 221196 - DNA, 1260 bp, Artificial Sequence
  Description of Artificial Sequence: Synthetic coding sequence
atgggaaatcgctctaccgcagacgcagatggactgctggcgggacgcggtccagccgctggcgctagcgccggagccagtgcaggacttgcaggccaaggggcagctgctttggtgggcggtgtgttgcttatcggtgccgtgctggctggaaattcgttggtctgcgtgtctgtagcgacagagcgagccctgcagactcctacaaactcttttattgtttctctagcagcggcagatttactcttggccctactggttttgcctctgttcgtgtacagtgaggtacaggggggagcatggctgctgtcacccaggctctgcgatgccctgatggccatggacgtaatgctttgtacagcatcaatcttcaatctgtgcgccattagtgtggaccggtttgtggctgttgccgtgcccttgaggtacaacaggcaggggggttcgcgtagacagcttctgctgataggggcaacttggctgctcagtgccgctgtggccgcacctgtcctgtgtggacttaacgacgtcagaggtagagaccccgctgtttgtcggttggaagatagagattacgttgtttactctagcgtctgtagcttcttcctaccatgcccccttatgctgctgctgtactgggccacctttcggggtcttcagaggtgggaagttgccagaagggcaaaattgcatggcagagctccaaggagaccctcaggcccagggcctccatccccaacaccgcctgccccaagattacctcaggacccctgcggacctgactgtgctccacctgcgccaggactgcccaggggcccttgtggtccagattgcgcccctgccgctcccagtctgcctcaggacccctgcgggcctgactgtgcccctcccgctcctgggttgccccctgacccttgtggcagcaattgcgcaccgcctgacgccgtgagggccgcagccttgccccctcaaacgccccctcagacgagacggagacgtcgtgcaaagataaccggcagagagcggaaggctatgcgggtcctgcctgtggtcgtgggtgcattcctgctgtgttggaccccgttcttcgtcgtgcatatcactcaagccctctgtcctgcctgctctgtgcccccacgtctggtctccgccgtcacctggctgggctacgtcaattctgccctgaaccctgttatctacaccgtctttaatgcagagttcagaaacgtcttccgaaaggccctgcgggcatgttgctag

SEQ ID NO: 221197 - DNA, 1434 bp, Artificial Sequence
  Description of Artificial Sequence: Synthetic coding sequence
atgctgccccctggatcaaatggaactgcatatcccggacaattcgccctgtatcaacagttggcccaaggaaacgctgtcggtggcagcgccggagcgcctcccttgggaccttcacaagtggtgaccgcgtgtctgctgaccctcttgatcatttggactctgctcgggaatgtactggtgtgcgccgctatagtcaggtcccgtcacctgcgggctaacatgacaaatgtttttattgtgtctctcgctgtatccgacctgtttgtagcccttttagtcatgccttggaaggcggtagccgaagtcgccggatattggccttttggtgccttttgtgacgtttgggtcgccttcgacatcatgtgctccacagcttccatcttgaatctgtgtgtcattagcgtagaccgatattgggctatctcgcgaccgttccgctacaagcgtaagatgactcagcggatggccctggtgatggtgggtctagcatggacacttagcattctgatctcctttattcctgtgcaactcaattggcatcgtgaccaggccgcttcttggggcggattggatctcccaaacaaccttgccaactggaccccttgggaggaggatttttgggaaccggacgtgaatgctgaaaattgtgattcaagtttaaatcgcacatatgccataagttcttcgctgatttccttttacatccctgtagctataatgattgtcacctacactcgtatctatcgaatcgcacaggtgcagattcgacgtatatcctcactggagagggccgctgaacacgcccagtcttgccgctcaagtgctgcatgtgctccagacacgagcctaagggcaagcatcaaaaaagagaccaaagttctcaaaacactgtctgtgatcatgggtgtttttgtatgttgttggctgcctttctttattcttaattgtatggtgcccttctgcagtggccaccccgaggggcctcctgcgggattcccctgcgtctccgagacaacctttgatgtatttgtgtggttcggctgggcgaactcctctttgaaccctgttatttatgcattcaacgctgattttcagaaggtattcgctcaattacttggttgctctcacttctgttctagaacgccagtcgagaccgtcaacattagcaatgagctgatttcctataaccaagatatcgtgttccataaggagatcgctgcagcttatatccatatgatgcctaacgctgttactccgggtaatcgtgaagtcgataacgacgaggaggaagggccatttgaccggatgtttcagatctaccagacctcaccagatggggatcctgtcgcagagagcgtgtgggagttggactgtgaaggggagatctcactggataagattacaccctttacacccaatggcttccactag

SEQ ID NO: 221198 - DNA, 438 bp, Artificial Sequence
  Description of Artificial Sequence: Synthetic coding sequence
atggaccctgaagaacaggagctactcaacgattaccgctatagatcgtactcaagcgtcatcgagaaagcactcagaaattttgagtccagctctgagtgggcagatctcatcagtagcctgggaaagctcaacaaggccctccagtcaaacctgcgctattccttactgcccagacggttgttgatctccaagcgactcgctcagtgcctacatcccgctctcccaagtggggtccaccttaaagcactggaaacgtacgagatcattttcaagatagtggggacaaagtggctggcaaaggacctgtttttgtattcctgcgggctctttccgttattagcccacgctgccgtgtccgtgcgccctgtcttgcttactctgtatgagaagtactttctgccactgcaaaagttgttactgccctccctccagtag

SEQ ID NO: 221199 - DNA, 6896 bp, Artificial Sequence
  Description of Artificial Sequence: Synthetic coding sequence
atggacccagaagagcaggagctgctgaacgactacaggtataggagctactcctccgtaattgaaaaagctcttcgaaacttcgagtcctcttccgagtgggccgatctcatcagcagtttgggaaaactgaacaaggccctgcagtctaatttaagatactcgttattaccccgacgactgctcattagcaagcggctggctcagtgtctccacccagctctcccatccggcgttcacctcaaggcacttgagacatatgagatcatttttaagatcgtgggcacgaagtggctggcgaaagacttatttctctacagctgtgggctgtttcctctactggcacacgcggcagtaagcgtccgtcccgtgctgctgactctttacgagaagtattttctgccattgcagaaattgctgctaccatccctccaggcgtttatcgtggggcttctgcccggtctcgaagagggctctgaaataagcgatcgcacggacgccctcctccttaggctgagcctggtagtcggcaaggaagtcttctacacagctctgtggggtagtgttctggccagccctagtattaggctgcccgctagcgtgttcgtagttggtcacattaaccgcgatgcccctgggagagaacaaaagtacatgctgggaacaaaccaccagcttaccgttaaatctctccgggcttcgcttctggacagcaacgtcttagtccaaaggaataacctggaaatcgtgcttttcttttttccattctatacttgcctcgacagcaacgaacgcgcaattccactgctgcgttcagatatcgttcggatcttgagtgcagccacacagaccttgctccggagggacatgtcactgaataggaggctttacgcatggctgctgggcagtgatattaaaggcaacactgtggttccggagtccgagatttcgaatagctacgaggatcaaagctcctacttttttgaaaaatactcaaaggacctgctagtggaagggctcgcagagatcttgcatcaaaagttcattgacgcggacgtggaggagcggcaccacgcgtacctcaagccattccgggtcctaattagtctgctcgacaagccagagatcggtccccaggtggtaggcaatctgttccttgaagtgatcagggccttttacagctattgtagggatgcattaggctccgatctgaagctgagttatacacagtcgggtaatagcctcatctccgcaataaaagagaatcgtaatgcctcggagatcgtgaaaaccgtgaaccttctaatcacttcattgagtacagactttctgtgggactacatgacgcgctgcttcgaagaatgcttccgccctgtcaaacagcggtattccgttcgcaattccgtttccccaccgcctactgtcagtgagctctgcgctctgttggtgttcctgctcgatgtaatcccactggaactctacagtgaggtgcagactcagtatttgccccaggtgctaggctgcctggtgcagccactcgctgaagatatggaagcacttagcctgcctgagcttactcacgcactaaaaacctgctttaaggttctgtcaaaggtgcagatgccaccatcctacttagacaccgagtccacttcagggacgtcctcccccgtgaaaggggaaaacggtaaaatcattctggaaactaaagcagtcatcccaggtgacgaggacgccagtttccctcccctgaaaagtgaagacagtgggatcggactctctgcctcaagccctgagctttccgagcacctgcgggtacccagggtatccctggaaagggatgatgtttggaaaaaaggtgggtccatgcagcggacattcctctgcattcaggagttaatcgcaaacttcgcctccaagaatattttcggggtccagctgacggcttccggtgaagaatcaaagagtgaagagcccgctgggaagcgtgacagggatggcacccagagtctagccgcaaacgattcatcaaggaaaaactcctgggagcccaaaccaattaccgtccctcagttcaaacagatgctgtcagatctcttcaccgctcgaggctctcctttcaagactaagtcctcagagtctccctctagctccccatcgtcccccgctagaaaaaatggcggagaatgggacgtcgagaaagtggttatcgacctgggcggttcacgcgaggagcggagggaagctttcgctgccgcttgccacctcttactcgattgtgctaccttccctgtttatctttctgaagaggagacggaacagctgtgcgcgacactgttccagctcccaggcgctggagatagttcattcccaagctggctcaagtcactgatgactatttgctgttgcgtcactgactgttacctccaaaacgtcgccatcagtacacttttagaggtgatcaaccattcccagagtctcgcactggtaatagaggataagatgaagcggtataagtctagcggacacaaccccttctttgggaaattacaaatggtgacggtacccccaatcgccccaggtattctgaaagtgatcgctgaaaaaaccgacttctaccagcgggtggcaagggtgctctggaaccaattaaataaggaaacccgcgaacaccatgtgacctgtgtggagctgttttaccggctgcactgtttggcacctacggctaatatttgtgaggacatcatttgccacgcgctcttggatcctgacaaaggaacaaggctggaggccctctttcggttctccgttatttggcaccttactcgcgaaatacaaggttcaagggtaaccagccataatcgatccttcgatcgctccctgtttgtggtgctggattcgctggcgtgtaccgatggtgccataggcgctgccgctcagggctggctggttcgagccctgagtttgggggatgtggctcgcatcctggaaccagtgctcctgctccttctccagccgaagacccagcgcaccagcatccattgtttgaagcaagaaaacagtgcggacgatcttcatcgctggttcaatagaaaaaagaccagtttccgggaagcttgtgcagtgccagagcctcaggagtcgggcagcgaggaacatctacctttgtcacagttcaccacggtggatagagaggctatctgggcagaggtcgagaaggaacccgagaaatacccactgcggggagaacttagtgaagaagaactaccgtactatgttgaattgcccgatagaacagcccatggggctcccgactccagtgaacacaccgagtcagcagacacttcctcctgccataccgatagtgagaatacatccagtttctctagcccttcgcacgacctccaagagctatctaatgaggagaattgttgcgccccaatccctatgggaggaagagcgtatcccaaaaggtctgctctgttggcggcttttcaaagtgagtcctttaaggcaggggctaagctgagcttagttagagttgattcagacaagacgcaggcctccgaatcattttctagcgacgaagaagcggacctggagcttcaagccctcaccacatccaggctgctcaagcaacagcgcgagaggcaggaagcggtggaggccttattcaaacatatcttgctgtacttgcaaccatacgactctaggagggtcctgtatgcgttcagcgtgcttgaggccgtccttaaaactaatccaaaggagtttatcgaggcggtgagcagaacctccatggacacatcatcaaccgcccacctcaacctgataagcaatcttttggctagacaccaggaggcattgatcggccagagtttctatggcaaactccagacacaggtacctaatgtctgccctcacagtttgttgcttgagctgctgacctatctttgtctgtctttccttagaagttattacccttgctatttaaaagtttctcacagagacatcttggggaacagggatgtgcaggtaaaaagtgtggaggtgctaattaggatcatgatgcaattggtgtctgttgccaagtcaagcgaaggtaaaaatgtagagttcattcatagtcttctgcaacggtgtaaagtccaggaattcgtgctgttgtcgctgtcagcctcaatgtacacgtcacagaaaaggtatgggctcgctaccgcgcaccatgggagggctctacccgaggactctctatttgaggagagtctgataaatctcgggcaggaccagatctggagtgagcatcccctacagatcgaactgctgaaactgctgcaggtcctcatagtgcttgagcatcacctaggtagggcccacgaggaagctgagaatcagccggatttaagcagggaatggcagcgcgcactgaactttcagcaggcaatctccgcactgcagtacgtacaacctcatccactgacaagccaagggctccttgttagtgccgtggttcggggactccagccagcctacggatacggcatgcaccccgcatgggtcagcctcgttacacatagtctgccgtacttcgggaaatcgttgggatggacagtcactccttttgtggtccaaatctgcaagaacttggacgatctggtaaaacagtacgaatcagagagtgtcaagctctctgtcagcaccacctctaaaagagagaacattagcccagattatcccctgactcttcttgaaggcttgactactatttctcatttctgcctattggaacaggcaaatcagaacaagaagaccatggccgcaggggacccagcaaatctgcggaatgccagaaatgccatactggaagagctgccacgcacagtgaacacaatggcactgctatggaatgttctgcggaaagaggaaacgcagaagcggccagttgacctgctgggcgcaactaaaggatcatctagcgtttacttcaaaaccactaagaccattcgccaaaagattctggacttcctcaaccccctgactgcccacctgggtgtgcaactgaccgcagccgtcgcagcagtgtggagcagaaaaaaggctcagaggcacagcaagatgaaaatcatacctaccgcaagtgcctcccagctgacactggtagatctggtttgcgctctctctactctgcaaaccgatacgctcctacacctggttaaagaagtggtcaagcgccctccccaagtgaaggggggagatgaaaaatcacccctcgtggacatccccgtgctccaattctgctacgcgttcttgcaacgcctacccgttcccgctctgcaggagaacttcagctctcttctgggtgttcttaaggagtcagtccagctgaacctggcccctcctggttatttcctccttctcagcatgctcaatgacttcgtgaccagaacaccaaaccttgaaaataaaaaggaccagaaagacctgcaggagataacacagaaaatcttggaagctgtgggtaacatcgccggatcttcactggagcaaacaagttggctgagtagaaatctagaagtcaaagcccagcctcaggcctccctggaggaaagtgatgcagaagaagatttatatgacgcggctgcagcgtcagctatggttagttctagtgccccttctgtgtattccgtgcaggctctatcactgttggctgaggtgctcgccagcttgcttgatatggtgtaccgctctgacgagaaagagaaagcagttccccttattagtcgtctcctgtactacgtctttccttatcttagaaatcattctgcctacaacgctccgagctttagggctggcgctcaactactgagtagcctgtctggatatgcctacacaaagcgggcatggcgaaaagaggttctcgagctgttcttagatcccgcatttttccaaatggatacatcttgcgtgcattggaaatccatcatagaccatttgctcactcacgagaagacaatgttcaaagatctcatgaatatgcagtccagttctctgaagcttttttcttcattcgagcagaaggccatgcttcttaagaggcaggcttttgccgtattttcaggcgaattggaccagtatcacctgtatctgcccctgatccaggaaaggttgacggacaaccttagagttggacagacatcaatcgtagctgcccagatgttcctgttctttcgcgttttacttctcagaatctccccacagcacttaacaagcctgtggcccatcatggtgagcgagttgattcagacctttacccagctcgaagaagatcttaaagatgaggacgagtctcttcgctctaccaacaaggtgaaccggacaaaggtgtcagtgcccgacgcaaatggcccatccgtaggggagattcctcagtccgagttgatcctgtacctatctgcctgtaagtttctggacacagccttatcctttccccctgataagatgccactgttccaaatctaccggtgggctttcatccctgaggttgacacagaggggcctgcctttctgtcagacgtggaggagaaccaccaggaatgtaaaccccatacggtccgaatccttgagcttctgaagcttaaattcggagagatctccagtagcgacgaaatcactatgaagtccgaatttccactgctgcggcagcatagcgtgagtagcatcagacaactcatgccattcttcatgacattgaatggcgcttttaaaacccaacggcagcttccagcagattcgccaggaaccccatttctggattttccagtgaccgactctcccaggatcttgaagcagctagaggagtgtatcgagtacgactttctcgaacacccagagtgtta

SEQ ID NO: 221200 - DNA, 792 bp, Artificial Sequence
  Description of Artificial Sequence: Synthetic coding sequence
atgttttattttcactgtccccctcagctggagggaacagcaacatttggaaaccacagcagcggtgactttgacgacgggttcctgcgccgaaaacagcggaggaatcggacgacattcacacttcaacagctcgaggctttagaagccgtcttcgcacagactcactatcctgacgtgttcacaagagaggaattggccatgaaaattaacctaacagaagcaagggtgcaagtttggttccagaaccgtcgcgcaaagtggaggaaaactgagcgtggagcatcagaccaagagcctggcgctaaggagccaatggcagaagttactccccctcccgtgcgcaacataaattctcctccccctggcgaccaggctcggtcgaagaaggaggcgctggaagctcagcaaagtctaggccgtaccgtggggccagccggtcctttctttccttcctgtttaccaggtactcttctcaacaccgccacctacgctcaggcactgagtcacgtcgcctcattaaaagggggacccttatgcagctgctgtgttccagatccgatgggactgtccttcctgccgacgtatggatgccagagtaatcgtaccgcttcggttgccacgctcagaatgaaggcccgtgagcattccgaggccgtgttacaaagcgccaatttattgccatcaacctcttcgagtcctggccctgttgcgaagcctgccccaccagacggtagtcaggaaaaaacgtcccccaccaaagagcagagcgaggccgaaaagtcagtgtag

SEQ ID NO: 221201 - DNA, 807 bp, Artificial Sequence
  Description of Artificial Sequence: Synthetic coding sequence
atggtcctgatgagctgcgaccagcgactcatcagtctccttctggtcgggaccgctacatttgggaatcactccagtggcgatttcgacgacggattcctcagacggaaacagcggaggaacaggaccacgttcacattacagcagcttgaggctctggaggccgtgtttgcccagacacactaccccgatgtctttacacgagaggaactcgcaatgaagatcaacctaactgaagcaagggtgcaggtttggttccagaatagacgtgctaagtggagaaagacagagcgcggtgcttctgaccaagagccgggtgccaaggaaccaatggctgaggtaacacctcccccagttcggaatatcaattcaccccctccaggagatcaggcgaggtctaagaaggaggcactggaggcccagcagagtctcggacgcactgtaggacctgcgggtccattcttccctagttgcctcccgggtacactgctgaacacggcaacctatgctcaggcactctcccacgtggctagcctcaagggtgggccactgtgctcatgttgtgttcccgaccccatgggcctgtcctttctcccgacctacggctgtcagagcaaccggaccgcctccgtggcaactttacgtatgaaagctagggagcacagtgaagctgttcttcagtctgcgaatttgctaccctccactagctcatcgccgggacctgtggctaagcccgctccgccagatggcagccaagagaagacctctcccacgaaagaacagtccgaagctgaaaagagcgtctag

SEQ ID NO: 221202 - DNA, 384 bp, Artificial Sequence
  Description of Artificial Sequence: Synthetic coding sequence
atgaagcttaatgtggatgggcttctagtgtactttccttacgattacatttatcctgagcagttcagctacatgcgcgagttgaagcgaactctggatgctaaaggccatggggtgcttgaaatgcctagcgggacaggaaaaaccgtctcacttttagccctgataatggcctatcagcgcgcataccctctcgaagtgacgaaactcatttattgttccagaactgtgcctgagattgagaaagtgatagaggaactacgcaagctactgaacttctatgaaaagcaggaaggtgagaagctgcccttcctgggcctggcgctcagctctcgaaagaatctctgcatccatcctgaaacaaccagcgcaagcacaccatag

SEQ ID NO: 221203 - DNA, 4614 bp, Artificial Sequence
  Description of Artificial Sequence: Synthetic coding sequence
atgggagagaagctggagcttaggcttaaatcgccggtcggcgcagaacctgccgtgtacccatggcccctgcccgtatatgataaacaccacgacgcagcacatgagattattgagaccatcaggtgggtttgtgaagagatcccagacctcaagcttgctatggagaattatgtcttaattgattacgataccaagagcttcgagagcatgcagaggctctgtgacaagtacaatagagcaattgattccatccatcagctgtggaaaggtaccacgcagccaatgaaactaaatactaggccaagtacagggctactcaggcacattttgcaacaagtttataatcactcagttactgatcctgagaaattgaacaactatgaacccttttctccagaagtatatggtgaaacttctttcgatttggttgcccagatgattgacgagatcaagatgacagatgatgatttgttcgttgacctcgggtccggcgtcgggcaggtcgtcctacaggtcgccgctgctacaaactgcaagcatcactacggcgttgaaaaagccgatatccctgccaaatacgccgaaactatggatcgggaatttaggaagtggatgaagtggtatggcaagaagcacgctgaatacacgctggagcgtggggatttcctcagcgaagagtggagagagcgtatcgcaaatacaagtgtcatttttgtcaataactttgcttttggcccagaggtggatcatcagctcaaggaacgctttgctaatatgaaggaaggtggccgaatcgtatcctctaagccatttgccccattgaacttcaggattaattctcgaaatctgagcgacattggtacaataatgagggttgtggaactttccccacttaaaggctctgtgtcttggactggtaaaccagtgtcttattaccttcacactatcgacaggacgattttagagaactacttttcgagtctgaagaaccccaagctgagagaagagcaggaggctgccagaagaagacaacagagggagtcaaagtcaaacgccgctacacctactaaagggcctgaggggaaagtagccggacctgcagatgctcccatggattcaggcgctgaagaagagaaggctggtgccgcaactgtaaaaaagccgagcccaagcaaggctcggaagaaaaaactcaacaagaaaggccgaaaaatggcaggtaggaagagggggaggccaaaaaaaatgaacacagctaatccggaaaggaagccaaagaaaaatcagactgccctagacgcccttcatgcccaaacggtttcccagactgccgcttcttccccccaggacgcctatagaagcccacatagccctttttatcagctgcccccatctgtgcagcggcatagccccaatccactccttgtcgctccaaccccacctgctctgcaaaagctgctcgagtcatttaagatacagtaccttcagttcctggcctatactaagacacctcagtacaaagcgtctttacaagaactgctaggacaagaaaaagaaaagaacgctcagctcctgggggctgcccagcagctgctgagtcactgtcaggcgcagaaagaggagatacggaggctgttccagcagaaacttgacgaactaggagtgaaagcactcacatacaacgatctaatccaagcccagaaggaaattagtgcccataatcagcaactgagggaacagtccgagcaactggagcaggacaacagggccctacgaggccaatctctgcaattattgaaggccaggtgcgaagagttgcagctggattgggcaaccctctctctcgaaaagttattgaaggagaaacaggctttaaagtcgcagatttccgaaaaacagcgccactgtcttgaactgcagatttcaattgtggagctggaaaaatcccagagacagcaggagctattacagcttaagtcttgcgtgcctccggatgatgcactgagcctccacttgagaggaaagggcgctcttggcagagagttagagcctgatgcatctcggctgcacctggagctggattgtaccaaattttctctaccccatttgtctagcatgtctcctgagttgagcatgaacggacaggcagccggatatgagctttgtggggttctgtctcgcccttcttcgaaacagaacactccgcagtatttggcttcccccctagaccaagaggtggtcccctgcacaccgtctcatgtcgggaggccacggttagaaaagctgtccggactggccgctcctgactacacccgactgagccctgcgaaaatcgtgcttagacgccaccttagccaggaccataccgtgcctggccgacctgcggcttctgaactgcacagccgcgctgaacacactaaggagaacggacttccataccagtccccttcggtgcctggtagcatgaagctgtccccacaggacccaagaccactgagtcctggggctctgcaacttgctggagaaaagagcagcgaaaaaggactgcgggaacgggcatacggaagcagcggcgagctcattacaagcctcccaatcagcatcccgctttcaacagtgcagcctaataagcttccagtgtccatccccctggcatccgtggtgctcccctccagagcggagagggccaggagcacgccttctccagtactgcaaccacgggacccttcatcgaccttggagaaacagataggcgctaacgcccacggggcagggagccgttctcttgctctggctccagccggtttctcgtacgctggcagcgtggcaatttccggtgccctagccggatcgccagcctccctgacacccggagctgagcctgctacactggacgagagctcctcatccggaagtctctttgccactgtcggcagtcgatcttctaccccacaacatccactgctcctggcccaaccaagaaattcactgccggcatctcctgcacatcagctgtctagtagcccccgtctagggggagccgctcagggtccactcccagaagctagcaagggagacttaccatccgactccggcttctctgatccggaatcagaagcaaagaggcggattgtgtttacaataaccactggcgctggaagtgccaagcagagccccagttccaaacactctcctctgaccgctagcgctcgcggagattgtgtgccaagccatgggcaagattctagaaggaggggcaggcgtaaaagggcaagtgccggaaccccatccctttcagccggagtctccccaaagagacgggctctacctagcgtagctggactctttacacagccttcagggagccccctgaacttaaatagcatggtctcaaacataaaccaaccactcgagattacagcaatctcctcccccgaaacttctttgaagtcttccccggtaccctatcaggatcacgaccagccaccagtgttgaagaaggagagaccattgagccagacaaacggcgcacattatagccccctgacttccgacgaggaaccaggaagtgaggacgaaccctcctctgctcggatcgaacggaaaatagccacgatctctctggagagcaagagcccacctaagaccttggagaatggcggagggcttgccggacgcaaacctgccccagccggtgaacctgtgaactcatctaaatggaaatctacgttcagccctataagcgatattgggctcgccaagagcgccgattcccccctgcaggcctcttccgccttgtctcagaactctttgtttacctttcgaccagcacttgaggaaccctctgctgacgccaaactggccgcacacccacggaagggcttccctgggtcacttagcggagcggatggtctgagcccgggtacaaacccagcaaatgggtgtacctttggcggtggactggcagctgacctgtcgctgcattcattcagcgacggcgcttcactgccccataaaggacctgaggccgctgggctctcttcgcctctgtcctttccgagccagagggggaaagagggctccgatgctaatccttttctttccaaaaggcagctggacgggctcgctggcctcaagggggaggggtctcgcggaaaggaagccggtgagggcggtcttcctctgtgcgggccaaccgacaagacaccactcctgagcggaaaggcagccaaggccagggatagagaagtggacctgaagaacgggcataacctcttcattagcgcagccgctgttccccctggatctctgctctctgggcctgggctggctccagctgcgtcgtctgcaggcggagccgcatctagcgcacagacacacaggtcctttctggggccttttccaccaggtccacagttcgcactgggtcctatgagcttgcaagctaacctgggctccgtggccggatctagcgtcttacaatcgttgtttagcagcgtgcccgctgcagctggcctggttcatgtgagctcagctgcaacccgcttaactaattcccacgcgatgggctccttctcaggggtggccggtgggacggttggaggaaattag

SEQ ID NO: 221204 - DNA, 1203 bp, Artificial Sequence
  Description of Artificial Sequence: Synthetic coding sequence
atgcgcggacgcaggggtgaccgaatgactataaacattcaggaacatatggccattaacgtatgccctggaccaattcgccctatcaggcagatttcagactacttccccagaggacccggtcctgaaggtgggggtggaggaggcggagaagctcccgctcaccttgttccgctagctctggctccccctgctgcgctgctgggagccactaccccagaagatggggctgaggtggacagctatgatagtgatgacgcaacagctctgggcaccctggaattcgatctgctctatgacagggcgtcttgcacgctgcactgcagcattctgcgcgctaagggcttgaagccaatggactttaacggcctggcagacccgtacgtcaagctgcacctactgcccggagcttgcaaggcgaacaagctcaagactaaaacgcaacgcaataccctgaaccccgtgtggaatgaagatctgacttacagcgggatcaccgacgatgatattacgcacaaggtgttacggattgcagtgtgcgatgaagacaaactcagccacaacgaatttatcggagagattcgcgtccctctccggcgattaaaaccgtcccagaagaagcatttcaacatctgtttggaaagacaagtccccctcgctagtccatcttcaatgtccgctgcacttagaggcatcagctgttatttaaaagaacttgaacaagccgagcagggccagggtctgctggaagagagaggacgcatactcctctctctcagctatagctctcgcagacggggactcctcgtcggtatcctgcgatgcgctcacctggcggctatggacgttaatgggtacagcgatccctacgtgaaaacctatctgagaccggacgtcgacaaaaagtctaaacacaagacgtgtgtaaagaaaaagactctgaacccggaattcaatgaggaattcttctacgaaatagagctctcaactttagccactaagaccctggaggttacagtctgggattacgatattggaaagtccaatgattttattggaggagtttctcttggtcctggggcacgaggtgaggccaggaagcattggagcgattgtctccaacagccagacgcagccctcgaacgttggcacaccttgactagcgaacttccaccggctgccggtgcactgagctcagcctag

SEQ ID NO: 221205 - DNA, 927 bp, Artificial Sequence
  Description of Artificial Sequence: Synthetic coding sequence
atgaccctcagacggagaggggagaaagccactattagtatacaggaacacatggccattgatgtctgcccagggcctatacggccaatcaagcagatctctgactacttccccagatttccgagaggcttgcccccagatgccggtcctcgggctgccgcaccaccggatgccccagctcggcctgcggtggccggagccggaagacggtccccaagtgatggggcacgcgaagacgatgaggatgtggatcagttgttcggcgcttacgggagctcccccggaccttcacccggtccaagcccggctcgcccacctgccaaacctccagaagatgagcccgacgcagacggttacgaatccgacgactgtaccgccctcggcaccctcgatttctcactgctgtacgaccaagagaataacgcgcttcactgtacaatcacgaaagctaagggcttgaaaccaatggatcacaatgggctagctgacccgtatgtgaagttgcacctgctgccaggggctagtaaagcaaacaagttacgcacaaagactctgaggaatacactgaatcccacttggaacgagacgctaacctattacggaatcactgatgaagacatgattcgcaaaaccctcaggatatcagtttgcgacgaggataaattcagacataacgagttcattggcgaaacccgggtgcccctaaaaaaactgaagcctaaccatactaagactttctcaatttgtctggagaagcagttgcccgtcgacaaaacagaggataagagtctggaggagcgtggaaggatactgatttctctgaaatacagtagtcaaaagcagggcctgttagtcggcattgtccgctgtgcacacctggctgccatggatgccaacggttatagcgacccctatgtcaaaacgtag

SEQ ID NO: 221206 - DNA, 927 bp, Artificial Sequence
  Description of Artificial Sequence: Synthetic coding sequence
atgacccttcgacgcagaggtgagaaggcaacaatctccatccaggaacacatggccatcgatgtatgcccgggtcctatcagaccgattaagcaaataagtgattatttcccccgatttccgaggggcctgccaccagatgccggaccaagagcagccgcacctccagacgcaccagcacggcctgccgtggccggagcaggacgcaggagcccatcggatggggctagagaagatgacgaagacgtcgaccagttgttcggggcttacggctcatcccccggacccagtccaggccctagtccagcccgtccaccagcaaaaccgccagaagatgagccagacgccgacggctatgagtctgatgattgcacagctcttggcacgctggatttctccctgttatatgatcaggagaataacgccctccactgcactatcacaaaggccaagggcctaaaacccatggaccataacggcctcgcagatccctacgtcaagctgcacctgttacctggcgcatcgaaggccaataaattgaggaccaaaactctgcgtaacacattgaacccaacttggaatgaaaccctcacatactacggaatcacggatgaggacatgatcaggaagaccttacgcatatccgtctgtgatgaagacaaattccggcacaacgagttcattggagagaccagggtcccattaaaaaaactcaagccgaaccatacgaagacattttcaatttgtcttgagaagcaactcccggtagataaaacagaggataagagcctcgaggaaagaggcagaatactgataagcctgaaatatagctctcaaaagcaggggctgctggtcggtattgtccgttgcgcacatttggcagccatggacgcaaacggctactccgatccctacgtcaaaacgtag

SEQ ID NO: 221207 - DNA, 1275 bp, Artificial Sequence
  Description of Artificial Sequence: Synthetic coding sequence
atggcactgccaacacctagtgattcgactctccccgctgaggctaggggacgtggtcggagacgtagactcgtctggaccccaagccagagcgaagcgttacgcgcttgcttcgaaaggaatccgtaccctggcattgctacgagagagcgcctcgcccaggcaatcgggattcctgagccaagagtccagatttggtttcaaaacgaaagaagccggcagctaaggcagcaccggagggagtcgcgaccttggccgggtcggaggggcccacctgagggcagaaggaagagaaccgccgtgaccggctcccagactgcacttctgctccgagcttttgaaaaggataggttcccaggaatcgctgctcgcgaagagctggctcgtgagactggtctccccgaaagccgcatccagatctggtttcaaaataggcgggctaggcaccccggacagggaggtcgcgctcctgcacaagctgggggactctgctctgccgctcccggtgggggacacccggctccaagttgggtcgcgttcgcccataccggcgcatggggcactggcctccctgcccctcacgtgccttgtgctcccggagcacttccccagggagcctttgtgagtcaggcggcacgcgctgccccagcgttgcagccttcacaggccgcacctgccgagggggtttcacagcctgctccagccagaggagactttgcctatgcagctcccgctccacccgacggagccctttctcatccccaagcacctcgctggcctccacaccccggtaaatcccgggaagatagggaccctcagcgggatggactgccgggaccatgcgcagtggctcagcctggaccagcccaggccggaccccagggccagggtgtgctggcgccacccacttctcaaggatctccgtggtggggctggggtcggggaccccaggtggcaggggcagcctgggagcctcaagccggagccgcaccacctccgcagccggctccacccgatgcaagcgcctctgctaggcaagggcagatgcaagggatcccagcgcctagccaggctctccaggagcctgcaccgtggagcgccctcccctgtggactcctcttggacgagctcctcgctagtcccgagtttctgcagcaggcgcagcctctgttggaaaccgaggccccaggagagctggaagcctctgaggaagccgctagtctcgaggctcccctgagcgaggaagaatatagagcccttctggaggaattatag

SEQ ID NO: 221208 - DNA, 1458 bp, Artificial Sequence
  Description of Artificial Sequence: Synthetic coding sequence
atgaaaggctggtcactgccagcttgcgggcctttgcagggcagactggctggttggctggccgtccgcgcagggctgctcgccgcaccggcagctgtgcacagtccggctgaggtgcatggttcaccccctgcttctttgtgtccaagacccagtgttaagttcagacccggtctgactgctatggccttgcccacgccaagcgatagtacactcccagccgaagccaggggtagggggaggcgcaggagattagtgtggacacccagccagtccgaagcccttcgcgcttgctttgagcggaatccatatcccggaatcgcgacccgggaaagactcgcccaggccataggaatccccgagcctcgagtgcagatttggttccaaaatgagaggtcacggcagctgcgccagcaccgcagggaatctcgcccttggccaggaaggcgcggtcctcctgaaggacgtcgcaaacgcacggctgtgaccggatctcagacagcgctcctgctcagagcctttgagaaagacaggtttcctggaattgccgcaagggaggagctcgccagagagaccggcctgccggagagcaggatccagatctggtttcagaataggagggctagacaccctggccaaggcggacgggcaccagcccaggctggcggactttgttccgcagcgccaggcggtggtcatcctgccccttcgtgggttgcattcgcccacaccggggcttgggggacaggcctgcccgctcctcacgtgccatgcgcccctggggctctcccacagggggctttcgtcagccaggctgccagagctgcccctgctcttcagccatctcaagccgcaccggctgaaggcgtcagccagcccgcacccgctcgcggagactttgcatacgccgcacccgctcctccagacggcgcactaagtcacccacaggctccgaggtggcctcctcatcctggtaaatctagagaggacagagatccccagcgagatggactcccagggccttgcgccgttgcacagcctggtccagcccaggccggtccccagggccagggcgtcctggcaccgccaactagccaaggcagcccttggtggggatggggacggggaccgcaggtggccggtgccgcatgggaaccacaggcgggtgctgcaccacctcctcagccggcacccccagacgccagcgcatctgccaggcagggacaaatgcagggtatccccgctccctcccaagctcttcaggagcccgcaccatggagtgctctgccatgtggtctccttctcgacgagctcctggcatcacccgaattcctgcagcaggcccaaccactgctggagaccgaagctcccggagagctcgaagcgtcggaagaggccgcaagcctcgaggctcctcttagcgaggaggaataccgagctctcctggaggaactgtag

SEQ ID NO: 221209 - DNA, 1326 bp, Artificial Sequence
  Description of Artificial Sequence: Synthetic coding sequence
atgaagacccttcctctgcatagccattgcacagaaatgcagcgtctgcttccaaagctcgagatgttaactcttggctcttcgttttgctccctgcaaggtgaattctgccaggctatggattcctttaccaccgtgtcacacgttggtatgtgcgaagagacagacgcatcatttaatgtgttttcccccaagttccaattcgaccggtcccactgtcagtccctccgcttccaccaaaatatggagctggactttggacatttcgacgagcgggacaaaacttcaagaaacatgagagggtcacgtatgaacgggctgccatcacctactcacagcgctcactgcagtttttaccgcacgcgcacattgcaggccctatccaatgaaaagaaagcgaaaaaggtgaggttctataggaatggagatcggtactttaaaggcatcgtctatgccgttagcagcgatcgatttagatcctttgatgcgcttctggctgatttgacacggagcctttcagataacatcaacctgccccagggtgttaggtatatttacacaatcgacggctccaggaagattgggagtatggacgaactggaggagggcgaatcctacgtctgctctagcgacaacttcttcaagaaggtagagtacacaaagaacgttaatccaaactggtccgtgaacgtcaagacttccgcaaatatgaaggcaccccaaagtctcgcaagtagcaatagcgcacaagctcgagaaaataaagattttgtaagacccaagttggtcacaattattcgaagtggggtgaaacctaggaaggcggtgcgcgttctcttgaataaaaagacagcccactcttttgaacaggtattaactgacattaccgaggcaatcaaactggaaacaggcgtggtcaaaaaactgtacactctcgacggaaaacaagtgacttgtctgcacgatttttttggcgatgatgatgtgtttattgcctgtggccctgagaagttccgttacgctcaggatgatttctcactagacgagaatgagtgccgcgtaatgaagggcaatcccagcgcaacagccggtcctaaagccagcccgactccgcagaagaccagcgcaaaatctccaggacctatgaggcgctctaagtctccggctgacagtgccaacggaacctcatcctcgcaactctcgacacccaagtccaaacagtctcctatatccacgcctacctccccgggaagcttgcgaaagcataaagatctgtatctccctctcagtcttgatgattctgacagtcttggtgattccatgtag

SEQ ID NO: 221210 - DNA, 1098 bp, Artificial Sequence
  Description of Artificial Sequence: Synthetic coding sequence
atggaacttgactttgggcactttgatgagcgggacaaaacgagcaggaatatgcggggaagcaggatgaatgggttgccctctcctacccatagtgcgcactgttcgttctatcgtaccagaaccctccaagcactcagtaacgagaaaaaagccaagaaggttagattttatcgaaacggtgatcgctatttcaaggggatagtatacgcagtatcatctgatagatttaggtcattcgatgcactcctggcagacctgaccagatcactgtccgataatatcaatttaccacagggagtccgctatatatacaccattgatggcagtagaaaaatcggatctatggatgaacttgaggagggggaatcttacgtgtgttcctcggataacttttttaaaaaagttgagtatacgaagaatgtcaatccaaactggagcgtaaatgtcaagacgtccgcaaacatgaaggcgccacaatctctcgcaagttctaattctgcgcaggctcgcgaaaataaggatttcgtgcgacccaagcttgtgactattatcagatctggagtgaagcctagaaaagctgttcgggtgctgctgaacaagaagacggcgcactccttcgagcaggtgctgaccgacataaccgaggcaattaagctcgagacgggggtcgttaaaaaactatatacgcttgacggcaaacaggtcacctgtcttcatgacttcttcggagacgacgatgtgtttattgcttgcggccctgagaagtttcggtatgcgcaggatgacttctcactggatgagaatgagtgtcgagtgatgaagggtaatccttctgctaccgccggtcctaaggcctcgcccacaccccaaaaaacatcggccaaaagccctggtccaatgaggaggagcaagtcccctgcggacagtgggaacgatcaggacgcgaatggcacttccagcagtcagctgagcacacctaaaagcaaacagtcccccatctccacccccacatcccccggttctctgcgcaaacataaggacttatacctgcctctctctctggatgattcagactctttgggcgatagcatgtag

SEQ ID NO: 221211 - DNA, 1098 bp, Artificial Sequence
  Description of Artificial Sequence: Synthetic coding sequence
atggagttggactttggccactttgacgagcgagataaaacgagtcgaaatatgaggggctctcgaatgaacggcttaccctccccaactcacagtgctcactgctctttctatagaaccaggaccctgcaggctttgagcaacgaaaagaaagcaaagaaggttcgtttctaccgcaacggcgaccgctattttaaggggatcgtgtatgcagtctctagcgatagattccgctctttcgacgctctgttagctgatctgactcgcagtcttagtgacaatattaacctgccccagggtgtgcgctacatctatacaattgatggcagccggaagatcggttcaatggacgagttagaagaaggggaatcctatgtctgttcctctgacaatttttttaaaaaagtggagtacaccaagaatgtgaacccaaactggtctgtgaacgtgaaaacgtcggccaatatgaaagcccctcagtctcttgccagctctaatagtgcccaggccagggaaaataaggactttgttcggcctaagctggtgaccatcatccggtctggcgtgaagcctcggaaggcagtccgtgtcctcctcaataagaaaacggcacatagtttcgagcaggtgctcactgatatcacagaagccatcaaacttgaaaccggcgtagtcaagaagctgtataccctagacgggaagcaagtgacctgcctacacgactttttcggagatgatgacgtcttcatcgcctgtggaccggagaagtttcggtatgctcaggatgatttctccctcgacgagaatgagtgtagagtgatgaagggaaacccgtcagccacggctggtcctaaggcgagtccgaccccacagaaaactagcgccaagagccccggtccaatgagacgcagcaaaagccctgcagactcaggcaatgaccaggacgctaatggcacttcatcgagtcaacttagcacacccaagagcaagcagtcaccgataagtaccccgaccagccctggctcactgcgcaaacacaaagacctgtatctaccccttagcctggatgattccgactcattgggggactccatgtag

SEQ ID NO: 221212 - DNA, 1317 bp, Artificial Sequence
  Description of Artificial Sequence: Synthetic coding sequence
tgatgtactgaaatgcagaggctgcttccaaagctggaaatgctgacgcttgggagcagcttttgttctcttcagggagagttctgccaagccatggattcctttaccactgtctcccacgtggggatgtgcgaagaaactgacgccagcttcaacgtctttagtcctaagttccaattcgacagaagccactgccaaagcctccgcttccatcagaacatggagctcgactttgggcactttgatgaacgtgataagaccagccgcaacatgaggggcagcaggatgaacggtctgccaagccctacacacagtgcacattgcagtttctatcgtactcggaccctccaggccctctctaacgagaagaaggcaaagaaggtgaggttttatcggaacggcgatcgatactttaagggcattgtctacgccgtgtctagcgaccggttccggtccttcgacgcactgctcgccgacctgactcgaagtctgtctgataatataaatctcccgcaaggcgtgcgctacatttatacaatcgacgggagcagaaagattggcagtatggacgagctcgaggagggcgagtcctacgtctgtagcagcgataacttctttaagaaagtcgaatacaccaagaatgtcaaccccaactggtcagtgaatgtcaagacgagtgctaacatgaaggctccccagagcttagcttcaagcaactctgcccaggccagggaaaataaggacttcgtaagacctaagctggtgacaattattagatccggggtaaagccccgtaaagccgtgagggtgcttctgaacaagaaaacagctcacagtttcgagcaagttctgactgatatcacagaggctatcaagctggagacaggggtggtcaaaaaactctatactctagacggtaagcaggttacatgcctgcacgacttcttcggggatgacgacgtgttcatcgcgtgtgggccagagaaattccggtatgcgcaggacgacttctcgctcgatgagaatgagtgtagagtcatgaaaggcaacccttctgcaaccgctggccctaaggctagcccaacccctcaaaagacgtctgctaaatctccaggcccaatgcgacggtcgaagagccctgctgatagcgggaatgatcaggacgctaacgggacgagcagctcccagctcagtacacccaaatctaaacagtctccaataagcaccccaacatctcccggatcactgcgaaagcataaggatttgtatttaccactctcattagatgactccgactcactgggcgactccatgtag

SEQ ID NO: 221213 - DNA, 1083 bp, Artificial Sequence
  Description of Artificial Sequence: Synthetic coding sequence
atggagttggactttggacattttgacgaacgagataaaacgagtagaaatatgagagggtctcgaatgaatggcttgccttctccgacccactccgcacactgttctttctaccgtacaagaaccctccaggcgctgagtaatgaaaagaaagctaagaaggtgaggttctacagaaacggcgaccgttacttcaaaggtatcgtttatgccgtgtcatccgatcgctttcggtccttcgatgcactgctggccgatttgacccgatcactatctgataatattaaccttcctcaaggcgtgagatatatctatactatcgacggctcaaggaagatcggctccatggatgaactggaggaaggggagagttacgtctgctcaagtgacaacttctttaagaaagtggagtataccaagaacgtgaaccctaattggagcgtgaatgtgaagacttccgccaatatgaaggcaccccaatcgcttgcctcatctaattccgctcaagcacgtgaaaacaaagacttcgtccggcctaaactggtaacaatcattcggtctggcgtgaaaccgcgtaaggctgtaagagtactattgaacaagaagacagcacattcctttgagcaggtgcttaccgatatcacggaggccataaaactggagaccggtgtcgtgaaaaaactttacacgctggatgggaagcaggtgacttgcttacacgactttttcggggacgacgatgtatttatagcctgcgggccagagaagtttaggtacgcgcaagacgatttctctctggatgaaaatgaatgccgggtgatgaaaggaaatccctccgccacagccggaccaaaagcatctcccacgccccagaagacatcagccaaatctcctggcccaatgaggcgctctaagagtccggcagacagcgctaatggcacttcaagttcacagctgtctacgcccaaaagcaaacagtctccaatcagcacccctacttcccctggctctctgcggaagcataaggacctttatctccctctctccctcgatgactccgatagccttggcgacagcatgtag

SEQ ID NO: 221214 - DNA, 342 bp, Artificial Sequence
  Description of Artificial Sequence: Synthetic coding sequence
atggagctggactttggccactttgatgagcgtgacaagacaagtagaaacatgcggggatccaggatgaatggtttgccctcccctacccactcagcgcattgttccttttaccgcacaagaactctgcaggctcttagcaatgaaaagaaagccaagaaagtacggttctatcgaaacggcgaccgatactttaagggtattgtttacgctgtgtcttccgacagatttcggtcgtttgacgccttgctcgccgatttgacaagaagcctgtccgacaatattaacctcccgcagggcgtgaggtacatctacactatcgacggttctcggaagatttag

SEQ ID NO: 221215 - DNA, 1083 bp, Artificial Sequence
  Description of Artificial Sequence: Synthetic coding sequence
atggaactggatttcgggcactttgatgaacgggacaagacctcccggaatatgcgcggttctcgcatgaatgggcttccttcccctactcactctgcccactgtagcttctatcggacacggactctccaggcccttagcaacgagaagaaagccaaaaaagtcagattctaccgaaacggagataggtatttcaaaggcatcgtgtacgctgtgtctagtgaccgcttcaggtctttcgatgccttattggctgaccttactagatcactctccgacaatataaatctcccgcaaggggtgcgctatatttacacgatagacgggtcccgcaaaatcgggagtatggatgaactggaggaaggagaatcctacgtatgctcatcggataattttttcaagaaagtcgagtatactaaaaacgttaatccgaactggagtgtaaatgtgaaaacttctgccaacatgaaggccccacaatccttggcgtccagcaactctgcgcaggctcgcgaaaacaaagacttcgtcaggcccaagttggtgaccatcatcagaagcggcgtgaaaccacggaaagctgtgcgcgttctgctcaacaaaaaaacagcccattcctttgagcaggtgctaaccgatataactgaagccatcaaactggagacaggggtggttaaaaagctgtatactctcgatggcaagcaggtcacatgcctgcatgacttcttcggcgacgatgacgtgttcattgcttgtggccctgaaaaattccggtatgcccaggatgattttagcttggatgaaaatgaatgcagagtgatgaaaggcaacccttccgccacggccggacccaaagcttccccgacaccgcagaagaccagcgctaaatcgcctggaccgatgcggaggtccaagagtcccgctgactctgcgaatggtaccagctcctcacaactgtccactccaaaatcaaagcagagtcccatttctacaccaacttctccaggttcactacgtaagcacaaagacctttacctccctctttcccttgatgattcagactcactgggcgattccatgtag

SEQ ID NO: 221216 - DNA, 1065 bp, Artificial Sequence
  Description of Artificial Sequence: Synthetic coding sequence
atggctaaaactggcgcagaggatcaccgcgaagccctgtcacagtctagtctctccttgctgacagaggccatggaggtgctccaacagtcttcaccagagggaacactcgatggcaatacggtcaacccaatatacaagtacattttgaacgatctccctagagagttcatgtctagtcaggctaaggccgtgatcaagactactgatgattatttacagtctcagttcggccctaacagactcgtacactccgctgcggtgagcgagggcagcggtctccaggattgcagcacccatcaaacggcatcagaccattcccatgacgagatttccgatttggactcgtataagtccaatagcaaaaacaattcctgttccattagcgccagcaagagaaatcggcctgtctcagcacctgtcggccagctcagggtggccgagttctcatctctgaaattccaaagcgcaaggaattggcagaaactgtcccagcggcataaactgcaaccaagggtgatcaaggttacagcctataaaaatgggagcagaacagtgttcgccagagtcacagtgccaaccattaccttattgctcgaagaatgcacagagaagctgaatctcaacatggcggcaagacgtgtgtttctggcagacggcaaggaagctctcgagcctgaagatatccctcatgaggcggatgtatacgtgagtaccggggagccgttcctgaacccctttaagaaaatcaaagaccaccttctgcttataaaaaaggtaacttggacgatgaacggtcttatgctgcctactgatatcaagcgtagaaaaactaagcctgtgctgtcgataagaatgaaaaaactgaccgagcggacttccgtcagaatccttttctttaagaatggtatggggcaggatggacacgagatcactgtgggcaaagaaacaatgaagaaagtgttggatacatgcacgatccggatgaacctaaacctgcctgctaggtatttttatgacctgtatggacggaaaattgaggatataagcaaaggcaagcattag

SEQ ID NO: 221217 - DNA, 690 bp, Artificial Sequence
  Description of Artificial Sequence: Synthetic coding sequence
atgaaaatgtggaacaattgggggtggtgcgggggtcggcgtcgcggatgtactaagattctgagcaccaaaaaaggcatacagatgagcattaagaacaagcacctgatcgtaattcctgctttcagccatacgatgtcccagctagatttcgattttcactgtgtgtttgtgagcattgacgaagggatttttaaggccggagctgaacggtcagaaacccgaggcgcagccgaagtccaggaggacgaagacacacaggttgaggtaccagtcgatcaacggccagccgagattgtcgatgaagaggaggatggcgagaaggcaaataaagacgccgagcagaaggaggacttctcaggaatgaatggcgacttggaggaggagggcggacgtgaagcaaccgatgcacccgagcaggtagaagaaatcctcgaccactccgaacagcaggccaggcctgctagggtgaacggcggtacggatgaggaaaacggcgaggaactgcaacaggttaataacgagctgcagctagtgttagacaaagagagaaagagtcagggtgcgggatcagggcaggacgaagctgatgtggacccacagaggcctccacgccctgaggtgaagatcaccagccccgaggaaaacgaaaataatcaacaaaataaggactacgctgccgtggcctag

SEQ ID NO: 221218 - DNA, 1431 bp, Artificial Sequence
  Description of Artificial Sequence: Synthetic coding sequence
atgagcggcagtagcgccagatcttctcacctcagtcagcccgtggtaaaaagtgtgctggtttacagaaacggtgacccattctatgcagggaggcgtgtggtcattcatgaaaagaaggtgtcaagtttcgaggtgttcctgaaggaagtgacaggcggtgtgcaggctcctttcggggcagtaaggaacatctataccccccgaacagggcacaggattcggaagcttgatcagatccaaagcggtgggaactacgttgctggcggtcaagaggcttttaagaagctaaattaccttgacatcggcgaaatcaagaaacgccctatggaggttgtgaacactgaagtgaaacccgttattcacagcaggattaatgtgtccgccagatttagaaagcccctgcaggagccttgcactattttcctgattgccaacggcgatctgattaatcctgcctctcggctgctgattcccagaaaaactctgaatcaatgggaccacgttctccagatggtaactgaaaaaattactttgcgttctggcgctgtacataggttatatacattagaggggaaactcgtggagtctggtgcggaacttgaaaatggccagttttacgtcgcagtagggagggataaatttaaaaaactcccctatagtgaactgctctttgacaaatctaccatgaggcggcctttcggccagaaggcaagctcactgccaccgattgttggtagtcgaaaaagtaaggggagcggaaatgaccgacatagtaagagcacagtcggatcaagcgacaactcaagccctcagcccttgaagcggaaaggaaagaaggaagatgtgaattctgagaagttaacaaagttgaaacagaatgtgaagttaaaaaatagtcaggagactattccgaattccgatgagggaatttttaaagctggtgctgaacgatccgaaacaagaggcgctgcggaagtgcaggaagatgaagatacccaggttgaagttcccgtcgaccagaggccagccgagatagtggatgaagaggaggacggcgaaaaagcaaacaaagatgcggaacagaaagaagacttctctggaatgaacggcgatctggaggaggaaggtggtcgggaggctactgacgctccagagcaggtagaggagatcctggatcacagtgagcagcaggctcggccagctcgcgtcaatggcggaactgacgaggagaatggcgaggaactccagcaggttaacaacgaacttcagttggtcctggataaagagcgaaagagccagggggcagggtcaggacaggatgaagctgatgttgatcctcagcgtccgcctaggcctgaggtgaagattaccagccctgaggagaacgaaaacaatcagcagaacaaggactacgcagccgtcgcttag

SEQ ID NO: 221219 - DNA, 267 bp, Artificial Sequence
  Description of Artificial Sequence: Synthetic coding sequence
tgagtggtcatacatgagaagaaggtgtcgtccttcgaagtcttcctgaaagaagtgactgggggagtacaagcccctttcggggctgtgagaaacatttacactcccaggacaggacatcggatccggaagctggaccaaatccagtctggagggaattacgtggccggaggacaggaggcttttaagaaactcaattacttagacatcggcgagattaagaagcggcctatggaggtggtgaacacagagctgcatgtgctttag

SEQ ID NO: 221220 - DNA, 363 bp, Artificial Sequence
  Description of Artificial Sequence: Synthetic coding sequence
atgtcggggtcatctgctaggtctagtcacctgagccagcctgtggttaaatccgttctggtataccgtaatggtgatcccttttatgctggcagaagagttgtaattcatgagaaaaaggtctcttcttttgaagtgttcctcaaagaagtaaccggcggagtgcaggcccctttcggagccgtgagaaacatttataccccccgtacgggccaccgcattagaaagttggatcaaatacaatcgggcggaaactacgttgccggaggacaggaggcattcaaaaaactgaactacctggatatcggggagatcaaaaaacgccctatggaggtcgtcaatactgagttgcacgtgctgtag

SEQ ID NO: 221221 - DNA, 1947 bp, Artificial Sequence
  Description of Artificial Sequence: Synthetic coding sequence
atgaagaaacccatctgcaaaactactgagccctatgccccagttagactgagagtcctccaaaacggggaaaagaacaagaatcggagtgtcacaatcctcggccctgatatatcccccggtcgcaagacccagtgcacggaaattctgaacctgccttctgccgcacggagactgtacaacgaaaaaggcaaagagatcttcgccctgaaggatctgcagagagacgaactggtgtatgtgagttgcggcgagctctggataaaccctgacctctcaattgcccagcagaaaaagcagatattcctgcggaatcttgagtctgatattgccaagattcagattttctgctcaacgcacaaaatcgaggccttggttttggaagtccagtccgacatcgtatccgggagcaagctggccgttcacaaaccggtcgccatttttggagaggagaaacaagtaactgaacccgaggagaagcaaatgcaggaggaccccctcactaccgagaatgcctcctcggagattctcgactctcatgttcgggcacacttaagaatgaaagcctgccacaccctgccgaggtacgcgtggcaagagacatctcacgattttgacgaagatgacagtttacccaagaaaactgagaaaggcttgtttgaaaatgtggaacctcaaaagaagcacagctgctctccgaaacactcgaaactacacaaacactgtcatcaacagttcgaatatagggacggtcagataattagccacgctgcacctcagctggtgctgggggttcagggcccaaaccttcgaagtgggatggaagtcgtcctggtggagaaaaaatctgacggatctcaccaaaggtggattcatcaggaagacagtcgtaccttccacctggtttctaaccccgatttggtactggctgtcagcatgaccaaaacaagaaacgaggtgtgtgggtatcccgtcattgtccagaaatataagccgtataacaatggcgcagctaatcagaaatggcactatatgaagaatattaaggcactcgtcgcttttcatagtactgccttggacaaggagatcaccagcgctaactacgctggtgtctgcacctcgagcgtgattaaggaggaaaacatcgatcagcccggttactgctatttaagccctgacggcaagcgaaagacaatgttgtgcttggcttgtggtcagtctatgcgcacagaaaaggggctcaagcaactcctgccaggcgtgccctttttgtgtattagtgggaccaagacgcagaaacctttcctccaggggcctttcaaggtgatctccgtcgctgaagtcgatcttagctgtgacaaagccgaaaagacgctgagctattaccaggcgagactcctgtccctgaggatgaagacctgcacccaggcagcgtcacactccggcatggccgctacgcatcaaaaggcagttaaaatcatcgcttataagaacggtgacgggtacagaaacggtaaactgattgtggcaggaactttccccatgcttcttactgaatgcaccgaacaactgggccttgccagggctgccagcaaggtgtacaccaaagacgggactccgatctttacacttagagatttggtgttatgggccttggacgagagtttcctacagcgagattctgagaagcagaagcaggatgccgcacccgtgggcaaagaacaaattattgtcgaaaagaaccctcgcatgaaagtgaagaacaggctgtttgccaaatccgttacgtcagacagtctcgacggcattgataagagcctgctaactctcatccttaggaacccaatcgcaatttgggtctcctgcggagaacccttcttgccgcctaacgagtcacggaaaattcgcgaaactgagctggcgaaaaaagggcaaaactttggctag

SEQ ID NO: 221222 - DNA, 1365 bp, Artificial Sequence
  Description of Artificial Sequence: Synthetic coding sequence
atgaagaacatcaaagcacttgtggcctttcactctacagccctggacaaggagattacatctgccaactacgctggggtgtgcacaagctcagttataaaagaagagaatattgaccaacctggttactgctatctgagtccggacggtaagcgcaaaaccatgttatgtctggcctgtggccagtcaatgcggacggagaagggactcaaacaactgctaccgggagtgcccttcctttgcattagtggcactaaaactcaaaagccattccttcaagggccttttaaggtcatctctgtcgctgaggtggacttgtcatgcgataaggcggagaaaacactgtcgtactaccaggcccgactgctgagcctgaggatgaagacgtgcacccaggccgcttcccatagcggcatggcagccacgcaccagaaagcggtgaaaattatcgcctacaaaaatggagatggctacaggaatggcaaactgatcgtagccggtaccttccctatgctgctaaccgaatgcacagaacagttggggttagcgagggccgcaagcaaggtgtatacaaaggatggcactcccatctttacccttagagacctagtgctctgggctctggatgagtcattcctgcagcgagatagcgagaaacagaaacaagacgcagcacccgtgggaaaggagcagataattgtcgagagcatggaagaaaaccctagaatgaaggtcaagaacagactatttgctaaatcggtcacatcagatagtctagacggaattgacaaaagtctcctgacactcattctacgcaaccctattgccatctgggtgtcctgcggggagcctttcttgcctcctaacgcactgcagaaggctgaaaaattggagaagcagaactggctgaaaaaggaccgaatcttggctgacctagatacaatgcggcacaagatgaggcaattgaagggcagacgcgtggcggcttgccagcccgcaaccatggttcctactaaaagcccggttcaacctgtggtcgtcgagggtggatggactgagcaaacccagcaggaaatcaaacttatggagctgatccgacacacagaagcacacctgtctgagattcaggaaatggagtcaaaaattaatttcccaatagccactaaacggatagcggtaaagcccagcaacctgtacaaacaacccaacaccaagcgcgtgtggatttacctcaatgggggacgccctgaagacggcacctatgcatggggaaaaaccatctctgaggtgagcctcctgtatttgaagacatggatttttatatggagccggaaggtgttcttttacttcctgattacggcctag

SEQ ID NO: 221223 - DNA, 2190 bp, Artificial Sequence
  Description of Artificial Sequence: Synthetic coding sequence
atgtcttttggaagggatatggagcttgagcactttgatgagagagataaagctcaacgatacagcagagggagccgagtgaacgggctaccctcccctacacactctgctcattgctctttttatcgcacccggactctgcagaccctgtcctctgaaaagaaagccaagaaggttaggttctatagaaatggagacaggtacttcaaggggatcgtctacgcaatctcccccgatcgctttaggagcttcgaggccttgcttgccgatctcacgagaacactttcggacaacgtgaaccttccccagggcgttaggactatttacacaatagacgggctcaaaaagatatcctccttagatcagttagtggagggagaaagttacgtgtgtggcagtattgagccctttaaaaagctggagtacaccaaaaacgtgaatcccaactggtcggtgaatgtcaagaccaccagtgccagccgggctgtaagcagtctggctaccgccaagggcagcccatccgaggtgagagagaataaagacttcattaggccaaaactggtgacaatcatacgctcaggggtgaaacccaggaaagctgtgcggatcttgctgaacaagaagacagcccattcttttgagcaggtcctcaccgatattacggatgcaattaagctggattccggggtggttaaacggctttatacattagacgggaagcaggtgatgtgcttgcaggacttctttggtgatgatgatatcttcattgcatgtggcccagaaaagttccgctatcaagatgattttctacttgatgagtccgagtgcagagtggtgaagtctacgagttatacgaagatcgcttcttcatcaaggcgctctactaccaagtcacccggacccagtcgtaggtctaaatccccagcctccacctcgtccgtgaatgggaccccagggtcacagttgtcaactcctcggtccggaaaatccccaagtccctcacccacttcccctggttcgcttcggaaacaacgttccagccaacatggagggagtagcacatccctggcgtcgacaaaagtctgttcttctatggatgaaaacgatggccctggtgaagaggttagtgaagaaggtttccagatcccagccaccataaccgaacgctacaaagttgggaggacgatcggggacggtaatttcgccgttgtgaaggagtgtgtagaaaggtcaactgcacgcgaatacgccttaaagattatcaagaagagcaaatgcagaggaaaagaacatatgattcagaacgaagtctccatactccggagggtgaaacaccctaacatcgtcctgcttattgaggaaatggacgtgccgaccgaactgtatcttgtgatggaactggtgaagggaggcgacctgttcgacgccatcacgtctaccaacaagtatacagagcgtgatgcgtccggcatgctgtataatctcgccagcgcaattaagtacttacacagtcttaacattgttcatagggacatcaaacctgaaaacctactggtgtatgagcaccaggacggcagcaagagtctgaagctgggtgactttggattagctacaattgtggacggccctctctatacagtgtgtggtactccaacatacgttgctcccgaaatcatcgccgaaacaggctacggccttaaggtggatatctgggcggcaggggtgattacctacattctcctctgtgggttcccaccatttcgcggaagcggtgatgatcaggaggtactgttcgaccaaattctgatgggccaggtggattttccatctccgtactgggacaacgtaagtgattctgcaaaggagctcatcaccatgatgctcctcgtcgatgtggaccagagattctccgccgtgcaggtgctggaacacccatgggtgaatgacgacggcctgcccgagaacgagcatcagctcagcgtggccggaaagatcaagaagcatttcaacacaggtcccaagcccaattccactgctgcaggggtgtccgtaatcgctttggatcatggattcaccatcaaacgaagtggaagtctggattattaccagcagccaggcatgtattggatacgaccaccactgttaattcgtcgcggtaggtttagcgacgaggatgcgacgcggatgtag

SEQ ID NO: 221224 - DNA, 2223 bp, Artificial Sequence
  Description of Artificial Sequence: Synthetic coding sequence
atgtcatttggccgagacatggagttagagcacttcgacgagcgggacaaagcccaacggtattcacgcggaagccgggtgaacggcctgcccagcccgacgcactcagcgcactgctctttttatagaacacgcacattgcagactctctcatctgaaaagaaagcgaagaaggttaggttctatagaaacggcgatagatattttaagggaatcgtgtatgccatcagtcccgaccgttttcgaagttttgaagcccttctggctgacctgacacggacccttagcgacaacgttaatcttccgcagggcgtgaggacaatttacacaatcgatggccttaagaagattagcagcctagaccagctggtggagggcgaaagttacgtgtgtggctccattgaacctttcaagaagctggagtacaccaagaatgtaaacccgaattggtcggtcaacgtgaaaactaccagcgccagccgtgccgtctcctcgcttgccaccgctaaggggagccctagcgaggtaagagagaacaaggacttcattagacccaagctagtgacaatcatacgtagtggggtgaagccccgaaaggcggtcagaatactgctcaataaaaaaactgcacacagtttcgaacaggtcctgaccgatatcacagatgcgatcaagctcgacagcggagtggtcaagagactgtacacgctagacggaaagcaagtgatgtgtctccaagacttctttggggatgatgacatcttcatcgcttgtgggcctgaaaagttccggtaccaggatgactttttgctggatgaatctgaatgccgagtggtcaaaagcacttcttataccaagatcgcctcttcctctcgtaggtccacaaccaagagtcccggtccaagcagaaggtcgaaaagtcccgcaagcacctcttccgttaatggaacaccgggatcacaactgtcaactcctagaagcggcaagtcacccagcccctctccgacctcacccggtagtctgagaaagcaacggagctcccaacatggcggttcatctacatctctggccagcactaaggtgtgtagtagtatggacgagaacgatggccctggtgaggaggtatccgaagaaggcttccagatccctgctacgatcacagaacggtataaagttgggagaactattggcgatgggaacttcgccgttgttaaagaatgcgttgaacgttcaaccgcgagagagtacgccctgaagattatcaagaagtcaaaatgtcggggtaaagagcatatgatacagaatgaggtgagtatcctgagaagggtcaaacatcccaatattgtcctgctgatcgaagagatggatgtcccaacggaactgtacctggtcatggagctggttaaagggggtgacctctttgatgccatcacctctacaaataagtacacggagcgggacgcctcgggaatgctctacaatctggcatctgcaataaagtatctgcatagtctcaatatcgtgcaccgcgatataaagcccgaaaacttgctggtttatgagcaccaagacggttccaaaagcctgaaacttggtgatttcggcctggccactattgtcgacggccctctatacacagtttgcggtacccccacctacgtggcaccagagatcatcgccgagaccgggtacggcctgaaggttgacatttgggccgctggggtcattacgtacattcttctgtgcggtttcccgccttttcgcggtagcggcgatgaccaagaagtgctgtttgatcagattctcatggggcaggtggattttccaagtccgtattgggacaacgtctcggattccgctaaagagctaatcaccatgatgctgttggtggacgttgaccaacgtttcagcgctgttcaggtccttgagcatccctgggtcaacgatgacgggctccctgagaacgaacaccagctgagcgtcgccggaaagatcaagaaacatttcaatactggccctaaaccaaatagcacagctgccggtgtgtctgtgatcgctacgactgcactcgataaagagaggcaggtgtttcgcaggcggagaaaccaggacgttagaagtcgatataaagctcagccggcaccacctgaactcaattctgagtccgaagactattcaccatcttcctcagagacagtccgatctcctaactcccccttctag

SEQ ID NO: 221225 - DNA, 1092 bp, Artificial Sequence
  Description of Artificial Sequence: Synthetic coding sequence
atgagttttggtagggatatggagctggagcacttcgatgagcgtgacaaggctcagcgctattcgagaggcagccgagtgaatggtctgccctcgcctactcactcggcccattgtagcttctacaggacacgcactctccagaccctctcctctgagaaaaaggcaaagaaggttaggttttatcgtaacggcgacagatacttcaagggaatagtgtacgccatttctccagaccggttccgcagctttgaagccctgctcgccgacctgacgcgcaccctgtctgacaacgtaaacctgcctcagggagtcagaaccatttatacgatagatggtctgaagaagataagttccctggatcagcttgtcgagggcgagagttatgtgtgcggctcaatcgaaccattcaaaaagctggaatacactaagaacgtaaaccctaattggtcagtgaacgtcaagactaccagcgccagccgtgccgtctcatctctggccactgccaaaggttccccgagcgaggtcagagagaataaggatttcatcagaccaaaacttgtgactattatacgaagcggcgtgaaacccagaaaagccgtccgcatcctgctcaacaagaaaacggctcacagttttgaacaggtactgacagatatcacagacgccatcaagcttgatagtggcgttgtgaaaagactttacaccctcgacgggaaacaggtcatgtgcctgcaggatttcttcggggatgatgatatttttattgcatgtggacccgagaagttcaggtatcaagacgatttcttactggacgaatcggaatgccgtgtggtcaagtccaccagctacaccaagatcgcatccagttcaaggcggagtaccacaaaatcccctggaccaagtagacgctccaagtcgccagccagcacgtcctctgtgaatggcacacccggatctcagctgtctaccccgcgatccggcaaatcaccaagcccttcccccacatcacccggatctctcagaaaacagcgggacttgtaccggccactgagctcggacgaccttgattcagttggagacagcgtgtag

SEQ ID NO: 221226 - DNA, 1302 bp, Artificial Sequence
  Description of Artificial Sequence: Synthetic coding sequence
atgcttgagctgatcgaggtgaacggtaccccaggatctcaactttctacaccccgatccggcaagtcacctagcccctcgcctactagccccggatccttgagaaagcagaggagcagccagcacggtgggtctagcacgtcactcgcatccaccaaagtgtgctctagcatggatgaaaatgatggccctggtgaggaagtgtctgaggaggggttccagatccccgcaaccattaccgagcggtacaaagtcgggcgaaccattggcgatggtaacttcgccgttgtcaaagagtgcgtagagcggagtactgccagagaatatgcccttaagatcatcaagaagtctaagtgtcggggtaaggagcatatgatacagaacgaggtgagcattctcagaagagtgaagcaccctaatatcgttctgctcattgaggagatggacgttccgactgaactgtacttagtgatggagttagtcaaggggggtgatctgttcgatgcaattaccagcaccaacaagtatactgagcgtgatgcaagcggcatgctgtacaacctggccagcgccattaagtacctgcatagcctcaacatagtccatcgggacatcaagccagagaacctgctggtatacgagcatcaggacgggtctaaaagccttaagctcggtgacttcggccttgccactatagtggatggacctctgtacaccgtgtgtggaacgccaacctatgtggcccctgagatcattgctgaaaccggatacgggttaaaagtggatatatgggccgcaggcgtaataacttatatcttgctgtgtggcttcccgcctttccgcggttctggcgacgatcaggaagtgctcttcgatcagattcttatgggccaggtcgacttcccaagcccgtactgggataacgtcagcgactcggccaaagagctgataaccatgatgctgctggtggatgtggaccaaaggttttctgcagtccaggttttggaacatccctgggtgaatgacgacgggttgcccgagaatgagcaccagctgtcagttgctggcaaaataaaaaagcacttcaacacaggtcctaaacctaattctactgcagctggggtgtctgtgatcgcaacaaccgcattagataaggagcgccaagtcttccgccgtagaagaaatcaagatgtgcgatcccggtacaaggcgcagcccgcaccacccgagcttaactctgagtccgaggactactctccttccagcagcgaaaccgtgcgtagccccaattccccgttttag

SEQ ID NO: 221227 - DNA, 1266 bp, Artificial Sequence
  Description of Artificial Sequence: Synthetic coding sequence
ctgagccttataaaattcaatggtacacccggaagtcagcttagtacacccagaagcggcaagagcccttctccgagtccaacgtctcccggttcgcttcgtaagcagcgttcctctcaacacggcggatcctcaacttctctggcatccacaaaggtatgctcatcaatggatgagaacgacggacctggggaagaggtttccgaggagggattccaaatacctgcgaccatcacagagagatataaggtgggcaggaccattggggatggtaacttcgctgtggtgaaggaatgcgtcgaacggtcaactgctcgcgaatatgccctgaagataatcaagaaaagcaagtgtcgaggcaaggaacacatgatccagaatgaagtgtctattttgcgaagagtgaagcatcctaacatcgtgctcctcattgaagaaatggacgtgcccacggaactttatctagtcatggaattggtgaagggcggtgatttgtttgatgcaataacaagtactaacaagtacaccgagagagatgcaagcggtatgttgtacaatttagcttcggcaattaaatacctgcacagcctgaatatcgtgcacagagatattaaaccagagaaccttctggtgtacgagcatcaggatggctccaaatcactcaagctcggggacttcggccttgccactattgtggatgggcctctatataccgtgtgtggtacccccacttatgtggcgcctgaaatcattgctgagactggctacgggctcaaagtagacatttgggccgctggtgtcatcacctacatactgttgtgtggttttccgcctttcagaggctcaggggatgatcaggaagtcctgtttgatcagattttgatgggtcaagtggactttcccagtccttactgggataatgtttccgattccgctaaggagctgattacaatgatgctgctggttgacgtagatcagcgcttttcagccgtgcaggtccttgaacatccatgggtcaacgacgatggcctgccagagaacgaacaccagctgagcgtcgccggtaagatcaagaagcattttaacactggcccaaagcctaactctacagccgcaggcgtgtccgttatcgcactggaccatgggtttacaatcaagagatccgggtctttggactattaccagcagcctgggatgtactggattcgccctccattactcattcgcagaggcagattttctgatgaagacgcaacccggatgtag

SEQ ID NO: 221228 - DNA, 1860 bp, Artificial Sequence
  Description of Artificial Sequence: Synthetic coding sequence
atgtccttcggacgggacatggagttagagcatttcgacgagcgtgacaaagcacaaaggtacagtaggggtagcagggtgaacggcctaccttcacccactcactcagctcattgttccttctacagaacccgtaccttgcagacattgagctccgagaaaaaagctaagaaagtacgattctataggaacggcgatcgatacttcaaagggatcgtgtacgccattagtcctgatcgcttccgaagcttcgaggctttgctggcggatctgacccggacgttgtccgataacgtgaatctgccgcagggcgtgcgcacaatatataccatcgatggcttgaagaagattagctccttggatcagctggtggagggcgagagttacgtgtgcgggagcatagagcccttcaagaagcttgaatataccaaaaatgtgaatcccaactggagcgttaacgtcaagacaacatccgcaagcagggcggtgtcttcactggccacagctaaaggtagtccttcggaggtccgagaaaataaggatttcattcgtccaaagctagttaccattataaggtcaggagtcaagccaaggaaggctgtccgtatcttgttgaataagaagactgcacattcattcgaacaggtgctgactgatatcaccgacgctataaaacttgacagtggagtcgtgaaaaggttatacacattggacgggaaacaggtcatgtgcctgcaggacttctttggcgatgacgacatctttattgcctgcggtcctgaaaaattcagataccaagacgactttctgctggacgagtccgaatgcagggtggtcaagtcaacctcctacactaagatcgcaagctcctctaggcgctccaccaccaagtcaccgggtccctccaggagaagcaaatcaccagctagcaccagctctgtcaacggtacccctggctcgcagctatccacgccacgatccggcaaatcaccaagccccagcccaacttcccccggttccctaaggaagcagaggtctagccagcatggcggaagctctacaagcctggcatccaccaaagtatgcagttcaatggacgagaatgatggcccaggtgaggaagtgtctgaggagggcttccagattcctgccacaataacggagcgctacaaagtgggccgaaccataggggacgggaatttcgcagtagtgaaggaatgcgtggagcgttcaactgctagggagtacgctcttaaaatcattaaaaagagtaagtgtagaggtaaagagcatatgatccaaaatgaagtgtcaatcctgcggagggtcaagcaccccaacatcgtgttactaatcgaagaaatggacgtgcccacggaactctatttggttatggagctggttaaaggtggggacctgttcgatgccattaccagtaccaacaagtacctgcattcccttaatattgtgcacagggacatcaagcccgaaaacctgctggtttatgagcaccaagatggaagcaaatctcttaagttgggcgacttcgggctggcaactatagttgatgggccactgtatactgtttgtggaacgcctacttacgtcgcaccggaaatcattgctgagacagggtatggactcaaggtagacatctgggccgcaggagtgattacatacattctgttgtgcggatttcctccgttcaggggatccggggacgatcaagaggttctctttgaccagattttgatggggcaagtggacttcccttcaccgtattgggataacgtgtcggactctgccaaggaactgattacaatgatggcaagtcagaagatgaacatctcttgtcagtag

SEQ ID NO: 221229 - DNA, 2301 bp, Artificial Sequence
  Description of Artificial Sequence: Synthetic coding sequence
atggctagcacaaggtcaattgaacttgagcacttcgaggagcgcgataaacgcccacggcctggttcccgccgtggggctcctagttctagtgggggttcgtcatcaagtggaccaaagggaaatggactgattccaagccccgcacactcagcccattgctccttttaccgcacacgcacattgcaggctctgagctctgagaagaaggctaagaaagcccgattttaccggaatggggacagatacttcaagggacttgttttcgctattagctccgaccggtttaggtccttcgatgctcttctgattgagctcacgaggtcactcagcgacaatgtaaacctgccccagggcgttcgcaccatctacacgattgacggatctcgcaaggtgacaagcctggatgagctcctcgagggggagagctacgtgtgtgcttccaacgaacctttcagaaaggtggattataccaagaatataaatcccaattggtccgtgaacatcaagggcggtacaagccgggctctcgcggctgcctccagcgtcaagagcgaagtcaaggagagtaaagacttcatcaagccaaagctcgtcaccgtgatcagatctggggtgaagcctaggaaagcagtccgtatacttctgaacaagaagaccgcccattccttcgagcaggtcctgactgacatcacggaggccatcaagctcgatagcggggtggtgaagagactgtgtacactggatggtaagcaggttacgtgtctgcaggactttttcggtgatgatgacgtatttattgcatgcggtccagagaaatttcggtatgctcaagatgatttcgtgctagaccactcggagtgccgagtgttgaagtccagctactcccggagcagtgcggtgaagtattctggttccaagagtcctggcccttcacgtcggagcaagtccccagcctctgtgaacggcacaccctcaagccaactgagtaccccgaagtcaacaaagtcttcatcatcctctccgacttcccctggctcttttcgcggactgaaacagatcagtgcacatgggagatccagttccaacgtcaacggcggtccagagctggatagatgtattagccctgaaggggtgaatggtaataggtgctccgagtcttccactctcctggaaaagtacaaaatcggcaaggtcattggagatgggaattttgctgtcgtcaaggaatgtattgaccgtagtaccggcaaggaattcgccctgaagatcattgacaaggccaagtgctgcgggaaggagcacctgattgaaaatgaagtcagcattttgcgcagagtgaaacaccctaatataatcatgctggtcgaggaaatggagaccgcaaccgagctgttcctcgttatggaactcgtaaagggaggggatttgtttgatgccataacgagctctacaaagtacacagaacgagacggttctgccatggtgtacaaccttgccaatgctctaaggtacctccatggcctgtcaatcgtgcaccgggacataaagccggaaaacctgctagtgtgcgaatatcccgacggcactaagtctctaaagctgggagacttcggactggctactgtggtagaaggccctctctataccgtgtgtggcacccctacgtacgtcgcacctgaaataattgctgaaacgggctatgggttgaaagttgatatatgggccgcaggagtgatcacttacatattgctctgtgggttccctccattcagaagcgaaaacaatcttcaggaggacctgtttgatcagattctggccggaaagcttgaattcccagctccttactgggataacatcacagactcggccaaagaactgatctcccaaatgctccaagtaaacgtggaagctagatgtaccgccggacagatcttgtcacacccctgggtcagcgatgatgcctcacaggagaataacatgcaggccgaggttacaggcaaactgaagcagcactttaacaacgctttgcctaagcagaattccacaaccacaggggtctctgtcataatgaatactgccttggacaaggagggacagatattctgctcgaagcactgccaggacagtggcaggccaggtatggagcccatatcccccgttccccctagtgtagaggagattcctgtgcctggtgaggctgtccctgcacccacaccccctgaatctccaactcctcacccaccccctgccgctccaggcggtgaacgcgctggaacctggaggcgtcaccgtgactag

SEQ ID NO: 221230 - DNA, 2352 bp, Artificial Sequence
  Description of Artificial Sequence: Synthetic coding sequence
atggcgtccactcgttccattgaactggagcattttgaggagcgagataagaggccacgaccaggctcccgaagaggcgctccctcatccagtggtggatcctcaagctccggtccaaaaggaaacggactaatcccttcaccagctcacagtgctcactgctcattctataggacccgcacactgcaggccctgtcttctgaaaagaaggccaaaaaagctaggttctacagaaatggtgatcgatattttaaagggttggtctttgctattagctccgatcgcttcaggtcttttgacgcgctgctcatcgagttaactaggtccctctcagacaatgtcaacctgccacagggcgtgcggacgatttacaccatcgatggttccaggaaagtcacaagtcttgatgagcttctagaaggcgaatcttacgtctgcgctagcaacgagccgttccgaaaggtcgattacactaagaacatcaatcctaattggtcggtcaatatcaagggtggaacctcacgggcattagcagctgcatcctccgtaaaatctgaagtgaaagagtccaaggacttcatcaaacctaagctcgtaacggttattcgcagtggggtgaaaccaagaaaagctgtgagaatcttacttaacaaaaaaacagctcactcatttgagcaggtgctgaccgatatcaccgaagcgattaaactcgattctggagtagtgaaacgactgtgtacccttgacggaaaacaagttacatgcttgcaagatttttttggcgacgacgatgtttttattgcgtgcggccctgaaaagttcaggtacgcccaagatgacttcgtcttggaccatagcgagtgtcgagtcctcaagtctagttacagtcgaagttccgccgtcaaatatagcgggtccaaatccccgggacctagccgacgctcgaaatcgcctgcatctgtgaagagaggaggacactattcctctgcctacagtacagccaagtcacccgtaaatgggactcctagctctcagctaagtacacccaagtccaccaagtcgtcaagcagcagtcccacctcaccgggttcgttcagaggacttaaacagatttccgcgcatgggcgatcttccagcaacgtgaacggcggtcccgaattggatagatgtattagcccagagggcgtcaacgggaatcggtgctccgaatcctccactctactcgagaagtataagatcggtaaagttatcggcgatggcaactttgctgtggtcaaggagtgcatcgaccgttccacgggaaaagagtttgctctaaaaatcattgacaaggctaagtgttgcggcaaggagcaccttattgaaaacgaagttagtatcttgcgccgagtgaagcatcctaatattatcatgctggtcgaagaaatggagacagccacagaactttttctagtgatggaactcgtgaaaggaggcgacctattcgatgcaataacatcctccacaaaatatacggaacgcgacggctctgccatggtgtataacctggctaatgccctccgctatctccatggactgtctatcgtccatagggacatcaagcccgagaaccttctcgtatgcgagtacccggacggtacaaaaagcctgaagttgggagattttgggcttgcaactgtcgtggagggcccactgtatactgtttgtggcactcctacgtatgtggctccagagattatagcagagacgggctatggactgaaagtagacatttgggccgcaggggtaatcacatacatcctcctgtgcggttttcccccattcagatctgagaacaacctccaagaggatctgttcgatcagatcctggccggtaaactggaatttccagcgccttactgggacaacatcacagatagcgcaaaagaactgatttcacagatgctacaggttaacgtggaagcacgatgtacagcaggacagatactgtcccacccctgggtatcagatgacgcctctcaagagaataacatgcaggccgaagtaacgggcaagctcaaacagcactttaataatgcgcttcctaaacaaaatagtacgaccacgggagtgagtgtgataatgaataccgcactggacaaggaaggacagattttttgtagcaagcactgtcaggactccggccgtcccggtatggagccaatctccccagtccctcccagcgtagaagaaatacccgtgcctggcgaggcagtcccagctccaacaccacctgagagcccgaccccacacccaccacccgctgctccagggggagagagggccggtacgtggcgaaggcatagagactag

SEQ ID NO: 221231 - DNA, 2298 bp, Artificial Sequence
  Description of Artificial Sequence: Synthetic coding sequence
atggccagtacacggtctattgagctcgagcatttcgaggagcgtgataaaaggcccagaccaggatcaagacgtggagctccaagctcctccggtggctccagctcatccggtcccaagggaaacggactaatcccgtcccccgcacactcagcccactgctcattttaccgcacccggacacttcaagcacttagtagcgagaaaaaagctaagaaagctcggttctacagaaacggggaccgctacttcaaggggctggtcttcgccatttcaagcgaccgctttcggagcttcgacgctctcctgatcgagcttactcgctctctgagcgacaatgttaacctgccacagggggttcgaaccatatatacaattgatggctcaagaaaagtaacatcgttagatgagctgctggagggcgagtcttacgtctgcgctagcaatgaaccattccggaaagtggactacaccaaaaacataaacccaaactggtcagtgaatatcaagggaggcacctcacgagcgcttgccgcagccagctccgtgaagtccgaggttaaagagtcgaaagactttattaagccaaagctcgtcactgtgataagatccggggtaaagccacgaaaggcagtgcgcatactgctgaataaaaagactgctcactcattcgaacaggtcctcacagatattactgaggccataaagctggattctggggttgtgaagcgcctttgcacgctagacggtaaacaggttacttgcctgcaggacttcttcggagatgacgacgtgtttattgcctgcggtcccgagaagtttcggtatgctcaggacgattttgtcctcgatcactctgaatgcagggtgctgaaaagttcatactcccgttcttctgctgtcaaatattctgggtctaaaagtccaggaccatctagacgatcgaaatctcctgctagtgtcaacggcacacccagcagtcagctgagtactccaaagtcaaccaagagttcctctagcagtcctacctcgcctgggtctttcaggggactaaagatcagcgctcacggcaggtcttctagcaacgtcaatggcggacccgagctggaccgctgtatctcccctgaaggcgtcaacggaaaccggtgctccgagagctccaccctactggagaaatacaaaatcggtaaagtcatcggagacggaaatttcgccgttgtgaaagagtgcattgacagatcgacaggaaaggagtttgcccttaaaattatcgacaaagccaagtgctgcgggaaggagcacctgattgagaacgaggtgagcatcttaagacgagtaaaacatcccaacatcataatgttggtggaggaaatggaaaccgcgactgagctttttctggtaatggagctcgtaaaggggggagacctgtttgatgccattaccagctccaccaagtacaccgagagggacggttctgcaatggtctacaacctcgcgaacgctctgaggtatttgcacggcttaagtattgtgcaccgggatataaagcctgagaacctattggtgtgcgagtaccctgacggcacgaaatccctaaagctgggcgactttggcctcgcaacagttgtggaaggcccattgtatacggtctgcggaactcctacgtatgtggcacccgagatcattgccgagacaggatacgggctcaaggtcgacatctgggccgcaggtgtcatcacctacatcctgctgtgcgggtttcccccattcagaagcgaaaacaacctacaggaggatctgtttgaccaaattctggcaggtaagctggagttcccagctccttattgggacaatattaccgacagcgctaaggaattaattagccaaatgcttcaggtcaacgtggaagccagatgcacagcgggtcagattctatcacacccgtgggtctctgacgatgcttcacaagagaacaacatgcaagccgaggtaaccggtaagttgaaacaacattttaataatgccctccccaagcagaattcgactacgaccggcgtaagtgttattatgaacactgcactggataaggaaggccagatcttttgcagcaagcactgccaggatagcgggcgacctggaatggagcctattagcccagtgccgccttctgtcgaggagatccccgtccccggagaggctgtgccagccccaacacctccagaaagtccaactccccatcctccaccagcagcaccaggcggtgagagagcgggaacctggcgcaggcacagagattag

SEQ ID NO: 221232 - DNA, 1947 bp, Artificial Sequence
  Description of Artificial Sequence: Synthetic coding sequence
atggggaaagagcccctgactctgaagtccatccaggtcgctgttgaggagctgtaccctaacaaggctcgagccctcacactggcccagcactcaagggcaccttccccgaggctgcggtcacgtctctttagcaaagctctcaaaggtgaccaccggtgtggagagactgaaacacccaaatcttgctctgaagtggcgggatgcaaagcggcaatgcggcaccaaggaaagattccagaggagctttccctggatgatcgagctcgcacccagaagaaatgggggagaggcaagtgggaacctgaaccttcctcaaagcctcccagggaagcaactctggaggaaaggcacgctagaggcgaaaagcaccttggcgtagaaatagagaagaccagcggagagattatccggtgcgaaaagtgcaaacgagaacgcgagctgcagcagagcctggaacgtgagagactgagcctcggaacgagcgagctcgacatgggcaaggggccaatgtatgacgtggagaaactggtcagaaccaggagctgcagaaggagcccagaggcaaatcccgcttccggcgaagagggatggaagggagattcacacagaagctctccacgaaacccaacacaggagttacgcaggcctagcaagtcaatggacaaaaaagaagaccgcggacctgaggaccaggagagtcatgcgcaaggcgcagccaaagctaagaaggatctggtcgaggtcttgcctgtgactgaggagggcctaagggaggtcaagaaggacacccgcccaatgtctaggtcaaagcacgggggatggctgttgcgggagcatcaggcagggttcgagaagctgcgccgtacaaggggcgaggaaaaggaagcagagaaagagaagaaaccttgtatgtcggggggtaggaggatgactctgagagatgaccagccggctaaactggagaaagaacctaaaacccggcctgaggagaacaagcctgaacgcccttccggaaggaaaccacgcccaatgggcataatcgctgctaacgtagagaagcactatgaaaccggtagagtcatcggggacgggaatttcgcagtggtgaaggagtgtcggcaccgggaaaccagacaggcctacgcaatgaagattatagacaagagtagattgaaaggtaaggaagatatggtggattcagaaatcctgatcattcagtccctgtcacaccctaacattgtgaaactgcacgaagtgtatgagacagatatggagatatacctgatcctggagtacgttcagggtggcgacctgttcgacgccatcatcgaatcagtgaagttcccggaaccagatgcggctctcatgatcatggacctatgtaaggcgctcgtgcacatgcatgacaagtctatcgttcatcgcgacctcaaacctgaaaatctgctagtacagcgcaacgaggataaaagtaccacactgaaactcgctgattttggactggcaaaacatgtggttcgtcccattttcactgtctgcggcaccccaacctatgtcgcgccagagatactttcagagaagggttacggcctggaagtggacatgtgggccgctggggtgatactctatatcctgttatgcggatttccaccctttaggtcccctgagcgggaccaggacgagctttttaatatcatccagctgggccattttgaatttctacccccatattgggacaacatttctgacgccgctaaggaccttgttagccggttactggttgttgacccgaaaaaacgatatactgcccaccaggtgctgcaacacccctggatcgaaaccgctggtaagaccaatactgtgaagcggcagaaacaagtctccccatcttcagaaggacactttcgatcacagcataagcgtgtagtcgagcaagtatcatag

SEQ ID NO: 221233 - DNA, 1122 bp, Artificial Sequence
  Description of Artificial Sequence: Synthetic coding sequence
atgcccaatgacgaagcctttagtaagccatctaccccctctgaagcccctcatgcaccgggtgtgccaccacagggaagggcagggggatttggcaaagcaagcggcgctttggtgggcgctgcctccgggtcttcagccggaggttcctcacgtggtgggggtagcggtagtggcgcttcagacctgggagccggtagtaaaaagtccccacggctgccaaagtgcgctcgctgtaggaatcacggctatgcatcccctctaaagggacataagcggttttgtatgtggagagactgccagtgtaagaagtgcaacctcattgccgaacgccagagggttatggccgctcaggtggccctgcggcgtcagcaggcacaagaagaagaactcggtatctcccaccccatcccactgccgtctgccgctgagcttctggtgaagcgcgagaataacggaagtaatccatgtctgatgactgagtgctctggaacatcccagccccctccggcaagcgtccctactaccgctgccagcgagggacggatggtgatccaggacatccctgcagtgacaagtagaggacacgttgagaatacaccagatctcgtgagcgatagtacatactacagcagcttctaccagccatcgctcttcccctactacaataacctttataattgtccacagtacagtatggctttagccgctgattctgcttctggcgaggtagggaatcctcttgggggttcccctgtgaagaatagtctccgtggactgcctggcccatacgtgcccggacaaactggcaatcaatggcagatgaagaacatggaaaaccgccatgctatgtcttctcagtacagaatgcattcttattatcccccaccaagttacctgggacagagtgttccccaattctttacattcgaggatgcacctagctaccccgaagcccgtgcatctgtgttctccccaccatcttctcaggactcgggtctggtgtccttgtctagttcctcccctatctccaataagagcactaaagccgtgctagagtgcgaacctgctagcgagccctcatccttcactgttacgccagtgatcgaggaggacgaatag

SEQ ID NO: 221234 - DNA, 525 bp, Artificial Sequence
  Description of Artificial Sequence: Synthetic coding sequence
atgccaaatgacgaagctttctctaaaccatcgaccccatccgaagctccccacgccccaggcgttccccctcagggccgagccggtggctttggtaaagcgtctggtgcattagtgggtgcagctagcgggagcagcgcaggcggatcttcaagaggtgggggttcgggaagcggagcttccgacttgggagcaggcagtaaaaagagtccccgactccctaagtgcgccagatgcagaaaccatggttacgcttctccactgaaagggcataagcggttttgtatgtggcgggactgccaatgtaaaaagtgcaacttaatcgctgaacgtcagcgcgtgatggcggcacaggtcggagccggtgttagggagcctggattctcactctcttttttttttttcttctttttcaggtggagcctggctagattacccagactgcagtgttctggggctatcctggctcactgtaactctgcctcccgagttcaggccattctgctgccccagcccccaaaatag

SEQ ID NO: 221235 - DNA, 681 bp, Artificial Sequence
  Description of Artificial Sequence: Synthetic coding sequence
atggcagatccacaagccggtagcgctgcaggcgattgggagattgatgtcgagtcacttgagctagaggaggacgtgtgtggagctccccgatctacacctccgggaccgtctccgccaccggctgacggcgattgcgaggatgatgaagatgatgacggggtggatgaggacgctgaggaagaaggtgatggagaggaagccggagccagtccaggaatgccagggcagccagaacagcgcggtggcccacagccacgaccaccacttgcgccacaggcttcccctgccggaacaggccctagggagagatgcacccccgctggcggaggtgccgaaccccgaaagctgtcccgaacgccgaaatgcgccagatgtcgtaaccacggcgtggtctcatgtttaaagggtcacaagcggttttgcagatggcgcgattgccagtgcgctaactgcctattggtggtagagcgccaacgagttatggctgcacaggtggcactccgacgacagcaggccaccgaagataagaagggactttctggcaagcagaataacttcgaaaggaaagccgtgtatcagcgccaggtgagggccccaagtctgttggccaagtccattctggaggtgttgcttggattattctactcttattacgtctacatcatgaatcacctgtag

SEQ ID NO: 221236 - DNA, 1686 bp, Artificial Sequence
  Description of Artificial Sequence: Synthetic coding sequence
atggctgatcctcaagcagggagcgccgctggggactgggagattgatgtcgagtcattggaattagaagaggacgtctgcggcgctcctcgcagcacacctccgggaccctcaccgcctcctgcagacggagattgtgaagacgacgaggatgatgacggagtggacgaggacgctgaagaagagggggatggcgaggaggcaggtgccagtcccggaatgcccggtcagcctgaacagcgcggaggacctcagccgcgacccccactcgccccacaagcatcacctgccggaactgggcctcgcgagcggtgcacacctgctggaggaggagctgagcccagaaagttgagtaggacaccaaagtgtgcgcgttgtagaaatcacggggtcgtgtcttgcttgaagggccacaagagattttgtcgttggagggattgccagtgcgccaactgtctcctcgtcgtggaaaggcagcgcgtgatggccgcacaggtggccctccgaaggcaacaggctacagaggataagaaaggcctgtcggggaagcagaataatttcgaaaggaaggctgtgtaccagcgccaggtgcgggcaccttcactcttagccaaaagcatactggaggggtatcgcccaatcccagctgaaacatacgttggcggtacctttcccctaccccctcccgtgagcgacaggatgcgcaaacggcgtgcattcgctgacaaggaactggaaaatataatgcttgaaagagaatacaaggaaagggaaatgctcgagacttcccaggctgccgcactcttcctgccaaaccgcatggtgcccggacctgattacaattcgtataagagcgcctacagcccaagccctgtggaacccccttcaaaggatttctgtaatttcctgcccacttgtctagacttaaccatgcagtattctgggtctgggaacatggaactgatctcttccaatgtgtctgtggcgaccacttataggcaatatccgttaagcagcaggttcctcgtctggcccaagtgcgggcctatcagcgacacactgttgtaccagcagtgccttttgaacgcgaccacatcagtccaggccctgaaacccggagcctcgtgggatctcaagggtgcgagagtgcaggacggcctgagcgcagaacaagacatgatgccatcgaagttggagggctctttagtgctgcctcacacacccgagatccagaccacaaggtccgatctgcaggggcaccaggctgtgccggaacgcagcgccttcagcccacctcgcagaaacttttcccctatagttgatacagatagcctggccgcacaaggtcacgttcttaccaagattagtaaggaaaacacaaggcacccactccctctcaggcacaatcccttccactccttgttccagcaaaccctgaccgataagtctggaccagagctgaaaacaccttttgtcaaggaggcttttgaagagacgccaaaaaagcatcgtgagtgcctggtaaaggacaatcagaaatacacatttaccattgatcgctgcgccaaagacctcttcgttgcaaaacaggttggtactaagctctccgttaatgagcctctgtcttttagcgttgagagcattctgaagcgtccttcttccgctatcactagagttagtcagtag

SEQ ID NO: 221237 - DNA, 1686 bp, Artificial Sequence
  Description of Artificial Sequence: Synthetic coding sequence
atggctgacccccaagctgggagcgctgctggagactgggagatagatgttgaatcacttgaactggaggaggacgtgtgcggggcacctcgtagtaccccaccgggaccttccccccctcccgctgacggggactgcgaggatgacgaggacgatgacggcgtcgatgaagacgccgaagaagagggagatggtgaagaggctggagcctcccctggaatgcctggacagccagaacagcgcggaggtccccagcctcgccctccgctggccccacaggcctcaccagcgggtactggccctcgcgagcgctgcacaccagcaggcggaggggcagaaccaagaaagctctcccggaccccgaaatgcgcccgatgccggaaccacggggtcgtcagttgcttgaagggccacaagcggttctgtcggtggcgcgactgtcagtgtgcgaattgtttgctggtggtggagcgccagagggtcatggcagctcaggttgccctgcggcgtcagcaggccaccgaggataaaaagggcctgtcggggaaacagaataacttcgagaggaaggccgtgtaccagcgtcaggtccgggctccatctctgctggctaaaagcattctcgaaggctatcgtcccattcctgccgaaacctacgtgggtggcactttcccacttcctccccctgtgtctgacagaatgagaaagcgccgagcattcgcagataaagagttagagaatatcatgttagagcgggagtataaagagcgggagatgctagagacgagtcaagctgcagcactatttctacccaatagaatggtgcccggtcccgactacaacagttacaagagcgcatactcccctagcccagtcgaacctccgtcaaaagacttttgcaacttcttgccaacatgcctcgatcttaccatgcagtacagtggatcgggcaacatggagcttatctcctctaacgtctcggtggctaccacgtataggcagtacccactctcatctagattcctcgtttggccaaagtgcgggcctatctcagacacactgctttatcagcagtgtttgttgaacgctaccaccagcgtgcaggctcttaaaccaggagcctcctgggatctgaaaggagccagagttcaagacggcctgtctgcagagcaggatatgatgcctagcaaactcgaaggctcattggtgttacctcacaccccagagatccagaccaccaggtccgaccttcagggccatcaggccgttcctgagcgatcagcgtttagtcctcctagaagaaacttctctcctatcgtcgacaccgactccttagcagcccagggtcatgttctgacaaagatttctaaggagaacacacggcaccctctgcctcttcgccacaacccatttcactcccttttccagcagactttgactgataagtccgggccagaactcaagacaccattcgtgaaggaagcttttgaggagacgccgaaaaagcaccgcgagtgcttggtgaaggacaatcagaagtataccttcaccattgaccgatgtgctaaagacttgttcgttgccaaacaggtgggtacaaaactgtccgtcaacgagccactgtcttttagcgtcgaaagcatccttaaacgaccctcatccgctatcaccagggtttcccaatag

SEQ ID NO: 221238 - DNA, 1686 bp, Artificial Sequence
  Description of Artificial Sequence: Synthetic coding sequence
atggccgatccgcaagccggaagcgcagcaggagattgggagatcgatgtagaaagcctggaactggaagaggacgtgtgcggggcaccacgttccaccccacccggaccgtcgcctcctcccgcagacggagactgtgaagacgacgaagatgacgacggcgtggatgaggatgccgaggaggagggggacggagaggaagccggagccagccctggcatgccgggtcagccagaacaacgtgggggacctcagcccagacctcccctagctccccaggcttcacctgccggaactggtccacgggaacgctgcaccccggcaggcggaggcgctgaaccccgaaagttgtcccgcactccaaagtgtgccaggtgtcgcaaccacggcgtggttagctgcctcaagggccacaagcgattctgtcgctggcgtgattgtcaatgtgctaactgcttattagttgtcgagagacagagggtgatggccgctcaggtggcgctccggcgacagcaggccaccgaagacaaaaaagggctgtcagggaagcagaataatttcgagagaaaagccgtgtaccagagacaggtaagggcaccatcacttctggccaagtccatacttgagggttacaggccaatacctgccgagacttacgtgggaggtacgttccctctgccccctcccgtgtctgaccgaatgaggaagagaagggcctttgctgataaggaactggagaatattatgctggaaagagaatacaaggagagggaaatgctagaaaccagtcaggcagcggctctcttcttaccaaacagaatggtgcccggtcccgattacaactcttataaaagcgcatattcacccagcccagtcgaaccacccagcaaggacttctgcaattttctgcccacctgccttgatttgacaatgcaatattccggaagcggcaacatggagctgattagtagcaatgtatcagttgccaccacgtataggcagtacccattgagctctagattcctggtgtggcccaagtgcggacccatatccgacaccctgttgtaccaacaatgcctgctgaacgccactacatccgttcaggccctgaagccaggcgcttcctgggacttgaagggcgcaagagtgcaagatgggctgagcgccgaacaggatatgatgccctccaaattagaagggtccctagttctgccacacacgcctgaaatccagacaactaggtccgatctgcaggggcaccaggccgtccctgaaaggtccgcttttagcccccctcgtcgaaattttagcccaatagtcgacactgacagtctggccgcacagggtcacgtgctcacaaaaatatcaaaggaaaataccagacacccccttccactgagacacaatccattccacagcttattccaacaaacgttaactgacaagagtggtcccgagctgaagacaccatttgtcaaggaggcttttgaggagacgcccaagaaacatagggagtgtctggttaaagacaatcagaagtatacatttaccatcgacaggtgcgcgaaggatttgttcgtggctaagcaggtgggaacaaagctgagtgtgaatgaacctttatctttcagcgtggagtccatcctgaaaaggccctccagtgcgattaccagggtgagccaatag

SEQ ID NO: 221239 - DNA, 681 bp, Artificial Sequence
  Description of Artificial Sequence: Synthetic coding sequence
atggccgaccctcaagccggatcagccgcaggagactgggaaatcgacgtggaatcgttagaattggaggaggatgtttgtggcgcaccccgtagcacaccaccaggtcctagccctcccccagccgacggggactgcgaagacgatgaagacgatgacggcgtcgacgaagacgccgaggaggagggcgacggagaagaggcaggcgcatctcctgggatgcctggccagccggaacaacgtgggggaccccagcctcgcccaccactcgctccacaagcttcaccggcaggcacagggccacgcgaaaggtgcacccctgcaggcggtggcgctgaaccaagaaaactgtccaggacaccaaagtgcgccaggtgtcggaatcatggggtggtgtcctgcttgaaaggacataagcgtttctgccggtggcgagactgtcagtgcgccaactgcctgctggttgtggaacgccagagagtgatggcggctcaggtggctttacggagacagcaggctaccgaagacaagaagggtctctctggaaaacagaataattttgagcgcaaagccgtataccaaaggcaggtcagggcaccctcccttctcgccaagtccattctggaagtccttttgggactcttctattcctactatgtctacatcatgaaccatctgtag

SEQ ID NO: 221240 - DNA, 681 bp, Artificial Sequence
  Description of Artificial Sequence: Synthetic coding sequence
atggcggaccctcaggctggcagcgcagctggcgactgggaaattgatgtcgaatctttggagttagaggaagacgtgtgtggagcccctcgctctacgcctccgggaccttctcctccaccagctgatggggattgtgaggacgatgaggatgacgacggtgtggatgaagacgctgaggaggagggcgatggcgaggaagccggagcctcccctggaatgcctggacagccggaacagcggggaggcccacagccgcgacctcctctcgcacctcaggcatctccagcaggcaccggcccaagggaaaggtgtacaccggcaggcggaggagccgagccgagaaaactctctcgcacacccaagtgcgcgcgatgccggaaccacggagtggtgtcttgcctgaaagggcataaacggttctgtaggtggcgggattgccaatgtgctaactgcctcctcgtcgtcgagcgtcagagggtgatggcagcacaggtcgccttacgacggcaacaggctacggaagacaagaagggattaagcggaaagcaaaacaactttgaacgaaaagcagtctatcagcgccaagtcagagccccatccttattagccaagtccattctggaggtgctcctcgggttgttctattcctactacgtatacatcatgaaccacctgtag

SEQ ID NO: 221241 - DNA, 6038 bp, Artificial Sequence
  Description of Artificial Sequence: Synthetic coding sequence
atgtggatcctggctctctccctgttccagagcttcgcaaacgtgttttccgaagatctccacagctcactgtactttgtcaacgctagcttgcaggaggtggtttttgcctccaccactggaacccttgtcccttgtccggctgctgggattcctcccgtaaccctgcgctggtacctggcaaccggcgaagaaatttatgacgtgccgggtatcaggcatgtgcaccctaacgggaccctgcagatttttcccttcccaccttcaagcttcagcacactgatccatgataatacgtactactgcactgcagaaaaccccagtggtaaaatacggtcacaggatgtgcacatcaaggccgtcctgcgtgagccatacactgtacgcgttgaagaccagaaaactatgagaggcaatgtggccgtttttaaatgcatcatcccgtcaagcgtcgaagcatacataaccgtggtctcctgggaaaaagatactgtgtctctggtgagtggaagccgctttctgatcacctccacaggagctctctatatcaaagacgtgcagaacgaagacggactctataattatcggtgtatcactcgtcatcgatacactggtgagacacgccagtccaacagcgccagactattcgtctccgatcctgcgaactccgctccaagcatccttgatggcttcgatcacaggaaggcaatggcaggacaacgggtggagctgccgtgcaaggctctcggccacccggaacccgactaccgctggctcaaagacaatatgccccttgagctctcgggaagatttcagaagacagtgacaggcctcttaatcgagaacatccggccttctgacagcgggagttacgtttgcgaggtgtccaaccgctacggtaccgccaaagtgatagggagactctatgttaagcaaccgctgaaagccaccatctccccacgaaaagtgaagagctctgtgggatcccaggtgtcccttagctgtagcgtgacgggcacggaagatcaggaattgagctggtacaggaacggagagattctcaatcccggtaaaaacgtgagaataacaggcattaatcatgagaacttaatcatggaccacatggtgaaatctgacggcggtgcatatcaatgcttcgttagaaaggacaaattatccgcacaggattatgtgcaggtggttttagaagacgggacccccaaaatcatctcggctttttccgagaaggtagtcagcccagctgaaccggtctctctcatgtgcaacgtcaagggcacaccccttcctaccatcacatggacattggatgatgatccaatactgaaaggcggatcacacaggatatcccagatgattactagcgagggaaatgtggtgtcctatttgaatatcagctcatcccaggtgagagacggaggggtgtataggtgcaccgcaaataattccgccggtgtcgtactgtaccaggccagaatcaatgtacggggacctgccagtatcagacccatgaaaaacattacagcaatagctggtagggatacatacatccattgtcgcgtgatcgggtacccgtattactccatcaagtggtacaaaaactcgaaccttctccccttcaatcacaggcaggtggcttttgaaaataacggcactttgaagctttctgatgtgcaaaaagaggtagatgagggggagtacacatgtaacgttctggtgcagcctcaattgagcacttcacaatctgtgcacgttactgtaaaagtcccacctttcatccagccattcgagtttcctaggttctcaatcgggcagcgcgtgtttattccatgcgtggtggtctcgggcgacctgcccatcaccattacgtggcagaaggatggcaggccaatccccggaagcctgggggtgacaatcgataacattgatttcacttcaagtttgaggataagtaacctatcactgatgcataacggcaactacacctgcatagctcgtaacgaggccgctgccgtcgaacatcagtcccagcttattgtgagggtgcctcctaagttcgtagtgcagccccgagaccaagatgggatttacggtaaggcagttattcttaattgttccgctgagggatatccagtgcctactatcgtctggaaattttccaagggagcaggtgtcccccagtttcaaccaatcgcactcaatggcaggattcaggtactgtccaacggctctctacttattaagcacgtggttgaagaggattctggatattatttgtgcaaagtgagcaacgatgttggagctgatgtcagtaagtcgatgtatttgacagtgaaaatccctgcgatgattacaagctatccaaacactactcttgccacccagggccagaagaaagagatgtcttgtacggctcatggcgaaaaacccatcatagtccgctgggagaaagaggatcgtattatcaacccggaaatggcaagatatttggtgtcaactaaggaggttggggaggaagtaatatccactctacagatactgcccaccgtaagggaagattccggcttttttagctgccacgccatcaactcctacggcgaagacaggggtatcatacaacttactgttcaggaaccacccgatccgcctgagatcgaaataaaggacgtaaaggccagaactataacgctccgctggaccatggggtttgatgggaatagtccaattaccggctatgatatcgaatgcaagaataagtctgacagctgggattcagcccagcgaaccaaggatgtgtccccacagctcaactccgcaacaataatcgatatccacccctcaagtacctactccatcaggatgtatgccaagaaccgaattgggaagtctgaaccatctaacgaactgaccatcaccgccgacgaggctgcacctgacggacctcctcaggaagtccatctagagccgataagctcacaatcaattagggtaacctggaaagcccctaaaaagcacttgcaaaatgggatcattagaggttaccagatcgggtatagggaatattccactggaggaaactttcaatttaacattatctccgtagatacatcgggcgattccgaggtttatacgcttgataatctcaacaagtttacccaatatggtttagttgtgcaggcttgcaatagagcgggtactggcccatcatcacaggagatcattaccaccacgttagaggatgtgccttcttaccctccggagaacgtgcaagcaatagcaaccagtcccgaaagcatcagcatttcctggtccacgctgagtaaggaggctctgaatgggatcttacagggctttagagtaatttattgggccaatcttatggatggcgagctgggtgagatcaagaatattactacaacacagccttccctcgagcttgacggcctggagaagtacactaactacagtattcaagttctcgcgtttacgagggctggagacggagtcagaagcgagcagatttttacaagaacaaaggaagatgtgccgggaccgcctgccggagtgaaagcagccgcagctagtgcctccatggtgtttgtcagctggctgcccccattgaaactgaacggcatcattaggaagtatacagtcttctgttcccacccctatcccacagtcatcagcgagtttgaggcttcccctgactcgtttagttatagaatccccaatctcagtcggaaccggcagtattctgtctgggtggtggcagtcacttctgccggaaggggtaacagctccgaaatcatcacagttgaacctctggcgaaggcaccggctcgtattttaacatttagtgggactgtgacaaccccctggatgaaagacatcgtcttgccatgtaaagcagttggcgacccgtcccccgctgtgaagtggatgaaggacagtaacggtaccccatctcttgtgaccatagacgggaggcgcagcatctttagcaacggaagctttatcatccggacggtcaaagctgaggactctggttactattcatgtattgccaataataattggggttcagacgagattatcctaaacctgcaggtgcaggttccgccagaccagcccaggctgacagtttctaaaaccacctctagcagcatcaccctctcttggctgccgggagataatgggggaagctctatcagaggttacatccttcagtattccgaagacaatagtgagcagtggggctcgtttcccatctctccctcagagaggtcctatcgattagaaaatctgaaatgtgggacatggtacaagtttacccttaccgcccagaacggagtgggccctggcagaatatccgagatcatcgaggcgaaaacgctcggcaaggagccccagttttccaaagaacaagagttgttcgcctccattaatactacgcgggtgagacttaatttgataggctggaatgatgggggatgtcccattacaagcttcaccctagaatatagacctttcggaacaaccgtgtggacaactgcacagcgaacaagtctaagcaagtcatatatcctgtatgacctgcaagaagccacctggtatgaactgcagatgagggtgtgcaatagcgctgggtgtgccgagaagcaagcaaactttgccaccctcaactacgacggttctaccattccccctttaataaagagcgtcgtccaaaacgaggagggattgacaaccaatgagggattgaagatgctggtcactattagttgcatattagtcggggtacttttgctgttcgtgctgttgctagtggtccgacggaggcgtcgagagcagcggctcaagagactccgtgacgcaaaaagcctggcagagatgctgatgtcaaaaaatacaagaacatctgacaccttgtcaaaacagcagcagactctcagaatgcatattgacattcccagagcccagctgctgatagaagagagagataccatggagacaatcgatgatagaagcacagtgcttcttactgatgctgattttggggaagccgctaaacagaaaagcttgaccgttacgcacactgtgcactatcagtccgtgagccaagctacaggaccactggtcgatgtgtccgatgctagacccggtacaaaccccactacccgcaggaatgcaaaggcgggaccgactgcccgaaatagatacgcttcgcaatggacactgaataggccgcatccgactatttccgctcataccttaaccactgactggcgacttcccacaccgcgtgccgctggaagtgtggacaaggagtcagacagttactccgtgagtccttctcaagacacagatagagctcgtagcagcatggtgagcaccgagtccgctagttcaacgtacgaggagctggcacgcgcttacgaacacgccaagatggaggaacaactgagacacgcaaagttcaccattaccgagtgttttatctctgacacgagctccgaacagctgactgccggaaccaatgaatatactgatagccttaccagctcaaccccctcggagagcggcatttgtcgctttacagccagcccacccaagccccaggatgggggtagagtcatgaacatggccgtcccaaaggcacatcgacccggagatctaatccacctgccaccttacctcagaatggatttcctgttgaacagggggggacccggaacaagcagggacctgtctctgggccaagcttgcctggaacctcagaaatcccgtactctgaagcggcctacagtgctggagccaattcctatggaggctgcaagctccgcttcaagcactagagaaggtcagtcctggcaacccggagctgttgcgactctcccgcagcgggagggcgcagagctgggccaagctgcaaagatgagctcttcacaggagagtctgctggatagtcgcggacacctcaaaggtaataatccctacgcaaagagctacacgttagtgta

SEQ ID NO: 221242 - DNA, 6341 bp, Artificial Sequence
  Description of Artificial Sequence: Synthetic coding sequence
atgaccggagcaggtgagcccaggagggaggagcctccccctcaacctagcgccggactgagaagccgcgagtctggtgcccctagcgccggtgggtgggaaagggcggagcgtggcagaggggctgcagcacgcccagcaaccggaccacctcccagacggattgggcctctgtatggtatgtggttggttactttcctactgctgctggactccctgcacaaagccaggcccgaggatgtggggacctccctctatttcgtgaacgacagcttgcaacaggtcacattctcaagctcagtgggggtcgtagtgccgtgcccggcagcagggagtccctcagctgcattgcgctggtatttagccactggcgacgatatctatgatgtcccacatatccgccacgttcacgccaacggcaccctgcagttatacccttttagtccctcggccttcaacagcttcatacatgacaatgattacttttgtaccgccgaaaacgctgcaggtaagatccgtagccctaacattagagtgaaagctgtgttcagggagccttatacagtgcgcgtggaagaccagagatccatgcggggaaatgtcgccgtctttaagtgtctgattcccagctcagtgcaggagtacgtatccgttgtttcctgggagaaagataccgtctcaatcattccagaacatagattctttataacataccatgggggtttatatataagtgatgtacaaaaggaagatgccctaagcacctatcgctgtatcaccaagcacaagtattcaggggagacccgccagtctaacggagctaggttatcagtcaccgacccggctgaatccattcccaccattctcgacgggtttcacagtcaagaggtgtgggccggacataccgtcgagctcccctgtacagcctccggttatccaatcccagctatcagatggctgaaggatgggagacccttaccagccgactcaaggtggactaagcggatcacggggcttacgatttctgacctaagaaccgaggatagtggcacttacatatgcgaggtgaccaacacctttggcagcgcagaggctactggaattctaatggtcatcgatccactccacgtgaccctgactcccaagaagctgaaaactggaatcgggagtacggtgatcctgtcctgtgctctaacaggctcacctgagtttacaataaggtggtaccgcaacacggaattggtgctcccagatgaagccattagcattcgcggtctcagcaatgagacgctcctgattacgtcagctcagaaatcacatagtggtgcttaccagtgtttcgcgacacgcaaggcccagactgctcaggattttgcaatcatcgcactggaagacggcactcccaggatcgtgagcagtttttccgaaaaggtcgtcaaccctggagaacagttttcacttatgtgcgcagcgaaaggcgctccccctcccacggttacatgggctctagatgacgagcctattgtaagggatggatcccacagaactaatcagtataccatgagcgatggcaccacgatctcacacatgaatgtcacaggccctcagattagggacgggggagtgtaccggtgcactgccaggaacttagttgggagcgccgaataccaggccagaatcaacgtgcggggaccgcctagcatccgggcaatgaggaacatcaccgccgtggctggtagagatactcttattaactgtagggtgatcggctacccgtattattccataaagtggtacaaagatgctctgctgctgccggataatcataggcaagtggtgtttgaaaatgggaccttgaagctgaccgacgtccagaaaggaatggacgagggggaatatctgtgttcagtactaatccagccacagctgtccattagccagtcagttcatgttgcagttaaggttcctcccttaatacaaccatttgagtttccgccagcttccattggccaactcctgtacattccctgcgtggtgtcctccggcgacatgccaatacgtattacttggcgtaaagacggtcaggttattattagtggttcgggcgtgacaattgagagcaaggagttcatgagcagcctgcagattagcagtgtatctctcaaacataatggaaactacacctgcatagcctcaaacgccgctgcaaccgtctctcgcgagagacagctcatcgtgagagttccacccaggttcgttgttcagcccaacaatcaagatggtatctacggtaaagcaggagtcctgaattgttccgttgacggataccctccccctaaagtcatgtggaagcatgctaagggctcaggaaatcctcagcagtaccacccagtgccactgacggggagaatccagattctccccaactcctctctactgatccgccacgttctcgaagaggatatcgggtattacctgtgccaggcttccaacggggtgggaacggatattagtaagagtatgtttttaactgtgaaaatacccgctatgattacaagtcatcccaatactacaatcgccattaaagggcacgcaaaggaactgaactgcaccgccaggggagagcggcctatcatcatccgatgggaaaagggcgacacagtgatcgatcccgatagggtgatgcggtacgccatcgcaacaaaggacaacggggatgaggtcgtcagcacactgaagctcaagccagcagaccggggtgatagcgtgttcttttcttgccacgcaattaacagttatggtgaagatagaggcctgatccagctgacagttcaggagccacccgaccctcctgaactcgaaatccgggaggtcaaagcacgttccatgaatctgaggtggacccagagatttgacggcaatagcatcatcacagggttcgacattgaatataaaaacaagtccgatagttgggattttaagcaaagcacacggaatatctcacctactatcaaccaggccaatattgtggacctgcatcccgcttccgtgtattccattagaatgtattcctttaataaaattggcaggagcgagccatccaaagaattaaccatttctaccgaggaggcggctcctgatggcccaccgatggacgtcactctgcagcccgtaacctctcagagcattcaggtgacatggaaggcacctaaaaaggagctgcagaacggggtaatcagaggctaccagattgggtacagagagaatagcccaggatctaacggccagtactcaattgtcgagatgaaggcaacaggggactctgaggtgtacacactggataaccttaagaaattcgcacagtatggagtggtggtccaagctttcaaccgcgctggaaccgggccatcatcgtcagagattaatgcaactactctggaagatgtaccgagccagccacccgagaacgtgcgggctctctccataaccagtgatgttgctgtgatttcctggtccgaacctccacggtcaaccctcaatggtgtgctcaagggctatcgagttattttttggagcctgtatgtggatggtgaatggggagagatgcaaaacatcacaacaacacgtgaacgcgtggaactacggggaatggagaaatttaccaattattcggtccaagtgctggcatatacccaggccggagacggagtgcggagctccgtcctttatatccagacaaaggaagacgtgcccggtccccctgcaggaattaaagcagttccgtcaagtgctagctctgttgttgtcagttggctgccacctaccaaacccaatggtgtaatacgaaagtataccatcttctgtagctcaccgggaagcggtcaacctgcacccagcgagtatgagacgagtccggagcaactgttctaccgaatagcccaccttaataggggccagcagtacttgctctgggtagcggctgtaacatccgcaggaagaggcaattctagcgagaaggtgaccatcgagccagcgggaaaagcacctgcgaagatcatttccttcggaggcacggtgaccacaccctggatgaaggacgtgaggctaccttgtaactcagtgggcgaccctgctcctgctgtgaagtggaccaaagactcagaggacagtgctatccccgtgtctatggacgggcaccgtctgattcacaccaacgggaccctcctgctcagggctgtaaaggcagaggacagcgggtactatacgtgtactgccaccaacacaggcggattcgataccattatcgtcaacctgctggttcaggttcccccagaccaaccacggctcacagtgtccaaaaccagtgcatcaagtatcacattgacgtggatccctggggacaatggtgggtcgagcatcagaggcttcgtgctccagtatagtgtggataattcagaagagtggaaagatgtgtttataagttcctctgaacggagcttcaagctcgattctctgaagtgcggcacctggtacaaagtgaaacttgctgctaagaattcagtgggatcaggaagaataagcgagatcattgaagctaagacgcatggcagagagccgagcttttctaaggaccagcacctcttcactcatattaactccacccatgcaagactgaatttacaaggctggaacaatggcggatgccccatcacagctatagtcctggagtaccgccctaaaggaacctgggcctggcagggactgcgcgcaaatagtagcggcgaagtgttcctaactgagctccgggaagcaacctggtatgagttgcggatgcgcgcatgtaacagcgcgggatgtggtaatgaaaccgcccagttcgccacattggattatgatggaagcacaataccccctatcaagtccgctcagggagaaggcgatgatgtcaaaaagctgtttactattggctgcccagtcatcctggccaccctaggagtggctctgctcttcattgtgagaaagaaaagaaaggagaagagattgaaacgcctccgagacgctaaatccctggcagagatgcttatatcgaaaaataacaggtcttttgatactccagtaaagggccctccccaggggcctaggctacacattgacatccctagagtccaactgctgattgaggataaagaggggataaagcagctgggcgacgacaaggctacaatccccgtgactgatgccgagttcagccaggcagtgaatccacaatcgttttgcactggggtttctctccatcaccctaccctgatccagagtaccggacccctgatagacatgtccgatatccgacctgggacaaatcctgtgagtcgaaaaaacgttaagagcgctcactccacaagaaatcggtactctagccaatggaccctgaccaaatgtcaggccagcacaccagctagaacactgacgtccgactggagaacggttgggagtcagcacggggtaactgtcacggagtcagatagttattccgcttctctctcccaggatacggataagggtagaaacagtatggtctctaccgagagtgcctcctccacttatgaggagctggctcgggcttatgaacatgccaaactcgaagagcagctccagcacgccaaatttgaaataactgagtgtttcatcagcgattctagctcagaccaaatgaccactggcactaacgagaatgccgacagtatgacaagcatgagcacccccagtgaaccgggtatctgccgttttactgctagccccccaaagcctcaggatgccgatcgagggaaaaatgtcgcagtgccgataccacaccgggcaaataagtcagattactgcaaccttcccctgtatgcaaaaagcgaggccttttttagaaaggctgatggcagggaaccatgccccgtggttccgcctcgagaggcatcaatcaggaatctggcgcgtacctaccatacccaggcacgccacttaactctggacccagcctccaagtccctgggtcttcctcatcctggagctccagccgctgcaagcacagcaactctaccgcagaggacactggcgatgccagctccgccagctgggaccgcccctccagctccaggaccaactccagctgagccgcctactgcgccttccgccgcacccccagctcccagcactgagcccccaagagcaggaggccctcacacgaagatgggaggctctagggactctctacttgaaatgtcaacatcgggagtcggcagaagtcagaagcaaggtgccggtgcttacagtaagtcttatactctggtcta

SEQ ID NO: 221243 - DNA, 5462 bp, Artificial Sequence
  Description of Artificial Sequence: Synthetic coding sequence
atgttaccatactgggccggtcacacagtggagttgccatgcactgcatctggctaccccatccccgctatacgttggttgaaggatggcaggcctttgcctgccgattctaggtggacgaagcggatcacaggcttgacgatcagcgacttgagaaccgaggattcagggacatatatttgtgaggtgacaaacacctttggctccgccgaggcaacagggatcctaatggttatagatccactgcatgttaccctcacccccaaaaagctgaagaccggcattggttctacagtgatactgagttgcgccctgaccggctcccccgagttcactattaggtggtatagaaacaccgaactggtcttacctgacgaggcaatttccatccgcggtctgagcaatgagaccttactgatcacatccgcccagaagtcgcattccggcgcttatcagtgctttgcaaccagaaaggcccagacagcccaggatttcgctatcatcgcactggaggacggtaccccccgtattgttagttccttcagcgagaaggtcgtgaatcctggcgagcagttttcactgatgtgcgccgctaaaggtgctcctccccctactgttacctgggcgctagatgacgagccaatcgtccgtgatggatcccaccgaactaatcagtacactatgagcgacggaactaccattagtcatatgaatgtaactgggccacaaattcgggacggaggtgtctaccggtgtaccgcaaggaatctagtcggcagcgcggaatatcaggcacggatcaatgtccgaggcccaccatccattcgcgctatgagaaatataacagctgtggctgggcgagacaccctgattaactgccgggtaattggttatccctattattccatcaaatggtacaaagacgctttactgctgcccgataatcatagacaagtggtttttgagaacggaaccctcaaactgactgatgtgcagaaaggcatggacgaaggcgaatacctgtgctcagtgctaatccagccgcagttatccatctcccagtctgtgcacgtcgcggtaaaggtgccaccattgatccaacctttcgagttccccccagcttccattggtcagctgttgtatatcccctgtgttgtgagtagcggcgatatgcccattcgcataacctggaggaaggatggtcaagttatcatcagcgggtctggggtaactatagagtccaaagagtttatgtcatcgctccaaatatcctctgtgtctctcaaacataacggcaactatacatgtattgcttccaatgctgccgctaccgtcagtcgagagagacagctgatcgttcgggtcccaccacgctttgtcgtgcaacccaataaccaggacggtatctacgggaaagcaggagtgctgaactgtagcgtggatggttatcctccccctaaagtcatgtggaaacatgccaaagggagtgggaacccccagcagtaccatccagtcccattgaccggtcgcattcagatactcccaaattcttccctgctgattagacacgtgctggaggaggacatcggctattacctatgccaggcttccaacggtgtcggtacagatatctcaaagtctatgttcttgaccgtgaagatcccggcaatgatcacaagccaccctaacacgaccattgcaatcaaaggtcacgctaaagagttgaactgtacagcacgtggggagaggccaatcattatacgctgggaaaagggggatactgtcattgaccctgatcgggtcatgaggtacgccatcgctacaaaagataacggcgacgaagtcgtttctaccctaaaattgaaaccggctgacaggggcgattccgtatttttcagttgccacgctatcaacagctacggagaagatcgcggtctgatccagctcacagttcaggagccgcctgatccaccggagctagaaattagggaggttaaggctcgctccatgaatctgcgctggacccaaagattcgatggcaactctattattacaggcttcgacattgaatacaagaacaagagcgacagttgggattttaaacagagcactcggaacattagcccgaccataaatcaagccaacattgtggatctgcatcctgcatctgtgtactccatacgtatgtacagcttcaataaaataggaagatccgagccttctaaggaactgactataagcaccgaagaggcagcccctgatggaccccctatggacgtcaccctgcagcccgtaacctctcagagtatacaggtgacctggaaggcacccaaaaaagaattgcaaaacggcgtgatacgcggataccagattggatatcgagagaactctccaggctcaaacggacagtatagcatcgtagagatgaaagctaccggcgacagcgaagtctacaccctggataatttaaaaaagtttgctcagtacggagtggtcgtgcaggcctttaatcgggcaggcacaggccctagctctagcgagatcaatgcaactactcttgaagacgttccgagccaaccaccagagaatgttagggctctgtccatcacgtctgatgttgcagtgatcagttggtcagagccccctcgatccaccttgaacggagtccttaagggatatagagtgatattctggagcctgtatgttgacggcgagtggggcgaaatgcaaaacattactaccactcgggagcgggtcgaactgcggggaatggagaagttcacaaattattccgtccaggtgcttgcctacactcaggcaggggacggagtgagatcttccgtgctctacatccagacaaaagaagatgtgcctgggccaccagccggaatcaaagccgtgccatctagcgcctcttctgtcgttgttagctggctgccccctacaaaaccgaacggtgttatccgaaagtacacaatcttctgttctagccctggaagtggacagcccgctccgagcgaatatgaaacgagtcccgaacaactgttctatcgcattgctcaccttaaccggggacagcagtatcttctgtgggtggccgctgttacgtcggccggtaggggaaattcatcggagaaagttaccattgagcccgctgggaaggcaccggcaaagattataagttttggcggtaccgtgaccaccccctggatgaaggacgtgaggttgccatgcaattcagtaggcgacccagcacccgctgtgaagtggactaaagacagcgaggacagtgccattccggtcagcatggacgggcaccgtctcattcacacaaacgggactttgctgctgagggcggtgaaagccgaggatagcggatactatacttgtaccgccacaaacaccggcggttttgataccatcatcgtgaatctcctcgtccaggtaccccctgatcaaccaaggttgactgtctcaaagacctcggcttcctcaatcactctcacctggatacctggagacaacggcggaagtagcatacgtggcttcgtgttgcagtactccgtagacaactcggaggagtggaaagatgtattcatttcctcttccgagcggtccttcaagttggattcccttaagtgcgggacgtggtataaagtcaaacttgcggctaagaactccgttggaagcggccgtatcagcgaaattatcgaggccaaaacgcacgggagagaaccttcttttagtaaggatcagcatttgtttacccacatcaacagcacacacgctagactgaaccttcagggatggaacaatggcggatgccctattacagctatcgtcttagaatatagaccaaaggggacttgggcctggcaaggactgagggcaaacagctctggagaagtcttcctgaccgagttgagggaagccacatggtatgaactgcggatgagagcatgcaatagtgccggatgtggcaacgagactgctcagtttgccacccttgactatgatggctccactatccctcctataaaatcagcacaaggggagggagatgacgttaagaagctgtttacaatcggctgcccggtaatcttggcaactctgggcgtggcgctcctttttatcgtgcgaaagaagaggaaagagaaaagactcaagcgactgagagacgcaaagtcactggctgagatgttgatcagcaagaacaataggtcctttgatacacccgtaaaaggcccacctcaaggcccaaggctgcacattgacatccctcgcgtgcagttgctcatcgaagataaggaaggcattaagcagttgggcgacgataaggctacaattccggtgaccgacgcggaattttctcaagccgttaacccgcagtcattctgcacaggagtgagcctccaccatcctactctgatccagagtactggccctctgatcgacatgagcgacattaggcccggtacaaaccccgtttctagaaaaaacgtgaagtcggcccactcaacgaggaatcgatattcaagccaatggaccttgaccaaatgccaagcttcaacgcctgccagaactctgacctctgattggagaacagtcgggagccagcatggggtgacagttaccgaatctgacagctatagcgccagtctgtcccaggatacagataagggcagaaattcaatggtgtcaacggaatctgcctcaagtacgtacgaggagctagccagagcctacgaacatgcaaaacttgaagaacagcttcagcatgccaagttcgagattaccgaatgctttattagtgactcttccagcgaccaaatgaccacaggaacaaatgaaaacgcagatagcatgacttccatgtcaactccctccgagcccggtatctgtaggtttaccgcctccccccctaaaccacaggacgcggatagaggaaaaaatgtcgccgtcccgatcccccatagggccaacaagagtgattactgcaacctgcctctatacgcaaagtcagaggcattctttagaaaggccgacgggagagaaccttgtcctgtcgtcccgccaagggaggcctcgattaggaacctggcgcgaacctatcatacacaggcgagacatctaaccctggaccctgcctccaaatcactgggcctccctcatcccggagcaccggctgccgctagtaccgcaactctgccacagaggactctagctatgcctgcaccccctgccggaacagctccgccagcaccaggacctacccctgccgaaccccctaccgccccttctgcagcacccccagcgcctagtacagagccaccccgtgctggaggaccccataccaagatgggcggatcccgagattcactgctggagatgtcaactagtggggttggcagaagccaaaagcagggtgcaggcgcatattccaagtcctacacacttgtcta

SEQ ID NO: 221244 - DNA, 762 bp, Artificial Sequence
  Description of Artificial Sequence: Synthetic coding sequence
atggagggaaccgtgaacctgcagctctccgctaaaagcgtcggtgttttcgaagcgttttacaacagtgtgaagccaatacaaattatcaactctacaatcgagatggtcaagcccggaaaattcccatccggtaaaactgaaatcccttttgagtttcctcttcacctaaagggcaacaaggtgctgtatgagacatatcatggagtttttgttaacatccagtacacactgaggtgcgacatgaagcgctcgcttttggccaaggacttgacaaagacctgcgagttcatcgtgcattccgcaccgcagaaaggcaaatttacaccctctcccgtcgactttaccatcacccccgagacgcttcagaacgtgaaggagcgagctctcttacctaagttcctgctgcggaccagccaactgaataagttatgccaccatgccgctaccaacggcagggctggcggtggggaactgggctctaggcaccagaagcgtggggcagcggctggagcaaggggagatgtgagggtgtgccgttatgccagagacgcaactgagattcagaacatacagattgccgatggggatgtttgtcgaggcctctctgtgcctatctacatggtgtttcctcggctgtttacctgccccactctggagaccaccaacttcaaggtggagttcgaagttaacatagtggtgttgctccacccggatcacctcataactgaaaacttccccttgaagctctgccgcatttag

SEQ ID NO: 221245 - DNA, 894 bp, Artificial Sequence
  Description of Artificial Sequence: Synthetic coding sequence
atgggaacagccctcgatataaaaataaaaagggctaacaaggtgtaccatgcaggcgaggtcttgagtggggtggtcgtgattagctccaaggacagcgttcagcaccagggggtttccctcaccatggaaggaacagtcaatctacagctctcggccaaaagtgtgggcgtgtttgaagctttttataacagcgtcaaaccaatccagatcatcaacagcaccatcgaaatggtaaagcccggaaagttccctagcggtaagaccgagattccttttgaatttccactgcacttgaagggcaataaagtcctttacgagacttatcatggcgtgtttgtcaatatccagtacacgctgagatgtgacatgaagcggtcgcttctagccaaggatctaactaagacctgtgagtttattgttcattccgctccccagaaaggcaaatttaccccgtcgcctgtggattttactataacccccgaaactcttcagaacgttaaggagcgggcattgctgcctaaatttcttcttagggggcacctaaatagtacaaattgtgtcattacccagcctctaacgggcgagctcgtggtggaatcttctgaagctgcaatccggtccgtagaactacaactagtgagagttgaaacatgtggctgcgctgaggggtacgccagagatgccacggagatacagaacatccagatcgctgacggcgatgtatgccggggtcttagtgtgcccatctatatggtgtttcctcgtctgtttacttgtccaactctcgaaacaacgaatttcaaagtcgaattcgaagtgaatattgtggtgctcctacatcccgatcacttaattacagagaacttccctctcaagctttgcaggatctag

SEQ ID NO: 221246 - DNA, 519 bp, Artificial Sequence
  Description of Artificial Sequence: Synthetic coding sequence
atggggacagcgctcgatatcaaaattaaacgagcaaacaaggtttaccatgctggaccccagaagggaaagttcaccccctcccccgtggatttcaccattacccccgagacactgcagaatgtgaaagaacgggcattactgccgaaattccttctcagggggcacctgaactcaactaattgcgttatcacacagccgctgaccggagagttagtcgtggagagctccgaagccgctatacgttctgtcgaactgcaattggtccgggtcgagacatgcggctgtgccgaaggctatgcgcgagacgccactgagatccagaatattcagattgccgatggcgacgtgtgtcgcggtctgagtgtgcccatttatatggttttccccaggctgttcacctgcccaaccctggaaaccactaatttcaaggtggagttcgaggtgaacatcgtcgtgctgctgcatcctgatcaccttattacagagaacttcccacttaagctgtgccgtatttag

SEQ ID NO: 221247 - DNA, 813 bp, Artificial Sequence
  Description of Artificial Sequence: Synthetic coding sequence
atgggtacagccctggacatcaaaatcaagcgggcaaataaggtgtaccacgcaggcgaagtactgagcggcgtggttgtaataagttcaaaagacagtgtccaacaccagggcgtttcccttactatggagggaactgtcaacctgcagttgagtgccaagtcagtgggcgtgttcgaggctttctataacagtgtgaagcccatacagatcataaatagcacgattgaaatggttaagcccggaaaattcccaagtggtaaaacggaaattccatttgagttcccccttcaccttaaggggaataaagtgctctatgagacataccacggggtgttcgtcaatatccagccccagaagggaaagttcacccctagtcctgtggactttaccattacacccgagacattacagaatgtgaaggaaagggctcttctgcccaaattcctgttgaggggacatcttaatagcacaaactgtgtgatcacgcagccactcaccggggaattagtcgttgagagctcggaggctgctattcggagcgtggagttgcagctggtgcgagtggaaacctgcggctgtgcagagggctacgctcgggatgctactgagattcaaaacatccagatcgcagatggcgacgtctgtcgtggccttagcgtgcctatttacatggttttccccaggctctttacatgtcccacactggaaaccaccaacttcaaggtcgagttcgaggttaatattgtggtgttactgcatccggatcatctgattaccgaaaactttccactgaaattatgccgtatctag

SEQ ID NO: 221248 - DNA, 663 bp, Artificial Sequence
  Description of Artificial Sequence: Synthetic coding sequence
atgggaacagccctggatatcaagatcaagagggcaaataaggtgtatcacgccggtgaggtgctgagtggggtggtggtgataagttccaaagactcagtgcaacaccagggggtcagcctgactatggaaggtaccgtgaacctgcagctgtcggctaagtctgttggagtttttgaagccttttataacagcgtgaagccccagaaagggaagttcacccctagtcccgtcgattttaccattactccagaaacactgcagaacgtgaaggaacgggctctgctccccaagtttctcctcagaggacacttgaactccactaattgtgtgattacacagcccctaacaggtgagctcgtggtagaatcatccgaggctgcaatccgatctgtggagcttcagttggtgcgggtggaaacatgtggctgtgcggaaggctatgctagagatgctaccgaaattcagaatatccaaattgccgatggcgacgtgtgtcgagggctgagtgtacctatctatatggtatttccgagactgttcacgtgccccacattggagaccacaaattttaaggtcgagttcgaggtcaacattgtggtcttgctccacccagatcatctcatcactgagaattttcccctgaaattgtgtaggatctag

SEQ ID NO: 221249 - DNA, 357 bp, Artificial Sequence
  Description of Artificial Sequence: Synthetic coding sequence
atgtcgctaattattctaacgcgtgatgacgaaccgcgaatttttacccccgattccgatgcagctagccccgcactacactccacctcccctctgccagatcccgcttcagctagccctctgcaccgcgaggagaagatcctccctaaagtgtgcaacattgtttcatgcctcagtttttctcttcccgcatctccgacagatagcggactggctagtcccactattattactcgggaaggccagcagttctgggccaaatgtctgatctggaagtaccaattatacctgcacggacttcataagaagtctgatggccgtagagacaagcagatcagcgcttccccttccacgtag

SEQ ID NO: 221250 - DNA, 573 bp, Artificial Sequence
  Description of Artificial Sequence: Synthetic coding sequence
atggagcccgaggctgcagctggtgctcggaaggctcgaggacgcggatgccactgtccaggcgatgccccatggagacctccgcctcctcgtgggccagagtccccagccccttggcggccttggatccagacccccggagatgctgagctgactcggaccggtaggccattagaacctagggccgatcagcacacattcggctccaagggcgctttcggatttcagcaccccgtccgggtgtatctccctatgagcaagaggcaggagtatctacgctctagcggagagcaggttctggcctctttcccagtgcaagccaccatcgatttttacgatgatgaatctacagagtctgcatcagaagccgaggagcctgaagaaggcccacccccactacacctcttaccacaggaggtcgggggacgacaggagaatgggcctggaggtaaaggacgtgaccagggcatcaaccaggggcaaagatcaagcgggggaggggaccactggggcgaaggccctctcccccagggagtgtcttccagaggaggaaaatgcagtagcagtaaatag

SEQ ID NO: 221251 - DNA, 294 bp, Artificial Sequence
  Description of Artificial Sequence: Synthetic coding sequence
atgaaggaacctggaccaaacttcgttactgtgagaaaaggcctgcactcattcaagatggctttcgtgaagcatctgcttctgtttctgtctccccgtctggagtgctcaggttccattactgatcattgttccctacatctgcctgtgcaggaaattttaatgtctcagcctcccgagcagctgggcctgcagaccaacctaggcaaccaggaatccagcgggatgatgaaactctttatgcccaggcctaaagtactggcgcagtacgaatcaattcaatttatgccctag

SEQ ID NO: 221252 - DNA, 276 bp, Artificial Sequence
  Description of Artificial Sequence: Synthetic coding sequence
atgaaagagccgggtccaaattttgtaacggtgagaaagggcttacactcattcaagatggcgttcgttaagcatcttctgctggagtgctcggggtctatcaccgatcactgctcactgcacctccctgttcaggaaattctcatgtcccagcctcccgagcaactgggcttgcagactaatctcggcaatcaagagtcttccgggatgatgaagttgtttatgccccgtcctaaagtgctcgcacagtacgagagcatccaatttatgccctag

SEQ ID NO: 221253 - DNA, 531 bp, Artificial Sequence
  Description of Artificial Sequence: Synthetic coding sequence
atggcctcatctagcgggaatgatgatgatttgaccattccacgggcagcaatcaacaaaatgattaaggagacacttccaaacgttcgtgtagcaaacgacgctcgggaactcgttgtcaactgttgtacagagttcattcacttgatctcaagcgaggcaaacgagatctgtaacaaatctgagaagaaaacaataagcccagagcatgtgatccaggctctcgaaagcttggggttcggctcatacatttccgaagtgaaggaggtgctgcaggaatgcaagacggtggcgctgaagcggagaaaagccagcagtaggctggagaacctaggaattccagaagaggaactactccgacagcaacaggagcttttcgctaaggccaggcaacaacaggccgagctcgcccagcaggaatggctccagatgcagcaggccgcacagcaggcacagctggcagcggcatccgcaagtgcttccaaccaggctggaagttcacaggatgaagaggacgacgacgacatttag

SEQ ID NO: 221254 - DNA, 531 bp, Artificial Sequence
  Description of Artificial Sequence: Synthetic coding sequence
atggcatctagttctgggaatgacgatgatttaaccatccctcgcgcagccataaacaaaatgataaaagaaacgctcccgaacgtcagagtggcaaatgatgccagagagctggtggttaattgttgtacagaattcattcacctcatttccagcgaggctaatgagatctgcaacaaaagtgagaaaaaaaccataagccctgagcatgtgatccaggcgctggaatctttaggtttcgggtcttacatctcggaagtgaaggaagttctccaagaatgcaagacagtggcgttaaaaagaaggaaagcatcgtcgaggcttgagaaccttggtattccagaagaagagctgcttcgccaacaacaagaactgttcgccaaggcccgtcagcaacaggctgagctcgcgcagcaggagtggctacagatgcagcaggccgctcagcaggcgcagctggctgccgcaagcgctagcgcgtctaatcaagccggtagctctcaggatgaagaagatgacgacgacatatag

SEQ ID NO: 221255 - DNA, 1470 bp, Artificial Sequence
  Description of Artificial Sequence: Synthetic coding sequence
atggaaagcatgttcagctcccctgccgaggcagctctccaaagggaaactggggtacctggactgttgacaccactgcctgacctggatggggtgtacgagctagagcgcgtggcaggattcgtgagagacttaggctgtgagagggtggccctccagttccccgaccagctgctcggagatgccgtggctgtggccgctcgtttggaggaaactacaggttcaaagatgtttattcttggcgatactgcttacggctcctgctgcgtggacgttctaggagccgagcaggctggggcacaggctctgatccatttcggccctgcctgcctgagccctcctgcacgcccactcccagttgcctttgtactgcgccaaaggagtgtggcgttggagctgtgcgttaaggcctttgaggcacagaacccagatccgaaagcccctgtggtgctcctcagtgagcccgcttgtgcgcacgctcttgaagccttggccaccctgttgcgccctaggtacttagacctcctcgtttccagtcccgcttttccccagcctgtcggcagtctctcccccgagcccatgcccctggaaagattcggtagaagatttccccttgccccaggtcgcaggttagaggaatatggagccttttatgtgggagggtccaaggccagcccagatcccgatctcgatcctgatttgagcagattgttgctgggctgggcgcctggccagcctttttcaagctgttgcccagataccggcaaaactcaggatgagggtgccagggctgggcgactgcgggctcgacggagatacctggtcgaacgggctagggacgctagggtggttggcttgctggctggaacgctaggcgtggcgcagcatcgcgaggctctagcccacctgcgtaacctcactcaggccgcagggaagcgcagctacgtgctcgccctcgggaggcccacccccgctaaactagctaattttcctgaagtggatgtgttcgttttgttggcctgccctctgggagctctcgcaccccagctgtctgggtctttctttcagcccattttggctccgtgtgagcttgaagcggcttgtaatcctgcatggccacctcctggtctggctcctcatctgacacactatgccgacctcctcccgggatcacccttccacgtggcccttccgccacccgaatctgagctctgggaaaccccagatgtgtcactgatcacgggcgacctgcgtccccctcccgcatggaagagttctaatgaccatgggtccctggcgctgactccccgaccacagctggagctagctgagtcctcccctgctgcttctttcctgtctagtcgatcttggcagggactagaaccgaggcttggtcagacacccgtgactgaggcagtatccggaagaagaggaatagcaattgcctacgaagacgaggggagtggctag

SEQ ID NO: 221256 - DNA, 786 bp, Artificial Sequence
  Description of Artificial Sequence: Synthetic coding sequence
atggagtccatgttctctagtcccgctgaggccgcattacagagagagactggagtcccagggcttttaactcctttgcccgatctggacggcgtctacgagctggagagggtagcagggtttgtgagggatctcgggtgtgaaagggtcgccctgcaatttccagaccagctgctgggagacgccgtggccgtggctgcccgactcgaagagaccaccggtagcaagatgttcatcctaggcgatacggcatatggctcttgttgcgtggacgtattgggggctgaacaagccggagcacaagccttgatccattttggccctgcttgcttgagccctcccgcacggccactgcccgttgcattcgtcctgcggcagaggtcggtcgcacttgagctctgcgttaaggcgtttgaggctcaaaatcccgacccaaaagcacctgtggtcctgctgagcgagcccgcttgcgctcacgccttaggcagtcccttccacgtagctctgcctcccccagaatcggaattgtgggagacccccgatgtatcccttattaccggcgacctaagacccccaccggcttggaagtctagtaacgaccatggctcgctggcattgactcctagaccccagcttgagctggctgagagctctcctgctgcctcttttctctcttctagaagttggcagggcctcgagccacgcctcggccagactccagttactgaggccgtatctgggcgtaggggcattgccattgcctacgaggacgaggggtctggctag

SEQ ID NO: 221257 - DNA, 1065 bp, Artificial Sequence
  Description of Artificial Sequence: Synthetic coding sequence
atgctgtggctgtggctccatgattggcggagacgccaaggtcaacgttgctccttctgggtaactcaacctactgccgaagccctagccacactactgaggccgaggtatctggaccttctggtttcgtccccggctttcccccagccggtgggctcgttgtctccagagccgatgcccctggagcggttcgggagacgatttcctctagccccagggaggagactggaggagtacggggcattctatgtgggcggatctaaagcctctccagaccccgacctggaccctgatctctcccggctgttgttgggctgggcccctggccagccgttcagctcatgctgtccggataccgggaagacacaggacgaaggcgctagagcagggagacttcgtgcaagaaggaggtatctcgtcgagcgcgctcgggatgcacgggtggtggggctgctggcaggaacactgggagtcgcccaacaccgggaagcactagcacacctccgcaacttgactcaagctgctggaaagcgctcttacgttctggccctgggaaggccaacacctgccaagcttgcaaatttccctgaggtcgacgttttcgttctgctggcttgccccttaggcgcactcgcgcctcaattgtctggcagctttttccagcccattttagcaccatgcgagctcgaggcggcatgtaatcccgcatggccccctccaggtctggccccacatctaacccattacgcagatctgcttcccggttcccccttccacgttgccttgcctccaccagagagtgaactatgggagacacctgacgttagtcttatcaccggcgacttgagacctcctcccgcatggaaatccagcaatgatcatggctctctagcacttacaccacgcccacagttagagctggccgaatcaagccccgctgccagttttctgtcatcaagatcctggcagggattggaaccacgcctcggccagacacccgtgacagaagctgtgagtggcagaaggggcattgccatagcctatgaagacgagggcagcggctag

SEQ ID NO: 221258 - DNA, 174 bp, Artificial Sequence
  Description of Artificial Sequence: Synthetic coding sequence
atggctgtcttccatgatgaggtggagatagaggacttccagtacgatgaagactccgaaacgtatttttatccatgcccgtgcggcgacaacttttccattacgaaggatcagtttgtctgcggtgagacagtcccagccccttctgcaaacaaggagttggtgaagtgttag

SEQ ID NO: 221259 - DNA, 249 bp, Artificial Sequence
  Description of Artificial Sequence: Synthetic coding sequence
atggccgtgttccacgacgaggtcgagatcgaagattttcaatacgatgaagacagcgagacatacttctatccatgcccttgcggcgacaatttcagtatcactaaagaggatctcgagaacggcgaggacgtagctacttgcccatcgtgttccctgattatcaaggttatctacgataaagaccaattcgtgtgcggcgaaacagttcctgcacccagcgctaataaggagctcgtgaagtgctag

SEQ ID NO: 221260 - DNA, 855 bp, Artificial Sequence
  Description of Artificial Sequence: Synthetic coding sequence
atgttgtatttgatcggactaggtctgggcgacgcaaaggacataaccgtgaagggtctggaagttgtgcgcagatgttctagggtctatctggaagcatatacttccgtgctgactgtggggaaggaagctctcgaggagttctacggtaggaaacttgtggtcgccgacagagaggaagttgagcaggaggctgacaatatcttaaaggatgctgacatctcggatgtggcttttttggtcgtgggagacccctttggagccactacccacagcgacttagtgctaagagctacaaaactgggcattccttaccgagtgatacacaatgcttccatcatgaacgcagtcggctgttgtggtctgcagctctacaaattcggcgagaccgtctccattgtgttttggaccgacacctggcgtcctgagtctttcttcgataaggtcaaaaaaaaccggcagaacggcatgcacacattgtgtttactggacatcaaggtcaaggaacagtccctggaaaacctcatcaaaggccgaaagatatatgaaccgcctcgatacatgtctgtgaaccaggccgctcagcagctcctcgagattgtgcagaaccagcgcattcgcggagaagaaccagtgacagaggagacactgtgtgttgggcttgcacgtgtgggcgctgacgaccagaaaatcgccgctgggacacttcggcaaatgtgcactgtcgatttaggcgagcctttacacagtctcataatcaccggaggttcaattcacccaatggagatggagatgctctccctcttttcgataccagagaattcttcagagtctcaatctattaatggactttag

SEQ ID NO: 221261 - DNA, 858 bp, Artificial Sequence
  Description of Artificial Sequence: Synthetic coding sequence
atgctgtatctgattggccttggattgggcgatgcaaaggatattactgtcaagggcctcgaggtagtaaggagatgcagtcgggtgtatttggaggcatacacctccgtccttaccgtcgggaaagaggctctggaggaattctatggaagaaagttagttgtcgcagatcgggaagaggtggagcaagaagccgacaacattcttaaggacgctgacataagtgacgtcgcttttttggtcgtcggcgacccatttggggctacaacccactccgacctggtattaagggccaccaagttgggcataccatatcgtgtaatccacaatgctagcatcatgaatgctgtgggctgttgtggactgcagctttacaaattcggcgagactgtgtccattgtgttctggaccgatacttggcgccctgagtccttttttgataaggtgaaaaagaaccggcagaacgggatgcatactctgtgcctcctcgacattaaggtgaaggaacaatctctggaaaacttaataaagggcaggaaaatttacgaacccccaaggtatatgagcgtgaatcaggccgctcaacaattgctagaaattgtacaaaatcagaggatcagaggcgaagaacctgccgtgacagaggaaaccctttgcgtgggcctcgccagggttggcgctgatgatcaaaaaatcgcagctggtactctgagacagatgtgcaccgtggatctcggcgagccactgcactcgttgatcattaccggtgggagcattcatcctatggagatggagatgttgtctcttttttccatacccgagaattcatccgaatcacagtctattaacggcctttag

SEQ ID NO: 221262 - DNA, 705 bp, Artificial Sequence
  Description of Artificial Sequence: Synthetic coding sequence
atgctgtatctcatcggtctaggactcggcgatgccaaggacattactgtaaagggtctggaagttgttcgccgttgctctagggtgtaccttgaagcctacacctcggtactgacagtcggtaaggaggctttggaggagttctatggcagaaaactcgtcgtggccgatagggaggaggtcgagcaggaggcagacaatatcctgaaagatgccgacatctctgacgtcgctttcctggtcgtgggcgaccccactgatacctggaggcccgagtccttcttcgataaagtgaaaaagaaccgccagaacggcatgcacacgttgtgtcttctggacattaaagtcaaggagcaaagtttggaaaatctgatcaaaggaagaaagatatacgaacctccaaggtatatgtccgtgaaccaagccgcacaacagctgttggagatcgtgcagaaccaacgaatcaggggagaggagcccgcagtgacagaggagaccctctgcgtgggactggccagggtcggagccgatgatcaaaagatagctgccggtaccctgcgacagatgtgtacagtggatttgggcgagcctttacacagcctgattatcacagggggttctatacaccctatggagatggagatgctctcattgttcagcattcctgagaattcctcagagagccaaagcataaatggactgtag

SEQ ID NO: 221263 - DNA, 141 bp, Artificial Sequence
  Description of Artificial Sequence: Synthetic coding sequence
atgtgcacagttgacttgggcgaaccgctccatagcctgatcatcacagggggaagtatacatcccatggagatggaaatgctctcattgttctccatcccagagaattcctccgaatcacagtccatcaacggactgtag

SEQ ID NO: 221264 - DNA, 855 bp, Artificial Sequence
  Description of Artificial Sequence: Synthetic coding sequence
atgctgtaccttattggattgggacttggcgacgctaaagatattacagtgaagggcctagaagtcgtccgccgttgtagccgagtctacctggaagcttacacaagcgtgctgacagtaggaaaagaagcactggaggagttctacggtagaaaactcgttgtggcggaccgagaagaagtagagcaagaggctgacaatattctcaaggatgccgatatatcagacgtcgcttttctggtggtgggcgaccctttcggagctactacccattcggaccttgtgttgcgtgcaaccaagctgggaattccttatagagtgatacataatgccagcattatgaacgcagtgggatgttgcggtcttcagtacatctctctggagagacaatttctgttgttttttggtcagacacttggccctgagagttttttcgataaggttaagaagaatagacaaaatggcatgcacaccctgtgtctgctcgacattaaagtgaaagaacagagcttggaaaaccttataaaaggacggaaaatttatgaaccccctagatacatgtccgtgaaccaggcggcacaacagctgctggagattgttcaaaaccaacgcatacgaggcgaggagcccgcagtcacggaggagaccctgtgtgtcgggctggcacgcgtcggcgcagacgaccagaagattgccgctggaacgctcaggcagatgtgtacggttgacctcggcgagccactgcacagcctgatcatcactggagggagcattcatcctatggaaatggagatgttgagtctgttctctattcctgagaactccagcgaatcccagtctattaacggactgtag

SEQ ID NO: 221265 - DNA, 858 bp, Artificial Sequence
  Description of Artificial Sequence: Synthetic coding sequence
atgctgtatctgatcgggcttggccttggagacgccaaagatattacagtcaaaggcctagaggttgtgagacgttgctcccgcgtgtatttagaagcttacaccagtgtactcaccgtcgggaaagaggccttggaagaattctatgggaggaaactcgtagttgccgatagggaagaagtggagcaggaggccgacaatatacttaaggatgcggatatctctgatgttgcctttctggtggtcggggatccatttggcgcaaccacacatagtgacctggtgctgagggctactaagctgggtattccatatcgggttatccataacgccagcatcatgaacgctgtagggtgctgtggccttcagctttataagtttggcgaaaccgtgagcattgtgttttggacagacacgtggcgtccggaaagcttttttgataaggtcaaaaaaaatcgccagaatgggatgcacacgctctgtctgttggatattaaggtgaaagagcagagtctggaaaacctaattaagggtagaaagatatatgagcctcctcggtatatgtccgttaatcaagcggctcagcagctactggagattgtgcagaaccagagaatcaggggggaggagccggctgtgaccgaagaaactctgtgcgtgggactggcccgagttggcgctgacgaccaaaaaattgctgcagggaccctgcgccagatgtgtacggtcgacctaggggagcctctccacagtctcatcatcacaggcggatccatccatcccatggagatggagatgctttcactgttttctattccggagaactcttctgagagtcagagcatcaatggtctgtag

SEQ ID NO: 221266 - DNA, 2028 bp, Artificial Sequence
  Description of Artificial Sequence: Synthetic coding sequence
atggagggacggccaccaccggaggggagaccccctcctagaccacgcactggcagagctcctcgcggtcgcagaagggctgtattcgccgctgtgcttcattggagccacattacccacttattcgaaaacgatagacacttctcccacctgtcgacactggaacgtgagatggctttccgaacagagatgggcctgtactacagctacttcaagacgatcgtggaggcaccatctttcttgaatggggtgtggatgatcatgaacgataagctgacggaataccctcttgtgatcaataccctcaaacgctttaacctgtatcccgaggtgatactagcctcctggtataggatctacaccaagattatggacttgattgggattcagactaagatatgctggaccgtgactcgtggtgagggcttgtcgcccatcgagtcgtgtgaggggctcggagaccctgcatgtttctatgtagcggtcatctttatacttaacgggcttatgatggcactgttcttcatctatggaacctatttaagcggatctcgtctgggaggacttgtcacagtcttatgcttttttttcaatcatggcgaatgtactcgggtgatgtggacccctccactcagagagtctttttcttaccccttcctggtgcttcagatgctgttggttacacacatccttcgcgcaactaagctgtataggggctccctgatcgccctgtgtatcagcaatgtcttcttcatgctgccctggcagtttgcacagtttgtgctgctcacacaaatagcaagtctgttcgccgtgtacgtggtgggctatatcgatatttgcaagcttcgcaagatcatctacatacatatgatcagcctggcactctgcttcgtcctgatgtttggtaactctatgctattgacctcctattacgcatcgtccctggtgataatttgggggatactggctatgaaaccccacttcctgaaaatcaacgtaagcgagctatccctgtgggtgattcagggttgtttctggttgttcggcacagttatactgaaatacctgacatctaagatatttggcattgcagatgacgcccatattggtaacctgctaactagtaagttctttagttacaaggatttcgacacccttctatatacatgtgcagccgaattcgactttatggagaaggagaccccgctacggtatacaaagaccctgctgctgcctgttgtgctggtcgttttcgtcgcgattgtgaggaagattattagcgacatgtggggggttctggctaagcagcagacgcacgtcaggaagcaccagttcgatcatggggagttagtttaccacgcgctgcagctgcttgcatacactgctttgggtatcttaatcatgaggttaaagctgttcttaacccctcatatgtgtgtgatggccagcctgatttgcagcagacaactttttggctggctcttttgtaaggtgcaccctggggctatcgtttttgcaattctcgctgccatgtctatccaggggtctgctaacctccaaacccaatggaatatcgtgggtgagttttccaacctaccacaggaagagttgatcgagtggataaagtacagcactaagcctgatgcagttttcgctggcgctatgcctaccatggcgtccgtgaaactgtccgctcttaggccaattgtgaaccatccgcactacgaggatgccggtctgcgggcacggacaaagattgtatatagtatgtactcaagaaaagccgcagaggaggtgaaaagggaactcataaagctcaaggtcaattattacattctggaagaaagctggtgcgtacgcagaagcaagcccggatgtagcatgccagagatctgggatgtggaggatcccgctaatgccggaaaaacaccgctgtgtaacctcctcgtaaaggacagcaaaccccactttacaaccgtattccagaactcagtttacaaggtgctggaagtcgtaaaggagtag

SEQ ID NO: 221267 - DNA, 258 bp, Artificial Sequence
  Description of Artificial Sequence: Synthetic coding sequence
atgtactcgcggaaagcagccgaggaggtgaaacgcgaactgatcaaactgaaggttaattattacatccttgaagaatcatggtgtgtgagacgaagtaaaccaggatgctctatgcccgagatatgggatgtggaggaccctgctaatgcaggtaaaacacccctctgcaacttactggttaaggattctaagccccactttaccacggtgtttcagaattctgtgtacaaggtccttgaagtagtgaaggaatag

SEQ ID NO: 221268 - DNA, 2277 bp, Artificial Sequence
  Description of Artificial Sequence: Synthetic coding sequence
atgaggaagcaaggcgtctccagcaaacgtctccagtcatctggacgcagtcaatctaagggaagaaggggtgcctcactagccagggagcccgaggtggaggaagaaatggaaaaaagtgccttgggcggtggaaaactgcccagaggctcttggagaagttctcccggtcgcatccagtctctaaaagagagaaagggtcttgaactggaggtggtggctaagacattccttctgggaccatttcagtttgtgcgtaactccttggcacagttacgggagaaagtccaggagcttcaggcaagaagattctcatctaggacaacattggggatcgccgtttttgtcgcaattctccactggctgcacctggtcactctgttcgagaacgaccggcatttttcacaccttagcagcctggagcgagagatgacattcagaactgagatgggactttactacagttacttcaagacaattatcgaagccccatcctttcttgaaggactgtggatgataatgaatgatcgattgacagagtacccactgatcattaatgcgatcaagagattccatctgtaccctgaggtgattattgcttcgtggtattgcaccttcatgggtatcatgaatcttttcgggctggagacgaagacctgctggaacgtgacaagaatagagcccctgaatgaggtgcagagttgtgaaggactgggggacccggcatgcttttacgtgggtgtcatattcatcttgaacggcttaatgatgggtctgttttttatgtacggtgcatatctgagtgggacgcaactgggagggctaatcacggtcctgtgcttcttctttaatcacggcgaagctactagagtgatgtggacacctccgctgcgtgagtctttctcctatccttttctcgttctgcagatgtgcattctgacattaattctgagaacctcgtcaaacgaccggaggcctttcatcgctctgtgcttgtctaacgtggccttcatgctgccgtggcagttcgcgcaattcattttgttcacccagatagcctccctgtttcctatgtacgtggttggttatatagagccctctaagttccagaaaattatctacatgaacatgatctcagtgaccctgtcattcatactgatgttcggtaactctatgtacctgagtagctattactccagcagcttactcatgacgtgggctatcatactcaagcgtaacgaaatccaaaaactgggtgtttccaaactaaatttttggctgatccaggggtctgcctggtggtgtggcactatcatcctcaaattcttgaccagcaagatattaggggtgtctgatcacatccgtctgtcagaccttatagccgctagaatcctgcgttacaccgactttgacactctgatctatacctgcgctccggaatttgatttcatggaaaaggctacccccttacgctacacgaaaaccctgctcctccccgtagtgatggtgattacttgttttatcttcaaaaagacggtacgagatattagctatgtactggccaccaacatttacctgaggaagcagttgcttgagcactccgaactggcttttcatacattgcagctgctggttttcacagctttagccatcctgatcatgagactgaagatgtttctgaccccccacatgtgtgttatggcttccctcatctgttctaggcagctgtttggatggttgttccgcagagtgcgctttgaaaaggtaatcttcgggattctgacggtgatgagtatccagggttatgctaacctgcgtaaccagtggtctattattggcgaattcaacaatttaccccaggaagagctgctacagtggatcaagtactctactacatccgacgctgtctttgcgggagcgatgccaaccatggcctctataaaactgagcacactccatcctatagtgaaccatccccactacgaggatgcagatcttagagccaggacaaagatcgtttattctacctactctaggaagagcgccaaggaggtgcgggacaagctcttggagcttcatgtgaactactacgtccttgaggaggcctggtgtgtagtgaggaccaagccaggctgcagcatgttggaaatctgggatgtggaggatccatctaacgctgctaaccccccactgtgttcggtgctactcgaggacgcccgtccctacttcacaaccgtgttccaaaatagcgtgtatcgcgtattaaaggtcaactag

SEQ ID NO: 221269 - DNA, 618 bp, Artificial Sequence
  Description of Artificial Sequence: Synthetic coding sequence
atgagactcaagatgttcctgactccccacatgtgcgtgatggcatcactgatttgttcacggcagctcttcggatggctgttccgtagagttaggttcgaaaaggttatctttggcatattgacagtaatgtccatccagggctacgcaaatctgcgcaatcaatggtcgataatcggcgaattcaataatttaccccaggaggagctgctacaatggataaaatactccaccacttcagacgcagtcttcgcaggtgcaatgccaacgatggccagtatcaagctgtccactctgcatcctattgtcaaccatccacactacgaggatgctgacctgcgcgcacgcactaaaattgtgtacagtacctactcacggaagtcagctaaggaagtgcgagataagctgctcgaactgcatgtgaactattacgtcctggaggaggcatggtgtgtagtgagaaccaagcccggatgttccatgctggaaatttgggacgtggaggatccttctaatgcagcaaacccccctctctgttcagtcttattggaagacgctcgcccttacttcacaactgtttttcagaattctgtgtatcgagttctcaaagtgaactag

SEQ ID NO: 221270 - DNA, 273 bp, Artificial Sequence
  Description of Artificial Sequence: Synthetic coding sequence
atgcgcaagcagggggtgtccagcaagagattgcagtctagtgggcgttctcagtcgaaagggaggagaggtgcttcattggccagagagcccgaggtggaagaagagatggaaaagagcgccctgggtggcggaaagctgccgagggggagttggcggtcttcacccggacggatccagagccttaaagaaaggaagggcctggagctagaggtagtagccaaaacttttcttctgggaccgtttcagttcgttagaaacagtttagcatag

SEQ ID NO: 221271 - DNA, 1629 bp, Artificial Sequence
  Description of Artificial Sequence: Synthetic coding sequence
atgatgtccatccgccagcgaagagaaattcgagccactgaggtgtctgaagattttccagcgcaggaagaaaatgtgaaattggaaaacaaactacctagcggatgcacgtccaggcgcctctggaagatactctcgctgaccattggcggtacaattgctttgtgtatcggacttctgacctcagtgtatctggccacgcttcacgaaaacgacctttggttcagcaacattaaagaagtggagagagaaatttcttttcggactgaatgtggcttgtattacagttattataagcaaatgttgcaagctcctactttggtccaggggtttcatggcttgatttacgacaacaaaacagagtccatgaaaactatcaacctgcttcagcgcatgaatatataccaggaagtgtttttaagcatattgtatcgggttctgccaattcagaagtatctggagccggtgtatttctacatatacaccttatttggactacaagccatttatgtgactgccttatatataactagttggctattgtcgggtacttggctgagtggactgctggcagctttttggtacgtgaccaaccgaatcgacacgactcgagtggaattcactatacccctacgcgagaattgggctcttccattcttcgccatccagatcgccgctataacttattttcttcggccaaacctccagcccctgtcagaaaggctcactctcctggctatttttattagcacctttctgttttccttaacttggcaatttaatcaatttatgatgctcatgcaagccctcgttctatttaccctggacagcctggatatgttgccggcagtgaaagcaacatggctgtacggcatccagattactagcctgctactggtctgcattctccaattctttaacagcatgattttaggatccctcctgataagctttaatctgtccgtgtttatagcacgcaagctgcagaaaaacctgaagacggggagtttcctcaatcgattgggtaagcttttgcttcaccttttcatggttctttgtcttaccctattcctgaacaacattattaagaagatcctgaacctgaaatccgacgagcacatatttaaatttctgaaggctaagttcggcttgggcgctacccgcgacttcgacgccaacttgtatctgtgcgaggaggcttttgggttgttaccattcaatacattcggtagactctccgacacactgctgttctacgcctacattttcgtcctctcgatcacggtcatagtggcctttgtagtagcctttcataatctcagtgattccacgaatcagcagagcgtgggcaagatggagaagggcaccgtcgatctgaaacctgagactgcctacaacctcatacataccattttgttcggtttccttgccctgtccacgatgcgcatgaagtatctgtggacatcacatatgtgcgtctttgcgagcttcggcctgtgtagtccggagatctgggagctgctgctgaagtccgtgcacctttacaaccctaagcggatctgcattatgagatatagtgtgccaatcttaattctactgtacctttgttataaaaatcagaaatcctag

SEQ ID NO: 221272 - DNA, 2151 bp, Artificial Sequence
  Description of Artificial Sequence: Synthetic coding sequence
atgatgtctattaggcagcgtcgcgagattagagctacggaggtgtctgaagacttccccgctcaagaggagaatgtgaagcttgagaacaaacttccgtctggatgtacttcacgtcgcctgtggaaaattctgtccctcacgatcggcggtacgatcgctctgtgcatcggcctcctgacctccgtatacttagccaccctgcacgagaatgacctgtggttcagtaacatcaaagaggtcgagagagaaatcagtttccggactgagtgcggtttgtattactcgtactataaacagatgctgcaggctccaaccctggtgcaggggttccacggcttgatctatgataacaagaccgagagcatgaagactataaaccttttacaaagaatgaacatttaccaggaggtgttcctgtcaattctctaccgtgttctgcctatccagaaatatctcgagcccgtttatttctatatctacaccctcttcggcctgcaagcaatttacgttacagctctgtacattactagttggttactgtccgggacttggttgagtggactcctggccgctttttggtatgttaccaacaggatcgacactacgcgtgtggaattcacaattccactacgagaaaattgggctctgcctttcttcgctatccaaatcgctgcgatcacctactttcttaggccaaacttgcagcctctctcggaacgactgaccctcttggcaatcttcatcagcacttttctgttcagccttacctggcagttcaaccaattcatgatgctcatgcaggctctggtgctcttcactctcgacagtctggacatgctccctgctgtaaaggcgacctggctgtatggcatccagatcacaagcctgctgctagtgtgtatcctgcagttctttaattccatgatcctgggttcacttctgattagtttcaacctatcggtgtttattgcacggaaactccagaaaaatttgaagactggttcttttctcaaccggctcgggaagctactgctccatttattcatggtcctctgcctgaccctgtttctcaataatattatcaagaagattttaaatttgaagtccgatgagcacatctttaagtttttgaaggcaaaatttggcctgggtgccaccagagatttcgatgccaacctttatctgtgcgaagaggctttcggcctcctgcccttcaataccttcggcagactgtcagacactctgctcttttatgcatacatttttgtcttgtctatcacagtgatcgtggcgttcgtggtcgcattccacaacctgagcgattccaccaaccagcagtcagtgggcaagatggagaagggaacagtggatctcaagcccgaaaccgcttacaatttaatacataccattctgtttggctttctggctctatcaaccatgcggatgaaatacctttggactagccatatgtgtgttttcgcctctttcgggctttgctctccggaaatttgggaactcctgttgaaatcagtccatctttacaatcccaaaaggatttgcattatgaggtatagcgtgcccatactgatcctgttgtatctctgttacaaattttggcccggtatgatggacgagttaagcgagcttagggagttctacgaccccgacactgttgaactgatgaactggatcaattctaacacacccagaaaggcggttttcgccggtagtatgcaactgctagctggtgtcaagctgtgcactggaaggacgctgaccaaccatccacattatgaagactctagcttgagggaacgcacgcgcgcagtgtatcaaatctacgctaaacgcgcaccagaggaggtccacgcactgctgagatcgtttgggacagactacgtaatactggaggattccatttgctacgagcgcagacaccgcagagggtgccgccttagggatcttcttgatatcgccaacggacacatgatggatggcccaggtgagaatgacccagacctgaagcccgcagatcatcccaggttctgcgaagagatcaaaagaaacctcccaccttacgttgcctacttcaccagagtatttcagaataagacgtttcacgtctataaattaagtagaaacaaatag

SEQ ID NO: 221273 - DNA, 342 bp, Artificial Sequence
  Description of Artificial Sequence: Synthetic coding sequence
atgatgtcgattcgacagcgcagagaaattcgcgctaccgaggtctctgaggattttccggctcaagaggagaacgtaaagctcgagaacaaactgccctccggatgcactagccgaaggctctggaagatcctgagcctgaccataggagggaccctgccttttgccctggattttctacacctatctactctcccaagatacatgaagatgatctacggcttcctgattttaaggaagtggtctgagaagagccatagcgagcagtcagtggcatgtatcactcccaccacctccagatgttgtcggctgcagcctagttgcaaagtgttcatggcttag

SEQ ID NO: 221274 - DNA, 2151 bp, Artificial Sequence
  Description of Artificial Sequence: Synthetic coding sequence
atgatgtccatcaggcagcgcagagagatcagagccacagaagtgtctgaggatttcccagcccaggaggagaacgtcaagctggagaacaaattacccagcggctgcacttcacggcgactttggaaaatcctatctcttactatcgggggtacaattgccctgtgtatcggtctgctgacgagcgtgtaccttgctacactccacgaaaatgatctgtggttcagtaacattaaagaggtggaaagagagatcagttttaggacagagtgcggactgtactactcctattataagcagatgttacaggcaccaacccttgttcagggttttcacggactcatatatgataataaaacagagagcatgaagaccataaacttgttacagcggatgaacatataccaagaggtgttcttaagcatcctttacagagtgctccctatacagaagtatctagaaccagtttacttttatatctatactctgttcggccttcaagctatttacgtaacagcactttacatcacctcctggctcctctcgggcacctggctttcggggctgctagccgctttctggtatgtgaccaaccgcatcgacactacccgggttgaatttactatcccactgagagagaactgggccctgccattctttgccatacagattgccgctattacctattttttgcgcccaaatttacagccgctgagtgagcggttaacactgctggcaatattcatatctacttttttgttcagccttacgtggcagtttaaccagtttatgatgttaatgcaagccctagtgctattcactctggactctctggacatgctcccggctgttaaggcaacatggctgtacggaattcagatcacaagcctccttctcgtgtgtattctgcaattttttaactctatgatcctaggtagcctgctcatctcattcaatttgtcggtctttatagctagaaagctgcaaaaaaacttgaagacgggcagttttttaaatcggcttggaaaactcctgctccacctgtttatggttctgtgcctcactctgttcctcaataatatcataaagaagatcttgaatcttaaatcagacgagcatatattcaaatttctaaaggccaagttcggactgggagcaacccgggattttgacgcgaacctgtatctctgtgaagaagcttttggtttgcttccctttaataccttcggccgactgtccgacacactcctcttctatgcctacattttcgtcctttctattactgtgattgtggctttcgtggtggccttccacaatttgtcagacagtacaaaccagcaaagcgtggggaagatggaaaagggcaccgtcgatttgaaacccgagaccgcctacaaccttatccacacgattctgtttggcttcctggctttgtcaactatgaggatgaagtacttatggacaagccatatgtgcgtgttcgcctcttttggcctgtgctcgcccgagatctgggagctgctgttgaagagtgtgcatttgtataaccccaaaagaatatgtattatgagatattctgttcccatcttgattctgctttatctgtgctacaagttctggccgggtatgatggacgaactgagtgagctgagggaattttacgatcccgacacggtggaattaatgaattggatcaattcaaatacaccacgcaaagccgtgttcgcaggttccatgcaacttctggcgggtgtgaaactctgcacaggacgcaccctgacaaaccatccccactacgaagacagttcgctgagagaaagaacaagagccgtctatcagatctatgctaaaagggcacccgaggaggtgcacgccctgctgcgcagttttggcacagactacgtaatcttggaagacagtatatgttacgagcggaggcacagaagaggctgtcgtttgcgcgatctcttggacattgcaaacgggcacatgatggatggaccaggtgaaaatgacccagatcttaagcctgcagatcatccacgcttctgcgaagagataaaacgcaatctgcctccctatgtggcctatttcacaagagtgttccagaacaagacattccacgtctacaagttatctcgaaataagtag

SEQ ID NO: 221275 - DNA, 2172 bp, Artificial Sequence
  Description of Artificial Sequence: Synthetic coding sequence
atggctgaagaggaggggcctcccgtagaattgaggcagaggaaaaagcccaagtcctctgagaacaaggaaagtgcaaaggaagagaagattagcgacattcctattccagaacgcgctccaaaacatgtactgttccagcggtttgccaaaatatttattggttgcctggccgctgtgacatcgggaatgatgtacgccttgtacttgagcgcttaccatgagcggaaattctggttcagtaataggcaggagctcgagcgcgagatcactttccagggggattctgctatctactatagttactataaggacatgttaaaagccccatcatttgagcgcggagtgtacgagcttacacataataataaaacagtgtctctgaaaaccatcaatgctgtgcagcagatgtcgctgtatcccgaactgatcgcttccattctgtatcaagccaccggtagtaatgagattatcgagcccgtatacttctatattggaatagtcttcggccttcaaggaatttatgttaccgccctttttgtaacctcttggcttatgtctggcacatggctggctggaatgctgacggtggcttggtttgttattaatcgcgttgatacaacccgcatcgaatacagcatcccattacgagagaactgggcgttgccatattttgcgtgtcaaatcgcagccttgaccggatacctgaaaagtaacttgaacacttacggggaacgcttctgctacttgctaatgtcggcttcaacatatacctttatgatgatgtgggaatactcgcattacctcctgttccttcaggccataagtctctttctgctggacacattttcggttgagcagagtgataaggtgtacgaagtgtacaagatctatatcttttccctgtttttaggatatttgctccaatttgagaatcccgcactgctagtgtcgcctctcctgtctctcgtggccgctcttatgctggcgaagtgtctacaactaaacgtgaagaaggggtccttcgtcgccaagattatcaaggttataaatttctaccttgtgtgtactttgacaattactctcaatatcattatgaagatgttcgtgccccacaaagagaatggtcatatgctgaaattcctggaagtgaaatttggccttaacatgaccaagaactttacaatgaattggctcctgtgtcaagagtctcttcaggccccttctcaggatttcttcctcagactgacacagagcagtctgcttcccttctacatcctggtgttgattatctgtttcctcagcatgctccaagtgatattcaggagaatcaacggtaagagcctcaaagaaacagtgactctggaggatgggcgtatcggcgagagaccagagattatctaccacgtgattcacactattctgttgggctctctggcgatggtgatagaaggactgaagtacatttggatcccatatgtctgcatgctcgccgctttcggtgtgtgcagtcctgagctgtggatgaccttgttcaagtggctgcgcctgcgcaccgtgcatcccatcttgctcgccctgatcctgagtatggcagtcccgacaatcatcggcctgtccctgtggaaagaattcttccctcgtctgatgaccgaattgatggagctacaggaattttatgaccccgacactgtggagctgatgacttggatcaaacgtcaagcacctgtggccgcagttttcgccggttctccgcagctaatgggagccatcaagctctgcacggggtggatggtgacaagcctgccactgtacaatgacgatgaccttctaaagagaaacgagaatatttaccagatttacagtaaacgatccgcagaggacatctacaagattttgacaagttacaaggctaactacctcatagtggaggatgctatctgcaacgaggtgggtccaatgcgaggatgcagagtaaaggacctgctggacattgcgaatggccacatggtgtgtgaggagggcgataagctcacatactcaaagtacggcagattttgtcatgaggtgaaaatcaactatagcccttacgtgaattatttcactcgagtatattggaatcgatcctatttcgtttacaagatcaacacggtcatcagtttccaatcttag

SEQ ID NO: 221276 - DNA, 300 bp, Artificial Sequence
  Description of Artificial Sequence: Synthetic coding sequence
atggaaccggagcagatgctcgaaggccagacccaggtcgccgagaatcctcatagtgagtatggattgactgacaatgtggaaagaatagtcgaaaacgagaagataaatgctgaaaagagttctaaacagaaagtggacttgcagtctctgccaaccagggcctacctcgaccaaaccgtggtacccattctccttcaaggcctcgctgtacttgccaaagagaggcctccaaatccaatagagtttctagcttcatatctgctcaaaaataaagcccagtttgaggacagaaactag

SEQ ID NO: 221277 - DNA, 300 bp, Artificial Sequence
  Description of Artificial Sequence: Synthetic coding sequence
atggagccagaacagatgttggaaggtcaaactcaagtggcagagaatccgcattctgagtatgggcttacagacaatgtggagagaatagtggaaaacgagaagattaatgcagagaagtcatccaagcagaaggtggacctgcaatctttgccaacacgagcctacttggaccagactgtggtccctattctgttgcaaggtctggcagtactggcgaaagaaagacccccaaaccccatagaatttctggctagctacctcctgaagaacaaggcgcagtttgaggatagaaactag

SEQ ID NO: 221278 - DNA, 1956 bp, Artificial Sequence
  Description of Artificial Sequence: Synthetic coding sequence
atggctggacacccctggcacggtaccgcagccctcgcttctagtcaggcctggagagatggcagagagaggcaggctcttgtttcttgtcgggcactgtatacctacgaggacggatctgacgacttgaaactagcagcctcgggcgagggaggtctccaagaattgtcaggccacttcgaaaaccagaaggtgatgtacggcttttgttccgtgaaggactcacaggcagctcttcccaaatacgttctgattaattgggtgggggaagacgtcccggacgcacgaaagtgcgcgtgcgcatctcatgtcgccaaggtggcagaattcttccagggggtggacgtcatcgttaatgccagctcagtggaggacatagacgctggtgctattgggcaacgcctctctaatggcctggcccgactgtcatcacctgtgttgcaccgtttacggctgagggaggatgagaatgccgagccagtggggaccacttaccaaaagacggatgctgcagtggaaatgaaaaggatcaacagggagcagttttgggaacaggctaagaaggaagaagagttgagaaaagaggaagagaggaagaaggccttggacgagagactgcggttcgaacaagagaggatggagcaggagcgacaagagcaggaggaacgtgagcgcaggtatcgagagcgtgaacagcagatagaagaacatagacgcaaacagcagactctcgaagctgaggaggccaagagacgcttgaaagaacagtctatctttggcgaccatagggatgaagaagaggaaactcacatgaagaagtctgaatctgaagtggaggaggccgctgctattatcgcccaacggcctgataatcctagagaattcttcaaacagcaagagcgcgtggcaagcgcctcggcgggatcatgcgacgtccccagcccctttaaccaccgcccaggatcacatctcgactctcataggcggatggccccaacaccgattcccactaggtccccctcagatagttccacagcctctaccccagtagccgagcagatagaacgagctctggacgaagtgactagctcccagcccccacccctcccgcctccacccccacccgctcaggagacccaggaaccttccccaattctcgactccgaagaaaccagagcagctgccccacaggcttgggccggtcctatggaagagccaccacaggcccaggcgccaccgcgtggccctgggagtccggctgaagatttgatgtttatggaatcagctgaacaagccgtcctggcagcccctgtagaacctgctaccgcagatgcaaccgagatacacgacgctgccgacacgatcgagacagacactgcgacagcagataccactgtggctaataatgtgccaccagccgctacgtccctcatcgatctgtggcctgggaatggcgagggcgctagtaccctccagggtgagcctagggctccaaccccgccatccggaacggaagtaactctggccgaagttccgcttcttgatgaggttgcgccagagccgctactccctgccggagagggttgtgcgactcttctaaactttgacgagctgcccgaacctcccgcaacattctgcgacccggaagaagtggagggcgagtcactcgctgcaccccaaacaccaaccctgccctcggcgctcgaggagcttgagcaggagcaggagcccgagcctcatcttctcaccaacggagaaacaacgcagaaggaaggcacacaagcttccgaagggtactttagccagagtcaggaggaggagttcgcccagagcgaggagttgtgcgcaaaggctccccctcccgttttctacaacaaaccccctgaaattgatattacatgctgggacgccgatccagtgcctgaggaggaagaagggttcgagggcggagactag

SEQ ID NO: 221279 - DNA, 1950 bp, Artificial Sequence
  Description of Artificial Sequence: Synthetic coding sequence
atggcaggcgtatccttttcaggtcacaggctggagttgctcgctgcgtacgaagaagtcatccgggaagagagtgccgcagactgggctttgtacacctacgaggacggatctgacgatcttaagctcgcagccagtggtgaagggggtctgcaggagctgagtggacatttcgaaaaccaaaaggtcatgtacggcttctgctcagtgaaagactctcaagcggcactcccaaaatacgtgctgattaactgggttggggaggacgtgccagatgcacgcaagtgtgcgtgcgccagccacgtagcgaaggtggccgaatttttccaaggtgttgacgtgattgtgaatgcaagtagcgttgaagatattgatgcaggggcaatcggtcagcgactgtctaatgggctggcaaggctttccagtccagtgcttcaccgcctgaggctaagagaggacgagaacgcagaacccgtggggacgacttaccagaagaccgacgctgctgtggagatgaagcggatcaaccgggagcagttctgggagcaggctaaaaaagaggaagaactacgcaaggaggaggaacgtaaaaaggctcttgatgaacgcctcaggtttgagcaggagaggatggagcaagaacgacaagagcaggaggaacgggaaagacgctaccgggagcgagagcaacagattgaggagcatcggcgtaagcagcagacgctggaagcggaagaagctaagcgcagattgaaggaacagtctatttttggtgaccacagggatgaggaggaggagacgcatatgaagaaaagcgaaagtgaagtggaggaggctgccgctataattgctcagcgcccagacaatccgcgtgaatttttcaagcagcaagagagggttgctagcgcctccgccggatcctgcgatgtgccttctcctttcaaccacaggcctgggagtcacctggattctcatcggaggatggcacccaccccgatccccacacggagcccaagcgactcgtcaacagcatcaactcccgtcgctgagcagatcgaaagagccctcgatgaagtgacttcttcacagccccctccgcttccccctccgccaccccctgctcaagaaacacaagagccatcaccaatactggacagtgaggagacgcgagccgctgctcctcaggcttgggccggtcccatggaggagccccctcaggcacaggctcccccaagagggccagggagccctgccgaggacctgatgtttatggagagtgcagaacaggccgtgcttgcagcaccagtggagcctgccacagctgacgcaactgagatccacgacgctgctgacactatcgaaacggatacagccacggcagacacaaccgtggctaacaacgtcccaccagccgctacgtccctaatagatctctggcctggcaatggagagggtgccagcactctccagggtgaacctcgggctcctaccccgccaagcggcaccgaagtgacactggccgaggtaccactgctggacgaggtggctcctgaaccactccttccagctggcgaagggtgcgccactctgcttaacttcgacgagctaccagaaccgcctgccaccttctgcgatccggaagaggtagagggggagtcgctggcggctcctcagacccctaccttgccctctgcacttgaggagctggaacaggagcaggagccagagccccacctgctgaccaacggagaaactacccagaaagaggggacacaggcttccgagggttacttttcacagtctcaggaggaagagtttgcccagtcggaagagctgtgcgccaaggctcctcctcccgtcttttataataagccaccagaaatcgacattacatgctgggatgccgacccagtcccagaagaggaagaaggattcgaaggaggagactag

SEQ ID NO: 221280 - DNA, 1146 bp, Artificial Sequence
  Description of Artificial Sequence: Synthetic coding sequence
atgaaaaagagcgaaagtgaggtcgaggaagctgccgctatcattgcacagcgaccagacaaccccagagaattctttaaacagcaggagcgcgtcgcgtcagccagtgccggttcctgcgatgtgcctagtcctttcaaccatagaccaggaagtcacttagattcacataggcgtatggctccaacccccatcccgactcggtcgccctctgacagtagcacggcaagtacacccgttgctgaacagatcgaacgtgccctggacgaagtgacttcttctcagccaccgccactgccgcctcccccaccccctgcccaggagactcaagaaccaagcccaatcctggattcagaggaaaccagggccgctgctccccaggcttgggccggacctatggaggaaccccctcaggcccaagccccaccgcgtggcccaggcagccctgccgaggacctgatgttcatggagagcgcagagcaggctgtactcgccgctcccgtggaacccgcaaccgccgacgccacagaaattcacgatgccgcagacacgattgagacagacacagccaccgcagataccacagtcgccaacaacgtccctcccgctgcgacttctctaatagatctgtggcccggaaatggcgaaggggcaagtaccttgcagggagagccccgtgctccaacaccccctagcggcacagaagtgacgctcgctgaagtcccactgcttgacgaggtcgctcccgagcctctgcttcccgctggcgaggggtgcgccactctcctcaacttcgacgagctcccggagccccctgcgactttttgtgatcctgaagaggttgaaggcgaatcgctggctgcccctcagaccccaactttacccagcgctctagaggagttggagcaggagcaagaacctgagccacatcttctcacgaatggggagactacacaaaaggagggcacgcaggccagcgaggggtatttttctcagtctcaagaggaggaattcgcccagtccgaggaactctgcgccaaagcccctccaccagtgttctataataaacctccggagatcgacattacgtgctgggatgcagaccccgtgccggaggaggaggaaggctttgaaggcggagactag

SEQ ID NO: 221281 - DNA, 954 bp, Artificial Sequence
  Description of Artificial Sequence: Synthetic coding sequence
atggccggagtgtccttctcgggacacagactcgagttactggccgcatacgaggaggtcatcagggaagaatctgccgctgattgggcactctacacctatgaggatggctcagacgatctcaaactcgccgctagtggcggaggactgcaagaactgtcaggacactttgagaaccagaaagtgatgtatggtttttgctccgtcaaagacagtcaggccgctctccccaaatacgtgcttataaattgggtcggcgaagacgtccctgacgcacgcaaatgcgcttgcgcctctcacgtagctaaagtggcggaattctttcaaggagtggatgttattgtgaatgcgtcctcagtcgaggacatcgacgccggagctataggccagagactttccaatgggctggctcgcctgtcttcaccagtcctgcataggctgagactcagggaagacgagaacgccgagcctgtggggacaacctaccagaaaacggatgctgcggttgaaatgaaaagaatcaaccgggagcagttttgggagcaagccaaaaaggaagaggagctacggaaggaagaggaacgcaaaaaggccctcgacgagaggctgcgattcgaacaagaaagaatggagcaggagagacaggagcaagaggaacgtgaacggaggtaccgtgagagagagcagcagatcgaagagcaccgacggaaacagcaaaccctggaggccgaggaggcaaaaaggcgcctcaaggaacaaagtatttttggcgaccacagagatgaggaggaggaaacacatatgaagaagagcgaaagtgaagttgaggaagccgctgcgatcatagcccagaggccagataaccccagggaattcttcaaacaacaggagcgcgtggcaagcgcttccgccggttcatgcgacgttccaagcccctttaatcaccgcccatag

SEQ ID NO: 221282 - DNA, 375 bp, Artificial Sequence
  Description of Artificial Sequence: Synthetic coding sequence
atggccggagtgtccttctctggccacagactcgagctgttggccgcttacgaggaagttatccgggaggaatccgctgcagattgggctctttacacatacgaggacgggtccgatgacctgaagctggcggcttcgggagaaggcggtttgcaggagctatccggacacttcgagaatcaaaaagtgatgtatgggttctgcagcgtgaaagattcccaagccgctctgcccaagtacgtcctgattaactgggtaggcgaggacgtgccagacgccaggaaatgtgcttgcgccagccatgtggccaaggtggcagaattcttccagggcgttgatgtgatcgtgaacgctagctcggtcgaagatatatag

SEQ ID NO: 221283 - DNA, 3900 bp, Artificial Sequence
  Description of Artificial Sequence: Synthetic coding sequence
catagaatgagcttccatcctgggcgtggctgcccacgcggaaggggcggacatggagccagacctagcgccccatcgttccgccctcagaatctgcggttactccacccacagcagcctcctgtccagtatcagtacgaacccccaagtgcccctagcactaccttttccaatagccccgctcctaacttcctcccaccgagacccgattttgttcccttcccccctccaatgccgccaagcgcacagggaccactccccccttgtccaattagacccccttttccaaaccatcagatgagacacccttttcccgtaccaccgtgcttcccaccgatgcctcccccaatgccttgtcctaacaatcctcccgttcccggagctcctcccggacagggaacgtttccctttatgatgcctccaccctcaatgccccacccaccccctccacctgtcatgccacagcaggtaaactaccagtatccaccgggttatagccatcacaactttcctcccccttccttcaatagctttcaaaacaacccaagctctttcctgccttccgccaataattccagctcccctcatttcagacacctgcccccatacccgctgcctaaggcaccctcagagcggagatcgcccgaacgactcaaacactacgacgatcacagacacagggaccattcgcacgggaggggtgagagacacaggtctttggatcggcgagaaaggggccgttctcccgacagaaggagacaggactcccgttacagaagcgactatgataggggccgtaccccgtcgcgccaccggtcctacgagcgtagctccagatctccctctcgagagaagaagagagctcgctgggaagaagaaaaagaccgctggtccgacaaccaatccagcggaaaggacaagaattacacaagcattaaagagaaggaacctgaagaaaccatgcctgataagaatgaggaggaggaagaggagctgcttaaacctgtttggataaggtgcacacactccgagaattattactccagtgacccaatggatcaggtcggggattcgacagtcgtcggcacttccaggctgcgcgatctgtacgacaaattcgaggaggagctaggtagtaggcaagaaaaagcaaaggccgcaaggccgccttgggaacctcctaaaacaaaactggacgaagatctggagtccagtagcgagtccgaatgtgagagcgacgaagacagtacatgcagttcttcctcagattctgaggtgtttgacgtcatcgcagaaatcaaacgaaagaaggctcacccggataggcttcacgacgagctctggtacaacgaccccggtcagatgaatgatggtccgttgtgtaaatgctccgccaaggcccgtaggacaggtattcggcactccatctatccaggggaagaggcaattaagccttgtcgacctatgaccaacaatgcgggacgtctttttcactataggatcacagtctctccacccaccaattttctgaccgatcggcctacagtaattgagtacgatgaccacgagtatatcttcgaggggttctccatgtttgcacatgcaccattaaccaacattcccttatgcaaggtgatcaggttcaacatagactataccattcactttatagaggagatgatgcctgagaacttttgtgtaaaaggcctggaactcttctctctcttcttgttcagggacatcctcgagctatacgactggaacctgaagggacctcttttcgaagattctcctccttgctgtcccagattccactttatgccgcgttttgtcagattcctaccagacggcggaaaggaagtgctcagcatgcatcaaatccttttgtaccttcttaggtgcagtaaggccctggtgcctgaggaggaaatagctaatatgctgcaatgggaggagctggagtggcaaaagtatgcagaggaatgtaaggggatgattgtgacaaatccaggaacaaaaccttctagtgtgcggatcgaccagcttgaccgggagcagtttaatcccgatgtgatcactttccccatcattgtccacttcggcatacggcctgcacagctgtcttatgccggtgacccccagtatcaaaagttgtggaagagttatgtgaaactgcgccacttgttggctaacagtcccaaagtgaagcaaacagataagcagaagctggcccagcgggaagaggcacttcagaaaattcggcagaagaataccatgcggcgtgaggttaccgttgaactgtccagccagggattttggaagactggcatacgaagcgacgtttgtcagcatgcaatgatgctccccgtgctaactcatcacatccgatatcaccaatgtcttatgcatcttgacaagctcatcggctatacctttcaggaccgctgcctgctgcaactagctatgacacacccatcccatcacttgaatttcggcatgaaccccgaccatgcccgtaacagcttgtctaattgtggcatcagacagcccaaatacggcgatcgaaaggtgcatcacatgcacatgagaaaaaagggcattaacacactcatcaatatcatgtctcgactgggccaagacgatcccactccgtcccggatcaatcataacgagagactggagttccttggcgatgctgtggtcgaattcctgacctccgtccacctgtactatttatttcctagccttgaagaagggggtctagctacctaccgcacagcgattgttcaaaatcagcacctcgccatgcttgccaaaaagttggagctggatcgatttatgctttatgcacatggcccagacctgtgtcgagagagtgatctacgccatgcaatggccaactgctttgaggctttgattggtgctgtttacctggaagggagcctcgaggaagcgaaacaattgtttggccgtttactctttaatgatccggatctccgtgaggtgtggctgaactaccctttgcacccgctgcagctgcaggagccgaacactgacagacagttgattgagacatctcctgttttgcagaaattgaccgagtttgaggaagctattggagtaatctttactcacgttagactactggccagggcattcacacttagaacggtgggatttaaccatctaacactcggccataaccagaggatggagtttctaggagacagcattatgcagctagtcgctaccgagtacctgtttatccatttccccgaccatcatgaggggcatctgacactcttgaggtcatccctggttaacaataggacacaagcaaaggtcgccgaagaattagggatgcaagaatatgccatcacaaatgacaaaactaagcgccctgtcgccttaagaactaagactcttgctgacctcctagagagcttcatcgcagccctatacatcgataaggaccttgagtacgtgcataccttcatgaatgtatgcttcttccccagactgaaagagtttattttaaaccaggactggaacgaccctaagtcacagctacagcagtgctgcctgactctgaggaccgaaggcaaggagccagatatccccctttacaagactttgcagacagttggtccatctcacgcaaggacctacacagttgctgtctacttcaagggcgaacgaatagggtgcggtaaaggaccttccattcagcaggctgaaatgggagccgctatggatgctctggagaagtataatttcccccagatggctcaccagaaacggttcattgaacgtaaatacaggcaggaacttaaagagatgaggtgggagcgggaacatcaggagagggaacctgacgagaccgaggatatcaaaaaatag

SEQ ID NO: 221284 - DNA, 4125 bp, Artificial Sequence
  Description of Artificial Sequence: Synthetic coding sequence
atgatgcaagggaatacctgccaccgcatgtctttccatccaggacgaggctgccctagaggccgaggaggacatggagcgaggccatctgctcccagctttcgtcctcagaacttacgcctcttgcatccccagcaacctcccgtgcagtatcagtatgaacctccatcagccccttctactacattctccaacagccctgctccaaatttcttgccaccccgtccagactttgtgcccttccctccccctatgccacccagcgctcagggacccttgcccccttgccccattaggccaccattcccaaaccatcaaatgcgccacccctttcccgtccctccatgtttccctcccatgccccctcccatgccttgcccaaacaacccccctgttcctggggcacccccagggcaaggcacctttcctttcatgatgcctcctccctccatgccacacccgccaccccctcccgtgatgccacagcaagtaaactaccaatatccccctggatactcacaccataactttccacccccaagcttcaactcctttcaaaacaacccaagttcgtttctgccgagtgccaataattcctcctctccgcattttcggcacctacctccgtacccactgcctaaagcaccttctgagcgcagatcgcccgagcgcctgaaacattacgatgatcaccgtcatcgggaccacagccacggtcgaggagagaggcatcggtcattggatcgcagagaacgcggtagatcgcccgatcgaagaaggcaagacagccggtaccgctctgactatgatcgaggcagaacccctagtcgccaccgatcctatgagagatctagagagcgcgagagggagcgccaccgtcatcgcgacaacagacgctccccatcactggagaggagctacaagaaagagtacaaaaggtctggaagaagctacggactgagcgtggtcccagaaccagccggatgtaccccggagctccccggagagattattaaaaatacagactcttgggcacccccacttgaaatcgtaaaccatcgctctccctcgcgcgagaaaaagcgggctaggtgggaggaggagaaagacaggtggtccgataatcagagctctgggaaagacaagaactatactagcataaaagaaaaggaaccagaagagaccatgccagacaaaaacgaggaagaagaagaagaattgctcaaacctgtctggatccgatgcacccactccgaaaactattacagtagcgatccaatggatcaagtaggcgacagcactgttgtggggacatcacgacttagagacctctacgacaagtttgaggaagagctgggatcacgccaagaaaaggccaaagccgctaggccaccatgggagccccctaagaccaagttggacgaggatctggaaagcagtagtgaaagcgagtgtgaaagtgacgaagactcaacgtgttcaagcagctcagacagcgaggtgtttgacgtgatcgccgaaatcaaacgtaaaaaggcccaccctgaccgcctgcacgatgagctgtggtataatgatccagggcaaatgaacgatggacctctgtgcaagtgctctgccaaggcaagaagaactgggattaggcactccatttaccccggtgaggaggccattaagccttgtcggccaatgaccaataacgccggaagactgttccattaccgcataactgtaagcccacccactaactttcttactgacaggcctacagtgatcgaatacgacgaccacgagtacatcttcgagggattctccatgtttgcacatgctcctctcactaacatacccttatgcaaagtaattcggtttaacatcgactatactatccacttcatcgaagaaatgatgcccgagaatttttgtgtgaagggattggagctgttcagtttatttctgtttcgggacatcctcgagctgtacgactggaacctcaagggccctttgttcgaggactcccccccatgttgtcctagatttcacttcatgccgagattcgtgcgcttcctacccgacgggggaaaggaagtactctctatgcatcagatccttctttatttattaagatgctccaaggcgctggtgccggaggaagaaatcgcaaatatgttgcagtgggaggaattggagtggcaaaagtatgcggaggaatgtaagggtatgattgttacaaatccaggcaccaaaccctcttcagtgcggatagaccagttggaccgcgagcagttcaatcccgatgtgatcacgttccccataattgtccactttgggatccggcctgctcaactctcttacgccggtgaccctcagtaccagaaactgtggaagtcatacgtcaagctcagacacttgctcgccaactctcctaaggttaagcaaacagacaaacagaaactggcccagagggaggaggccctacagaagattcgccagaaaaacacaatgaggcgagaagtaacagttgagcttagctcccagggtttctggaagactggtattcggtcagatgtgtgccaacacgctatgatgctgccagtgctgacacatcatattcggtaccaccagtgtctgatgcatttagataagctgatcggttacacatttcaagatcgatgcctgctacagctggccatgactcaccccagccaccacttgaacttcggcatgaatcctgatcatgcacgtaacagtctaagtaattgcggcataaggcagcctaagtacggagacaggaaggttcaccacatgcacatgaggaaaaagggcatcaataccctgatcaacattatgtctcgacttgggcaagatgaccccactccctcccgaatcaatcacaacgagagattagaattccttggggacgcagtagtagaatttctaaccagtgtgcacctttactacctttttccctctctggaggagggaggcctcgcaacatatcgcacagctattgttcagaaccaacatctagcaatgctcgcaaaaaagttggagttagacagatttatgctttacgcccacgggcctgacctgtgcagagagtctgacttacgccatgccatggcaaattgctttgaggcgctgataggagccgtgtacctggaagggagcctggaggaggcaaagcagcttttcgggaggctgttgtttaatgaccccgacctgagagaggtgtggttaaactatccgcttcaccctcttcagttgcaggagccgaatactgaccgacagctcattgaaacatctcccgtgctgcagaaattgaccgagttcgaggaggccataggggtgatttttacacacgtcaggctgctagcacgtgcctttactttgaggaccgtcggttttaaccatctgacacttggacataaccagcggatggaattcctgggagatagcatcatgcaactggtggccactgagtatctcttcatacatttccctgatcaccatgaaggccacctcacactgctgcgtagcagtctggtgaacaataggacccaagccaaggtggccgaagaattaggaatgcaagagtatgcgatcacgaatgacaaaaccaagcgccctgtcgccctcaggacaaagactttggccgacctgctcgaaagcttcatcgctgccttgtatattgataaggacctggagtatgtacacaccttcatgaacgtgtgttttttccccagactcaaggaatttattcttaatcaggattggaacgatccaaagtcacagctccagcagtgttgcctgaccttgcggaccgaaggcaaggagccagacataccactctacaagaccttgcaaactgttggcccatcccatgcccgaacctacacagttgccgtctattttaagggggaaagaatcggctgtggtaaaggtccaagcatccagcaagctgagatgggggcagctatggacgctctggagaagtacaattttccacagatggctcaccaaaaaagattcatcgagcgcaagtaccgacaggaactgaaagagatgcgctgggagagggaacatcaggagcgcgagccggatgagacagaggacatcaaaaagtag

SEQ ID NO: 221285 - DNA, 3558 bp, Artificial Sequence
  Description of Artificial Sequence: Synthetic coding sequence
cacagaatgagcttccacccagggagggggtgcccacggggacgaggcggacatggagctcggccttcggccccttctttcaggccccagaacctccggctcttgcatccccaacaaccgcctgtccagtaccagtacgagcctccgtccgcaccttctaccacattttccaattcacctgccccaaacttcctcccccctagacccgattttgttcccttcccccctcctatgcctccctccgcccaaggaccattgcccccatgtcctattagacctccgtttcctaaccaccaaatgcgccatccattccctgtcccaccttgtttccctcccatgccacccccaatgccttgcccaaacaatccaccagtgcctggggctcctccgggacaaggtaccttcccgttcatgatgccgccacctagcatgccccaccctccacccccaccagtgatgccccagcaggtaaactaccagtatccacccggatattctcatcataacttccccccaccaagtttcaactccttccagaataatccttcgagtttcctgccttccgccaacaattctagttcccctcatttccgacacctccctccatatcctttgcctaaggcaccttccgaacgcaggtcccccgaacgcctgaaacattacgatgaccaccgtcaccgggatcacagtcacggcaggggtgagaggcatagatctttggaccggcgagaaaggggcagaagtcccgaccgacggaggcaggattcccgctaccgctctgactatgacagagggagaaccccgtctaggcaccgatcctacgagcgctcacgtgagcgcgaaagggagcgacaccgccaccgagacaacagacgaagcccaagcctcgagagatcctacaagaaggaatacaagaggtctggtagtcgatctccatcaagggagaaaaaaagagctcgctgggaggaagaaaaggacaggtggagcgataatcagagcagcggaaaagacaagaattacacctctattaaggaaaaagagcccgaagagacaatgccggataagaacgaggaagaggaagaagaactgctgaagcctgtgtggattcggtgcactcacagcgaaaactactatagttcagaccctatggatcaggtcggcgattcaaccgtagttggcacatcccgacttcgagatctgtatgacaagttcgaagaggagctgggatctcgccaagaaaaggccaaggccgcacgcccaccatgggaaccccctaaaaccaagctagacgaggatctggaaagttcctctgaatccgaatgcgagtccgacgaggactcaacctgctcctccagtagtgactcggaggtcttcgacgtcattgcagaaataaagcgcaagaaagcgcatccggaccggttgcatgatgaactctggtataatgaccccggacagatgaatgacgggccactgtgcaaatgcagcgcaaaagcacgcagaaccggcataagacattcaatttatcctggtgaagaggctatcaagccatgtcggcctatgactaataatgcgggacgcctgtttcactatcgcatcacagtttccccacccaccaatttcctcacagataggcctactgttatcgagtacgatgatcacgagtatatattcgagggatttagcatgtttgcgcatgcacccctgactaatattccattgtgtaaggtcattagattcaatattgattacaccatccactttatagaagagatgatgcctgaaaacttctgtgttaagggattagagctgttctccttatttttgtttagggacatcctggagctgtacgattggaacctcaagggccctctgtttgaggactcccccccttgttgcccccgatttcactttatgccacgttttgtgagattcctgcccgacggtgggaaggaggttctgagtatgcaccaaattttgctttacttattacgctgctccaaggccctggtccctgaggaggaaattgcaaatatgcttcagtgggaggaactcgagtggcagaagtacgcggaggagtgcaaaggcatgatagtgacaaacccaggaacaaaaccttccagcgtcaggatagaccagctggatcgggaacaattcaatcccgatgtgatcacttttccaatcatagtgcactttggaatcagacccgcacagctgagctacgctggggatccccagtaccagaagctctggaaaagctatgtcaaactccgccatctgctggccaattctcctaaagtcaagcagaccgataagcagaaactggcgcaacgtgaagaagccctgcagaaaatccgtcagaagaacacaatgcgccgagaagtgactgtggagctctcatcccaaggcttctggaagacaggaattcgtagcgacgtctgtcaacacgccatgatgttacccgtcctcacacaccacatcaggtatcatcaatgcctgatgcatctggacaaactgatcggctacacatttcaggaccggtgtttgctacagttagctatgacacacccctcacaccacctgaacttcggaatgaatccggaccacgcgagaaatagcttgagtaactgtgggatccgacagccaaagtacggcgatagaaaggtgcaccatatgcacatgaggaagaaaggtatcaatacgctgattaatatcatgtcaaggctcggacaggatgaccctactcctagtcgtattaaccataacgagcgactcgaatttttgggagacgcggtggtggagtttttaactagcgtgcatctgtattacctgttcccatctttagaggagggcggactcgccacatataggaccgctattgtccaaaaccaacacctggcgatgcttgccaagaaattggaactcgatcgttttatgttatatgcccacggccctgacctgtgtagagaaagtgacctccggcacgccatggccaactgctttgaggcactcatcggggctgtgtacctggagggctccctggaagaagctaagcaactctttggcagactcttatttaatgacccagatcttagggaggtatggcttaattacccgctgcatccactgcaattgcaggaacctaacactgacaggcagctgatcgagacctcacctgtcctgcagaaactgactgagttcgaggaagctattggtgttatcttcacgcatgtaagactcctcgcgagagccttcaccctgaggactgtgggcttcaaccatttgaccctgggccataaccagaggatggaatttttgggggattcaattatgcagctggtggctaccgagtatctatttatccatttccccgaccatcacgagggacacctgacactcttgagaagcagcctcgtcaacaacaggacacaagccaaggtggccgaagaattgggcatgcaggaatggtcaatctatctcttgtcaaattgtgattgctgccttctgaggccctcacttgtttttctgcaaactatgaatgaggtatgctcgctgaagtag

SEQ ID NO: 221286 - DNA, 4014 bp, Artificial Sequence
  Description of Artificial Sequence: Synthetic coding sequence
atgatgcagggaaatacatgccatagaatgtctttccacccaggccgtgggtgtcccagaggtagaggaggtcacggtgctagaccgtccgcgccaagcttccgcccacaaaacttacggctgctgcatcctcagcagcctcctgtccagtaccaatatgagcctcctagtgctccatcgaccacctttagcaatagtcctgctcctaatttccttcccccaaggcccgatttcgtcccttttcccccacccatgcctccttccgctcagggacccttaccaccctgcccgattaggccaccatttcccaatcaccagatgcgccaccctttccccgtccctccttgttttcccccaatgccaccccctatgccttgccctaacaatcctccggttccgggagccccaccaggtcagggcacattcccttttatgatgccccctccatccatgccgcaccctcccccaccacctgtcatgcctcaacaggtcaattaccagtatcccccaggctattctcatcataatttccccccacccagcttcaattcttttcagaataatcctagttcatttctgcccagtgctaacaattccagctctccacattttagacatctgccgccatatccgcttccaaaggctccctccgagcgcagaagtcccgagagactgaaacattatgatgaccatcgccacagggaccattcccacgggaggggggaacgacatcgttctctggaccgtcgggagagaggtaggtcgcctgatcgaaggaggcaggattcgcgttatagatctgattacgacagaggccgtaccccgagtcgacacaggtcatatgaacgcagtagagagcgcgaaagagaaaggcaccgacacagagacaacaggaggtcccccagtctagagaggagttataaaaaagaatataaacgatcaggttcaagaagtccttcacgcgaaaagaagcgagcaaggtgggaagaggaaaaagaccgttggagtgataaccagtccagcggtaaagacaagaattacacctcaataaaggagaaggagccagaggagactatgccagataaaaatgaagaggaggaggaggagcttttgaagccagtgtggattagatgcacccattccgaaaactattactcttccgaccccatggaccaggtaggcgactccaccgtagtgggaacaagccgcctgcgcgatttgtatgacaagtttgaagaagaactgggcagcagacaagaaaaggcaaaggccgcacgcccaccctgggagcccccaaagacaaagctggatgaggaccttgaatcatcaagcgaatccgaatgtgaatctgacgaagattctacatgctcatcatcatccgactccgaagtgtttgacgtgatcgccgagatcaaacgcaaaaaggctcatcctgatagattacatgatgagctctggtataacgatcctggccaaatgaatgatggcccactgtgcaagtgctccgccaaggcacgcaggacagggattagacacagcatttaccccggtgaggaagcaataaaaccctgccgccctatgactaataacgcgggacggctgtttcactataggattaccgtctccccacccacaaactttctgactgacaggcctaccgtgatcgaatatgacgaccatgagtatatctttgagggctttagcatgttcgcccatgcaccactcaccaacattcctctgtgcaaggtaatccgatttaatatcgactatactattcattttatcgaggaaatgatgcccgaaaacttctgcgtgaagggcctggagctgttctccctgtttctctttcgcgacattctggaactatacgactggaatctgaagggcccactgttcgaggacagtcccccatgttgcccacgctttcactttatgcccaggtttgtgcggtttctcccagatggaggtaaggaggtacttagcatgcatcagattctactgtatctgctcaggtgtagcaaagccctggtccccgaggaggagattgctaacatgctgcaatgggaagaactcgagtggcaaaagtacgctgaggagtgcaagggcatgattgtgaccaaccccggaacaaaaccatccagcgtccggattgaccagctggatcgggaacagtttaaccctgacgtgatcacctttcctataatcgtgcactttggcattagacccgcacagctgagttacgcgggtgatcctcaataccagaagctatggaaaagttacgtgaagctgcgacatcttctggcaaacagccccaaggtgaaacaaacggacaagcaaaaattggcccaaagagaggaggccctgcagaagattcgtcagaaaaacactatgcggagagaggtcaccgttgaactcagctctcagggattctggaaaaccggcattcgaagcgacgtttgccaacacgccatgatgctgcctgtattaactcatcacatcaggtaccatcagtgtctcatgcatctagataagctcatcggctacaccttccaggataggtgtcttcttcagttggcgatgacccacccctctcaccacctgaacttcggcatgaatccagatcatgcacgcaattcattgagcaactgcggtattagacagccaaagtacggagacaggaaggttcaccacatgcatatgcggaagaaaggaattaataccctcatcaacatcatgagccgtctgggtcaggatgaccctacgccatctaggatcaaccacaacgagcgacttgaattcctgggagatgctgtagtggaatttctgacctcagtgcatctgtattacctcttcccgtcgctggaagaggggggtctggccacgtaccgcactgctatagtgcagaatcagcatctcgccatgttagctaaaaagcttgagcttgaccgtttcatgctttatgctcatggtcctgacctgtgcagagaatctgatctgcgccacgccatggccaattgctttgaagcccttatcggagccgtctaccttgaaggttctctggaggaagccaagcagctgtttgggaggctgctttttaatgaccccgacttgagagaggtctggctcaattatccgcttcatccgctgcaacttcaggaacccaacacagaccggcaactgattgagacatccccagttctgcagaaacttaccgagttcgaggaggctattggagtcatttttacacatgtaagactattggcaagggcatttacattacgcaccgtgggttttaatcacctgacattaggtcacaaccagcgtatggagtttctgggcgattccataatgcagctcgtggcgacagagtacctgttcatccacttccctgatcaccatgagggacatctgacattgcttagatcctcactggtgaacaaccggacccaggccaaggtcgccgaggagctcggcatgcaggaatatgccatcacaaacgataagacgaaaagacccgttgcactaagaactaaaacactagccgacctgctggaatctttcatcgcagccctctacatcgacaaggacttggagtacgtccatacctttatgaatgtgtgtttctttccacggctgaaagaatttatactgaaccaggactggaacgaccctaaatcacaattgcaacaatgttgtcttacactcagaacagagggaaaagagccagacatacccttgtacaaaacactacagaccgtgggtccatcacacgctaggacttatacagtggccgtgtattttaagggcgagcgcataggctgtgggaagggcccatctatccagcaggccgagatgggagcagctatggatgctctcgagaagtataacttcccccagatggcacaccagaaaaggttcatagagcgcaaataccggcaagagctgaaagaaatgagatgggagcgagaacatcaagaacgcgagcccgatgagacagaggacattaaaaaatag

SEQ ID NO: 221287 - DNA, 606 bp, Artificial Sequence
  Description of Artificial Sequence: Synthetic coding sequence
atgatgcaaggcaatacctgtcaccggatgtcgttccaccctggccgaggatgccccagaggcagaggcggacatggagctagaccaagcgctccatcctttcgccctcagaatctccgtctgttgcaccctcagcagccccctgtgcaataccagtacgaacctcccagcgctccatcaaccacttttagcaactcgccggctcctaattttttgccaccacgccctgactttgtccctttcccccctcctatgccccctagcgcccagggtccacttcccccatgcccaatcagaccacccttccccaatcaccaaatgcgacatccttttcctgttccaccatgcttcccgcctatgcctcctcccatgccttgccctaacaaccctcccgttcccggtgccccaccaggccaggggacattccctttcatgatgccacccccatccatgccgcatcccccaccacctcccgtcatgccgcagcaagtgaattaccagtaccctccgggatactcccaccacaactttccgccaccgtcctttaatagtttccagaacaatccttcttctttcctgcctagcgcgaacaactctagtagctag

SEQ ID NO: 221288 - DNA, 4125 bp, Artificial Sequence
  Description of Artificial Sequence: Synthetic coding sequence
atgatgcagggcaatacttgtcatcgtatgagcttccacccaggacgcggatgccctcgcggacgtggcggtcacggcgcacggccttccgctccaagcttccgcccacagaacctgaggctacttcacccacagcagccaccagtccaatatcagtatgagcccccatctgctccttccacaactttcagcaactcacccgcacccaactttctgcctcctcggcctgatttcgtgccgttcccaccccctatgccacccagcgcccagggccctcttccaccgtgtcccattcgtcccccttttcctaaccaccagatgaggcatcccttccctgtgcctccgtgtttccctcccatgcctccgccaatgccctgtcctaacaatccgccagtcccaggcgcacccccaggccagggcaccttcccgttcatgatgcctcctccttcaatgccccacccaccgccacctcctgtgatgccacagcaggtgaattatcagtatccaccaggctactcacaccacaatttcccccctccttcgttcaacagtttccagaataatcctagcagcttcctccctagtgccaacaattccagctctccccacttccgccacctgccgccatacccactgcctaaggccccatccgagaggagatcacctgagaggctcaagcattacgacgaccatcgccaccgcgatcattcccacggccgaggggaacgtcatagaagtcttgatagacgagaaaggggtagaagccctgataggcgcagacaggatagcagatacagaagcgactacgaccgtggcaggacaccaagcaggcatcgaagttacgaaaggtcgcgcgaacgtgagcgtgaacgacaccgccatagagacaacagacggagcccctctttagagcggagctacaaaaaggaatacaagcggtccggtcgttcttacgggctgagtgtggtgcctgaacctgccggatgtactccggagctgccaggagagatcatcaagaacactgacagctgggctccaccattggagatcgtgaatcacagatctcccagcagggagaaaaaaagggctcggtgggaagaagaaaaggacaggtggtctgataatcaaagctcagggaaagacaaaaattacacaagcatcaaagaaaaggagcccgaagagaccatgcctgacaaaaacgaggaggaggaagaagagctcctcaagcccgtgtggataaggtgcacccacagcgaaaactactatagtagtgatccaatggaccaagtcggagacagtactgtcgtcggaacaagtcgcctcagggatttatacgacaagttcgaggaagaattaggctcaaggcaggaaaaggctaaggcagccaggcctccatgggagcccccaaagaccaaattggacgaggacctggagtcaagcagtgagtctgagtgtgaaagtgatgaagacagtacttgcagttcctcatcagattcggaggtgtttgacgtcatcgcggaaatcaagcggaaaaaggctcatcccgaccgtctgcatgatgaattgtggtataatgaccccggacagatgaacgatggcccactttgtaagtgctcagccaaagcccgacgcaccggaatccgccattccatttatcccggtgaggaggcaattaaaccatgtaggccaatgactaacaacgcgggaagattattccactatcggataacagtatcccccccaacaaatttcctaaccgacaggcccaccgtgattgagtacgatgatcacgaatacatcttcgaggggttttcaatgtttgcccacgcccctttgacaaacattcccctgtgcaaggtcatccggttcaatattgactacaccatacattttatcgaggagatgatgcccgagaatttttgtgtcaaaggtctcgaactcttcagccttttcctgtttcgcgatatcctggaactgtacgattggaatctcaagggacccctcttcgaagacagtcctccttgctgcccacgtttccattttatgccgcgatttgtgagattcctccccgacggcggtaaagaggtcctgagcatgcatcaaatactgctctacctgctgcggtgtagcaaggctctggtgcccgaggaagagatcgctaacatgctacaatgggaagaactcgagtggcaaaagtacgcagaagagtgtaaaggaatgatcgtaacaaaccccggaactaagccttcctccgtgcgcatcgatcagctggaccgggagcagtttaaccccgatgtcatcacgtttcccataatagttcatttcggaatcaggccggcacagttgagctacgcaggcgatccacagtaccaaaagctttggaaaagttatgtaaaactgcggcatctgctggccaattcaccgaaagtcaagcagaccgataaacaaaagctggctcagcgggaggaggccttgcagaaaatccggcagaaaaatacaatgcgcagagaggtgacggttgagctgtctagccagggcttttggaagactggtatccgaagtgacgtttgtcaacatgccatgatgctgcccgttctgacgcatcacatacgctatcatcagtgtcttatgcatctggataagcttattggctacacctttcaagaccgctgtctcctccagctggccatgactcatccatcccaccaccttaacttcggaatgaatcccgaccatgccagaaattcactgagcaactgcgggattcgtcaaccaaagtacggcgatcgcaaagtgcaccacatgcacatgcgcaaaaagggtatcaacaccctgataaacatcatgagcaggttggggcaggacgaccctacaccttctcgcattaatcacaacgaaagacttgaatttttaggggatgctgtcgtcgagtttcttacttccgtccatttgtattacctgttcccaagcctagaagaggggggactggccacataccggacagccatagtacagaatcagcacctggccatgcttgccaagaaactggaactagatcgatttatgctctacgcccatggcccagacctctgccgcgagtccgatctccggcacgccatggccaactgtttcgaagcccttattggcgcagtctacctcgagggctccctggaggaagccaagcagctcttcggtaggttactgtttaatgaccccgatcttagagaggtgtggctgaactaccccctccacccactgcagctgcaggaacctaatacagaccgtcagctgatcgaaacaagtcccgtcctccagaagctaaccgagttcgaggaggcaatcggggtcatattcactcacgttaggctgctggctagggcctttaccttgcggactgtgggttttaatcacttaacactgggccataatcaacgcatggagtttctcggcgactcaattatgcagctggtggctaccgagtacctgttcattcattttcccgatcaccacgaaggtcacttgactcttctgaggtccagcctcgtcaataatagaacacaggcaaaggtcgccgaggagctgggaatgcaggaatacgcaataacaaacgataaaactaaaagacccgtggcactgcggaccaagaccctagccgatctgctcgagtccttcatagccgcactgtacatagataaggacctcgagtacgtgcacactttcatgaatgtctgttttttcccacggcttaaagagtttatactgaaccaggattggaatgatcctaagtcacagctgcagcaatgctgcttaactctaaggacagaaggcaaggagcccgatattccactctacaagactcttcagaccgtaggtcctagtcacgctagaacttataccgtagccgtctatttcaagggtgagaggatcggttgcggaaaaggacccagcattcagcaagccgagatgggcgcagcgatggacgctttggagaagtacaatttccctcaaatggcccaccagaagcgatttatagaaagaaagtaccggcaggagttgaaagagatgcggtgggaacgagaacaccaggaaagagaacccgatgagacagaggacattaagaaatag

SEQ ID NO: 221289 - DNA, 630 bp, Artificial Sequence
  Description of Artificial Sequence: Synthetic coding sequence
atgaaggcagtggtgcaacgggtgacccgggcttcagtaacagtgggtggagaacagatctctgccattggtcggggtatctgcgttctcctcggaattagccttgaagatacacagaaggagctggagcacatggtgcggaagatcctgaacctgcgggtgttcgaagatgaatcagggaagcactggtctaaatccgtgatggataagcagtatgaaattctgtgtgtgagtcagttcaccctgcagtgcgtcctgaagggcaacaagccggacttccacctagcaatgcctactgagcaggccgaaggtttttacaatagctttctggagcagctccgaaaaacctaccgccctgaactgatcaaggacggaaaatttggtgcctacatgcaggtccacatccaaaatgatgggcctgtgacaatagagcttgaatcaccagcgcctggcaccgctacctccgaccctaaacagcttagtaaacttgaaaagcagcaacagaggaaagagaaaactcgtgccaaaggtccatcggagtcatcaaaagagcgaaacacaccaaggaaagaggatcgcagcgcctcatcaggtgcagaaggggatgttagcagtgagcgagagccctag

SEQ ID NO: 221290 - DNA, 843 bp, Artificial Sequence
  Description of Artificial Sequence: Synthetic coding sequence
atgggacgcgctgagctcctggaggggaaaatgtctactcaggatcctagcgatctctggtcccggagtgatggagaggccgaactgcttcaggatcttggctggtaccacgggaatctgactcgccacgccgcagaagcgctgctgctttctaacggctgtgatggcagctatctcctgcgcgactcaaatgagaccactggtctgtatagcctatcggtccgagcaaaggactcagtaaaacatttccacgtggaatataccggatattcttttaaattcggtttcaacgagttttcctccctgaaggattttgtcaaacattttgcaaatcaaccactcattggaagcgagactgggactcttatggttctaaaacatccctatcctcgaaaggtggaggaacccagtatctatgagtctgtgcgtgtgcacacagccatgcaaacagggagaacagaggatgatttagttccaacagccccatcactaggtacaaaggaaggatatctgacaaagcagggaggtctggtgaagacatggaagacgagatggttcacccttcatcgcaatgagctgaaatacttcaaggaccagatgagccctgaacccatccggatcctcgatctcaccgagtgctctgcggttcagttcgattactctcaagagcgggtcaactgcttttgcctggtctttcccttccggacattctacctgtgtgccaagacaggagttgaggcagacgagtggataaaaatcctgagatggaagctcagtcagattcggaaacagcttaatcagggcgaaggtaccattagaagtcgctcgtttatctttaagtag

SEQ ID NO: 221291 - DNA, 4656 bp, Artificial Sequence
  Description of Artificial Sequence: Synthetic coding sequence
atggggttctgcctggctctggcctggaccttgctcgtgggagcatggacacccctcggggctcagaatcccatatcctgggaggtccagagattcgatggatggtataataaccttatggaacacagatggggcagtaagggttcacgactgcagcggctagtgcctgcctcctacgccgatggcgtttatcagcctttgggggaaccacatttgccaaatccccgtgacctttccaacacaataagcagaggacccgcagggcttgcatccctgagaaatagaactgtgttaggggtcttcttcggatatcacgtcctctcggatctggttagcgtcgagacaccgggttgtcctgccgaattcttaaacatcagaattcccccaggcgaccccatgtttgacccagatcaacgaggcgatgtcgtcctgcccttccagcgcagtcggtgggaccccgaaacgggtagaagtccatcaaatccaagagaccctgccaaccaggtgaccggctggttggatggaagtgctatctatggaagcagccactcctggagcgacgccctgagatccttttctcgtggtcagctcgcgtctggcccagaccccgcattcccgagagactcacagaatcccctgctgatgtgggccgcaccagatcctgccactggccagaatggaccccgtggtctatatgctttcggtgccgaacgcggtaaccgagaaccatttttgcaggccctgggactgctgtggttccgataccacaacctctgggctcaacgactcgccaggcagcatccagactgggaagacgaggagctgtttcagcatgccaggaaacgggtgatcgccacctaccagaacatagccgtctatgagtggttgccctcgtttctgcaaaagactcttcccgaatatactggatataggccatttttggatccgtccattagttccgagttcgttgcggcatctgaacaatttctgtcaaccatggtgccacccggagtctacatgcgaaacgccagttgtcacttccaaggcgtgataaacaggaactcttcggtaagcagagccctgagggtgtgcaattcctattggagccgtgagcatcctagtctacagagcgccgaggatgtcgacgccctgctactgggtatggcgtctcagatagcagaacgagaagatcacgtgctggtcgaggacgttcgcgacttttggccaggtccactgaagttctctcggacagatcatttggcaagttgtttgcaacgtgggagggatctgggtctcccctcctataccaaggccagagccgcacttggcttatcccctatcacacgatggcaggatattaatccagcactaagccgaagcaacgacacagtgttggaggctaccgccgctctctataaccaggatctcagttggctggaactgctgccagggggactgctcgaaagccaccgagacccagggcctctcttctctacgattgtgttggagcagttcgtaaggctgagagatggtgacagatactggtttgagaacactcggaatggcctgtttagcaagaaagagatcgaagagattagaaatactactctgcaagatgtgctggtggccgtcatcaacatcgaccccagcgccttgcaaccaaatgtcttcgtttggcataaaggcgacccttgcccccagcctcggcagctgtcgacagagggccttcccgcttgcgctccttccgtcgtgagagactatttcgagggctccggcttcggctttggagtgaccataggaaccctgtgctgtttccccctagtttccttgctatctgcctggatcgttgcccgtctaagaatgagaaattttaagaggcttcagggacaggacaggcagagcatcgtttcagaaaagctcgtgggtggaatggaggctttagaatggcagggtcataaggagccctgcagaccagtgctggtgtacctgcaacccggacagatccgcgttgtcgacggccgtctgaccgttctgcgcaccattcaactccagcctccccaaaaagtgaactttgttctgagtagcaaccggggaaggaggacgctattgctaaagatacccaaggagtacgatctggtgcttctgttcaatctcgaggaggagagacaggcactggtggagaatcttaggggggctctgaaagaatccggtcttagcatccaagagtgggagttacgtgagcaggagctaatgagggctgcagtcacacgcgaacagagaagacacctcctcgagacattcttcaggcacctattcagtcaagttcttgacattaatcaggcggatgcaggcacattacccctggactcctcacaaaaggttagagaggcccttacttgcgagctgtctcgtgccgagtttgcagaaagcttgggattgaagccgcaggacatgttcgtcgagagtatgttctctcttgctgataaagacggcaacggctacctctcgttccgagaattcctggacatactggtcgtttttatgaaaggcagccccgaagagaagtccaggctgatgttcagaatgtatgactttgatgggaacggactgatttccaaggatgagtttatacgaatgctgcgatctttcatcgagatatctaataactgtctctcaaaggcccagctggccgaggtggtggagagtatgttcagggagtctggattccaggacaaagaggaactgacctgggaggatttccacttcatgctgcgcgatcataatagcgagcttcgattcacacagctgtgtgtgaaaggcgtcgaggtccctgaggtcatcaaggatctgtgtcggagggctagttatatatcccaggatatgatttgtccatcccccagggtttctgcaagatgcagccgatccgatatagaaactgagttgacccctcagcggctgcagtgccctatggacaccgaccccccacaagagataaggaggcgattcgggaagaaagtgacttcttttcagcctttgctgttcaccgaggcccatagagagaagttccaaagaagttgtctgcaccaaactgtgcagcagttcaagaggttcatagaaaattaccggcgacatatcgggtgcgtcgctgtcttctacgctatcgctggcggtttgttcctggaacgcgcttactattatgcttttgcggctcaccacaccggcataaccgacacaacacgggttggtataatcctgtccaggggtaccgccgcaagtatatcctttatgttctcctacatccttcttaccatgtgccgcaatctcatcacatttctgcgggagacatttctgaaccgctacgtgccatttgatgccgctgtggactttcaccggctgatcgcctcaacagcaatcgtactgacggttctgcactccgttggacatgtggtcaatgtttatctgttttctatctcgcctctttccgtgctatcatgcttgtttcctggtctgttccatgatgacggcagcgagctgccccagaagtactactggtggttcttccagacggtgccaggtttgactggcgtcgttttgcttctgatccttgctatcatgtacgtattcgcatcccaccacttcagacgccgttcattccggggattctggctcacacaccacttgtacatattactctatgtgctgctgatcatacatggctcttttgccctgatacagctgccaagatttcatatcttcttcttggttcccgctataatttatggaggtgataaactggttagtctgagtaggaaaaaggttgaaatttcggttgtgaaagcagagctactcccctccggcgtgacccacctgcgcttccagagacctcagggcttcgagtataagagcggccagtgggtcagaatcgcttgtctggccctgggcaccactgagtaccaccccttcactctgacctctgcccctcacgaggacacgctttctctccacatccgggctgctggcccttggacgaccagacttagggaaatatattcagctcccaccggtgatcgatgtgcaaggtacccaaagttgtacttggatggaccatttggcgagggccatcaggaatggcacaagtttgaggtttcagtgctggtggggggaggcatcggcgtaacaccatttgcatcaatccttaaagacctcgttttcaagtcctccgtgagttgccaggtgttctgcaagaagatctactttatatgggtgacaaggactcagaggcagtttgagtggctggctgacataattagggaggtggaagagaacgaccaccaggacttggtgagtgtgcatatttatattacccagcttgccgagaagttcgacctccggactactatgctttacatctgcgaacgtcacttccagaaggttctgaatcggtccttgtttacaggactaaggagcattacacattttggaagacctccattcgagcccttctttaattcactccaggaggtccacccccaggtgcggaagatcggcgtgttctcttgcggaccccctggaatgactaaaaatgtggaaaaagcttgtcagttaatcaaccgtcaggatcggacccacttttctcaccactacgagaatttttag

SEQ ID NO: 221292 - DNA, 4656 bp, Artificial Sequence
  Description of Artificial Sequence: Synthetic coding sequence
atgggattttgtttggctttggcttggaccctgctcgtgggcgcatggacgccattaggagcccagaatcccatctcctgggaagtccagcgattcgacggttggtataataatctgatggagcaccgctggggctccaaaggctctagactgcagagactcgttcctgcctcctacgccgatggcgtatatcaacccttgggcgagccccacctgccaaacccacgagacctgagtaacaccattagccgcggtccagctggattggcaagcctgaggaacagaacagtccttggggtctttttcggttaccacgtccttagcgacttggtctccgtagaaacccccggttgtcccgcagagttcctgaacataaggatccccccaggggaccctatgtttgatcctgaccagagaggagatgtcgttctcccttttcaacgctctcgctgggacccagaaacaggtcgaagcccgtccaatcctagggaccctgctaaccaagttacaggctggctcgacggcagtgctatctacgggtcatcacactcttggtccgatgcgctacgaagttttagccggggtcagctggcttctggcccagacccagcatttcccagagacagtcaaaacccacttctaatgtgggccgctcctgatccggctactggacagaacggccctagaggattgtatgctttcggagcggaacgaggaaacagggagccatttctgcaggcgctgggactgctgtggtttagataccataacttatgggcacaacggctagccagacagcatcctgactgggaggacgaagaactgttccaacatgccagaaagcgagtcattgctacttatcaaaatatcgcagtttatgaatggctgccctccttcctgcaaaaaaccctgcccgaatacaccggctatcggccattccttgaccctagcataagctccgagttcgtagcagcctccgagcagttcctgtctaccatggttcctcctggggtgtacatgaggaacgcatcttgtcactttcagggagtcatcaacaggaatagcagtgtttctagagccctgagagtttgcaacagctactggtcccgtgagcatccctccctgcagtccgcagaggacgtggacgcgctgctgctcggcatggccagtcaaattgctgaacgagaggatcacgtgctcgtagaggatgtcagggacttctggcccggacctctaaagttctcccggaccgaccacctggcgtcgtgtctgcagcgtggcagagatttaggcctgccatcttacacaaaggccagagctgcgctcggcctgagccctatcaccagatggcaggatattaaccccgcactgagtcggtccaatgatactgttttagaagcgacggctgctctatataatcaggacctcagctggcttgagctgctgcctgggggtttgttggagtcccacagagatccaggcccactgttttccactattgttctggagcagtttgtgcggcttcgagacggagatcgatattggtttgagaacacccgcaacggcctcttcagcaaaaaggagatcgaggagattcgtaacacaacacttcaggatgtgttagtcgccgtgatcaacattgacccttcagctctgcagcctaacgtattcgtctggcacaagggggacccctgcccacagcctagacagctgagtactgaaggcctccctgcctgcgcgccatccgtggtgagagactatttcgagggctctggattcggcttcggcgtaactatcggcactctgtgttgcttccccctggtatccctcctgtccgcatggatcgtcgcgcgactgaggatgagaaatttcaaacggctccaaggacaggacagacagtccatcgtgtccgagaaactagttgggggaatggaggccctcgaatggcagggacacaaggagccttgtagaccagtcctagtttacttgcagcccggtcagatccgcgtggtagacggacgtctgacagtgctgcggaccattcagctccagcccccacagaaagtgaatttcgtgctgagtagcaataggggaaggaggaccttgctgctgaagatacctaaagaatatgatcttgtcctcttatttaatttggaggaagaacgacaggcccttgttgaaaatctgcggggagccttaaaggagagcgggctctcaatccaagaatgggaactgcgggaacaagagttgatgcgggcagctgtcacgagagaacagaggcggcatctcctggaaacgttctttcgtcacctgttcagtcaggttctggacatcaaccaggcagacgccggtacactccctctggacagcagccaaaaagtgagggaggctttaacctgtgagctatcaagggcagagttcgccgaatctcttggactcaaaccacaagatatgttcgttgaaagcatgttctccctcgccgataaggatggcaatggttacctgtcattcagagaatttctcgatatcctcgtagtgttcatgaaaggaagtccagaggaaaagtcccggctgatgtttagaatgtatgacttcgacgggaacgggttgattagtaaggatgagttcatcaggatgctccgctcttttatcgagattagcaacaactgcctgtccaaagcccagcttgctgaggttgttgagtccatgtttagagaaagtggttttcaagacaaggaggagctgacgtgggaagatttccactttatgctcagagatcataactcggaactgcgttttacccagctgtgcgtgaaaggggtggaagtcccagaggtgattaaagatctctgtcgccgagcctcctacatctcacaggacatgatttgcccatccccaagggtgtctgccaggtgttctaggagtgacattgagacagaactgactccccagcggctccaatgtcccatggatactgacccgcctcaggagattagacgtaggttcggtaaaaaggtaacatcatttcagcccctgctgttcaccgaagcccaccgagagaagttccaaagaagttgtctgcatcaaaccgtccagcaattcaaaagatttatcgaaaactaccgcaggcacataggttgtgttgcagttttttatgcaatcgcaggtgggcttttcctagagcgagcctattactacgccttcgccgctcatcatacaggtatcactgacacaactcgcgtcggtatcattttgagcagaggcacagccgcatctataagctttatgttctcgtatattctcctgaccatgtgtaggaatctgatcacctttctgcgcgaaacctttctgaatagatatgttccattcgacgctgcagttgactttcaccggctcattgcatcgacagccattgtactgaccgtgttgcacagcgtcggtcacgttgttaatgtctatctgtttagcatttcaccattgagcgtgctgtcatgcctgttccctggtctgttccacgatgacggaagcgaattgccccagaagtattattggtggtttttccaaacagtcccagggctcactggagttgtgcttctgctcatcttagcgattatgtacgtgttcgcttcccatcattttcggagacggagtttccggggtttttggctcactcatcatctttatattctgctgtacgtactgttaataatccacggctcatttgccctaatccagctcccacgatttcacattttcttcctcgtgccggctattatctacggaggggacaaacttgttagcttatccagaaagaaggtcgagatctccgtcgtgaaagcagaactgctgccgtccggcgtcactcatctgaggtttcaaaggccacagggtttcgagtataagtcgggacagtgggtgaggatagcttgcctggccctcggcacaacggagtaccatccatttactcttacctctgccccacatgaagacacgttgtctctgcacattcgggcagcaggaccctggactacaagattgagagagatttacagcgctccaaccggagacaggtgcgcgaggtacccgaagctttacctggatggtcccttcggagaggggcaccaagagtggcacaagtttgaggtgagcgtcttggtgggaggaggcatcggcgtcacccccttcgcctctatcttgaaagatctcgtttttaaaagctcagtgtcatgccaggttttctgcaagaagatctacttcatatgggtaacacggacgcagagacagtttgaatggctggcagatattatccgagaagtggaggaaaatgatcatcaagacttggtttcggtacacatatacattacccagctggctgaaaaatttgaccttcggactacaatgctgtacatctgcgaacgtcactttcaaaaagtactcaataggtcactttttaccggcttgagatcaatcacacacttcggacgccctccattcgagcccttctttaatagtttacaggaggttcatccgcaggttaggaagatcggggtgttttcctgtggacccccaggcatgactaaaaacgtggaaaaagcctgccagttgatcaacagacaggacagaacacacttctcccaccactatgagaacttctag

SEQ ID NO: 221293 - DNA, 4656 bp, Artificial Sequence
  Description of Artificial Sequence: Synthetic coding sequence
atggggttttgcctggctctggcttggaccctgctagtcggtgcttggacacccctgggagcccagaatcccatcagctgggaggtgcagaggttcgatggttggtacaacaacctcatggaacaccggtgggggtccaaaggcagccgcttgcagcgcctggtgcctgcgtcctacgccgatggcgtgtatcaaccgctgggtgagcctcatctccccaatccaagagatctgagcaatacaatcagcagagggccagccggactagcttctctgcggaaccgaaccgttctgggggttttcttcggctaccacgtgttgtctgatttggtctccgtcgagacacctggctgtccagccgagtttctcaatatcagaattccgcctggggacccgatgttcgacccagaccaacgtggggatgtcgtattgccatttcagcgctctaggtgggatcccgaaaccggacgctcccccagtaaccccagagacccggcaaaccaggtaactggttggctggacggcagcgccatatatggcagtagccattcatggagcgacgcactgcggtccttttctcgagggcagctggccagcggtcccgacccggctttcccaagagatagtcaaaatcccctccttatgtgggctgcccctgatcctgccacgggccaaaatggccctaggggactatacgcatttggcgcagagaggggaaaccgggagcctttccttcaagccctcgggctgctgtggtttcggtaccacaatctctgggcacagcgcctcgcgagacaacatcccgattgggaagacgaagagctatttcagcatgcaaggaagagagtgatcgcaacataccagaacatagcagtgtatgaatggcttcccagctttctccaaaagactctgcctgaatataccggctaccggcctttcctggacccatctatttctagtgagttcgtcgcggctagtgaacaatttctgtcgacgatggtacccccaggtgtctacatgcgcaatgcaagctgtcacttccagggcgtcatcaatcggaattcctctgtcagcagagcgctccgggtttgtaatagctattggagcagagaacatccgtctctgcaatctgcagaagacgtggacgccctgctgttgggaatggcttctcagatagccgagcgggaagaccatgtgctcgtggaagacgttagagacttttggcctggcccactgaaattctccagaacagatcacctggcgtcttgcctgcagcggggacgggatctgggactcccaagctatactaaagccagagctgccctcggcctgtctcccatcacccggtggcaagatattaaccccgctctgtctaggtcgaatgatacagttttagaagccaccgcggcactttacaatcaggatctcagctggttggaactactgccgggaggactcttggaaagtcacagagaccctggccctttgttttccaccattgtcctcgagcagttcgtgcgactacgcgatggtgaccgttactggttcgagaacacccgaaatggacttttttcgaagaaggagatcgaggaaattagaaacactactctccaggatgtgctggtagctgtcatcaacatcgacccgagcgctctgcagccaaatgtttttgtgtggcacaaaggcgacccttgcccccagccgagacagctgagtacagaaggactccctgcatgcgcccctagcgtcgtgagggactactttgagggctctggttttgggttcggagttacaatcggaaccctgtgctgttttcccttggtgagtctgctttcggcctggatcgtggccagacttagaatgcgcaacttcaagaggctgcagggacaggatagacagagtattgtatccgagaagttagtgggcggaatggaagcccttgaatggcaaggccataaagagccatgccgccctgtcctggtgtatttacagccaggacaaattcgagtggtggacggcaggctcaccgtcctgcgaactatccagctgcagcccccacagaaagtcaattttgtgctcagttcaaatcgcggaagacgtaccctgctcctgaaaatcccaaaggaatacgatctggtgctcttgttcaacttggaggaggagcgccaagcacttgtggagaatctccgaggagcccttaaggagagtggtttgagcatccaggaatgggagttaagggaacaagagctgatgagagctgccgtgacacgcgagcaacgcagacacctgcttgaaacatttttccgccacctgttcagccaagtgcttgacatcaaccaggctgacgcagggactctgccactggattcctcacagaaggtgagggaagctcttacatgcgagctcagccgcgctgagttcgccgagagcctcgggcttaaacctcaggacatgtttgtggagagcatgttctccttggcagataaagacgggaacggatacctgtcattcagagaattcttggatattcttgttgtatttatgaaaggtagtcctgaagagaaatctcgcctgatgttccggatgtatgatttcgatggaaatggtttgatctctaaagatgaattcattcggatgttgagaagcttcatcgagatatctaacaactgtctttctaaagcacagctggctgaagtggtggaatctatgtttagggagagtggattccaggacaaagaagagctaacatgggaagatttccatttcatgctgagagatcacaatagcgagctgagattcacacagttgtgcgttaaaggggtcgaagtcccagaagtgatcaaggatctctgtaggcgtgcgtcatatatcagccaggatatgatttgtccctccccgcgtgtgagcgcccgatgcagccgcagcgatatcgagactgagttgaccccccaaagactccagtgccctatggataccgaccctcctcaagaaatacgcaggagattcggcaagaaagtcaccagctttcaaccactgctgttcacagaagcccaccgggaaaaattccagagatcttgcttgcaccaaaccgtgcagcagttcaagcggtttattgagaattacaggaggcacattggctgtgtagcagtgttctacgctatcgccggtggattattcctggaacgggcatactattacgctttcgcagctcaccataccgggataacagacactacacgcgtaggaatcattctcagccgagggacagcagcctccatctccttcatgttcagttatatcctccttacaatgtgtaggaatctcattacatttcttcgcgaaaccttcctcaacaggtatgtgccatttgacgccgcagtggactttcataggctgatagcctccacagcaatcgtgctcactgtcttgcactcagtcggccacgtggtgaacgtttatctgttttcaatcagccccttgtccgtgctgagttgcctttttccgggactctttcatgatgacggttcggaactcccacagaagtattactggtggtttttccagactgtaccgggactaacaggagtggtgttactcctcatactggctatcatgtatgtgttcgcgagtcaccactttaggcgcaggtcctttagaggcttttggcttacccaccacctttacatcttgttatatgtcttgttaattatccatggttcttttgcccttatacaactgcctaggttccacatcttctttctcgtgcccgctatcatttacggaggagacaaactggtatcactttccagaaagaaggtggaaattagcgtggttaaggctgagctgcttcccagcggtgttacgcacctgaggttccaaaggccacagggattcgaatacaagagtggccagtgggtgaggatagcctgtctggcgctaggcacaactgagtatcatccttttacccttacctccgctccccacgaggataccctgtccttacacatcagggctgccggaccctggaccacccgcctgcgagagatttactcagcgccaacgggggaccgctgcgctcgttaccctaagctgtacctcgacggacccttcggagaagggcatcaggaatggcataaattcgaggtgtcagtattagtggggggtgggattggtgtgaccccttttgcatctatcctcaaggatttggtctttaaatccagcgtgtcctgccaggtgttttgtaaaaagatttactttatttgggtgactcggacacagcggcagttcgagtggctggccgacattattcgggaggtagaagagaacgaccatcaggatctggtgagcgtgcacatatatattacccagttagccgagaaatttgatttaaggactaccatgctgtatatctgcgaaagacacttccagaaggtgctgaatcggtctctcttcacgggactgagatccatcacccactttggccgtcctccgttcgaaccgtttttcaactctctgcaggaggttcacccccaagtaagaaagattggggttttctcatgcggtccgcctggaatgacaaagaacgtagagaaagcctgtcagcttatcaacagacaggatcgtacccactttagtcatcattacgagaatttctag

SEQ ID NO: 221294 - DNA, 132 bp, Artificial Sequence
  Description of Artificial Sequence: Synthetic coding sequence
atggggttctgcttagctctggcctggactctgctggtgggagcttggacgccactgggcgctcagaaccccattagctgggaagtccagcgctttgacggttggtacaacaatctaatggaacaccgatag

SEQ ID NO: 221295 - DNA, 3594 bp, Artificial Sequence
  Description of Artificial Sequence: Synthetic coding sequence
atgtggatgcactgctgctgggcctggcctccgaggagccagagtgaaaggaccatgtgctggctcaagatgtgcggagtctccctccggttatcacttcaggtggttaattcatggcccctgggcagagggtctgctggcttgcccgaacccgatttctggccaggcccactcaagttcagccggacagatcatttggcctcatgtctccaacgcggtcgtgacctaggtctgccaagttacacgaaagccagagcagctttagggctaagccctattactcgatggcaggacattaaccctgccctcagccggagcaacgacacagttttagaagctaccgcagccctgtacaatcaggaccttagctggctggaactactgcccggaggattgttggaaagccacagagacccaggcccactgttcagtaccatcgtgttagagcaattcgtgcgactccgagacggggatcgttattggtttgagaatacacggaatggactgttctctaaaaaagaaattgaggagatccgcaatactactctgcaggatgtgttagtagctgttattaacatagacccctctgcactgcagcctaacgtgtttgtatggcacaagggtgatccttgcccccagcctcgacagctctctactgaaggcctccctgcatgcgctccttccgttgtacgtgattattttgaggggtccggatttggtttcggagtgacgattggcacactgtgttgtttcccattggtcagtctgctctccgcctggatcgtcgccagactccggatgagaaacttcaaacgcttgcagggccaagaccgccagagcatcgtgagcgaaaaactggttggagggatggaggcactggaatggcaaggtcataaagaaccgtgtcggccagtcctggtatacctgcagcccggacaaattcgcgttgttgacggacgcttaaccgtgctgcggacaattcagttacaacccccacagaaagtgaattttgtgctcagtagtaataggggtaggcgaactctcttgcttaaaatccctaaggaatacgatttagtgctgctcttcaatctagaagaggagaggcaggccctagtggagaatctccgcggtgccctgaaggaatcgggcctctcgatccaagagtgggaattgcgcgagcaggagctgatgcgagctgccgtgaccagagagcagcggagacatctgcttgaaacattttttaggcacctgttcagccaggtgttagacatcaaccaagctgacgccggaaccctccctctggatagttcacagaaggtgagggaagctctaacatgcgagcttagccgcgcagaatttgctgagtccctcggtctgaaaccccaggatatgtttgttgagagcatgtttagtttggccgacaaagatggcaatggctacttgtcatttcgagaattcctcgatatcttggttgtgtttatgaaggggagccctgaagagaaaagcaggctcatgttcaggatgtacgatttcgatggcaacggcctgatcagtaaagatgaattcatcaggatgcttcgctctttcatagaaatctcaaacaattgtctctccaaggcccaattggccgaggtggtggagtctatgtttcgtgaaagtggctttcaggataaggaagagctgacttgggaagatttccatttcatgctccgcgatcacaacagtgaactaaggttcacacagttgtgcgtaaagggcgtagaggtgccagaagtcatcaaggatctgtgtcgccgagctagttacatcagccaggatatgatctgtccaagcccacgggtctccgcacgttgctcccggtccgacatcgagacggagttaactccccaacgactgcagtgccccatggataccgatcctccacaggagatcagaaggcggtttggtaagaaagtgactagcttccagcccctgctgtttacagaggctcatagggaaaagttccagcggtcttgtctgcatcagacggtgcagcagttcaagagatttatagaaaactacaggcggcatatcgggtgcgtggccgttttctatgcaatcgcgggagggctgttcctggagagagcctactactacgcattcgccgctcaccatacgggcattactgatacaactagagtcggaatcatcctgtctagggggacagcagcctcaatcagcttcatgttcagttacatcctcctaaccatgtgccgcaacctgattactttcctcagagagactttcctcaataggtatgtgccattcgacgccgcagtggatttccaccggctcattgcctctacagccatcgtgctaaccgtgctgcactccgtcgggcacgtcgtcaacgtgtacctattttctatcagtcccctcagcgtgctctcttgccttttccccggtctcttccacgatgatggctcggaactcccacaaaagtattattggtggttcttccagaccgttcctggactcactggcgttgtgctgctcctgattctcgctatcatgtatgtctttgcctctcaccatttcaggcggcgaagctttcgcggattttggctcactcatcacctctacatcttgttgtacgtccttctgattatccacggctcgttcgcactcatacaactgccaagattccacatattttttctggttcctgcaattatttacggcggtgataagctcgtgagtctctcccgcaaaaaggtggagatctctgtggtcaaggccgagttactgcccagcggagtgactcatttgcgcttccagaggccccagggtttcgaatataaatctggccagtgggtacgaatcgcatgcctggcactgggcacgacggagtatcacccatttaccctgacatccgcccctcatgaagacactctttctctgcatatccgagcagccggaccatggacaacgagactacgggagatttattccgcccctactggtgacagatgcgccaggtaccccaaactgtatttagatggaccttttggcgaggggcaccaggagtggcataaattcgaagtatccgtattagtcggcggtggcatcggagtcaccccttttgcgagtatcctaaaagacctggtatttaaatccagcgtgagctgtcaggtcttctgtaaaaagatctactttatttgggtgactagaactcaaaggcaattcgagtggcttgctgatatcatccgagaggtcgaagagaatgaccaccaggatctagtgtctgtccacatctatatcacgcagctggcagaaaagtttgatctcagaacaaccatgctgtacatctgcgaaagacacttccagaaagttttgaaccgaagtctgttcactgggctccggtcaatcacacactttggaaggccacctttcgagccatttttcaacagcctgcaggaggtgcacccacaagtccgcaagattggcgtgtttagctgtggccctccaggtatgacaaaaaatgtggaaaaggcatgtcagttgatcaatcgacaggacaggacacatttctcccaccactatgagaacttctag

SEQ ID NO: 221296 - DNA, 4647 bp, Artificial Sequence
  Description of Artificial Sequence: Synthetic coding sequence
atgttacgggcacgtcccgaggctcttatgctcctgggggctctcttaactgggagcctcggcccttctggaaatcaagacgctctctccttaccctgggaggtccaaaggtatgatggttggttcaacaatctccgccaccacgagcgcggagccgtgggctgtaggctgcagcggagggtgccagcaaattatgccgacggagtatatcaagcccttgaggagccacaactgccaaatcccaggaggcttagtaatgctgccactcggggtatcgccggtctgccctctttgcacaaccgcaccgttctgggcgtgtttttcgggtaccacgtgctttccgacgtggtcagtgtcgagactcctgggtgccccgcagaattcctaaatattcggattcccccaggcgaccctgtgtttgatcctgatcagagaggggacgttgtccttccttttcagcgttctcgctgggatcccgaaaccggacggagcccatccaatccacgggatctcgcgaaccaggtgactgggtggctggacggctccgccatatacggcagcagtcacagctggtccgacgccctgcggtcgttcagtggcggacagctcgctagcggtcccgacccggctttcccccgtgatagccagaacccattgctcatgtgggccgctcccgatcctgccaccgggcagaacgggcctagagggctttatgcctttggcgcagagcgcggaaaccgggagccgttcttgcaggcactgggcctactctggtttcgctatcataacctgtgggcacagcgcttagcaagacagcatcctgattgggaagatgaagagctctttcagcatgctaggaaacgggtcatcgccacgtaccaaaatatcgccgtgtacgagtggctgccaagcttcctgcaaaaaacccttcccgagtatacaggctaccgtccattcttggacccctctatctctcccgagtttgtcgtagcttctgagcagtttttctccactatggttccccctggcgtgtatatgcggaatgccagttgccattttaggaaagttctcaacaaagggtttcaatcttctcaagcgctgcgcgtgtgtaacaactattggattagggaaaaccctaatctgaactctacccaggaggtcaatgaactgctcctgggcatggctagtcagatctcagagctcgaagacaatattgtcgtggaggacctgcgcgattattggcccggacctggaaagttttcacggactgactacgtggcctctagcatacagcgcggtcgcgacatgggacttccgtcctattctcaggcactgctagcgttcgggttggacattcccagaaattggtctgatcttaatcccaacgttgacccacaagtgctggaagcaacagctgcgttgtacaaccaggacctgagccagttggagctcctccttggtggactgctggagagccacggggatcccggacccttattctctgccatagtattagaccagttcgtacgcctgcgggacggcgaccgctattggtttgagaatactaggaacggcctattcagcaaaaaggagattgaagacattcggaatactacactgcgagatgttctggtcgctgtgattaacatagatccgagtgcccttcagcctaatgttttcgtgtggcacaaaggcgcaccctgtcctcagccaaaacagctgacgacagatgggcttccacagtgcgcgcctctcaccgtcctcgacttcttcgagggcagcagcccaggcttcgccatcaccattattgcactgtgctgcctgccactagtgtctttgctcctgagtggggtggtggcatacttccgaggtcgggagcataaaaaattgcaaaagaaacttaaggaatcagtgaagaaggaagcggctaaagacggggtgcccgctatggagtggcctggccctaaggagcgaagcagtccgattattatccaactcctgtccgacagatgcctgcaggtgttgaataggcacctcacagtcctgcgggtggtccaactgcaaccccttcagcaggttaacttgatcctttcgaataatagaggttgccggacactcttgctgaagattcctaaggaatacgatctggtgctgctgtttagcagcgaagaagaacgcggtgcctttgtgcagcagctgtgggacttttgcgtcaggtgggccctgggcctgcatgtcgcagagatgtctgagaaggagctcttccgcaaagcagtgaccaagcagcagagagagcggatcctggagatcttttttcggcacctgtttgctcaggttttagacatcaaccaggcagacgccggtaccttacctttggattcaagccagaaggtgcgagaagccctcacatgcgaacttagccgcgcagagtttgccgaaagccttgggctgaagccacaagatatgtttgtggagtccatgttctcacttgccgacaaagatggtaacgggtatctgtcatttcgcgagtttctagatattcttgtcgtgttcatgaaagggtcacccgaggacaaaagccgattgatgttcactatgtacgaccttgatgaaaacggttttttgtcaaaagatgagtttttcactatgatgcgtagcttcatcgagatttctaacaattgtctgagcaaagctcagctcgcggaggtggtcgaatccatgttccgggagtccggcttccaggataaggaggagctcacatgggaggattttcatttcatgttgcgtgatcacgactccgaactccgttttactcagttatgcgtcaaagggggtggaggcggtgggaacgggattcgggatatctttaaacagaatattagttgccgagtaagcttcataactcgtacgccaggcgaacgtagtcatccgcagggtctgggccctccagccccagaagcacccgagttgggcggacccggactaaagaagagatttggtaagaaagctgctgtaccaactccaaggctctataccgaggccctgcaggaaaagatgcagcggggatttctggcccagaagctgcagcagtataaaaggtttgtggagaactaccgacggcacattgtttgcgtggctatcttttctgccatttgcgttggtgtttttgccgaccgcgcatactattacggcttcgccagcccaccctccgatattgctcagactacactcgtcggaatcatcctctctagaggcaccgctgcatccgtaagtttcatgttcagctacattctgctgaccatgtgtaggaacttaataaccttcctgcgcgaaactttccttaacagatatgtgccattcgatgctgccgtagactttcaccgctggatcgctatggcagccgtagtactggctatcttacactccgccggacatgccgtcaatgtgtacatcttttcagtatctccactgtctctgctggcgtgcattttccctaatgtttttgtcaatgacggctccaaacttcctcaaaaattctactggtggtttttccagactgttccaggcatgaccggagtgctgttactgctcgtgcttgccattatgtatgtttttgcaagccaccactttcgcagacggtcatttcgcggattctggcttacgcaccacttgtatattctgctgtacgcccttctgatcatccacggcagctatgctctgattcagttacccacctttcatatttatttcttggtgccagcaattatctacggtggcgacaagctggtttctttgtctcgaaagaaggtcgagatttccgtcgttaaggccgagctcctcccgagcggcgttacctatctacagtttcagcgcccacagggttttgaatacaagagtggacagtgggttagaatcgcctgtctggctctaggcactacagaatatcatcccttcaccctcaccagtgcgccacacgaggataccctcagtctgcatatcagggctgtagggccatggactactaggctgcgcgaaatctacagcagccccaaaggaaatggttgcgccggataccccaaactgtacctcgacggcccttttggagaagggcaccaggaatggcacaagttcgaggtgtccgtcctggtcggcggaggaatcggcgtaacccccttcgctagtatcctaaaggacttggtctttaagtcatcactgggaagccagatgctgtgtaaaaagatttacttcatctgggtgacaaggacgcagcgccagtttgaatggttggcagacatcatccaggaagtggaagaaaacgaccatcaggaccttgtctccgtccacatctatgtgacacaattggcagaaaaatttgacctccgcacaacaatgctgtacatctgcgaaaggcatttccagaaggtgctcaatcgatctctgtttactggacttcggagcattacacactttggcaggccaccgttcgaaccgttcttcaactctctgcaggaggtacaccctcaggtccggaaaatcggggtctttagctgcgggcctcccggaatgactaaaaatgtggaaaaggcatgtcaactggtgaataggcaggatcgcgctcacttcatgcaccactacgaaaatttctag

SEQ ID NO: 221297 - DNA, 1452 bp, Artificial Sequence
  Description of Artificial Sequence: Synthetic coding sequence
atggctacactgggacacacatttcctttttatgccggacccaagcctacgttcccgatggacactacacttgcttcgatcataatgatttttctgaccgccctcgcaacgttcattgtcatcctgcctggcatcagaggcaaaactcgactgttctggctactgagagtagttacttcactgttcatcggagccgcaattctcgccgttaacttctcctcagagtggtcagtggggcaggtgtctaccaatacatcttacaaggcattctctagcgaatggatttcagcagacatcggacttcaagtagggctaggcggtgtgaatattactctcaccggaacaccggtacagcagttaaatgagacaatcaactacaatgaggaattcacctggcgcctgggcgaaaactatgccgaagagtatgctaaggccttggaaaaggggctgccagatcccgtgctgtacctggctgagaaatttacacctcgctccccctgcggactctaccgccagtaccgccttgcaggccactatacctctgcaatgctttgggtggcatttctgtgctggttgctcgcaaatgtgatgttatcgatgccagttttagtgtacggtggctatatgctgctcgcaacaggcatcttccaactactcgcactgctgttcttttccatggcaacttcattgacctcaccttgccccttgcatctcggcgcttccgtgctgcatacccatcatgggcctgcgttttggatcacccttactactggattgctgtgtgtactgctggggcttgctatggccgtggctcaccggatgcagccccaccgtctgaaagcctttttcaaccagtcagttgacgaggaccctatgctagaatggagtccagaagagggcggtctgctatcgccacgctataggtctatggcggatagccccaaatcccaggacatacctctgtccgaagcatcttcaacaaaggcttattatcgccctcgcaggctgtcgctggtacccgcagacgtcaggggcttggcaccagccgctctgtccgctttgcccggagccctgctggcccaggcatggcgcgctctgttacctggcctgcgttgtcctaaagccggaaaggagtctagactgggccctccccattcaccatggcgattcggcccagagggttgtgaagagagatgggctgagcacactggggactctccgaggccccttaggggcaggggtaccggcaggctctggcgatggggatccaaggaaagaagggcatgtggcgtgcgggcaatgctccccagactagtgtcgaacagcggtctcaagcgaccttcctgtcttgatctgccaaagtgttgggattaccgtcgcgacgccagggcattcttccatttactagaaccaacgccttgcgtcacatcacgtcacacaccactcatttag

SEQ ID NO: 221298 - DNA, 1317 bp, Artificial Sequence
  Description of Artificial Sequence: Synthetic coding sequence
atggccaccctggggcacacattccctttctacgccggacccaaaccgacctttccaatggataccacccttgcttccattataatgatcttccttaccgccctcgcaaccttcatagtgatcctgccagggatccgaggaaaaacgagactgttctggctgctgagagtggtgacatccctgttcatcggagccgctattctgggcacacccgtgcagcagctgaacgagaccattaattataatgaggagttcacttggaggctgggagaaaactacgccgaagagtacgccaaggcccttgagaaaggcctccctgaccctgtcctctacttggccgaaaaattcactccacggagcccctgcggcctgtaccggcaataccggctcgccggacactatacaagtgcaatgctctgggttgctttcctgtgctggttgctggcaaacgtcatgctaagcatgcccgtgctggtctatggcggatatatgcttctggcgaccgggatatttcagctgctggctctgctttttttcagcatggcaacgagcctcaccagtccatgccctttgcacctaggggcatctgtgcttcatactcaccacggacctgctttttggatcactttgaccacagggcttctgtgcgtcctgttgggcctggcaatggcggttgcccacagaatgcagccacacaggctgaaagccttcttcaaccagtcagtcgacgaggatcccatgcttgagtggtctcctgaagaagggggactcctctcccctagatatcgaagtatggccgacagccctaagagccaggacattccattgagcgaggcctcatctaccaaggcgtattaccgacctagaagattatccctggtgcctgctgatgtgcggggtctggcccctgctgcgttgtcagccttacctggcgctctgctggcacaagcctggagggccctgctccctggacttagatgtcctaaggcgggtaaggagtcaagacttggcccaccccactctccttggcggtttggtcccgagggatgtgaggaacgatgggctgaacacaccggtgactctcctcggcctctgagaggaaggggaaccgggagactatggaggtggggctccaaggagcggcgagcctgcggagtgcgagccatgttgcccagactggtttcgaactctgggcttaaaaggccgtcgtgtctggatctgcctaaatgctgggactatcgacgggacgccagagccttctttcatctccttgagccgactccgtgcgtgacaagcagacatacgccattaatctag

SEQ ID NO: 221299 - DNA, 234 bp, Artificial Sequence
  Description of Artificial Sequence: Synthetic coding sequence
atggctactctgggacatacctttcccttctatgctggacctaaacctacgtttccgatggatacgaccctggctagtattattatgatcttcttgacggcgttagcaacattcatcgtcatcctgccgggaattaggggcaagacccggctcttctggctgctccgggttgttaccagcctatttataggggcagctattcttggaactccggttcagcagttgaacgagtag

SEQ ID NO: 221300 - DNA, 219 bp, Artificial Sequence
  Description of Artificial Sequence: Synthetic coding sequence
atggccaccctcggtcacacgtttccgttctatgcaggcccaaagcctacatttcctatggataccacactcgcatctatcataatgattttcctcacagccctcgccactttcattgtgatcttaccgggaatccgagggaagacaagactattctggctgctgcgcgtggtaaccagcctgttcatcggggctgctatcctggccgttaacttctag

SEQ ID NO: 221301 - DNA, 897 bp, Artificial Sequence
  Description of Artificial Sequence: Synthetic coding sequence
atggccactctggggcacacctttccattctacgcagggccaaagcctaccttccccatggacactaccttggcctccatcataatgattttcttaacagctctggcaacatttatcgtgatccttccgggaatcagaggtaaaacacggctgttttggctgctccgggtggtcacttccctcttcattggggcagccatcttgggcacccctgtccaacagctgaatgagaccattaactacaacgaggagtttacttggcgccttggagagaattacgcagaggagtacgccaaagccctggagaagggtctgcccgaccctgtcctgtacttagctgaaaagtttaccccaagaagcccctgtggtttatataggcagtatagactcgccggacactacacttcagccatgctctgggtggcgtttctgtgctggctcttggccaatgtgatgctgtcaatgccggtcctggtgtatggtggctatatgctgcttgccactggaatttttcaactcctggctctactgttcttttctatggcgacttctctgaccagtccatgtcctttgcacttgggagcgtccgtgctccacacacaccacggacctgcattctggatcacactgaccaccggcctgttatgcgtgctcctgggtttagctatggcagtggcccatagaatgcaaccgcatcggctgaaggccttcttcaatcagagtgtcgacgaggacccaatgcttgagtggtctccagaggaggggggtctcctgtctcccagatataggtctatggcggattctccaaagagccaggacattcccctgtctgaggcatcttccaccaaagcatattgcaaggaagctcaccccaaggatcctgattgcgcactgtag

SEQ ID NO: 221302 - DNA, 42 bp, Artificial Sequence
  Description of Artificial Sequence: Synthetic coding sequence
atggccactttgggtcacacatttcctttctatgccggatag

SEQ ID NO: 221303 - DNA, 897 bp, Artificial Sequence
  Description of Artificial Sequence: Synthetic coding sequence
atggctaccctgggccatactttcccattttacgcgggtcccaagcctacatttcctatggataccaccctggcctctataatcatgatcttcctcaccgctctagctaccttcatcgtgattcttcccggtattcggggaaaaacaagacttttctggttgctgagagtggttaccagcctctttatcggcgctgcgatcttggggactcccgtgcagcagttgaacgaaacaatcaactataacgaggagtttacttggcgactcggcgaaaactatgccgaggagtatgctaaagcactcgagaaaggcctgcccgaccctgttttgtatcttgctgagaaatttaccccgaggtctccctgtgggctgtatcggcagtatcgactcgcgggtcattatacgtctgctatgctttgggtggcatttctctgctggttgctggctaacgtcatgctgagcatgcctgtgttggtatacggtgggtacatgctgctggccacaggcatatttcagctgctcgcactgctttttttcagtatggctacttccctgacctccccgtgtccgttgcacctcggggcatcagtactccatacacaccacggtccagccttttggatcactctgacaaccggcctgttgtgcgtgctccttgggctcgctatggccgtcgcgcacaggatgcaacctcatcggcttaaggcattcttcaatcaatctgtcgatgaggatccgatgctggaatggtcacccgaagaagggggactgctcagtcctagatatagatctatggccgacagtcctaaatctcaagatataccgctgagcgaggccagcagcactaaagcttactgtaaggaagcgcacccaaaagatccagattgcgctctgtag

SEQ ID NO: 221304 - DNA, 1452 bp, Artificial Sequence
  Description of Artificial Sequence: Synthetic coding sequence
atggctacccttggacatacctttccgttctacgcgggaccaaagcctactttccccatggacactactctggcgtcaatcatcatgatcttcctgaccgccttagctaccttcatagtaatcctcccgggaatcagagggaaaaccaggcttttttggctgctgagggtggtgacctcactgttcatcggagccgctattctcgcggtgaacttcagttccgagtggtccgtcggtcaggtcagcacgaatacatcatataaggctttttcatctgagtggatcagcgccgacataggtcttcaagtaggcctggggggtgtcaatatcaccttgaccggcacgcctgtccaacagctgaacgaaactataaattataatgaggagtttacatggcgcttgggggaaaactatgcagaagagtatgcgaaggccctcgaaaagggattgccggaccccgtactgtacttagccgagaagtttacacccagatcaccttgcggactgtacagacagtacaggctcgctggtcattacacttctgctatgctgtgggtcgccttcctgtgttggctcctggccaatgtcatgctgtccatgcctgtgttagtgtatgggggttacatgttgctggccacagggatctttcaacttctggccttgttgttctttagcatggctacctcactgacatccccctgccccctccacctgggcgcatcagtgttgcatactcatcacggcccagcattttggataacacttaccacaggtctcctctgcgtactcctggggctggccatggccgtggcccaccgcatgcagccccatcggctgaaggctttctttaatcagtccgtggatgaggatccgatgctggaatggtctcccgaggaaggcggtcttttgtcaccacggtatcgatctatggctgacagcccaaaatcccaggacattcctctatccgaggcgtccagcaccaaagcttactatcgacctagacgattatcactggtccctgcagacgtcagggggttggctcccgcagccttgtcagccctaccaggggcactcctggctcaggcgtggagagccctgctgcctggcctgcgatgcccaaaggccggtaaggagtcccggttgggacctccccatagcccatggaggttcggcccagaagggtgtgaggagcgctgggccgagcacactggggattccccccgacccctgaggggcagaggcacaggcaggttatggaggtggggatccaaggaaagaagagcttgtggcgtgagagcaatgctgcctaggctggtgagtaattcaggccttaagcggccatcgtgtttggatcttccaaagtgctgggactaccggcgagatgctcgggctttttttcacctgctggagccaactccttgtgtgacaagcagacacacccccctgatctag

SEQ ID NO: 221305 - DNA, 219 bp, Artificial Sequence
  Description of Artificial Sequence: Synthetic coding sequence
atggcgaccctgggccatacttttccattttacgcaggtcctaaacctacttttccaatggacaccaccctggcttcaattatcatgatttttctcacagcacttgcaacgtttatagtaattttgcctgggattagagggaagacccggctgttttggctgctgcgagtggtcaccagcctcttcattggggctgcaatattggggactcccgtctag

SEQ ID NO: 221306 - DNA, 51 bp, Artificial Sequence
  Description of Artificial Sequence: Synthetic coding sequence
atggcaaccctgggacacacttttcccttctacgccggtcctaagccttag

SEQ ID NO: 221307 - DNA, 366 bp, Artificial Sequence
  Description of Artificial Sequence: Synthetic coding sequence
atggctacactgggtcacaccttcccattttacgcagggccaaagccaacattccccatggacacaacactcgcttcaatcatcatgatcttcctgacagcactggccaccttcatcgttatactgcctgggatcagagggaagacccgattattttggctactccgggttgtgacctctcttttcatcggcgcagccatcctagctgtcaatttcagcagcgaatggagcgtcggacaggtgagtactaacaccagttataaagccttcagctccgaatggatttctgctgatataggtctgcaggttgggcttgggggtgtaaatatcaccctgactggaacaccagtacagcagttaaactag

SEQ ID NO: 221308 - DNA, 1032 bp, Artificial Sequence
  Description of Artificial Sequence: Synthetic coding sequence
atggccactctaggccacacattccccttctacgccggtcccaagcccaccttccccatggacacaaccttagcctcgattatcatgatcttcctcacagctctggccactttcatagtaatccttcccggaatccgcggaaagaccaggctgttttggcttttgcgggtggtcactagcctctttattggtgccgctattctcgccgtgaacttcagctctgaatggtctgtgggtcaggtgagcactaatacttcttataaggctttctcatccgagtggatttccgcggatattggcctacaggttggtttgggaggagtcaacatcacccttacgggaacaccagtgcagcaacttaatgaaacaatcaattataacgaggaattcacatggcgattgggcgagaattacgcagaggagtacgccaaagccttggagaaaggcctccccgatccagtgctctacctcgcagagaagttcacccctcgctccccctgtggcttgtaccggcagtaccgcctcgccggacactataccagtgccatgctatgggtggccttcctgtgttggctcctggcaaacgtgatgctgtccatgcctgtcctcgtatacggaggctacatgctcctggccaccggtatttttcagctcttagcattgttgttttttagcatggcaacatcactgacctcgccatgtcccctgcatctcggagccagcgtactgcacacccaccacggtcccgctttttggatcaccctcacgactgggctgctctgtgtgcttctgggtctggccatggctgtcgctcaccggatgcaaccgcatagacttaaagcctttttcaatcagtccgtggatgaagatccaatgttggaatggtcacccgaagaagggggtttactttctcctcggtaccgatctatggcggattcacccaagagccaggatattcctctatctgaggcctccagcacaaaggcatattgtaaggaggcccacccgaaggaccccgactgcgcgctatag

SEQ ID NO: 221309 - DNA, 963 bp, Artificial Sequence
  Description of Artificial Sequence: Synthetic coding sequence
atgaccctgtggaatggcgtgctgccattctacccccaacccagacatgctgcaggtttttctgtgccattgctgatcgtgatactggtgttcttggccctggccgctagttttctgctgatcctacctggcattagaggtcatagtagatggttttggctggtcagggtgctcttgtctttattcattggcgctgaaatcgtagccgttcatttcagcgctgagtggtttgtggggacagtcaacaccaacacctcctacaaggccttctctgctgccagggtgacggcgcgtgtgcgactcttagtggggttagaaggcatcaatattactcttacaggcacacctgtgcaccagctgaatgaaacaatagactacaacgagcagtttacatggagactcaaggagaactatgccgcagagtatgcaaatgctcttgaaaaagggctgcccgatcctgtgctctatcttgccgagaaatttacacccagctcaccatgtggactgtaccaccaataccatctggccggacattatgcttctgctacgctttgggtagcattttgcttttggctcttatccaacgtgttactgagcacacccgctccgctctacgggggattagcattgcttacaacaggtgctttcgcattatttggtgtcttcgcattggcctcaattagttcagtgccgttgtgcccactacgcttgggatcctcagccctgaccactcagtacggagccgcattttgggtgacgctcgccaccggggtgctatgtctgttcctcggaggagcagtggtgagtcttcagtatgtcagaccaagcgcattgcggacactcctggaccaatccgccaaggactgttcacaggaaagggggggttctccactgatcctcggtgatccactacacaagcaagccgctttgcccgatctgaagtgtattactactaatctgtag

SEQ ID NO: 221310 - DNA, 1767 bp, Artificial Sequence
  Description of Artificial Sequence: Synthetic coding sequence
atggagggtgatggcgtcccttggggcagtgagccagttagtgggccaggaccaggaggcggtgggatgatcagggagctgtgccgtggctttggaaggtaccgtcgctacttgggcagactcaggcaaaacctccgtgaaacacagaaattcttccgcgatatcaagtgttcacacaatcacacctgcttgagttctttaacgggaggcggaggtgctgagcgcggaccagccggagacgtcgcagaaacggggttacaagcagggcaactaagttgcatatcattccctccaaaggaggagaaatacctgcagcagatcgtagattgtctgccatgcatccttatccttgggcaagattgcaatgttaagtgtcagctccttaacttgctactgggcgtgcaggtgctccctaccactaaactaggctctgaggagtcctgcaagctgagacgccttcgcttcacgtatggaactcagactcgcgttagcttagctctgcccggacaatatgaactcgtgcacactctggttgcccaccaaggaaattgggaaacaatccctgaggaggatctagaagtccaagagaataatgaggatgcagcccacgtgctggcagagttggaagtaactatgcaccacgcactgttgcaagaggtggacgtggtggtcgcaccttgtcagggactgagacctacggtggatgtgctcggcgacctggttaacgatttcctgcccgtcatcacgtatgccctccacaaggacgagctcagtgagcgcgatgaacaagagctgcaagagattcgcaagtattttagctttcctgtgtttttctttaaggtgcctaaactaggctccgagatcatagattccagcacccgcagaatggagtctgagcgctccccactatatcggcagctgatcgacctgggctatctgagtagttcccactggaactgtggagccccaggacaagatacaaaagcccaaagtatgctagtggaacagagtgagaagctgcggcatctgagtacttttagccaccaggtactccagacacgcctcgtcgatgcagccaaagccctgaacctcgtccattgtcactgtcttgacatcttcatcaaccaggcttttgatatgcaacgcgacctgcagataactccaaagcggctcgaatacacgaggaagaaagaaaacgagctgtatgagtcactgatgaatattgccaatagaaagcaagaagagatgaaagacatgatcgtcgagacactgaatacaatgaaggaggaactgctggacgatgccaccaatatggagttcaaggatgtcatcgtgccagagaacggcgaacctatcaccgatttggggttctgtaaacctgaagccatgatgagcggttcaatcgtgggaacacctatccatatggccccagagttattcaccggtaagtatgacaattccgtagatgtttacgcattcgggattttgttttggtacatctgctctggctccgtgaaacttcctgaagctttcgaaagatgtgctagcaaggaccatctgtggaacaatgttcggaggggggctcgacctgaacgtttaccagtttttgatgaagagtgttggcagctgatggaggcctgctgggatggtgacccactaaaacgtccactcctcgggatcgttcaacccatgctgcagggcatcatgaaccggctctgcaaaagtaatagcgagcagcctaatcgaggcctcgacgactctacctag

SEQ ID NO: 221311 - DNA, 2655 bp, Artificial Sequence
  Description of Artificial Sequence: Synthetic coding sequence
atggaaggcgacggcgtaccctgggggagcgagccggtcagcggacccggtcccggtggcggaggtatgatccgtgagctgtgtcgaggtttcggtcggtatagaaggtatcttggtaggttgagacagaacctgagggaaacacagaagtttttccgagatatcaagtgctcccacaatcacacctgccttagtagcttaaccgggggtggcggtgccgagagaggaccagctggggatgtagctgagaccgggctgcaggcaggacaactgagctgcatcagcttccctcctaaggaggaaaaatacttacagcagattgtggactgcttaccctgtatactgatcctgggacaggactgcaatgtgaaatgccagctcctaaatctcctgctgggagtccaggtattaccaacaactaagctcggctctgaggagtcatgtaaactgcgcaggctgcggttcacatacggcacacagacacgcgttagccttgcgctgccgggtcagtacgagctggtgcatacacttgtggcccaccaagggaactgggagaccatccccgaggaagatctcgaagtccaggagaataacgaggacgctgcacatgtcttggctgaacttgaggttactatgcaccacgctctgcttcaggaggtcgacgttgtggtggccccatgtcaaggtttaagacccactgtagacgtcctgggcgatcttgtgaatgactttctacccgttatcacgtacgcccttcacaaggatgaactgagcgagagagatgaacaggaactacaggagatacgcaaatacttctcatttccagttttcttctttaaagtgcccaagttgggctccgagatcattgattctagtaccaggaggatggagtccgagcgctcaccactgtatcgacagctgattgatctcggatatctgtcgtcctcacactggaactgcggagctcccggtcaggacaccaaagcacagtcaatgctcgtcgaacaatcagagaaactcagacacctgagtaccttttcccaccaagtgttgcagacccgcctagtggacgcagcgaaagctctcaatcttgtgcactgtcactgccttgatattttcatcaatcaagccttcgatatgcagcgggatctccagattacaccaaaaagactggagtatactaggaaaaaggagaatgagctctatgaatcgttaatgaatatcgccaacaggaaacaggaagagatgaaggatatgatcgtggagactctgaacacaatgaaggaggagctactggacgacgcgaccaacatggaatttaaagatgtcattgtcccagaaaatggcgaaccggtggggactcgagagattaagtgttgcattcggcagatacaggaacttatcataagtagactgaatcaagccgtggccaataagctgatctcgagtgtggattatttacgggagagctttgttgggacactggagcgatgtctccagtctctcgagaagtcgcaggacgtttccgtacatattaccagcaattacttgaagcaaattctgaatgccgcttaccatgttgaggtgaccttccatagcggttcttcagttacacgcatgctgtgggaacagattaaacaaattattcaacgcattacatgggtctcaccgccagctatcacactcgagtggaagagaaaggttgcgcaggaggcaattgagtcgctctccgcaagtaagctagcaaagtccatctgttctcaatttcgcaccagattaaattctagccatgaagcctttgctgccagcctgcgccaactggaggccggacactctgggagactggagaaaacggaagatctgtggctgcgagtgcgtaaagaccacgcacctagactggcacgcctcagccttgagtcctgctcacttcaggacgtattactgcatcgtaagcccaagcttggccaggagctgggccgaggccagtacggagtggtgtatctctgtgataactggggcggtcactttccatgcgccctgaagagtgtggtgccgccagacgagaagcattggaacgacctcgcgttagaatttcattacatgcggtccctgccaaaacatgaacggctggtggatttgcacggttctgttatagattacaattacgggggaggatccagcatcgcggtccttctgataatggagcgtttacacagggatctttataccggactgaaagccggattaacactcgaaacccgcctgcagatcgccctcgatgtcgtggaagggatccgctttctgcatagccaggggctcgtgcaccgagatattaaacttaagaatgtgcttctggacaaacaaaaccgggctaagatcacagacttaggcttttgcaaacctgaagcaatgatgagtgggagcatcgtgggcactcctatacatatggcacccgagctgttcacgggagcccgacctgagagactgcccgtatttgatgaagaatgctggcaactgatggaggcgtgttgggacggtgatccactgaagcgcccactgctgggcatcgtccagccgatgctccaaggtattatgaacaggctttgcaagtccaacagtgagcagccaaacagaggcctggacgacagcacctag

SEQ ID NO: 221312 - DNA, 2790 bp, Artificial Sequence
  Description of Artificial Sequence: Synthetic coding sequence
atggagggggacggcgtcccttggggatcggaacctgtgtctggacccggaccagggggtgggggaatgatccgagaattgtgcaggggtttcgggagatatcgtagataccttggacgactccgccagaacctccgtgaaactcaaaagtttttccgcgatataaaatgttcccataatcacacctgtctaagtagtctaacaggtggagggggagctgaacgaggtccggcaggagacgtagcagagacaggcctgcaggcaggacagctgagctgtatcagctttccacccaaggaggagaaatacctgcagcagatcgtggattgtttgccgtgtatactgatcctggggcaagattgcaacgttaagtgtcagcttctgaaccttctcctgggcgtgcaagttctcccaacaacaaagctcggctccgaggaatcctgtaagctaagacgcctgagatttacgtacggcacacagacccgggtgtcactagctctccccggtcagtacgagctggtgcacacattggtagcccaccagggaaattgggagaccattcctgaggaggatctcgaggttcaggagaataatgaagacgctgcccacgtactggctgagctggaagtgaccatgcatcatgccctcctgcaggaggtggacgtggtggtggccccatgtcaagggctgagacctacggtggatgtattgggagacctggtcaatgactttctacccgtgatcacctacgctctgcacaaggatgaattatccgagcgtgacgagcaggagttacaggaaatacgaaaatatttttcctttcccgtgttcttcttcaaggtgcccaaactgggaagcgaaattattgactctagtacccggaggatggagagtgagaggagtcccctctatcgccagttgatcgacctgggttaccttagcagtagccactggaactgcggagccccaggacaggatactaaggctcaatctatgcttgtggagcagagtgaaaaactccgacacctgagtacatttagccatcaggtcttgcagacaaggttagtagacgcggcaaaagcgctgaatctcgtccattgccattgcctcgatattttcatcaatcaggccttcgacatgcagagggatctgcaaataacacccaaacggctcgagtatactcgcaagaaggagaacgagctgtatgagagcctcatgaatattgcaaacaggaagcaggaggagatgaaggatatgattgttgagactctaaacacaatgaaagaagaacttctcgatgacgctacaaacatggagtttaaggacgtgatcgtgcccgaaaacggcgaaccggttgggacccgggagattaaatgctgcatcaggcagatccaggagctcatcatttccaggctcaatcaggcagtagcaaataagctcatctctagtgtggattacctccgcgagtcattcgtgggcacactggaaagatgccttcaatctctggagaaatctcaagacgtatccgtgcacatcacctctaattatttgaagcagatcttaaacgcagcctaccatgtagaggtgaccttccacagtggctcttcagtgaccagaatgttgtgggagcagatcaagcagatcattcagcggattacttgggtgagcccgcctgcaattaccttggagtggaagagaaaggtggcccaggaagcaattgagagtctatcagctagtaaactggccaagtctatctgctcccagtttaggactaggttaaatagcagccatgaggcatttgctgcatccctcaggcagctggaggccggacattcgggcaggctggagaaaaccgaggacttgtggctgcgcgttagaaaggatcatgctccacgacttgcacgcctcagcctggagtcatgttccctccaggatgtcctgttacacaggaagcccaaacttggccaagagttaggacgcggacagtacggagttgtgtacttgtgtgataattggggtgggcacttcccgtgtgctctgaagagcgtggtgccacctgatgagaagcactggaacgatctggcactggagttccactacatgagatccttgcctaagcacgagcggctggtggacttgcacgggtctgtaatcgactataattacgggggaggcagctccattgctgtcctgctgatcatggagagacttcatcgggatctgtatacaggactgaaggctggactgactttggagacccgcttacaaattgccctggacgtcgtagaaggtatcagatttttgcattcacaggggcttgtgcacagggatataaaactgaagaatgtcctattggacaagcagaatcgggcaaagattaccgacctgggcttctgcaagcccgaggctatgatgtcaggcagtatagtgggcactccaatccacatggcacccgagctgttcacaggcaagtacgacaattctgtagacgtctatgccttcggtattctcttttggtacatttgctctggcagtgtcaaactgccagaagctttcgagcggtgcgcctctaaagatcatctgtggaacaatgtgcggcgaggggctcggcctgagcgtctgcctgtgttcgacgaagagtgttggcagcttatggaggcatgttgggacggggaccccttgaagcgccctctactgggaatcgtccagcccatgctgcagggcatcatgaatagattgtgcaaaagcaactcagaacagccgaaccggggactggatgactcaacgtag

SEQ ID NO: 221313 - DNA, 1104 bp, Artificial Sequence
  Description of Artificial Sequence: Synthetic coding sequence
atggtgatggaagtagggacattggatgccggaggtctacgcgctcttctgggtgagcgcgcagctcagtgtctgcttcttgattgtaggtcatttttcgcttttaatgctggtcatatagccggatcagtgaacgtccgtttctctacaattgtgcgccgaagagcaaagggggctatgggcctggaacatatcgttccaaatgcagaactcagaggacggcttcttgctggcgcttatcatgcagtcgtgctgctcgacgagaggagcgctgccctcgatggcgctaagcgggacgggactttagcactggcagccggagctttgtgccgtgaagctagggccgcacaggtgtttttcctcaagggaggctatgaagctttttctgcttcatgccctgaattatgctccaaacagtctactcccatggggcttagcctccccttaagcacctctgtgccagatagcgcagaatcaggttgttcgtcttgctcaacccccctgtatgaccagggcggacccgtagagatcctgccctttctttatctaggctccgcataccatgcttctcgtaaggatatgctcgacgccctgggtatcactgctctgataaacgtcagcgcaaattgtcctaaccactttgagggacactatcagtataagagcattccagtagaagataatcacaaagctgacatcagttcttggtttaatgaggccatcgactttatcgacagcattaagaatgccggagggcgagtttttgtgcactgccaggccggaatttcaagatccgccacaatttgcttagcgtacctgatgagaaccaatcgggtgaaactagacgaagctttcgagtttgtgaagcagaggaggtctataatatcccctaatttcagttttatgggacagttacttcaatttgaatcccaggttctcgcccctcactgcagtgcagaggctggttctccagccatggccgtgctggaccgcggaaccagcactacaactgtttttaattttcctgtgagtattcccgtccacagcacgaattcggcattatcatacctgcagtctccaattacaaccagcccttcttgctag

SEQ ID NO: 221314 - DNA, 909 bp, Artificial Sequence
  Description of Artificial Sequence: Synthetic coding sequence
atggtcatggaggtgggcacactagacgccggaggactcagggcgctactgggcgagagagcagcacagtgcttgcttctcgattgccgaagcttcttcgcttttaacgccggacacattgccggatccgtaaatgtaaggttctcagccgcacaggtgttcttcctcaagggcggatacgaagccttctccgcatcatgcccagagctgtgtagcaagcagtccaccccgatgggactttccctgcccctttcaacttccgtccctgactctgcagagagcggttgttccagctgttccactccactctatgatcaaggaggtcctgtggagattcttcctttcttatacctgggaagcgcctaccacgccagcaggaaagatatgttggatgcattgggaattaccgctcttataaatgtctctgccaactgcccgaaccacttcgagggacattatcagtataaatccatccccgtcgaagataatcacaaggcagatatttcctcttggtttaatgaggctattgattttatcgatagtataaaaaacgcagggggacgtgtttttgtacattgccaagccggtatcagccggtccgccacgatctgcctcgcataccttatgcgcactaaccgggtcaagcttgacgaggcttttgagtttgttaagcagcgcagatctattatctcccctaatttctcctttatgggacagttactccaattcgagtcccaggtactcgcaccgcactgttcagcagaagccggaagtcctgccatggccgttctcgaccgaggcacatcaacaaccacagtctttaacttccccgtatctatccccgtgcacagcactaactccgccttgtcatatttacagagcccgattacaacttccccctcctgctag

SEQ ID NO: 221315 - DNA, 1023 bp, Artificial Sequence
  Description of Artificial Sequence: Synthetic coding sequence
atggtgatggaagttggaacgctggacgccggtgggctgcgggctcttttaggagaacgcgctgcgcagtgcctgctcctggattgtagatcatttttcgcctttaacgccggacacatcgctggctccgtcaacgtcaggttcagcactatagtgcggcgtcgagctaagggcgcaatggggcttgaacatatagtgcccaatgctaaacgtgatggcactctagcattggccgcaggtgctctttgccgggaggctagggcagcacaggtcttctttctaaagggcggatacgaagctttcagtgccagttgcccagagttgtgtagcaagcaatccacccccatgggcctgtcgttgccactgagtacctccgtgcccgatagcgccgagtctgggtgctcatcatgttccacgcctttatacgatcaagggggacccgtcgagatcctgcctttcttatacctgggcagcgcatatcatgcctctcgaaaagatatgctggatgccctggggatcacagccttgatcaacgtttccgccaactgtccaaaccatttcgaggggcactaccaatacaagagcatccctgtggaggacaaccacaaagccgatatcagctcatggttcaacgaagcgatcgacttcatcgattccatcaaaaatgcaggaggacgtgtcttcgtgcactgtcaggcgggtatctctaggtccgccacaatttgcctggcttacctgatgcggactaatagggtgaagctggatgaagccttcgagtttgtgaaacagaggcgttctatcatctccccaaatttctctttcatggggcagctactgcagttcgaatcccaggtcctggcccctcactgttcggcagaggctggcagtcccgcaatggctgttctggatcgagggacaagcaccaccacagtgttcaacttcccagtgtccatacctgtccattccacgaactctgcactttcctatcttcagtctccaatcaccacttcaccttcgtgttag

SEQ ID NO: 221316 - DNA, 1134 bp, Artificial Sequence
  Description of Artificial Sequence: Synthetic coding sequence
atgaggaattccgagactctcgaaaggggagtcggaggctgcagagtgttctcctgcttgggctcataccccggtattgaaggcgctggtctggcgctcctagcagacttagctcttggcggaagactccttggcacgcacatgagccagtggcatcacccacgctccggttggggccgacgacgggacttttctggtaggagcagtgctaaaaaaaaaggcggaaatcacattcccgaacgctggaaggattacctgccagtgggccaaagaatgccaggaacacgcttcatagcatttaaggttcctctccagaagtcctttgagaagaaacttgcccctgaggaatgtttttcgcccctggatctatttaataaaattcgggagcagaatgaagaactcgggctgatcatagaccttacatatactcagaggtattacaagcctgaagatctgcccgaaactgtgccatacctcaaaattttcaccgtgggtcaccaggtgcctgacgatgaaaccatcttcaaattcaaacatgctgttaatgggttcctgaaggagaacaaggacaacgacaaactcataggcgttcattgcacccacggacttaatcggactggctatctgatctgtcggtacctgatagatgtcgagggagtgcgtccggatgacgctatcgagctttttaaccgttgtagaggtcactgccttgagcgccagaattatattgaggacctgcagaatggcccaattagaaaaaattggaacagtagcgtgcctagatcctctgactttgaagattcagctcatttgatgcaaccagttcacaacaaaccagtaaaacagggccctcggtacaacctgcaccagattcaaggacatagtgccccaaggcacttccacacacagactcagagcctccagcagagtgtgagaaagtttagcgagaatccgcatgtgtatcagcgccaccacctcccaccccctgggcctccaggcgaagactattctcaccgccgttactcttggaatgtgaagcccaacgcgtctagagcagcacaggatcgtagaagatggtacccttataattatagcagactttcctaccccgcttgctgggagtggacacagtag

SEQ ID NO: 221317 - DNA, 681 bp, Artificial Sequence
  Description of Artificial Sequence: Synthetic coding sequence
atgtcccagtggcatcaccctagatccgggtggggccgacggcgtgatttctcaggacggtcttctgccaagaaaaaagggggaaatcacatccctgaaaggtggaaagactaccttcccgtgggtcaacggatgcctgggacgcgttttattgcgttcaaagtcccgctgcaaaagtctttcgaaaaaaaacttgcgccagaagagtgtttcagcccactggacctcttcaacaagattagagaacagaatgaagagttgggtctaatcattgatctcacctacacccagaggtattataaacctgaggatcttcccgaaactgtgccttatttgaagattttcaccgtcggtcaccaggtccctgatgatgaaaccatttttaaatttaagcatgctgtgaacgggttcctcaaggaaaacaaggacaatgataagctaattggcgtccattgcacacacgggcttaatcgaaccggatatcttatttgcagacgcagtcttgcactgagcccacggctggaatgttctggtacaatttccacacactcaaaattctgtttccccggaagcaggcgatccccagctagtgcctcacaggtcgctgggactacaggcgcacgccaccacgctagactcatcttctgcattttctctcgtgacgttgtgagcccctgctag

SEQ ID NO: 221318 - DNA, 822 bp, Artificial Sequence
  Description of Artificial Sequence: Synthetic coding sequence
atgcgcaacagtgagacccttgaaagaggggttggtggttgccgcgtcttctcctgccttggatcatacccagggattgaaggcgctgggttagccttgttagcagatttggctctaggcggacggcttttgggaacccacatgtctcaatggcaccatcctaggtcgggctggggacggagacgggatttttcaggtaggtcatcggctaagaaaaaagggggaaaccatatccctgagagatggaaggactacttaccagtggggcagagaatgcccggtaccaggttcatagctttcaaggtgccactacaaaaatctttcgaaaagaaactggccccagaagaatgtttttcacctctagatttgttcaataaaatccgagagcagaacgaggagctgggccttatcatcgatctgacgtatactcaacgctactacaaacccgaagacctgccagagaccgtaccatatctaaaaatctttacagtagggcaccaggtaccggacgacgaaaccatattcaaattcaagcatgcagtgaatggttttctcaaggagaacaaggataatgataaattgataggtgtgcattgtactcacggcctcaaccgtacaggctatctcatctgtcggcgaagcctcgccctgtctcctagactggagtgcagcggcaccatctccacccacagcaaattctgctttcctggttcccggagaagccccgcttccgcttcacaagttgcgggtactacgggggctaggcaccacgcccgattaatcttctgtatcttttcacgtgatgtggtgtcaccgtgttag

SEQ ID NO: 221319 - DNA, 597 bp, Artificial Sequence
  Description of Artificial Sequence: Synthetic coding sequence
atggatagtctgcagaaacaagacttgaggcgtcctaaaattcacggagctgtgcaggccagtccgtaccagcctcccacattggcatcactacagcgactcctgtgggttcgccaggcagccacccttaaccacatcgatgaggtctggccatcacttttcctcggcgacgcctacgctgctcgggataaatcaaagctgatccagctcggaattacacacgtagtcaacgccgctgccggtaaattccaagtagacaccggcgctaaattttatagggggatgtctttagagtattatggtatcgaagcagatgacaacccattcttcgatcttagtgtttatttcctgcccgtggccaggtacatccgggcagccctgtctgttcctcaaggaagggtgctggtacactgtgctatgggcgtgtcccgtagcgcaacccttgtattggctttccttatgatttgtgagaacatgactcttgtggaggcgatacagactgttcaggcacatagaaatatttgcccgaattccggcttcctccgacagcttcaggtgctcgataatcgcttaggtcgtgaaaccggcagattctag

SEQ ID NO: 221320 - DNA, 747 bp, Artificial Sequence
  Description of Artificial Sequence: Synthetic coding sequence
atggctgaaacatcactgccagagctgggcggtgaggataaagccaccccatgcccctccatactggaacttgaggagctgcttcgcgctgggaagagcagctgctcaagggtggatgaagtttggccaaatctcttcatcggcgatgccatggattctctgcagaagcaagacttgcggcgtcctaagatccacggtgctgtccaagcctcgccctaccagcctcctactctcgcatctttgcagcgactgctgtgggttcggcaggcagcaactcttaaccatatcgacgaagtgtggcctagtttgttcctcggagacgcttacgcagctcgggataagtcgaaattaattcagctcggaataacccatgttgtcaacgctgccgcaggtaaatttcaggtcgatactggagccaagttctaccgaggaatgtcactggagtattacggcattgaagcagatgacaatcccttcttcgacctttcggtgtatttcctccctgtggcgagatatatcagggccgcacttagtgtaccccaaggacgggttttggtccactgcgctatgggcgtcagcagaagtgccactctggtcctcgcgtttctcatgatttgcgagaacatgacactggttgaggccatccagactgtgcaggctcaccgtaacatttgccccaactccggctttcttcggcaattgcaggtcctcgacaataggctagggagagagactggaaggttttag

SEQ ID NO: 221321 - DNA, 567 bp, Artificial Sequence
  Description of Artificial Sequence: Synthetic coding sequence
atggccgagacctcacttccggagctcggcggtgaggacaaagccaccccctgtcccagcattcttgaactggaggaactgctccgcgctggaaagagctcgtgctctagagtggatgaggtgtggccgaatctgtttatcggagacgcggcaacagctaataatcgctttgaactgtggaaacttggaattactcacgtactcaacgccgcacataaaggactgtattgtcagggagggcctgacttctacggatcaagcgtgtcgtacctgggagtacccgctcatgacctgcctgatttcgatataagcgcctacttttccagcgcagcggatttcatccacagggccctgaatacccccggagccaaagtcttagtacattgtgttgtgggagtgtctcgatcagctacactggtgctcgcctatctcatgctccaccagaggctgtccttacgacaggctgtgatcaccgtccggcaacacaggtgggtctttccaaatcggggattcttacaccagctgtgcaggctcgaccagcaactcagaggcgctgggcagtcctag

SEQ ID NO: 221322 - DNA, 876 bp, Artificial Sequence
  Description of Artificial Sequence: Synthetic coding sequence
atgggcttgtgccatttcgccacattggctctcatactgttggtactcttggaggccttagcccaggcagacacccagaagatggttgaagcacagaggggggtgggcccaagggcctgctacagcatctggctcctgctcgctccaacgccccctctatcccattgtctgcagagtcctcagaagcagcatcaggtttgtggcgatcgccgtcttaaagcctctagcacaaattgcccgtctgaaaagtgcactgcttgggccagatacagtcaccgtatggactcactgcagaagcaggaccttcgccgacccaagattcacggcgcagtccaggctagcccatatcaaccacccactctagcgtccctccagaggctgctatgggtgcgccaagccgcaactctgaaccacattgatgaggtctggccatctctcttcctgggagacgcttatgccgcacgagataaatcaaagctcatccagttagggataactcacgttgtaaacgcagccgcaggcaagttccaggtggacacgggcgctaaattctatagagggatgtcattggaatattatggcatcgaggcagatgacaaccccttctttgacctgtcagtgtattttctgcccgtagctcgctatattagagccgcactctctgtccctcagggccgtgtgttggtgcactgcgcgatgggagtctcaagatctgctacacttgtactcgccttcctcatgatctgtgagaacatgacacttgttgaggctattcaaaccgttcaggcacatagaaatatttgtcccaatagtggttttcttcgtcaactgcaggtgctggataataggctgggaagggagaccggcaggttttag

SEQ ID NO: 221323 - DNA, 597 bp, Artificial Sequence
  Description of Artificial Sequence: Synthetic coding sequence
atggattctctgcagaaacaggatctgcggagacctaagatccacggtgcagtgcaggcctccccttatcagcccccaaccctcgcatctcttcagcgcttgctgtgggtcagacaagccgcaacactcaatcacatcgacgaagtctggcctagtcttttcctgggcgatgcttatgccgctcgggataaatcaaagctgatccaactcggaatcacgcacgtggtcaacgccgcagcgggaaagttccaggtggacacaggggctaagttttatcggggaatgagcctggagtactacggcatcgaggctgatgacaacccattttttgacttatcagtctattttctgcccgtcgccaggtatattagggccgcactatcagtcccccaggggagagtattagtgcattgcgccatgggcgtctcgcggtcggcaaccctggtacttgcctttttaatgatttgtgagaatatgactttggtagaagccattcaaactgtgcaggcgcatagaaatatttgccccaactccggattccttcggcaactacaggtcctggacaacaggctgggacgcgagactggccgtttttag

SEQ ID NO: 221324 - DNA, 984 bp, Artificial Sequence
  Description of Artificial Sequence: Synthetic coding sequence
atgggtctgcctcagcctaggttacccgctcccgcattacaggccggtcctgcaaccgcagggtgcaggccggagctgagaggacagagctggtcacttctgcccgcaatgggtttatgccattttgcaactttggccctcatccttttggtcctcttagaagcacttgcccaagcagacacccagaagatggtggaggctcagcgcggagtaggtccaagggcgtgctattcaatctggctgctcctcgccccaacaccccctctgtcacattgcctccagtccccacagaagcagcatcaggtgtgcggcgacaggagactgaaggcgtccagtaccaattgtccatccgagaagtgcaccgcatgggcgagatatagtcatcggatggatagccttcagaagcaggacctgaggcgcccaaaaattcatggagccgttcaggcctcgccgtaccagcctcccacactagcatctctgcagagactgttgtgggtacgtcaagctgcgacactcaatcacatcgatgaggtgtggccctctctttttctgggagatgcttacgccgcacgtgataagagcaaactgatccaactgggcatcacccacgtagtgaatgccgcagccggtaaattccaggtcgatactggagcaaagttttaccgaggcatgagcttagaatattatggcatcgaggccgatgacaaccccttcttcgatctgagcgtttatttcctccctgtggccaggtacattagggccgcactttccgtaccccaaggccgagtccttgtccactgtgctatgggagtgtcacgctccgctacgcttgtcctggcgttcctgatgatctgtgaaaatatgacactcgtggaagctatccagacagtccaagcgcaccgcaacatatgcccaaacagcggattcctgagacagctgcaggttttagacaaccggttgggacgggagactggtcgattctag

SEQ ID NO: 221325 - DNA, 597 bp, Artificial Sequence
  Description of Artificial Sequence: Synthetic coding sequence
atgtcatctcggggtcacagcacattgcccagaacactgatggcccctcgaatgatctcagagggagacatcggagggatcgctcagatcacctcctccctgtttctgggacggggtagcgtagcatctaatcgccatctgctgcaggccaggggaatcacttgcattgtcaatgccactatcgagattcctaatttcaattggcctcagtttgaatacgtgaaagtcccactggcggacatgccacacgcgcctatcggcttgtattttgatacggtggcagataaaattcactctgtgtctaggaagcacggcgctactcttgttcactgtgccgcaggagtgtccagatccgccacactttgcattgcttacctgatgaaatttcataacgtgtgtttactcgaagcatacaactgggtcaaggccagacgtcccgtcatccgtcctaacgtgggtttctggagacagctgatcgactacgagcgccagctcttcggcaaatctacagtcaagatggtgcagacaccgtacggaatagtgcccgatgtctatgaaaaagagtcacggcacctgatgccatattggggcatctag

SEQ ID NO: 221326 - DNA, 597 bp, Artificial Sequence
  Description of Artificial Sequence: Synthetic coding sequence
atgtcttctcggggtcactccactctccctcgcacactcatggccccacggatgatctctgagggcgatataggcggaattgctcaaattacgagcagtctgtttcttggacgcggatctgtggcctcaaatagacatctcctgcaggcccgtgggatcacctgtattgtgaatgcaactatagaaatccctaatttcaactggccgcagtttgaatacgtgaaggtgccactggccgatatgccccacgcccctattgggctatacttcgatactgtggctgacaaaatccacagcgtgagcagaaagcatggcgcaaccctagtgcactgcgctgctggagtgtcgcggagcgccactctgtgtattgcgtatctcatgaaatttcacaacgtctgcctgctggaagcttacaactgggtgaaagccagacggccagttattaggccaaatgtggggttttggcggcagctaattgactacgagcggcaattatttggtaaatcaactgtaaaaatggtgcagactccgtacgggattgtgccagacgtctacgagaaggaaagcaggcacttaatgccctattggggtatctag

SEQ ID NO: 221327 - DNA, 945 bp, Artificial Sequence
  Description of Artificial Sequence: Synthetic coding sequence
atggggctcgaggccgcacgggagctcgagtgcgccgctctgggcaccttgctgcgcgatcccagggaggctgagcggactttgctgctggattgcagaccttttctagccttttgccgacggcacgtccgggcagcacgtccagtcccctggaacgcactcctgcggcgacgggctaggggacccccagcagccgtgcttgcatgcctgctgccagacagagcgctccggacacggttagtgaggggagagctggctcgtgccgtagtgttggatgagggctctgccagcgttgccgagctaaggcccgacagtcctgctcacgtgttacttgcggctctgctgcatgaaacgcgtgccggtcctacggcagtgtactttttgagagggggattcgacgggtttcagggctgttgccccgatctttgctccgaagcacccgcacccgcactgccgccaactggcgataaaacgtcgcgctccgactccagagcaccagtctacgaccagggcggtccagtcgagatcttgccctacctgttcctcggctcatgcagtcacagcagcgatttgcagggattacaggcctgcggaatcaccgccgtgctgaacgtgtctgctagttgtcccaaccactttgaaggcttattcagatacaaatctatccccgtcgaagataatcagatggtcgagatcagcgcttggttccaggaagctatcggctttattgattgggtgaagaactccggcggtcgcgttttggttcactgtcaggctggaatatcccggtccgccacaatctgtctggcatatctcatgcagtcgcgccgagtgcgactcgacgaagcttttgactttgtgaaacagcgccgtggagtgatctcacccaatttctcatttatgggtcagttacttcagttcgagacacaggttctctgccattag

SEQ ID NO: 221328 - DNA, 288 bp, Artificial Sequence
  Description of Artificial Sequence: Synthetic coding sequence
atggcggctgctagactgtgcctgtctctgctgctgctctccacatgcgtcgccctcttgctgcagccactccttggagcgcagggcgctcctctcgaacccgtgtatccaggggataatgcaactccggagcagatggcccagtacgccgctgacctgaggcggtacattaacatgctgacgaggcctcgctatggcaagaggcacaaagaggatactttggcctttagcgaatgggggtcaccccacgcagccgttcctcgcgaattatcacccctagacctgtag

SEQ ID NO: 221329 - DNA, 435 bp, Artificial Sequence
  Description of Artificial Sequence: Synthetic coding sequence
atgtccgttgcccaggacatcccaaagctgcagaagctcggcatcacccatgtcttaaatgcagcagaagggcgatcgttcatgcacgttaacactaacgcaaacttctataaggatagtggtattacctacctgggaataaaggccaacgacacccaggaatttaatttatcagcatacttcgagagggccgcagactttatcgatcaggcactcgctcaaaagaatggaagggtgctggttcattgtcgagagggctatagtcgctcacctaccctggtgatcgcatatctgatgatgcgacagaaaatggacgtgaagtctgccctgtccatcgtgcgccaaaatcgggagatcggcccaaatgacgggttcctggctcaactttgccaactgaacgaccggcttgcaaaggagggcaagctgaaaccatag

SEQ ID NO: 221330 - DNA, 1185 bp, Artificial Sequence
  Description of Artificial Sequence: Synthetic coding sequence
atggttaccatggaagagcttcgggagatggattgttctgtattgaaacgcctgatgaatcgggatgaaaacggagggggtgccggaggctcagggagtcacgggacgctgggcctcccctcgggcggtaagtgtttgctgctggactgtcggcctttcctcgcacattccgcaggctatatccttggctcagtcaacgttagatgtaacacgatcgtccggagaagagcaaaagggtccgtgtctttggaacagatcttgcccgctgaagaagaagtgagggccagactgaggagcggtctgtattcagctgtcatcgtttacgatgaacggtcacctagagcagagtcactgcgagaagacagcaccgtgtccctagttgtccaagcccttcggcgtaacgcagaacgcacagacatctgcttgctgaaggggggttacgaacgattcagcagtgagtaccccgagttctgttctaagacgaaggctctggctgccattccaccacccgtgcccccttccgctacagaaccattagatctgggttgctctagctgcgggacacctctgcatgatcaggggggaccagtggagattctgccattcctgtaccttggttccgcttaccatgctgcaagaagggatatgctggacgcacttggtattaccgcgcttctgaacgtgtctagcgattgtcccaatcacttcgaggggcattaccagtacaagtgcatacctgttgaggataatcataaggccgacatcagttcctggttcatggaggctatcgagtatatcgatgccgttaaggattgtcggggtagggtgctggtgcattgccaagctggcatctctcgcagcgcaaccatttgtctagcttatctaatgatgaaaaagagggttaggctggaggaggcttttgagtttgtgaagcagcgcaggtctatcatcagccctaatttctcttttatgggacagctccttcagtttgaaagccaggtgctcgccacgtcatgcgccgcagaggctgccagcccctctgggccacttagagagaggggcaagaccccagccaccccaacgtctcagtttgtgttttcgttcccagtctcagtgggggttcactcagcgcctagctccctaccgtaccttcattctcctattacaacaagtccaagctgttag

SEQ ID NO: 221331 - DNA, 912 bp, Artificial Sequence
  Description of Artificial Sequence: Synthetic coding sequence
atggggagaaaggtacatagcaatggttctcagtttgcggaacattcacgcagtcctcggcgaacagggagggattgcaagcccgtaagagctccttccatggcattaggtgtttctcaactagccggtaggtctcggtgcctctgcagcgagagccagggcggttacgagagattctcatccgaataccccgagttctgctcgaagactaaggccctcgcagcgattcctcccccagtcccgcctagtgcgacggaaccactagatttaggctgcagcagctgcggaacgccgctgcatgatcaaggtggcccagttgagatccttccgttcctgtatttaggctctgcctatcatgctgccaggcgcgacatgctggacgcattaggtatcacggcattgctgaacgtaagtagcgactgccccaatcactttgaaggccactaccagtataagtgcatccctgtggaagataaccataaagctgatatctcctcatggttcatggaggcaatcgaatatatcgatgcagtcaaagattgtagggggcgagtcctagtacactgtcaggccggtatttcgaggtccgccactatctgccttgcctatcttatgatgaaaaaacgggtgcgcttagaggaagcttttgagttcgtgaagcagcggagaagcatcatttccccaaacttctcctttatgggccagctgcttcagttcgaatcccaagtgttggccacttcttgtgccgctgaggcggcttcgcctagtgggcctctccgagagagagggaagaccccggctaccccaacttctcagttcgtttttagcttcccagtatcagtaggagtccattcagctcccagctctttgccgtaccttcatagccccatcaccacttctcctagctgctag

SEQ ID NO: 221332 - DNA, 1155 bp, Artificial Sequence
  Description of Artificial Sequence: Synthetic coding sequence
atgaaggtcacttccctcgatgggaggcagttacggaaaatgttgcggaaagaggctgccgctagatgcgtggtccttgactgtcggccttaccttgcatttgcagctagtaacgtacgcggttccctgaacgtcaatcttaacagcgtcgtgctgcgtcgggctcgcggtggcgcagtcagcgcccgatatgtcttgcccgatgaggccgctcgggctagactactgcaggaggggggaggaggtgtggcagccgtggttgttctcgatcaggggagccggcactggcagaagctgagggaggagagcgcagcaagagtagtcttaacatccctgctggcgtgtctcccagcgggaccgcgtgtgtatttccttaagggaggctacgagactttttattcagagtatcccgagtgttgcgtggatgtgaagcccatctcacaagagaaaatagagtctgagcgggctctgattagtcagtgcggcaagccagtggtcaatgtcagctatcggccagcctacgaccagggaggccctgtggagatccttccttttttgtacctagggagcgcctaccacgcgtctaaatgtgagtttttagcaaacttgcacatcactgccctgctgaacgtgagtagaagaactagcgaggcttgtgccacccatcttcactacaagtggatccccgtcgaagatagccatactgccgacatcagctcccatttccaggaagctatcgactttattgattgcgtgagggaaaagggcggtaaggtactggtacattgcgaagccggaatcagcagatcccccaccatctgtatggcatacttgatgaaaacaaagcagttccgtttaaaagaggcattcgactatatcaaacagcgccgaagcatggtctcccctaactttggtttcatgggccagctgctgcagtatgagtccgagatcctgccatctacgcccaacccccagccccctagttgccagggggaggcagctggctcttctctgattggtcatcttcaaacactctcgccagatatgcagggggcatattgcacctttcccgcatctgtcctggccccagtacccactcatagcactgtttccgagctgtctcggtcacccgttgcaactgctactagttgctag

SEQ ID NO: 221333 - DNA, 1107 bp, Artificial Sequence
  Description of Artificial Sequence: Synthetic coding sequence
atgccatgcaagagcgctgagtggctgcaggaggagcttgaggctaggggtggcgcttctttactgctgcttgattgccgaccacacgagctgttcgagtcaagtcacatcgagacagccatcaacctggcaattcccggtctgatgcttcggcgtttgcggaagggcaacctgcctattagaagtataattcccaatcatgcagataaagagaggttcgcgaccagatgtaaggctgctactgtgcttctctacgacgaggctactgctgagtggcagcctgagcctggtgcccctgcttcagtgttgggcctcctgctccaaaagttgcgtgatgatggatgtcaggcctactatctgcaaggtggctttaataaattccagactgagtattcagaacattgtgaaacgaatgtggactcgagtagtagtccctcaagcagccctccgacttctgtactgggactgggaggacttaggattagttccgattgttcagatggagagtccgacagagaacttccaagcagcgcaacagagtccgacggctcccccgtcccgtcttcccagcccgcttttcctgtccagatcctgccctacctgtacttagggtgtgcaaaagattctaccaatctcgacgtcttagggaaatacggcatcaaatatatcctgaacgtgacacccaatctgccaaacgcattcgagcatggaggggaattcacctacaagcagatccctatctcagaccactggtcacagaacttgagccagtttttccccgaagcaatatcattcattgacgaggctcggagtaaaaaatgcggcgtactggtacattgtctggctgggatcagccggagcgtgacggttactgtcgcgtatctgatgcaaaaaatgaacctttccctcaacgacgcttacgactttgtgaaacgtaaaaaatctaacatctcacctaatttcaacttcatgggacagttactcgatttcgaaagaacactcggcctgagctctccatgcgataaccacgcatcatctgaacagctctacttttccacaccaaccaatcacaatctgtttcccttgaatacactcgaatccacatag

SEQ ID NO: 221334 - DNA, 1260 bp, Artificial Sequence
  Description of Artificial Sequence: Synthetic coding sequence
atgaaaaatcaactccgaggtcccccagctcgggctcatatgtctacaagtggtgcggcagcagccggaggaacccgggcaggctcagaacccggagctggctccggcagcggcgcagggactggcgcaggggcagcgactggtgcgggagcgatgccctgcaagagcgctgagtggttgcaggaggagcttgaagcgaggggaggtgcaagcctgctattgctagattgcaggccccacgagcttttcgaaagctcccacatagaaaccgctatcaacctggcgatccccggtcttatgcttagaaggctgagaaagggaaatctgcccattagatccattatacctaaccatgccgacaaggaaaggttcgccaccagatgcaaggctgcaaccgtgctgctgtacgatgaggcaacagccgaatggcagcctgagccaggcgcacctgcctctgtgcttgggctactcctgcagaaactgcgcgacgacggatgtcaggcatactatctgcaagggggatttaacaaattccaaaccgagtactccgagcactgtgaaacaaatgtcgactcatccagtagcccctcgagcagcccgccaacaagtgttctggggctgggaggcctgcgcatctcctcagattgtagtgatggggagagtgatagagagcttccaagcagtgctaccgaaagtgatggctccccagtgccctctagccagcctgcgtttccggtgcagatcttgccttatctctacttgggttgcgccaaggactctaccaaccttgacgtcttgggcaagtatggaatcaagtacattcttaatgttacacccaatttacccaacgccttcgagcacggcggagaatttacatataagcagatccccattagcgatcactggtcacagaatctgtctcagttttttcccgaggctatttcctttatcgatgaagccagaagcaagaaatgtggcgttctggtgcattgtcttgctggcatctcaaggagcgtcactgtgacggtggcctacctgatgcagaaaatgaacctcagccttaatgatgcctatgatttcgtcaagcggaagaagagcaacatctctcctaattttaactttatggggcagctgctcgactttgaaaggacactgggcctgagctcgccatgtgataaccatgccagttcagaacaactgtatttttcaacccccacgaatcataatctattccccttgaatacactcgaaagcacatag

SEQ ID NO: 221335 - DNA, 1878 bp, Artificial Sequence
  Description of Artificial Sequence: Synthetic coding sequence
atggcaggtgaccgcctccccaggaaggtcatggatgccaagaagttggcgagcctcctgcggggaggacctggaggccctctggtgatcgactcacgttccttcgtagaatataactcttggcacgtcctgtcctctgtgaacatctgctgtagcaaactggtgaaaaggagactgcagcagggtaaggtaaccattgccgagctgattcagccagccgcaagatcccaggtcgaagctaccgaacctcaggacgtggttgtttatgaccaaagtaccagggacgccagcgtactggccgctgattccttcctgagtatactgctgagcaagctcgacgggtgctttgactctgtggccattctcactggcggattcgcgacattttcctcttgtttccccggtctctgcgaaggtaaaccagccgctcttctgccgatgtctctcagtcagccatgtctgcctgtcccctcggtggggctgaccaggattctcccgcacttatatctggggtcgcaaaaagacgtgttgaacaaggatctgatgactcaaaatggtattagttacgtgctgaacgcctcaaactcgtgccctaagcctgacttcatatgtgaaagccgctttatgcgcgttccaatcaacgataattactgtgaaaaactcttgccctggcttgacaagagcatagaatttattgacaaagccaaactatcttcttgtcaagtgatcgtgcattgccttgccggaattagccgtagcgccacaatcgccattgcctatattatgaagacaatgggcatgtcttctgatgatgcataccggtttgtgaaagaccgacggccttccattagtcctaatttcaatttccttggtcagcttctggagtacgagcggtctctcaagctgctggcagcgctgcagggggaccccggaactccaagtggcacgccagaaccgcctccaagtccagctgccggagcaccactgcctaggctacctccacccaccagcgaatctgctgctacaggaaatgccgctgcaagggaaggcggacttagtgctgggggagaaccacctgccccacctaccccccctgcgacttcagctcttcaacaaggtctgcgcggtctgcatctcagtagcgacagacttcaggacaccaataggctcaagcgatccttttcccttgacataaagagcgcttacgcaccctcccgtcggcctgacggaccgggtccccctgatccaggcgaagccccaaaactctgcaaactggactctccgagtggtgcggcattgggcctgagtagtcctagccctgatagtcccgacgcggctcccgaagctcgtccgcgacccaggagacgaccacgtccccctgccggaagcccagcgcgatcccctgcgcactcactgggcctaaacttcggcgacgccgctcgtcagacaccgaggcacggtctctctgcactgtctgctcccggactgccaggtccaggccagccggctggaccgggtgcttgggcaccccctttggacagccctggcacccccagtccggatggcccatggtgtttttcaccagagggcgcacagggagcaggtggtgtcctgttcgcacccttcggtagagccggtgccccaggaccgggaggcggatcagacctacgtaggcgggaagccgctcgagccgaaccgagagatgctcgaaccggctggcctgaagagcctgcccctgaaacccagttcaagcggcgttcgtgccagatggagttcgaggaagggatggtagaagggagagcccgaggtgaagaactggctgccctgggaaaacaggccagtttttcgggctcggttgaagttatcgaagtgtcttag

SEQ ID NO: 221336 - DNA, 1878 bp, Artificial Sequence
  Description of Artificial Sequence: Synthetic coding sequence
atggcaggtgatcgcctgccgagaaaggttatggatgctaaaaaattagcctccctactgagggggggaccaggcggtccgctcgttattgatagtaggagttttgtggaatacaattcctggcacgtgctttccagtgtcaatatctgttgctccaagctcgtcaaacgccgtctccagcagggcaaggttaccatagcggaacttatacaacccgctgccagaagccaggtcgaggccacggagccgcaagacgtggttgtgtacgatcagagcaccagggatgccagcgtcctggccgctgactcctttctgagtattttactctctaagttggatggctgcttcgactctgtggccattctaactggcggttttgctacattttcatcctgcttccctggactgtgcgagggcaagccagcagctctgctgcctatgtcattgtcccagccatgtctgccggtcccctccgtcgggctcacccggatcctgccacacttatacctgggatcacaaaaagacgtactgaacaaggatctcatgacccaaaatggcatttcttatgtgctcaatgccagcaactcctgtccaaaacctgattttatctgcgagtccagattcatgcgcgtgcctatcaatgataactattgcgagaagctgctgccctggcttgacaagagcatcgagttcatcgacaaagcaaagctgagcagctgccaagtaattgtgcactgcttagcaggaatctccagatctgccacaatagcaatcgcttacatcatgaaaactatgggaatgagctctgacgacgcctataggttcgttaaggatcggaggccttcaataagcccaaactttaattttctcggccaactgctggagtacgagcggagcctgaagctgctggctgctttgcagggagaccccggaaccccttctggcacccctgagccaccaccaagccctgccgcaggcgctccgctgcccagactgcctccacctactagtgaatccgcagcaaccggcaacgcagccgcacgagaggggggactgtctgcaggcggtgagccaccagccccacccaccccgcctgcaacgtcggcattgcagcagggactccggggactacatttgtcgagcgatcggctacaggatactaaccgactgaaacggtccttttctctggatattaagtccgcttacgcgcctagccgaagacccgacggaccaggtcccccagatccaggagaagccccaaagctgtgcaaactcgattctccttctggggctgcacttgggctttctagcccttccccagacagcccggacgccgctcctgaagcaagaccaagaccaaggcgcagacccagacccccagccggatcacctgctcgcagcccggcacactccttgggtctcaattttggagacgccgctagacagacccctcggcatggtctgagcgctctctcagcgccaggcttaccaggtcctggacagccggctgggccaggggcatgggcacccccactcgatagcccaggtaccccatccccggatggaccatggtgcttcagccccgagggcgcacaaggcgcaggaggggtgctattcgccccattcggaagagctggggcacccggaccaggtggaggcagtgacctcagacgccgagaagctgccagggctgagcccagagatgcccgtaccggctggccggaagaacccgctcctgaaacccagtttaagcgcagatcctgccagatggagttcgaggagggaatggtcgaaggaagggctaggggcgaggagctcgctgctctcgggaaacaagccagcttttccggcagtgtggaagtaatcgaggtgtcctag

SEQ ID NO: 221337 - DNA, 1626 bp, Artificial Sequence
  Description of Artificial Sequence: Synthetic coding sequence
atgcacactgggggtgagacctccgcctgcaaaccaagttctgtcagactggccccttcattctccttccacgctgccggactgcagatggccggtcagatgcctcactcccatcagtactccgaccggaggcagcctaacatcagtgaccaacaggtgagcgctctcagttattcagaccagatccagcagccattaactaaccaagtgatgcctgacatcgtgatgctgcagcggcgaatgccacagaccttccgagatccagctaccgcccctttgcggaagctgtcggttgacctcattaaaacgtataagcacatcaacgaagtctattacgcaaaaaagaagcgccgacaccagcaggggcagggcgatgatagcagtcataagaaggaacggaaggtctataacgatggatacgacgatgataactatgattatatcgtgaagaacggcgaaaagtggatggatcgctatgaaatagactctctgatcggaaaggggtcctttggtcaggtcgtgaaggcttacgaccgcgttgagcaggagtgggtggccatcaagatcattaagaacaagaaagctttcctgaatcaggctcaaattgaggtgcgactcctggagcttatgaataagcacgataccgagatgaagtattacatcgtccacctcaagcgccactttatgtttcgaaatcacctatgtctggtcttcgagatgctctcctacaacctgtatgaccttcttcgtaatactaacttccggggtgtgtccttaaacttaaccaggaagtttgcgcagcagatgtgtactgctctcctttttctggccactcctgaactctccatcatccactgtgacctgaagcccgagaatattctgctgtgtaaccctaagagatccgccatcaagattgtcgactttggatcttcttgtcagctgggccagaggatttatcagtacatccagtcacgcttctatcgctcacccgaggtactcctgggcatgccctatgaccttgctatagacatgtggagcctgggatgcattttagtggagatgcacaccggcgaacctctgttttcaggggctaatgaggtcgatcagatgaataagatcgtggaggtcctaggaatccctccagcacacatcttagaccaggccccaaaagctcggaagtttttcgaaaagttacccgacgggacctggaacctaaagaagacaaaagacgggaaacgcgaatataagcctcctgggacacgcaaattacacaatatactgggagtggaaactggcggtcctggtggtaggcgcgcaggcgagtcaggtcacacagtagccgactatcttaagttcaaggatctgattctccgtatgctggactatgacccaaaaacccgaattcaaccttattatgctttgcagcactccttttttaaaaagacagcagacgagggcacaaacacgagcaattctgttagcacaagcccggcaatggagcagagtcagtcgtccggcacgacctcctcgactagcagctcaagtgttgtggaacagcattggatgcctggcgcttttcgaatgacggtcagtttcacactagaggtgcacgacgtgccagtgtag

SEQ ID NO: 221338 - DNA, 1755 bp, Artificial Sequence
  Description of Artificial Sequence: Synthetic coding sequence
atgcacactgggggtgagacgagtgcttgtaagccttcaagcgtacggcttgccccttctttcagttttcatgctgcagggcttcagatggccggacagatgccccattcccaccagtacagcgacagaaggcaacctaacatctctgatcagcaggtgtctgccctgtcttactctgaccaaatccagcaaccattgacgaatcaagtgatgccagacattgtcatgttgcaacgccgaatgccacagacgttccgggacccagctaccgcccctttgaggaagctatccgtggatctaatcaagacctacaagcacattaatgaggtttactacgcgaaaaagaaacgacgccatcaacaggggcagggtgatgactcttcacacaaaaaagaacgaaaggtttataatgatggttatgatgacgacaattatgactatattgtcaaaaacggcgaaaagtggatggaccgctacgagatcgactcgctgattgggaaagggtcatttggtcaggtggtcaaggcatatgatcgggtcgaacaggagtgggtggctattaagataataaaaaacaagaaggcttttctgaaccaggcgcagatcgaggtgcggttgttggagttgatgaataagcacgatactgagatgaagtattacattgtgcaccttaagcgacatttcatgttcagaaaccacctctgcctcgtgtttgaaatgctttcctacaatctttacgacctcttgaggaacactaacttcaggggagttagtttgaatttaacgaggaaatttgcccagcagatgtgtacagcattgctcttcctggcaactcctgagcttagcatcatccactgcgacttgaagcctgaaaatattctcctgtgtaatcccaagcgatctgccattaagatcgtggacttcggatcttcctgccagttaggccaacggatttatcagtatatccagtcccggttttatcgtagtcctgaagttctgctgggaatgccttacgacctggcaatcgacatgtggtccttgggctgcatcctggtggagatgcacactggggagcccttgtttagcggggcaaatgaagtggaccagatgaataaaatagtcgaggttttgggaatcccgccagctcatatattggaccaagccccaaaggcgcgaaagtttttcgaaaagctaccagatggtacatggaaccttaaaaaaacgaaagatggcaagagagagtacaagcccccaggtacacgtaaactccacaacattctgggggtcgaaaccggtggtccagggggaagaagagccggagaaagcggccacacggtagccgactacctcaaattcaaagatcttatcctgcggatgttagactatgaccctaaaacccggatccagccttattacgctcttcaacatagcttttttaagaagactgcagatgagggcaccaacactagtaactctgtatccacgtcacctgcgatggagcagagccagtcatctggcaccaccagcagcacatcttcctcttcaggagggtcttccgggacctctaatagtggcagagcccgtagcgatcccacccaccagcacagacactctggcggacactttactgccgctgtacaggccatggactgtgagacccactccccgcaggtgtcttctcatgtcgtccacctgctcgtgtctccggcaattctccgatggtctagcacgggctgtcaggttcccctcgaatag

SEQ ID NO: 221339 - DNA, 2265 bp, Artificial Sequence
  Description of Artificial Sequence: Synthetic coding sequence
atgcacaccggaggagaaacatccgcttgcaaaccctcctctgtgcggctggcaccgtcattttcattccatgctgccggactacaaatggcaggccagatgccccacagccaccagtatagtgaccgtagacagccgaatatctcagatcagcaggtcagcgccttgagttattccgatcagatccagcaacccctcactaaccagcgacggatgccacagacttttcgagaccctgcaacagcaccactgagaaaattgagtgtggacctcatcaagacctataaacatattaacgaggtgtactatgccaagaaaaagcggaggcatcagcaagggcagggcgatgactcctcacacaagaaagaacggaaggtttacaatgatggatacgacgatgacaattacgactacattgtgaagaatggcgagaagtggatggacagatatgagattgatagcctgatcgggaaaggcagtttcgggcaggttgtgaaggcttatgaccgcgtcgagcaggagtgggtggctattaagataatcaagaacaagaaggcttttttaaatcaagctcagatcgaagttagacttttggagctgatgaataaacacgacactgaaatgaagtactatatcgtacacttgaaacgacacttcatgtttaggaaccacctttgcctggtcttcgagatgctctcatataacctatatgacctgcttcggaataccaatttccggggagtgagcctcaatctcacgcgcaagttcgcgcaacaaatgtgtacagcactgctgttcctcgccacccctgagttgagtatcatacactgtgatttgaagcctgagaacattttgctgtgcaaccctaaaagaagtgccatcaagatcgtggatttcgggtcctcctgccagctggggcagcggatttaccagtatatccagtccagattctatcggagccccgaagtgctcctgggaatgccctacgatcttgcgatagatatgtggtccctgggctgcatcctggttgagatgcacacgggtgagccactgttttcaggtgccaatgaggtcgaccagatgaataaaatcgttgaagtgctcggcataccaccggctcatattctggaccaggctccgaaagcaagaaagtttttcgaaaagctgcctgacggaacatggaatctgaaaaagactaaggatggaaaaagagagtacaaaccccctggaacgaggaaattgcataatatcctgggagtcgagacaggtggtccaggcggacgtagagcgggagaaagcggacataccgtcgccgattacctgaaattcaaggatttgattctgagaatgcttgactatgatccaaagacacgcattcaaccatactacgccctgcagcactcttttttcaaaaagactgccgacgaaggaactaacacttcaaactccgtgagcacatctccagccatggaacagtcccaatcctcgggcaccacttccagcaccagctcctcttcggggggatctagcggaacttcgaacagcgggagggccagaagcgatccaacacatcagcaccgacactcgggcggacattttacagccgcagttcaggctatggattgtgaaacacattccccccaagtgcggcagcaattccccgctccgctcggctggagcgggacagaggcccctacccaggttaccgtggaaacccatccagtgcaggagacaacctttcacgtggctccccagcaaaacgctctgcaccaccatcacggtaactcgtcacaccatcaccaccaccaccatcaccatcatcatcatcatgggcagcaagctctcggtaatcgaactcgcccaagggtctataacagtccgaccaattcaagctccacacaggatagcatggaggtcggacattcgcaccatagtatgacatctttatctagtagtacaacatcctcttcaacttctagcagctccaccggtaaccaggggaaccaggcgtatcagaatcgccctgttgccgctaacacacttgacttcggacagaatggcgctatggatgtgaacctgaccgtgtattccaatcctcggcaagagactgggattgctggccacccaacttaccagttttcagccaatacagggcctgcgcactacatgacagaaggtcacctgacaatgaggcagggcgctgatcgcgaagaatccccaatgacgggagtctgcgtgcagcagagcccagtcgcatcgtcatag

SEQ ID NO: 221340 - DNA, 1590 bp, Artificial Sequence
  Description of Artificial Sequence: Synthetic coding sequence
atgcatacaggcggagagacaagcgcatgtaagcctagctccgtccggctcgcgcctagtttctcatttcacgccgctggtctgcagatggctgggcaaatgccacattcgcaccaatacagtgatcggagacagccgaatatcagcgatcagcaggtttctgcgctcagttattctgatcaaattcagcagccattgacgaaccaggttatgccagatatcgttatgctacagcgcagaatgccccagacgttccgggatccggctacggcgcctctccggaagctgagcgtcgatttgattaagacgtataagcacatcaacgaagtttattatgcgaagaagaagagaaggcatcagcaaggccagggcgatgattccagccacaaaaaagagcgcaaggtatataatgatggctatgacgacgacaactatgattacattgttaagaatggagaaaaatggatggacagatacgaaatagactcacttataggcaaaggctcgttcggccaagtggtaaaggcctacgaccgcgtagagcaggagtgggtcgcaatcaagattattaagaacaagaaagcgttcctcaaccaggcccagatagaagtgcgtctgttggagctcatgaacaaacacgatactgaaatgaaatattacatagtgcacctgaaacgtcacttcatgttcagaaaccacttgtgcctggtgtttgagatgctgtcttacaatctgtacgatttgctgcggaacacaaacttccgcggtgtcagcctgaacctgactaggaaatttgctcaacaaatgtgtactgctctcttgttcctcgctactcctgaacttagtatcatacactgcgatcttaagccagagaacatactgctgtgcaaccctaagcggtctgccatcaaaattgtggattttggaagtagttgtcagctaggccagaggatctatcagtacatccagtccagattttaccggtctcccgaagtgctattgggtatgccatacgacttagctatagatatgtggagtctgggttgtatccttgtcgagatgcacacgggcgaacctttattttctggagctaatgaagtcgatcagatgaacaagattgtggaagtgctggggatacctcctgctcacatccttgatcaggcacccaaggctaggaagttctttgagaagctgcctgacggtacatggaatctgaaaaaaaccaaagacggaaagcgggagtataaaccccctggtacccgtaaactgcataatatcctgggtgtagaaaccggaggaccaggaggcagacgggcaggggagtccggccacacagtggctgattacctgaagttcaaggacctgattctcagaatgctggactatgaccctaagaccaggatacagccgtattatgcgctgcagcatagtttctttaagaagacagcggatgaaggcaccaataccagcaatagcgtgagcactagcccggctatggagcaaagtcaaagcagtggaaccacgagcagcacctcgtctagttctggcgcatccgctatctcttgttcctcatggctggttcggcactag

SEQ ID NO: 221341 - DNA, 2292 bp, Artificial Sequence
  Description of Artificial Sequence: Synthetic coding sequence
atgcataccggtggtgaaacaagcgcttgtaaaccaagctccgtgaggcttgctccttcctttagcttccacgccgctggcctgcagatggctggacaaatgccgcacagtcatcagtactctgacaggcgccaaccaaatatctccgaccaacaggtcagtgcactctcctattccgaccagattcagcagcccctgacgaatcaggtaatgcccgacatcgttatgttacaaagacgaatgccacagaccttccgggatcctgccaccgcccctttacggaagttgtccgtggatctgataaagacgtacaaacatattaacgaagtctactacgcgaagaaaaaaaggagacaccagcaaggacagggggacgacagttcacacaaaaaggagcgaaaggtgtataatgacgggtatgacgacgacaactacgactatatcgtcaaaaatggagagaaatggatggaccgatacgagatcgattcgcttataggaaagggctcctttggccaggtggtcaaggcgtatgaccgggtggaacaggagtgggttgcaataaaaatcattaagaacaaaaaagcgttcctaaatcaggcacagattgaagttagattgttggaactgatgaacaaacatgatactgaaatgaagtattacattgttcaccttaaacgccatttcatgtttcgtaaccatctttgccttgtcttcgagatgctatcgtacaacttgtacgacctgctccggaacacaaactttcggggtgtttcccttaacctgactagaaagttcgcccaacagatgtgtacagcactgctcttcctggccactcccgaactgagtataatccactgcgacctgaaacctgaaaacatcttactgtgcaaccctaagcgctcagccatcaaaatagtggacttcggcagcagttgccagctaggccaaagaatttaccagtatattcagtcccggttctacagaagtcctgaggtgctgcttgggatgccctatgatctagcaatcgatatgtggtctctgggatgtattctggtagagatgcacactggcgagccactgttctctggggcaaatgaggtcgatcagatgaataagatagtcgaggtgctgggaatcccacccgctcacatcttggatcaggccccaaaagctcggaagttttttgagaagctacccgatggaacatggaacctcaaaaaaaccaaagacggcaaacgcgagtataagccacccggtacgcgcaagctgcacaacatcttgggcgtggagactggcggtccagggggacgtcgagcaggggagtctggacacacagtggcagactacctaaaatttaaagacttgattctgagaatgttggactacgaccctaagacaaggattcaaccttactacgccctgcaacattcatttttcaaaaagactgctgatgaggggaccaatacatctaactccgtgtcaacaagccctgcaatggaacagtctcagtcatccggaacaaccagctctacctcttcttcatccggaggtagcagcggcacaagtaattccggcagggcgaggagcgaccccactcaccaacatcgccactctggcggtcattttaccgctgcagttcaggccatggattgcgagactcactcaccacaggtccgccagcagttccccgctcctctgggatggtccgggaccgaggcccctacgcaggttactgttgaaacccaccctgtacaagaaactactttccacgtggcaccccagcagaatgcgcttcaccaccatcacgggaactcttcccaccatcaccatcaccatcaccatcaccatcaccatcacggccagcaagcattagggaatcgaactaggcccagagtttacaactccccaaccaacagttcgtcgacgcaggattccatggaagtcggacattcacatcacagcatgaccagtctatcctcaagcaccaccagttcatcaacaagctcatctagcacaggcaaccagggaaatcaggcttaccagaaccggcctgttgccgctaacactttggactttggccagaacggcgctatggatgtgaatctcacagtgtactctaatcctaggcaggaaacggggattgccggacaccctacgtatcaattcagcgcgaacacaggacctgcacactacatgacagaaggacaccttaccatgcgccagggggctgaccgggaagaaagccctatgacaggagtctgcgtccaacagagccctgtcgcctcatcctag

SEQ ID NO: 221342 - DNA, 396 bp, Artificial Sequence
  Description of Artificial Sequence: Synthetic coding sequence
atgcatacagggggtgaaacatcagcctgcaaaccctcaagcgtgagactggcacctagcttttctttccatgctgctggactacagatggctggacagatgcctcacagccaccaatattctgacagacggcaaccaaacatctccgaccagcaggtctccgcgttatcttactcggaccagattcagcagcctctcaccaatcaggtgatgccagacattgtaatgctgcagcgcaggatgccccagactttccgggaccccgctaccgccccattacggaagctctcagtggatctgatcaagacctataaacatatcaatgaagtctattacgcaaagaagaagcgcagacatcaacagggacagggtgacgacagcagccataaaaagtag

SEQ ID NO: 221343 - DNA, 1755 bp, Artificial Sequence
  Description of Artificial Sequence: Synthetic coding sequence
atgcatacaggaggcgagacgtccgcctgcaagccgtcttccgtgagactggcacccagtttctcgttccatgccgctggcctccaaatggctgggcagatgccacactcacaccagtactctgataggcgccagcccaatatcagcgatcagcaagtctctgcccttagctacagcgaccagatacaacaaccactgacaaatcaggtgatgccagatatagttatgctgcagcggagaatgcctcaaactttccgagatcctgctactgctccactacggaagctatcagtggacctgattaaaacttataaacacattaatgaggtctattacgccaagaaaaagcgacgtcaccaacagggtcagggggacgatagctcacacaaaaaggagaggaaggtatacaacgacggctacgatgacgataactacgactacattgttaagaatggggagaaatggatggatcgctatgagattgattctctgatcggcaagggatctttcggtcaggtcgtcaaagcgtatgatcgggtggagcaagaatgggtagccataaaaataatcaaaaacaagaaggccttcctcaatcaggcccagatagaagtccgcctgttggaactaatgaacaagcacgacactgagatgaagtactatattgtgcacctaaaacgtcatttcatgtttcggaatcacctctgccttgtattcgaaatgctgagctacaatctgtacgatctgcttcgcaacactaactttagaggagtgtctctaaatctcacccgcaaattcgcgcaacagatgtgcactgctctgctgttcctcgcaacccccgagttgagcataattcattgcgacctgaaaccagagaatatcttgctgtgcaatcccaagaggtccgctataaaaatagtggactttggctccagttgccagcttggtcagaggatctatcagtatatacagagcagattttatcggtcacctgaagtattgctggggatgccttacgaccttgccatcgatatgtggtctctgggctgcattttagtggagatgcatacgggagaacctcttttttccggggctaatgaggttgaccaaatgaacaagatcgtagaggtcttgggaatcccacccgctcacatcctggaccaagccccaaaggcccgaaagttctttgagaaactgcctgacggcacgtggaatctgaagaagaccaaggacggcaagagggagtacaagccaccaggaacacgtaagcttcacaacatcctcggggtggaaacgggcggacctggaggccgtcgagccggtgagtctggacacaccgtcgccgactacctcaagttcaaggacctcattctgcggatgttggactacgatcccaagaccaggatacagccctactacgcactccagcattccttttttaaaaaaactgctgatgaggggactaatacctcgaactccgtctccacgtcacctgcgatggagcagtctcagagtagcggcacgacctcctccacatccagcagctccggcggatcctctgggactagcaacagcgggagggcaaggagcgaccccactcaccagcacagacacagcggtggacactttacggcggcagtgcaggcgatggactgcgagacgcactcaccccaggtctctagccatgtggtgcacttattggtgtcccctgcgatcctgcgttggtcttctaccggttgccaggtgcccctggaatag

SEQ ID NO: 221344 - DNA, 141 bp, Artificial Sequence
  Description of Artificial Sequence: Synthetic coding sequence
atgcatacgggtggggaaacctctgcgtgcaagccaagctctgtgcgactagccccaagcttcagttttcacgccgcaggtctccagatggccggacagatgccacactctcaccagtactccgatagaagacaaccatag

SEQ ID NO: 221345 - DNA, 1608 bp, Artificial Sequence
  Description of Artificial Sequence: Synthetic coding sequence
atgttccggaaccatctctgtcttgtgtttgaaatgctgtcttacaatttgtacgatcttttacggaacacgaacttcagaggtgtgtctctcaacctgacaaggaagtttgcccagcagatgtgtacagcccttctgtttcttgctactcccgaactttcaattattcactgcgatctgaagcctgagaacattctcctctgcaaccctaagcggtccgcaattaaaatcgtggactttggctcttcatgccagctgggccagcggatttatcagtacattcagtccagattctatcgctccccagaagttctgttgggaatgccgtatgacttggcaatagacatgtggtcgctgggctgtatcctggttgaaatgcataccggggagcctctgtttagcggcgctaatgaggtggatcaaatgaacaagattgtggaggtgttaggaattccacccgcacacatcctcgaccaggctcctaaagccaggaagttcttcgagaagcttcctgatgggacctggaacttaaagaagaccaaggacgggaagagagagtataaaccccctggaacaaggaaattgcacaatatactcggtgtcgagactggcggaccgggagggagacgtgctggcgaatccggccatacagtcgcagactatctgaagtttaaggacctgatcttacgcatgctggactacgacccgaagacaaggattcagccatattacgcactccagcactctttcttcaagaagactgccgatgagggtacgaatacttccaactccgtgtcgaccagcccagcgatggagcaatcccagagcagtgggactactagctcaacaagcagttccagcgggggatctagtggtacgtcaaactccggcagggcgagaagcgaccctacccaccaacaccgccactcagggggacattttaccgcagctgtgcaggcaatggactgcgaaactcacagcccacaggtgcgccagcagttcccggcacccttggggtggagcggcactgaggcacctacccaggtcacagtcgaaacacaccctgtgcaagaaacaacattccatgtcgcaccccagcaaaatgctctgcaccaccaccatgggaatagcagtcatcaccaccaccatcaccaccatcaccatcaccaccatggacaacaggctttgggtaataggaccagacccagagtctacaattcacctaccaacagcagcagcacgcaggacagcatggaagtaggccattctcatcattccatgacttcattaagctcaagcacaacttcttcttctactagttcttcctctactggtaatcaagggaaccaggcctatcagaacagacccgtcgctgctaacacactggatttcggacagaacggtgcaatggatgtcaacctgaccgtatacagtaaccccagacaggaaaccggtatcgcaggccatccaacttatcagttcagcgcgaatacaggtcctgctcactatatgaccgagggtcatcttaccatgcggcagggagccgacagggaagagagtcctatgacgggtgtttgtgttcaacagagtccagtggcttcatcttag

SEQ ID NO: 221346 - DNA, 1890 bp, Artificial Sequence
  Description of Artificial Sequence: Synthetic coding sequence
atggcagtgccacccggtcatggaccattctccggcttcccaggtccacaggagcatacccaggttctgccagatgtccgacttttgcctcgccgattgcctttagcttttagggatgctacgagtgctccacttagaaagctttctgtggatttaattaaaacctacaagcatataaatgaggtctactatgccaagaagaagcgaagggcccagcaggctcctcctcaggattcatcaaataaaaaagagaaaaaagtcctcaaccatggatatgatgatgacaatcacgactatattgtacggagcggggaacggtggctggaaaggtatgagatcgactcccttattggcaaaggcagttttggccaagttgtgaaagcctatgatcaccagacgcaggaattagttgccattaaaattatcaaaaacaagaaggcctttctaaaccaggcccagatcgagctgagactgctggagctgatgaaccagcatgacacagagatgaaatactatattgtgcacctgaagagacattttatgtttcgcaaccacctttgtctggtttttgagctgttaagctataatttgtacgatttactgcggaatacccacttccgcggagtgtcactgaacctaacacgcaaactggctcagcagctctgtaccgcactactgttcctcgctacgccagaactatcaattatccactgtgatctgaagccagaaaatattctgctctgcaaccccaagcgctccgcaatcaagatcgttgatttcgggagttcctgccagctcggccagaggatatatcagtatattcagtcaagattttacagaagcccggaagtgctgctcggaaccccctacgacctcgctattgacatgtggtcattgggatgcattctggtggagatgcacaccggagagccattgttcagtggctccaacgaagtggatcaaatgaacagaattgtcgaggtattggggataccacccgctgccatgctggaccaggccccaaaagctcgtaaatattttgaacgtcttccagggggaggctggacactacggagaaccaaggagctaaggaaggactatcaaggtcccggaaccaggcgcctacaagaggtactgggcgtgcaaactggaggacctggaggcagaagagcaggggagcctgggcactcccccgcagattaccttcgcttccaggatctggtcctgaggatgctagagtacgagccggcagcacgaatctcacctctgggggctctgcagcatgggtttttccggaggaccgcggatgaagctaccaacactgggccagccggttcgagcgcctctacttcgccagcccctttggacacatgtccttcctcttctaccgcctcaagcatcagcagttccggcggttcaagcggcagctcctctgacaaccgcacgtaccgatactctaataggtactgcggaggtcctggtccccctatcaccgattgtgaaatgaactctcctcaggtgcccccaagccaaccactccggccttgggccggaggcgatgtgcctcacaagacccaccaagcccctgccagtgcatcctcactgcctggaaccggtgcacagcttccccctcagcctcggtacttagggagacccccaagcccaacgagccctccccctcccgaactgatggatgtatctctggttggcggacccgcagattgcagccctccccatcccgcaccggcaccccaacaccccgctgcctcagcgctgagaacacgcatgaccggcggtcgaccccctctcccgccaccagatgaccccgctactctcgggccacatctcggcctgaggggcgtgccacagtctaccgccgctagttcttag

SEQ ID NO: 221347 - DNA, 1806 bp, Artificial Sequence
  Description of Artificial Sequence: Synthetic coding sequence
atggccgtacctcccggacatggtccattctccggatttcctggaccccaggagcatactcaagttcttcctgacgtgcgcttactgcctcgccgattgcccctggccttccgagacgccacatctgctcccctcagaaaacttagcgtggatctgattaaaacatataagcacattaacgaggtgtattacgctaaaaagaagaggagggcccaacaggctccgccacaggacagcagcaataaaaaggagaaaaaagtgcttaaccatggttatgatgacgacaatcacgactacatcgtgcggagtggcgagagatggctggaacggtatgagattgactcactcatcggcaagggatcattcggacaagtcgtgaaagcttatgatcaccagacacaagaactggtggcaatcaagattatcaaaaacaagaaggccttcctcaaccaggcacagatcgagctccggctgctggaacttatgaaccagcacgacaccgaaatgaaatattatatcgtccaccttaagagacactttatgttcaggaatcacctctgcctggtttttgaacttctgtcatacaacctctacgacttgttgcgtaacacgcatttcagaggggttagcttgaatctgactaggaaactggcccagcagctttgcactgcgcttctttttttagcaacacctgaactttctatcatccactgtgatctaaagccagaaaatattctgctctgtaacccaaaacgatcggccataaagatagtagacttcggttccagttgtcagctgggccaaaggatctatcagtacatacagagcaggttctaccggagccccgaggtgctgctggggactccctatgatctggcaatagacatgtggtctttgggctgcattctggtggagatgcataccggagagcccctgttctcgggctcaaacgaagtcgaccagatgaaccgtatcgtggaagtattgggcatcccccctgccgctatgctggaccaggccccaaaggcaagaaagtacttcgagaggctaccaggtggcggatggaccctgcgcaggacaaaagagctgcgtaaagactatcaaggtcctggaacccgtagactgcaggaggatctcgtgctgcgtatgctcgagtatgagccagccgcacgcatctcacctctcggggcactgcagcatgggttttttcgcaggaccgcagatgaagccacaaacaccgggccagcagggagctctgcatccactagcccggcacctcttgatacctgcccttctagctccacagcgtcatccattagcagctcgggaggaagtagtggatccagttctgacaatagaacatacagatactccaatcggtattgcggaggacccggaccacctatcaccgactgcgagatgaattctcctcaagttccacccagccaacccctgcggccatgggcagggggtgatgtaccccataagactcaccaggcaccggctagtgcatcgagcttgcccggaaccggagcccagctaccaccacaacccaggtatctcgggagacctcctagtcccacgagccccccacccccagagctgatggacgttagtctggtgggtggccctgccgattgtagcccacctcaccctgccccagctccacagcaccccgctgcctccgcactcagaactcggatgaccggcggtcgcccacccctccccccaccagatgaccctgcaaccctaggcccacatctgggactccgaggggtacctcagagcacagcagcctcatcttag

SEQ ID NO: 221348 - DNA, 1770 bp, Artificial Sequence
  Description of Artificial Sequence: Synthetic coding sequence
atggccgtgccaccagggcatggtccattctccggctttccaggaccccaggaacacactcaggtcctcccggacgtgcggctcctgccacggaggctccccttagcatttcgggatgcaaccagcgccccactgagaaaactctccgtggatctgatcaaaacctacaagcatatcaatgaggtctattacgctaaaaaaaagagacgcgctcaacaggccccaccccaggactcatctaacaagaaagagaagaaggtgctgaatcacggttacgacgatgataaccatgactacatcgtcaggtcgggggagcgctggctcgagcgctatgaaatcgatagcttgatagggaagggatccttcggacaggtcgtgaaagcctacgaccatcaaacccaagaactggtagcaatcaagataataaagaataaaaaggcattcctgaaccaggcccaaatagagttgcggctcctggagcttatgaaccagcacgataccgaaatgaaatattatattgtccacctgaagcgtcactttatgttccggaaccacctctgcctagtgttcgaattgctgagctataacctctatgacctgctaaggaatacacacttccgcggtgtgtctctgaaccttacccgcaaacttgcccagcagctttgcaccgccctcttgtttttggccacgcctgagctgtccatcatccactgtgatttgaaaccagagaacattctgctctgcaaccccaagaggagcgccataaagatcgtggacttcggctcttcctgtcaactaggacagcgtatttatcagtacattcagagccggttctaccgaagccctgaggtgctgctagggacgccatacgatctcgccatcgatatgtggagtctgggatgcatcctagtggagatgcatacaggagagcccctattcagcggctccaacgaggtggatcagatgaaccggattgtggaggtactgggcatcccaccagccgcaatgctggatcaagccccaaaagctcggaagtattttgaacgcctgcccggaggagggtggacactgaggcggaccaaggagctgcggaaggatttggttctgagaatgctcgagtatgagccagcagctcgcattagcccgctgggtgcactgcagcacgggttcttcagacgaacggccgacgaagccacaaataccggtcctgcaggctcttccgcctccacttcacccgctcccctggacacttgtcccagttcctccacagcatcgagcatttcttctagtgggggttcatcagggagcagcagcgacaaccgcacatatagatactccaataggtactgtggtggcccaggaccacccattaccgactgcgagatgaattcaccgcaagtgccgccaagtcagcccctccgcccatgggctgggggagacgtcccccacaagacacatcaagcacccgcatctgcatcctcattacccggaacaggggctcagttacctcctcaacccaggtacctcggcaggcccccaagtccgacctcaccccctccccctgaactgatggacgtcagtctggtgggtggcccagccgattgcagtccaccacatcccgcacctgcccctcagcaccccgcagcatctgccctacgcacgaggatgaccggaggtcgtccacctttaccaccaccagacgatcccgctactcttggccctcatttaggcctgagaggggtccctcagtctacggcagcatcttcttag

SEQ ID NO: 221349 - DNA, 285 bp, Artificial Sequence
  Description of Artificial Sequence: Synthetic coding sequence
atgaatgaccacctgcacgtcggctctcacgcacacggccagattcaggtgcagcagcttttcgaggataatagcaacaaacgtacagtgctgaccacgcaaccaaacgggttaactaccgtgggcaagacagggctgcctgtggttccagagagacagcttgatagcatccatcggaggcaggggtccagcacgtctctgaagagtatggaaggaatgggaaaggtaaaggccaccccaatgacaccagaacaagccatgaagcaatatatgcaaaagctctag

SEQ ID NO: 221350 - DNA, 1806 bp, Artificial Sequence
  Description of Artificial Sequence: Synthetic coding sequence
atgcttacccggaaaccctcagcagccgcacctgctgcctatcctaccggccgtggcggagattcggccgtgcgacagcttcaggctagcccaggtcttggagctggagcaacacggtcaggcgtgggcacaggaccaccgtctccaatcgctcttcccccactaagggcaagcaacgctgcagccgcagcccatactatcgggggttccaaacacaccatgaacgaccatctccacgtgggttcccacgcccacggtcagattcaggtgcagcagttgttcgaggataactctaataaacgcactgtgcttacaacacaacccaacggcctgacaactgtcgggaagacgggtttaccggtcgtgccagagcggcagcttgactccattcacaggcgccaagggagcagcacttctctcaaaagcatggaaggcatgggaaaagtgaaggctacccccatgaccccagagcaggcaatgaagcagtatatgcagaagctgacagcctttgaacatcatgaaatctttagctaccccgaaatctactttcttgggctgaacgctaagaagaggcagggaatgactggagggcctaacaatgggggatatgatgacgatcaggggtcatatgtacaagtccctcatgatcacgttgcttaccgttatgaggtgctcaaggttattggcaagggcagcttcgggcaagtggtgaaagcttacgatcataaggtccaccagcatgtcgcgcttaagatggtgagaaatgaaaagcgatttcatagacaggcagctgaagagatccgtatattagagcatctgcgaaagcaggataaggacaatactatgaatgtcattcatatgttggagaattttaccttccgtaatcatatctgcatgaccttcgagttgctgtccatgaacctctatgagctaataaagaagaataaattccaaggcttttcactgcctctggtgcgtaagtttgcgcactctatcctccagtgtttggacgcattacacaaaaatagaatcattcactgcgacttgaagccggaaaatattctgctgaaacaacagggccgttcaggcatcaaggtcatcgatttcggtagcagttgctacgagcaccagcgtgtctatacttatatacagagcagattttatcgtgccccagaagtcattctgggcgctaggtacggtatgccaatcgacatgtggtcactcggttgtatattggccgaattgcttactggctacccgctgctacccggagaagatgaaggagatcagctcgcttgcatgatcgaattgctgggtatgccctctcagaagctcctggatgccagcaagcgcgctaagaattttgtatccagcaaaggatacccacgttactgtacagtgaccacattaagcgacggctccgtggtgctaaacggtggacgaagcaggcgcggaaagttgcgcggaccgcctgaatctcgggagtggggcaatgctcttaagggttgtgatgaccctctatttcttgacttccttaaacagtgtctggagtgggatccagcagtgagaatgactccaggacaggcattgaggcacccatggctgagacgcaggcttccaaaacctcccacgggcgagaaaacaagcgttaaacggatcaccgaaagcaccggtgccataacctcgatctccaagcttccacccccttcgtcctctgcctccaaactaagaacgaacctcgcccagatgaccgacgcaaatggcaacattcagcaaagaacagtgctgccgaaactcgtttcttag

SEQ ID NO: 221351 - DNA, 1587 bp, Artificial Sequence
  Description of Artificial Sequence: Synthetic coding sequence
atgaatgaccacttacatgtgggcagccatgcccatgggcagattcaggtgcagcagctgtttgaagacaactcaaacaaacggacagttctgacgacccaacctaacggcctcacgactgtgggcaagactggcctgccagttgttcccgagagacagctcgatagcattcatagacggcagggcagctcaacctccctaaagtccatggagggaatgggaaaggtgaaagcaacaccgatgactccggaacaggctatgaagcagtatatgcagaaactcaccgcattcgagcaccacgaaattttctcgtatccagagatctacttcctgggcctcaatgctaagaaacgacagggaatgacaggcggtccaaacaatgggggttacgatgacgatcagggctcgtacgtacaggtgccgcatgatcatgtcgcgtacagatacgaagtgctgaaggttattggaaagggatcctttggacaggtggttaaagcctatgatcataaagtgcaccagcatgtggctctcaaaatggtacgcaacgaaaaaaggttccaccggcaggcagctgaggaaattaggattcttgaacatctccgaaagcaggacaaggacaatacgatgaatgtgatccatatgttagaaaatttcacctttagaaatcacatttgtatgacctttgaactcctgtctatgaatctgtatgaactgattaaaaagaataagttccaagggttttccctgcctctcgtgagaaaattcgcccattcaatccttcaatgtttagacgccctgcacaagaatcgcatcatccactgcgacctgaagcctgagaacatcctattaaagcagcaagggcgatccggcattaaggtaatcgactttgggtcctcgtgctacgagcaccagcgagtgtacacctacattcagtccagattttaccgcgcacctgaggttatcttgggggcaagatatggcatgcccattgatatgtggagcctgggatgcattcttgcggagctgctgaccggttacccactattgcccggtgaagatgagggggatcagctagcatgtatgatcgagttattagggatgcccagccagaaactgctggacgcctctaaaagggccaaaaatttcgtgtcttcaaagggctatccccgatattgcactgtgactaccctgtccgatggctctgtagttctgaacggcggacggtcccgacggggaaagctgcgcggacccccagaatcccgcgaatggggcaacgcactgaagggctgcgatgatcctctcttcctggatttcttgaaacagtgcctggaatgggacccagccgtgcgtatgactcctggtcaggcattacgtcatccgtggcttagacggcgactcccaaagccccctactggtgaaaagacctctgtgaagcggattaccgaaagcaccggagccatcacctcaatcagcaagttacctccaccaagttcatctgcaagcaaactgcggacaaacttagctcaaatgaccgatgccaacgggaacattcagcaacggacagtgctgcccaagctcgtctcatag

SEQ ID NO: 221352 - DNA, 471 bp, Artificial Sequence
  Description of Artificial Sequence: Synthetic coding sequence
atgaacgaccacctccatgtgggttcacacgctcatgggcagatccaggtccaacagctgtttgaggacaacagcaataagcgcacagtgttgactactcagccaaacggcctgacaaccgtcgggaagactggtctgcctgttgtgccagagagacagctcgacagcatacaccggaggcaggggtctagcacatcattaaaaagcatggaaggcatgggaaaggtaaaggccacgccaatgacccctgaacaggctatgaagcagtatatgcaaaagctcacggccttcgagcaccacgagatcttttcctaccccgagatctattttctcggcctcaacgccaagaagaggcagggcatgacagggggacccaacaatgggggatatgacgatgatcaggggagttacgtgcaggtgccccacgaccacgtggcataccggtatgaggtacttaaggtgataggctag

SEQ ID NO: 221353 - DNA, 1707 bp, Artificial Sequence
  Description of Artificial Sequence: Synthetic coding sequence
atgaaatggaaagagaaactgggagatggggtgtacgatacatttatgatgatcgatgagacaaagtgtcctccatgcagcaacgttctgtgtaatccatccgagcccccaccgccacgcaggttgaacatgaccaccgagcaattcacaggagaccacactcaacactttctcgatgggggtgagatgaaggtggagcaactcttccaggaatttggcaatcggaagagtaacacaatccagtccgatggcatcagtgatagtgagaaatgcagtccaacagtcagccagggcaaaagcagcgattgtctgaacaccgtaaagagcaattctagtagtaaagcccctaaggtcgtgccactgacaccagagcaggccttgaaacagtacaaacatcacctgaccgcgtatgagaagcttgaaatcattaactatcctgagatctactttgtcggaccaaatgcaaagaaacgccacggggtgatcggcggaccaaacaacggtggttatgacgacgccgacggtgcttacattcacgtacctagggaccaccttgcgtataggtacgaggtgcttaagataataggcaagggctcttttggccaagtggctagggtgtatgatcataagctgcgtcaatacgtcgccttgaagatggtgcggaacgaaaaacgatttcatcgccaggccgcagaagagattcgcattcttgagcacctgaagaagcaggacaagactgggtccatgaacgtgatccatatgttggaatcattcacattccggaatcatgtgtgtatggcttttgaactgctcagcatcgatttgtacgagctcattaaaaagaataagtttcagggcttcagcgtccagcttgtgcgtaagttcgcacaaagtatccttcagtcactggatgcgctccacaaaaacaaaatcattcattgcgatcttaagcccgagaacattctcctgaagcaccatggtagatcgagcactaaggtcatcgattttggttcctcgtgttttgagtatcagaagctttacacatatatccagtccaggttctatcgagcccctgagattattctcgggagtcgctattcaacccccatcgacatctggtccttcggctgtatactagctgagctgctgactggtcaacccctatttccgggagaggatgaaggcgatcagctcgcctgcatgatggagctgctgggcatgccccctcctaagttactcgagcagagcaaaagagccaagtactttatcaattccaaagggatccccagatactgtagcgtaacaacacaggcagatggccgagtcgtcctagttggaggcagaagtagaaggggtaagaagcggggaccacctggcagcaaggactggggtaccgccctgaagggctgtgacgactacctgttcatcgagttcctcaagcgctgtttgcactgggacccgtccgctcgcctcacacccgctcaagcactgcggcatccgtggatctcaaaaagcgtccctcgtccgctcactactattgacaaggtatctgggaaaagagtggtcaaccccgcaagcgcatttcaggggcttggctccaagctgcctccagtcgtcggtatagccaacaaactgaaagccaacctgatgtccgaaacaaatgggtctatccctttgtgctccgtgctacctaaattgatttcatag

SEQ ID NO: 221354 - DNA, 1707 bp, Artificial Sequence
  Description of Artificial Sequence: Synthetic coding sequence
atgaagtggaaggagaagctgggcgatggtgtgtatgacaccttcatgatgattgacgagacaaaatgcccaccatgttcaaatgtcctctgcaacccctcggaaccccctcccccacgacgcttgaacatgaccacagaacagtttactggcgaccatacacagcacttcctagacggcggagaaatgaaagtggaacagctctttcaggagttcggtaaccggaaatccaacactatccaaagcgatggaatctcagattcagaaaagtgcagccctactgtaagccaggggaaaagctctgattgcttgaatactgtgaaatctaacagcagtagcaaagctcccaaggtggtaccccttacacctgaacaggcacttaaacaatacaagcatcatctcaccgcttatgaaaagctagaaatcataaactaccccgagatctattttgtgggccctaacgcgaagaagaggcacggcgtgattggcggacccaataacgggggttacgacgatgctgacggggcatacattcacgtgcccagggaccaccttgcttatcggtacgaggttctgaaaataatagggaaggggagtttcggccaggttgcgagagtctacgatcataagttgcggcagtacgttgcactaaagatggtcaggaacgagaaacggtttcatcgacaggccgcagaggaaataagaattttagaacacctgaagaagcaggataaaacgggttcgatgaatgtaatccatatgcttgaaagttttacttttagaaatcacgtatgcatggcatttgagttactgtctattgatttatatgagttaattaagaaaaacaaattccaaggttttagcgtacagcttgtccgaaaatttgcccagtcaatcttgcagtctctcgatgcgttgcataaaaataagatcatacactgcgacttgaagccagagaacattctgctgaagcatcatgggaggagctccactaaagtgatcgatttcgggtctagttgcttcgaataccaaaaattgtacacatacattcagagccgcttttatagagcccctgaaatcatcctgggcagtcggtacagcacccccatagacatttggtcctttggctgcattcttgcagaactcctgacgggccagcctctttttcccggagaggacgagggcgaccaactcgcatgcatgatggagctcctgggcatgccccctccaaagctactcgagcagtccaaaagagctaagtacttcatcaacagtaaaggcatccccagatactgctcggtgaccactcaagccgatggtagagtcgtattggtgggtgggagatctcgacgaggcaaaaagagaggcccacctgggtccaaggattggggcactgcactgaagggatgtgacgactacctgtttatcgagtttttaaagcgctgcctacactgggatccaagcgccaggttgacgcccgctcaggcccttcgccacccctggatctcaaagtcagttcccagacctctgacgactattgacaaagtgtcaggaaaaagggtggttaatcccgcaagcgccttccagggcctcgggtctaaattgccaccagtggtgggtatcgccaataaactgaaggccaatctgatgtccgagacgaacggatccattcctttgtgctcggtgctccctaagctcatctcttag

SEQ ID NO: 221355 - DNA, 1767 bp, Artificial Sequence
  Description of Artificial Sequence: Synthetic coding sequence
atgggcggaaccgccagggggcctggccgtaaagatgcagggcctcctggcgctgggctcccgccacagcagcgtcgcttgggcgacggggtctacgataccttcatgatgatagatgaaactaaatgtcccccatgctcaaatgtgctatgtaatccaagcgaaccaccccctcctcgtcggttaaacatgaccacggaacaatttaccggcgaccatacacagcatttccttgacgggggtgaaatgaaagtagaacagctgttccaggagttcgggaaccgcaagagcaatactatccagtcagatggtatttccgactctgaaaaatgttcccccaccgtgagtcaaggtaagtcttcagactgcctcaataccgtcaaatcaaacagctctagcaaagcgccaaaggtggtccccctgactccagagcaagccctgaaacaatacaagcatcacctgactgcctacgaaaagttagaaattatcaactaccctgaaatttatttcgtcggacctaacgctaaaaagagacatggcgtgatcggtggcccaaataatggcggttacgacgatgccgatggagcatacatccacgtccctagagatcatttggcttacaggtacgaagtactgaaaattatcggtaaggggtccttcggacaagtggctagagtgtatgaccacaagctgaggcagtatgttgccctgaaaatggtccggaacgaaaagcgtttccatcgtcaagcggcagaagagatccgcattctggaacatttaaaaaaacaagacaagactggctccatgaacgtgattcatatgttagagagcttcacattcaggaatcacgtctgcatggctttcgaactactctctatagatctttacgaattaatcaagaagaacaaatttcagggcttctcagtgcaactcgtccggaaatttgctcagtccatactacagagcctggacgctttgcacaagaacaagattattcactgcgatctgaagccagagaatatcctattgaagcatcatggtaggagctcgacaaaggtcatcgacttcgggtcaagctgcttcgagtatcaaaagttatatacttatatccagtcccgcttctatcgggcacccgaaatcatcctcggatcacgctacagcactccaattgatatctggtcatttggttgcatcctggccgagctgctgacaggtcagccgctgtttcccggagaagacgaaggagaccagcttgcttgtatgatggagttgctgggcatgccaccgcctaaacttctggagcaaagcaaaagagccaaatactttatcaacagtaagggaatcccaaggtactgcagcgtgactacccaagcagatgggagggtcgtgctggtcggaggtaggtcacggagagggaagaaacggggtccacccggatcgaaagattggggtacagcactcaaaggctgcgacgactacctctttatagagtttcttaaacgctgcctccactgggacccgtccgcaaggctgacacccgcacaagcccttcgtcacccgtggatctcgaagagcgttccacggcctctgactaccatcgacaaagtctctgggaagcgggtggtgaaccctgccagcgcgttccagggcctggggtcaaaactgcctcccgtggtcggaattgcgaacaagcttaaggccaacttgatgagcgaaaccaatgggtcaatcccattgtgtagcgtgctgcccaagcttatctcctag

SEQ ID NO: 221356 - DNA, 732 bp, Artificial Sequence
  Description of Artificial Sequence: Synthetic coding sequence
atgaaatggaaggaaaagctgggagacggggtatatgatacctttatgatgatagacgagacgaagtgtccgccttgcagtaacgtcctgtgcaacccatctgagccaccaccaccccgaagactgaacatgaccacagaacaatttactggggatcacacacaacattttttagacggcggagaaatgaaggtcgaacagttgttccaggaattcggcaatcgcaaatcaaacaccattcagtcagacggaatttccgacagcgagaaatgtagcccaaccgtgtcccaggggaagtcaagcgactgccttaacacagtgaagtctaatagctcatcaaaggcccctaaggtggtgcctcttaccccagagcaggccttaaagcaatacaagcaccatttaacggcttatgaaaaactcgagatcataaactacccggaaatttacttcgtgggcccaaacgccaaaaagcgtcacggggtaataggcggacccaataatggaggatacgacgacgctgacggggcttacatccacgtgccgagagaccacctcgcatataggtacgaggtgctgaagattatcggcaagggctcctttggccaagttgcccgagtgtatgatcataaactgcggcagtatgtggccctcaagatggtccgcaatgaaaagagattccaccggcaggcagccgaggagataagaatactggagcatctgaagaagcagtag

SEQ ID NO: 221357 - DNA, 1563 bp, Artificial Sequence
  Description of Artificial Sequence: Synthetic coding sequence
atgcccgcatctgagcttaaggcttccgaaatcccctttcatccttcaattaagacgcaggaccctaaggccgaggagaagagtcccaaaaaacagaaggttacattgactgcagccgaagcacttaagttatttaaaaatcagttgtccccttacgagcagtccgagatcttgggatatgctgagctttggtttctcggtcttgaggcaaagaaactggacactgcacccgagaagttcagcaaaacttcattcgacgatgagcatgggttttacctcaaggtgctgcacgaccatatcgcctatagatatgaagtgcttgagaccatcggcaagggcagctttggacaggtggccaagtgtctggaccacaagaataacgaattggtcgccctgaaaattatacgcaacaaaaaaaggttccatcagcaagcccttatggagctgaaaatacttgaagcgctgcggaagaaagataaagacaacacttacaatgttgtccatatgaaagactttttctactttcgtaatcatttctgcataacgttcgagcttctgggaataaatctgtacgaactgatgaagaacaacaacttccagggattcagcctgagtattgtgagaagattcactctgagtgtcttgaagtgtctgcagatgctctccgtagagaaaattatccactgcgacctgaaacctgagaatatcgtcctctatcaaaaaggacaagcttcagtgaaagtcatcgactttggctcaagctgctatgagcaccagaaagtatacacatatatccagtcacgattttatagatcacctgaggttatcctgggtcatccctacgacgttgccatcgatatgtggtctttgggctgtattaccgccgagctctacaccggttaccctctgtttcctggcgaaaatgaggtagaacagctcgcctgtataatggaagtgcttggcctgccaccagctggatttattcagacagctagtcgcaggcaaacctttttcgattcaaagggcttccctaaaaatataaccaacaatagaggcaagaagagatatcctgacagcaaggatctgacaatggtgttaaagacatacgacacctcttttctagactttctccgacgttgtctggtatgggagccctctcttaggatgacacccgatcaggctctcaagcatgcctggattcaccagtctcgcaacctgaagccacagcctcgccctcagacgcttcggaaatccaattcattctttcctagtgagacaagaaaagataaagttcagggatgtcaccacagcagcaggaaggccgacgaaatcactaaagagacaactgagaaaactaaagactcacctaccaaacacgtgcagcactctggcgatcagcaagactgcctccagcatggcgctgataccgtccaacttccccagcttgttgatgctcccaagaagtctgaagcagcagtgggtgccgaagtgagcatgacatctccgggacagtctaaaaatttcagccttaaaaataccaacgtcttaccacccatagtttag

SEQ ID NO: 221358 - DNA, 1563 bp, Artificial Sequence
  Description of Artificial Sequence: Synthetic coding sequence
atgccagctagtgaactgaaagcgtcagagattccattccatcctagtatcaagacacaagaccctaaagccgaggaaaaatcacccaaaaagcagaaagtgactttaaccgcagcggaagcactgaagctcttcaaaaaccagcttagcccctatgaacagtccgagatcctcgggtatgcagaactctggttcctgggtctggaggcaaagaaattggatacagctcctgagaagttcagcaaaacttcttttgatgacgagcacggcttctatttgaaggtgcttcacgaccatattgcctaccgatatgaagtcctggagacgattgggaaagggagctttgggcaggtcgcgaaatgtctagatcacaagaacaatgaattagttgcgctcaaaatcatacgcaataagaagagattccatcagcaggctctgatggaattaaaaatactagaggcactgcgcaaaaaagataaggacaatacttataatgtggtgcacatgaaagatttcttctatttccgcaatcacttctgcatcacctttgagctcctcggtatcaacctttacgagttgatgaaaaacaataattttcagggtttctctctctcgatcgtgaggagattcaccctgtccgtgttgaaatgtctgcagatgttatccgtggaaaagattatccattgcgatctcaagcccgagaacatagttctgtatcagaaaggacaagctagtgtaaaagttatcgatttcggttcaagctgctatgagcatcagaaggtctatacgtacatccagtcacggttctatcggtctcctgaagtgatactgggacacccgtatgacgtggcaatcgatatgtggtccctgggatgtatcaccgccgagctctatacaggatacccgctattcccaggggagaatgaggtggagcagttagcctgtattatggaggtgctgggtctgcccccagccggtttcatacagaccgcatcaagaagacagacttttttcgattccaagggattccccaaaaatatcactaataacaggggcaagaagagatatcccgattctaaggacctcaccatggtgcttaagacctacgacacatcctttctggatttcctgcgcaggtgcctcgtatgggagcccagtctaagaatgaccccagaccaggccctcaagcacgcgtggatccaccagagtcgtaacctgaaacctcagcctcgtcctcagactctgagaaagtcgaattccttctttccatctgagacccggaaagacaaggtgcagggttgtcaccacagttctcgtaaggcagatgaaataacaaaggagacaaccgagaaaacgaaggactcccccaccaaacatgtgcaacactccggcgaccagcaggactgtctgcagcacggcgcagataccgtacagctgcctcagctggtcgacgctccaaaaaaatcagaagctgctgtaggagcagaagtttcgatgacttcgcccggacagagcaagaactttagtctgaagaacaccaatgtgctcccaccaatcgtgtag

SEQ ID NO: 221359 - DNA, 1560 bp, Artificial Sequence
  Description of Artificial Sequence: Synthetic coding sequence
atgccagccagcgaactgaaggcatccgaaattccctttcatccttctatcaagactcaggatcctaaagctgaagaaaagagtcccaagaagcagaaggtgacactcaccgcagcagaggctttgaagttgttcaagaatcagctctccccatacgagcaatccgagatcctaggttacgccgaactttggtttcttgggcttgaggcgaagaagttggacacagcacctgagaagttttctaagacgtcctttgacgacgagcacggcttttatttaaaggtcctgcacgaccatatcgcctatagatatgaagtcctggagacaatcggaaaggggtcctttgggcaagtagctaaatgcctggaccacaagaataacgagcttgttgctctaaagatcattcgcaataagaaacgttttcaccaacaggcattgatggaactgaagatattggaagcactgcggaagaaggacaaggataacacttacaacgtggtgcacatgaaagattttttctattttaggaaccatttttgtatcacttttgagcttctcggcatcaatctgtatgagttaatgaagaacaataactttcagggcttcagcctgtccatcgtgcgcaggttcaccttaagcgtgttaaaatgcctccagatgttaagcgtcgaaaagataatccattgtgatttgaaaccagaaaacattgtcctataccaaaagggacaagcttccgtcaaagttatagactttggatcaagctgctacgagcaccaaaaagtgtacacatacatccagtctagattttaccgttcaccagaggtgattctaggccacccttacgacgtagcgatcgacatgtggtcgttggggtgcattacggccgaactgtatacaggataccccctgtttcccggagaaaacgaagtcgaacagctcgcttgcatcatggaggtgctcggcctgccaccagctggatttattcagacagccagcaggcgtcagacattcttcgatagtaagggattccctaaaaatatcaccaataatagggggaagaaacggtacccagactctaaggacctcactatggtgcttaaaacatacgacacaagctttcttgatttcttgcgcaggtgtttggtttgggagccctctctcagaatgacgcctgatcaggccctgaagcatgcatggatacaccagtcccgcaaccttaagccccaacccagacctcagaccctccgcaaatcaaatagctttttcccgtctgaaacacggaaggacaaggtgcaagggtgccatcactcatctcggaaggatgaaatcacaaaggagaccactgaaaagaccaaggactcaccaaccaagcatgtgcagcattcaggggaccagcaggattgtctgcaacatggcgctgatactgtgcaactcccccagctggtcgatgccccaaagaaaagcgaagccgctgtcggcgcagaagttagcatgacaagccccggacagtcaaagaattttagcctgaagaacacaaacgtcctcccccctattgtttag

SEQ ID NO: 221360 - DNA, 474 bp, Artificial Sequence
  Description of Artificial Sequence: Synthetic coding sequence
atggttctcaagacatacgacacaagttttctggactttctgcgtcggtgccttgtttgggagccgagcctgagaatgacccccgaccaggctctgaaacatgcctggatacaccagtcccgcaacctcaaaccacagccacgccctcagaccctgcgcaagagtaactcgttttttccatcggagacacgcaaagacaaagtgcaaggctgccaccatagctctcggaaggctgacgagattaccaaggaaaccactgagaaaacaaaagactctccaaccaagcacgtacaacactccggggatcagcaagactgcctgcagcacggcgctgacaccgtgcagctgccccagctggtggacgcccctaaaaagagcgaggcggcagttggggcagaagtgtctatgacttctcccggtcagagcaaaaatttctcccttaagaatacaaatgtccttccacctattgtttag

SEQ ID NO: 221361 - DNA, 1011 bp, Artificial Sequence
  Description of Artificial Sequence: Synthetic coding sequence
atggggaactgtttacaccgggctgaactctcaccttccacagaaaatagttcccagcttgatttcgaagatgtgtggaattccagctatggagtgaacgactcattccccgatggcgactacggggcaaacctggaagccgcagccccttgccattcttgtaatttactggacgattctgctctaccatttttcatcttgaccagtgttctgggcattctggcttcctctacagttctcttcatgctgttcagacctctattccgctggcaactttgtcccggttggcccgtgctcgctcagctcgccgtgggctccgctttatttagcattgtggtacccgtcttagccccaggcctcggctcaacgagatcttccgctctctgctcactagggtactgtgtatggtacgggagtgcatttgcccaggctcttctcctcggatgtcatgcctctctggggcacaggttgggggctggacaggtcccagggctgacactcggactgaccgtcggaatatggggagtggcagccctactgacactcccggtaacgcttgctagcggggctagcgggggtttgtgtaccctgatctattccactgaactgaaagctctgcaagccacccacactgtggcgtgcctcgccattttcgtactgctgcccctgggactgttcggcgcaaaggggttgaaaaaggccctggggatggggccaggtccatggatgaatattctttgggcgtggttcatcttttggtggccgcacggagttgtgctcggattggattttcttgttcgaagcaaactgttgctcctatccacctgcctggcgcagcaagcactggatcttctgctgaacctggcagaagctctggccatattacattgcgtggctacccctctgcttctggccttgttctgtcaccaggctactagaaccttgctgccatccttgcctctgccagaaggttggtcaagtcacctggatacccttggatccaaatcatag

SEQ ID NO: 221362 - DNA, 1017 bp, Artificial Sequence
  Description of Artificial Sequence: Synthetic coding sequence
atggcctcctcaggctacgttctgcaggctgagctcagccctagcacagagaactcatctcagttggatttcgaggatgtgtggaattcttcgtacggtgtgaacgacagcttccccgatggtgactatggagctaatctggaggcagctgccccttgtcatagctgtaatctcttggatgactctgccttaccatttttcatcttgacatcagtgttgggcatactggctagcagcacagttcttttcatgctgtttagaccgttgtttcggtggcaactctgcccaggatggcccgtacttgcccagcttgccgtaggctcagccctgttcagcattgttgtgccagtcttagcacctgggctgggctcaacacgttcttccgcgctttgttccctgggctattgcgtttggtacggcagcgcctttgcacaggccttgttactgggctgtcacgcctccctgggacaccgtctgggcgcaggacaagttcctggcttaacactcgggctgacagtaggcatttggggagttgcagctcttctgacactgcctgtaacattggcctctggagcctcaggcggactgtgtacccttatttattcgacggagctgaaggcccttcaggccactcacaccgttgcttgccttgccatatttgtactgcttcccttgggccttttcggcgctaagggactgaaaaaggctcttgggatgggacccggaccgtggatgaatatactctgggcttggtttattttttggtggcctcacggcgtggtcttgggcctggattttctcgtgagatcaaaattgctactgctatctacatgcctggcccagcaagctctggacctgttgctcaacctcgccgaagcattagccattttgcactgtgtggccacccctttgctcctggctctgttttgccaccaggctacccgaacgctgcttccatctcttccgctgccagagggatggagctctcatctcgatacactcggttccaaatcatag

SEQ ID NO: 221363 - DNA, 1011 bp, Artificial Sequence
  Description of Artificial Sequence: Synthetic coding sequence
atggggaattgcctgcatcgcgcagagctgtctccctccaccgagaatagcagccaactggacttcgaggacgtttggaattctagttacggagttaatgacagcttccccgatggtgactacggggcaaatctcgaggctgccgcaccctgccactcttgcaatctgttagatgacagcgctctcccattttttatactgaccagcgtccttggcatactggccagctctactgtcttgtttatgcttttcaggccactatttagatggcagctgtgccccggatggccagtcctcgcgcagctggcggttggctccgccctctttagcatcgtggtgcctgtactagcacccggactggggtccactcgatcctccgcactttgtagccttggctactgcgtctggtacgggagcgcctttgcgcaggctcttctgttgggctgccatgccagcctcggtcataggctgggagccggacaggtgcctgggctcacactgggtcttacagttggcatttggggggtggctgctcttctaactttaccagtaacattggcatcaggcgcaagtgggggtttgtgtacccttatctatagtacagaacttaaagcgcttcaggcaacacacactgttgcgtgcctggctattttcgtcctcctgccgcttggcctctttggcgctaaaggcctaaagaaagcactgggaatgggtcccggaccttggatgaacatcttatgggcctggtttatcttctggtggccgcacggagtcgttcttggcctagacttcctcgttaggtcaaagctgctattgctctctacttgccttgcccaacaggccctggacttgcttctgaatttagccgaagccctggcgatactgcattgtgtggctacaccactgttgctggcgcttttctgtcaccaagctactcgaaccctgcttccttcgcttccactccctgaaggatggagctcacacctggacaccctcgggagcaaatcctag

SEQ ID NO: 221364 - DNA, 468 bp, Artificial Sequence
  Description of Artificial Sequence: Synthetic coding sequence
atggcctcctcaggctatgtcttgcaggccgaactgtctccatcaaccgagaatagctctcagctggattttgaggacgtgtggaacagttcatatggtgtcaatgatagcttcccagacggggactacggcgcaaacctggaagccgcagcgccttgtcactcctgtaatcttcttgacgattcagcactgccattctttatcctgacgtctgtgcttggtatactggcttccagcaccgttttgttcatgctctttcgccctctgtttcggtggcagctgtgtccgggttggccagtcctcgcacagctggcagtgggatcagccctgttttcaatcgtggtgcctgtgctagctcctgggctgggttcaacacggtcttcagcactttgctccctcggctactgtgtttggtacggttcagctttcgctcaagcgctgctgcttggctgtcacgctagcctatag

SEQ ID NO: 221365 - DNA, 1011 bp, Artificial Sequence
  Description of Artificial Sequence: Synthetic coding sequence
atgggtaactgcctccacagggcagaactcagcccatccaccgagaactcaagccagctggactttgaagacgtgtggaatagctcttatggtgtaaatgacagctttccagatggggactatggggctaatctggaagccgcagcaccatgccattcctgcaatctactggatgattctgccttacccttttttatccttacctcagtgcttggaatcctggcgtcaagcacggtgctgttcatgttattcaggcccctttttaggtggcaactatgtcctggatggccagtgcttgcacagctggccgtaggtagcgctctgttcagcatcgtggtgcctgttctcgcccctgggttaggctctactcgatcctccgctctatgctccttaggatactgtgtttggtacgggtcagcttttgcccaggcactgctgctgggttgccacgcttcattaggccacaggctcggggcagggcaggtgcctggactgactttgggcttaactgttggcatatggggtgtagccgctttgctgaccctgcccgtgacccttgcttctggcgcaagcggtggcttgtgcacactgatctacagcactgagttgaaagccctgcaagccacgcacaccgtggcctgtctggccatcttcgtcttgttaccactcggcttgttcggcgcaaaaggtttaaaaaaagctttgggaatgggcccagggccatggatgaatatcttgtgggcctggttcattttttggtggccccacggcgtggtgctggggcttgatttcctcgttcggtctaaactgctccttctcagtacctgcctggcccagcaagccctggacctccttctcaatttggctgaggcactagctatactgcattgcgtagcaactcccttattacttgccttgttctgccaccaagccaccaggaccttgctcccatctctcccactcccagaaggctggtcctcgcacttagacaccctagggagcaaatcgtag

SEQ ID NO: 221366 - DNA, 2010 bp, Artificial Sequence
  Description of Artificial Sequence: Synthetic coding sequence
atgggcagcaattccagccggattggcgacttacctaagaacgaatacctcaaaaaactgtccggtaccgagagtatttctgagaatgatcctttttggaatcagttgctgtcatttagctttcctgcccctacgagcagcagcgagctgaagttgttggaggaagcaaccatctcggtgtgccgctccctggtggagaacaatcccagaaccggcaatctgggagccctgatcaaagtgttccttagccggactaaggagctgaaactctccgcagaatgtcagaaccacatctttatctggcaaacacacaacgccctctttatcatctgctgtctgctaaaggtgttcatatgccagatgagcgaagaggagctgcaactgcacttcacctatgaagagaagtcccccggtaactactcgtcagactccgaggacctgttggaggaactcctgtgttgtctcatgcagctgatcaccgacattcctcttctggacatcacctacgaaattagcgtggaagcaatctccacaatggttgtgttcttgtcttgccagctttttcacaaggaggttctccggcagtctatttctcataagtacctcatgagaggaccatgcctaccatatacctccaagcttgttaagacactgctatataatttcatcagacaggagaagcccccaccacctggcgcacacgtttttccccagcagtccgatgggggaggactgctgtacggtctggcatctggcgtggctaccggactatggactgtattcacactcggaggtgtaggaagcaaggccgcagccagtcccgagctttctagtcctcttgcaaatcagtcacttctgctgttgctggtgctggccaacttgacagacgcttccgatgccccaaatccctatagacaagccattatgtcattcaagaacacacaagactcttcaccattccctagcagcattccacatgccttccagatcaacttcaactctctgtataccgctctgtgcgaacagcagacgtctgaccaggccacactgttattgtatactctgttgcaccagaactcaaacattaggacatacatgttagctcggacagatatggaaaacttagtactgcccatcctggagatcctgtaccacgtggaagagaggaattctcatcatgtctatatggctctgataatattactgattctgactgaggatgacggatttaatcgctccattcatgaagtgattctgaagaatatcacttggtacagtgaaagagtccttacagagataagtcttgggtcccttttaatcttggtggtgataagaacgattcagtacaacatgacaagaacccgagacaaataccttcacactaattgcctcgctgccttagctaatatgagcgcccagtttcgaagcctgcatcaatatgcagcgcaacgtatcatcagtttgttctcactgttatctaaaaagcataataaggtgcttgagcaagccacgcaaagtctcagaggctcgctgtccagtaacgacgttccattgcccgattacgcccaggacctcaatgtaatagaagaggtgatcaggatgatgctggaaatcataaactcatgtctcactaatagtctgcaccacaatcctaatctggtgtacgctctgctatacaaacgagatttgttcgaacagttcagaactcaccccagtttccaggacatcatgcagaacatagatttggtgataagcttcttctctagccgattactccaggcgggagccgagctatccgtggaaagagtgctggagataattaaacagggcgtcgtggccttacctaaagacagactgaaaaagttccctgagctgaagtttaaatacgtcgaggaggagcagccagaagagttttttatcccttacgtctggtcactggtgtacaactccgctgttgggctttattggaacccacaagacatccagctattcaccatggattctgactag

SEQ ID NO: 221367 - DNA, 519 bp, Artificial Sequence
  Description of Artificial Sequence: Synthetic coding sequence
atggccctcataatcttattgatcctgactgaggatgacggttttaacaggtccatccatgaggtgatcctgaaaaatatcacttggtacagtgagagagtgctgaccgagataagcctgggctctctgctaatcctagtggtgataaggacgatccagtacaacatgactcgtactagggacaagtacttgcacaccaactgcctggcagcactggctaacatgtcagcccaatttagaagcctgcatcaatatgcagctcaaaggataatatcttacacttgcagacatcttcgcaggtatgtttacgtcctggacaagctgtactttccacacagccactgctcaactctccagcattgtttttcaaccctaagtgacaatggcgaggagctgctgagcttgacctgctcccacatactgaggtcatacgcgagctccctgttctcactactaagcaagaaacataacaaagtgttagaacaagcgacacagagtcttcgagggtccttgtcctag

SEQ ID NO: 221368 - DNA, 1440 bp, Artificial Sequence
  Description of Artificial Sequence: Synthetic coding sequence
atgggctccaactcgagtcgcatcggggatttgccaaagaacgaatatctcaagaagctgagcggaacagaatccatcagcgagaacgatcccttttggaaccagttgctcagcttctcttttccggctcctacctcatcctccgaactgaaactcttagaagaggcgacgatctctgtgtgccgctctctggcgggtctttggaccgtcttcacattaggtggtgttggaagtaaggctgcagccagtcctgagctcagctcacctctagcaaaccagagcctgcttctgctgctggtcttagccaatttaaccgatgctagcgatgccccaaacccatatagacaggccattatgtcatttaagaacactcaagactcctctccgtttccgagctccattcctcacgcattccagattaatttcaattcactgtacactgctctgtgcgaacagcagacatcagaccaagccacactgttactgtacactctgttacaccagaacagcaatataaggacatatatgcttgcaagaacggatatggaaaacctggttctcccaattcttgagattctttaccacgtggaggagagaaattcgcatcacgtgtacatggcacttattattctcctcatcctgaccgaagatgatggtttcaatcgttctatccacgaggtgatactgaagaatattacttggtattctgagcgcgtattaaccgaaataagtctaggaagtctcttaattcttgtcgtgatccgcactattcaatacaacatgacaaggactcgggacaagtatctgcatacaaattgtctggccgctctggctaatatgtcagcccagtttcgcagccttcatcagtacgctgcccagaggattatcagcttgtttagcctgctgagcaaaaagcacaataaagttctggagcaggccacccagagtctcaggggcagcctatcatccaatgatgttcctttaccagactatgctcaggacctgaacgtgattgaggaggtgattcggatgatgctcgaaatcatcaacagctgtttaaccaacagcctgcaccataatccaaatctggtgtacgcgctcctatataaaagggatctgttcgaacagttccgcactcacccatccttccaggatatcatgcagaatattgatctcgtaatttcattcttcagttctaggctgctgcaggctggggcagaactgtcggtggagagagtcctggaaattatcaagcagggggtagtcgcccttccaaaggaccgcttgaagaaatttccagagctaaaatttaaatatgtggaagaggagcagcccgaagagttctttatcccctacgtttggagcctggtgtataacagcgctgtggggctttattggaatcctcaggatatccagctgtttactatggactcagactag

SEQ ID NO: 221369 - DNA, 3837 bp, Artificial Sequence
  Description of Artificial Sequence: Synthetic coding sequence
atggcccaatccaaacgccacgtgtattcacggacaccaagcggctcacgcatgtctgccgaggccagtgccaggcccttgcgagtgggtagcagagtggaggttatcggaaagggacataggggtactgtcgcgtacgtcggcgctaccttgtttgcgactggtaagtgggtgggggtcatcttggacgaggcaaagggaaaaaatgatgggactgttcaagggcgtaagtacttcacttgcgatgagggtcatgggatcttcgttcggcagtcccagatccaggtttttgaggatggcgcagatacaactagccccgagactccagattcaagtgcttccaaagtactgaagagggagggtacagacactacagccaagacgagcaagctccggggtttaaaacccaaaaaggccccaacagctagaaagactaccacccggaggccgaaacctactcggccagcgtccacgggagtggctggagccagttcatcacttgggccatcaggctcggccagtgctggcgagctcagtagttccgagccgtctacacccgctcagactccgctagctgcccctattattcccacacccgtgctaacctcaccgggagcagttccacccctgccttctccatctaaggaggaggaaggcctgcgcgcacaggtccgagaccttgaggagaagttagagaccctccggttgaagcgagctgaagacaaggcaaaactgaaggagttggaaaagcataaaatccagctggaacaggtgcaggaatggaaatcaaagatgcaagaacagcaggctgatttacagaggaggctcaaggaggccagaaaagaggccaaagaggctctcgaagccaaagagaggtatatggaagagatggcggatacagcagacgccattgagatggctacgctggataaggagatggctgaggaacgtgccgagagtctccagcaggaggtggaggcattaaaggagagggtggacgagctcacaacagatttagagatcctgaaggccgagatcgaagagaaaggcagcgacggggctgcgtcgtcataccagcttaagcaacttgaggagcagaatgcccgactcaaggatgctttagttagaatgagggatctgagctcctcggagaaacaggagcacgtgaagctccagaaactcatggagaagaagaatcaggagctagaagtcgttcggcagcagagagagcggttgcaagaggagttgtcccaggccgagagcacaattgatgagctaaaagaacaggtcgatgcggcactgggcgcagaagaaatggttgagatgttgactgatagaaacctcaatctggaagaaaaggttagagaattgagagagaccgttggcgaccttgaggccatgaatgagatgaatgacgaacttcaagagaacgcaagggagactgagctggaactgcgggaacagctcgacatggccggtgccagggtgcgcgaggcgcagaagagagtggaagccgctcaggagaccgtcgcagattaccagcagaccataaagaagtatcgtcagctgaccgcccacctgcaggatgtcaaccgcgaactcacaaatcagcaagaggcttccgtcgaaaggcaacagcagcctccccctgaaacctttgattttaagatcaaatttgcagaaactaaggcccatgcaaaagctattgagatggaactccgccaaatggaagttgcccaggccaatcgccatatgagcttgctgacagcttttatgcccgactctttcctccggcctggaggggaccacgactgtgtacttgtgttgctcttgatgccccgactgatctgtaaggccgagttaatacgcaaacaggcacaggagaaatttgagctgagcgagaattgtagcgaacgacctggcctacgcggagccgctggagaacagctgagttttgccgctggcctcgtctactctttgagcctcctgcaagccaccctgcataggtacgaacacgcactgtcacagtgctctgtggatgtatacaaaaaagtgggttcattatatccagagatgtctgcccacgagcgcagccttgacttcttaattgaattacttcataaggatcagctggacgagacagtgaacgtcgaacccctcacgaaagccatcaagtattaccagcacctctactcaatccacctcgcagagcagccggaggactgcacaatgcagcttgctgatcacataaaattcacacagagcgctctcgattgtatgagtgtcgaggtcggccgattgcgcgcatttctccagggaggtcaggaagcaacagacatcgccctcctactacgggatctcgagacaagctgttccgacatacgacagttctgcaagaaaatcagacggagaatgcctggcaccgacgcacccggtatacctgccgctttggctttcgggccacaagtgagcgacactctgctggactgtagaaagcacctgacatgggtggtggcagtccttcaggaggtggctgccgcagccgcacagctgattgctcctttagctgagaatgagggcctactcgttgctgccctcgaggaacttgcgttcaaagcctctgaacaaatttatgggacaccgtctagctcaccttacgaatgcctgcggcagtcctgtaatattttaatatcaactatgaataagctggcaaccgctatgcaggaaggtgagtacgatgcagaacgccctcctagcaagccacccccagtggagctgcgggctgcagcactcagagccgagattaccgacgctgaaggactgggattgaagctcgaggatagagagactgtgattaaggagctgaagaagtctttgaagatcaagggcgaagagttgtcggaagccaatgtgcgcttgagtctgttggaaaaaaagctcgacagtgccgctaaggacgcggatgagaggattgaaaaggttcaaacccgattggaagaaactcaggcacttttgcgcaagaaggaaaaagaatttgaggagactatggatgccctgcaagccgatattgaccagttggaagccgagaaggctgagttaaagcagcgcttgaattcacaaagcaagagaacaattgagggccttaggggtccccctccatcaggaattgcaactctggtgagcggcatcgccggtgaagagcagcagcgaggggcaatccccggacaggcccctggctctgtccccggtcctggactggtgaaggattctcctcttctgttgcagcaaattagcgccatgagactgcacattagtcaactgcagcacgagaattcaattctaaaaggagctcagatgaaagctagccttgcttcacttcccccactgcacgtagcaaaactgtcacacgagggacccggtagtgagcttcctgccggtgcactttatcgtaaaacctcccagctgttagagactctgaaccagctgagcacccacacgcatgtggtggacatcacccgtacttccccagctgccaagagcccatctgcccaactgatggaacaggtcgcacagctcaaaagcctctcagacacagtggagaaactcaaggacgaggttctgaaggaaacagtgtcacagcggcctggggcaacagtgccaaccgattttgccacatttccatcttcggcctttctgcgcgctaaagaggagcagcaggatgatacggtttatatggggaaagtgaccttctcttgcgccgctggcttcgggcagcgtcatcgcctggttttgacgcaagaacagttgcaccagctgcattcacgtctgattagttag

SEQ ID NO: 221370 - DNA, 3786 bp, Artificial Sequence
  Description of Artificial Sequence: Synthetic coding sequence
atgagcgcggaggcctctgcaagaccactccgcgtcggctctcgggtggaggtcatcggtaaaggacatagaggaacagtggcatatgttggggcaacactctttgcaaccggcaagtgggtgggcgtgatcctagacgaggcaaaaggcaagaacgacgggaccgtgcaaggacgcaaatacttcacttgtgacgagggacatggtatatttgttagacaaagccaaatccaagtctttgaggacggggctgacacgacctcccctgagactcccgatagttccgccagcaaagttctcaagagggaggggactgacactactgccaagactagtaaattgagaggactgaaacctaagaaggcccctaccgccagaaagggcagacgcgttagaacgaagcctacccgacctgccagcacaggcgtagccggagcctcgtcttctctgggaccctcgggttccgcctccgctggcgagctctcttcctcggagccgtctactcctgctcagacgccactggcagctcccatcatcccaaccccagttcttacgtcgcctggcgcagtacctcctctgcccagtccttccaaggaggaggaaggactacgggctcaggttcgggatctcgaggaaaagctggagacgctgcgtttgaagcgggctgaggataaggcgaaactgaaagaactggaaaaacataaaatccaattggagcaggtccaagaatggaagtcaaagatgcaggagcagcaggccgatttacagaggcggctcaaggaggccaggaaagaagccaaggaggcacttgaagcaaaagagcgatacatggaggagatggctgatacagctgacgctatcgaaatggccactctggacaaagagatggctgaagagagggccgagtcactgcaacaggaggtggaagccctgaaggagagggttgatgagctgacaaccgacttggagatcctgaaggccgaaatcgaagagaagggaagcgacggcgctgcttcatcttatcagctgaagcagctggaggagcagaacgcaagattaaaagacgccctggtcaggatgcgggacctgtcctcatccgagaaacaagagcatgtgaagctgcagaaactcatggagaaaaagaatcaagaactggaggtggtgagacagcagcgcgagcggctccaggaggagctgtcccaggcagagagcacaatcgatgagctcaaagagcaggtagatgccgctttaggggcagaagagatggtggagatgttgacagaccgtaatctaaacttagaagagaaagtgcgagagttgagagaaacagtaggggacctcgaagccatgaacgagatgaacgacgaactacaggaaaatgctcgagagacagagctagaactcagagaacagctggatatggcaggcgcacgagtgcgggaagcgcagaagcgcgtggaggccgcacaggaaacagtggcggattaccaacagacaatcaagaagtacaggcagttaaccgctcacctacaggatgtgaacagggaactcactaaccagcaggaggcctccgtggagaggcaacagcagccccctccagagacttttgactttaaaatcaagtttgccgagactaaggctcatgctaaagcaatcgagatggagctgcgtcagatggaggtagcccaggcaaatcgccacatgtctctccttaccgcctttatgcccgatagctttctacggccaggaggagaccatgactgcgttctggtcctcttgctcatgcctcgccttatctgtaaggctgaactgatccgtaaacaggcccaggagaaattcgaactctcggaaaactgctctgaaaggcccggactacgtggcgctgctggtgaacaactgagcttcgccgctggcctagtgtacagcttaagcctgctgcaggctaccctgcacaggtacgagcacgccctttcgcagtgcagcgtggatgtttataaaaaagtcggaagtctgtacccggaaatgtctgctcacgaacgaagtctggacttcttaattgagctgcttcacaaagaccagttagatgagaccgtgaacgtcgaaccgttgacaaaagcaatcaaatactatcagcacctttatagtattcacttagcagaacaacccgaagattgtacaatgcaattagctgatcacattaagtttactcagagcgcattggactgcatgagcgtagaggtggggaggcttcgtgctttcctgcaggggggtcaggaggcaaccgatattgccctgttgctcagagacctggagacatcgtgtagcgatatcaggcagttttgcaaaaaaatacgcaggagaatgcctggcaccgatgcacccggaataccagccgctctcgccttcgggcctcaggtctccgatactctactcgattgtcggaaacatctcacgtgggtggtggcagtgctgcaagaggtagcagcggctgcagcgcagctaatagccccacttgccgaaaacgaggggctactggttgcagccctggaggaattggcgttcaaagcttccgagcagatttatggaaccccatcaagttccccttatgaatgcttgcgtcagtcctgcaatattctgatatctacgatgaacaagctggcgacagcaatgcaggaaggcgagtacgacgcagaacggcctccctctaagccccctcccgttgagttgcgcgctgccgctctccgggctgagattaccgacgcggaaggcctaggactgaaacttgaagatagggaaaccgtgatcaaggaacttaagaagtccctgaagatcaagggcgaggagctttctgaagcgaatgttcggctgtccctcctggaaaagaaactggatagcgcagctaaagacgcagacgaaaggatcgagaaggtccaaacgcgtttggaggagacacaagcactgctcagaaagaaagaaaaggaatttgaggagacaatggatgctctgcaggccgacatcgaccagctcgaagccgagaaagcagaactaaagcagcggctgaactctcagagcaagagaaccatcgaggggctccgcggacctccccctagcggcatcgctacactcgtgagtggtattgctggtgaggagcaacagagaggtgccattccaggccaagctcccggatctgtccccggtcctggcctcgtcaaagactctcctctgttattgcagcagatatcggccatgagattgcatatctcgcaactgcagcacgagaatagtatattaaagggcgcacagatgaaggctagtctggccagcctgcctcccctacatgttgccaagctgtcacacgagggaccgggaagcgaattaccagcaggtgcactgtaccggaaaacctcacaactgttagaaactctgaatcagctatccactcacactcatgtcgtcgatattacaaggacgagtccagccgcaaaatcaccaagcgcacaactgatggagcaggtggcccaactcaaatccctttctgacaccgtggagaagcttaaagacgaagtgcttaaggagacagtgagtcagagacccggtgccacagttccgaccgactttgccacttttcccagttccgcattcctccgagccaaggaggaacagcaggatgatacagtgtatatgggaaaagtgaccttttcgtgcgcggcaggttttgggcagaggcacaggctggtgctcacccaggagcagttgcaccagctgcacagtaggctgataagttag

SEQ ID NO: 221371 - DNA, 3816 bp, Artificial Sequence
  Description of Artificial Sequence: Synthetic coding sequence
atggcccagtccaagaggcatgtctattctcgaaccccatctggatcaaggatgtcagctgaggccagtgcaagaccgctacgggtgggctcccgcgtggaggttatcggcaagggacatcgaggaacagtggcttacgttggtgccactctgtttgccaccggcaagtgggtgggcgtgattttagacgaagccaaaggaaaaaacgatggcacagtacaaggccgaaagtacttcacctgtgacgagggacacggcatttttgtgcggcaaagccagattcaggtatttgaggacggcgctgacacaactagtcccgagacccctgattcaagtgcctctaaagtgctaaaaagagaagggactgatacaaccgccaagaccagtaagctggcacctaccgcaagaaaaacaacaacaagaagacctaagcccacaaggcctgcgtctaccggagtggccggagccagttctagcctggggccaagcggctccgccagcgctggggagctctccagctccgagcccagcacccccgcacaaacacccctagctgctcccattatccctacccctgtgctcacctcacctggcgcagttcccccactcccctctccttctaaggaagaagaagggcttagggctcaggtccgggatcttgaagaaaagctggagactctcagactcaagcgggctgaggataaagccaaactcaaagaacttgagaagcacaaaattcagctcgagcaggtgcaggagtggaaaagcaaaatgcaggagcagcaagctgatctgcagcgccgactcaaggaggctcggaaagaggccaaggaggcactggaggccaaagaacgctacatggaagaaatggccgatacagccgacgcaatcgagatggccacactcgataaagaaatggcagaagaacgcgcagagtccctgcaacaagaggtcgaggctcttaaagagcgcgtggacgaactgaccacagatcttgagatcctgaaagcagaaatcgaagagaagggctccgatggcgcagcctcaagttatcaactcaagcagctggaagagcagaacgctcgattgaaagatgcactcgtccggatgcgggacctgtcttcctccgagaaacaggagcatgttaagctacagaaactcatggaaaaaaagaatcaggaactggaagtggtgcgtcagcagagagagagactgcaagaagagctttctcaggcagaatccactattgacgaacttaaagagcaggtagacgccgctctgggcgctgaggagatggtggaaatgttaaccgacaggaacctcaatctcgaggagaaggtcagggaactgcgcgaaaccgtgggagaccttgaggcgatgaacgagatgaacgacgaactccaagagaatgcacgggagactgaactggaactccgcgagcagctcgacatggccggagcgagagtacgtgaggcccagaaaagggtggaagccgcacaggagaccgtggccgattaccagcagactattaagaagtatagacaactgacggcccacctgcaagatgtgaaccgggagctcactaaccagcaggaggctagcgttgaaaggcaacaacagccacccccagagaccttcgatttcaagattaagtttgccgaaaccaaggcacacgccaaagccatcgaaatggagttgcgccaaatggaggttgctcaggcgaatcgtcatatgtccttactgaccgcattcatgcccgactccttcctccgccctggcggagaccacgattgtgtcctagttctgctgctgatgcccaggctcatctgcaaggccgagctgatcagaaaacaagctcaggagaaattcgagttgtccgagaattgtagcgaacggccaggccttcgcggtgctgcaggagagcagctgtcattcgcagcaggcttggtgtacagcctgtctctgttgcaggcgactctgcataggtacgagcacgctctgtctcagtgctcagtagacgtgtacaagaaggtaggatccctatatcccgaaatgtcagctcatgaacgctctctcgatttcctgattgagcttcttcacaaggaccaattggatgagacggtgaacgtggaaccattgactaaagcaatcaaatattaccagcacctgtactcgattcatcttgcggaacagcctgaggattgcacaatgcaattggctgatcatattaagttcactcaatccgccttggactgtatgtctgtagaggtcggacgcctgcgagcattcctgcaggggggacaggaagcaacggacattgcactactgctgcgggatttggagacgagctgtagcgatatccgacagttttgtaaaaagatcagacgccgaatgccaggcacagatgcaccaggaatcccggcagccctggcctttggaccacaggtatctgacaccttactggattgtcggaagcacctgacctgggttgtcgcagtcctgcaggaggtcgccgcagcagcagcacagttgatcgctcccctcgcagaaaatgagggcctgctggttgcagctctggaagagctcgcttttaaggcctcagaacagatctacggcacgccatcatcatctccctatgaatgtctgagacagtcctgcaacatcttgattagtaccatgaataagttagccaccgccatgcaggaaggagagtatgacgccgagcgcccaccctcaaagccccctcccgtggaactgcgcgctgccgctctcagggcagaaattactgatgccgagggcctgggattaaagctagaggatcgcgaaacagtgattaaagaactaaaaaagtcactgaagatcaagggtgaggaactgtccgaagcaaatgtgagactctcactgctcgagaaaaaacttgatagtgccgcaaaggatgcggacgaaagaattgagaaagtgcaaacccgattggaagagacccaagccctgctacggaaaaaggagaaggaatttgaggagacaatggatgccctgcaggccgatattgatcagctggaggcggaaaaggctgaactgaagcaacgtctgaacagccagagcaaaaggacgattgagggtttaagagggccacctccctccgggatcgctaccctggtcagcggcatcgcaggagaggagcagcaaagaggggcaatccctggacaggcaccaggtagcgtcccaggaccaggactggttaaggacagccccctgctgctgcagcaaatttctgcaatgcgactgcatatttctcagctgcagcacgaaaactcaatcttgaaaggcgcacagatgaaggcctccctggcaagcctgccgccattgcacgtggcaaagttgtcacacgaaggaccaggttcagagttgccggcaggcgcactgtacagaaaaaccagccaacttctggaaactctgaaccagctgtccacacatacgcacgtggtggacatcacccggacgagtccagccgcaaagagcccctctgcacagctcatggaacaggtggcccagctgaagtcactgagcgatacagtagagaaattaaaggatgaagtgctgaaggaaaccgtcagccagagacctggggcaaccgtacccactgatttcgccacctttccaagctccgcgttcctgcgagcgaaggaggagcagcaggacgatacggtgtatatgggtaaggtgaccttcagttgcgcagccggttttggccagagacatagattagtcctgactcaggaacaactgcaccagttacacagcaggctcatatcatag

SEQ ID NO: 221372 - DNA, 3435 bp, Artificial Sequence
  Description of Artificial Sequence: Synthetic coding sequence
atgatgcggcaagctccgacagcacgcaaaacaacaacacgccgtcccaaacccacccggccagcctccaccggcgtggcaggagctagttcttccctggggccttctgggagtgcctcagccggtgagttgagcagttctgagccctcgactcccgctcagacccctctcgccgctcctatcatccccacccccgttctcaccagccccggagcagtgcctcccctgccttccccttctaaagaggaggagggcttgcgcgctcaggtccgtgacttggaagagaaactggagacactgcgcctgaaaagggctgaagataaagcaaagctgaaagaactagaaaaacacaaaattcaactcgagcaggtccaggagtggaaaagtaagatgcaagaacagcaggccgacctccagaggagattgaaggaggctcgcaaggaagctaaagaggctctggaggccaaggaacgctacatggaagagatggctgacaccgccgatgctatcgagatggcaacactcgataaggagatggcagaagaacgcgctgaaagcctccagcaggaggtcgaggcacttaaggagcgggtggatgagctgactacggacctcgagatacttaaagcagagattgaggaaaagggatccgatggtgccgcttcctcataccagttgaagcaattggaagagcagaatgcccgtctgaaggacgctctggtgcgaatgcgcgacttatctagttccgagaagcaggagcatgttaagctgcagaagttaatggagaaaaagaatcaagaattggaagtggtgcggcagcagcgcgagcgccttcaggaggaactatcccaggctgaatcaacaattgatgaactgaaggagcaggtagacgcagcgctgggagctgaagaaatggtggaaatgctgactgaccgtaatctgaacctcgaagaaaaggtacgcgaactgcgagagaccgtgggggacctggaggccatgaacgaaatgaatgacgagttgcaggaaaacgctagagagactgaactcgaactccgggaacagctggatatggctggtgcccgagtgagggaggctcagaagcgtgtcgaggcggctcaggaaacagtcgctgattaccagcaaaccattaagaaatacagacagcttaccgcacacctgcaggacgtcaacagggagctgacgaatcagcaggaagcaagtgtggagagacagcagcagcctccgcctgagacctttgactttaagataaaatttgccgagaccaaggcccatgccaaagccattgaaatggaactccgtcagatggaggtggctcaggctaatagacacatgtctctgctgacagcttttatgccggactctttcctgagaccgggtggagaccacgactgcgtgctggtgctgctcctgatgccaaggttaatctgcaaggcagagctgatccgcaagcaagcacaagagaaattcgaactgtctgaaaactgtagtgagagacctggccttcgtggcgcagcaggcgaacagctgtcttttgcggctgggctcgtgtactcactgagcctccttcaggctaccctccaccgatacgaacacgccctgtcccagtgctccgtggatgtctacaagaaagtgggttccttatatccggaaatgtctgctcacgagaggtcccttgattttctgattgagctgctgcacaaggaccagctcgatgaaacagttaacgtggagcctttaaccaaggccattaagtactaccagcacctctatagtatccatcttgcggagcagccagaagattgcactatgcagcttgcagaccacatcaaattcactcagtctgctctggattgcatgagcgtggaggtcggcagactccgagctttcctgcagggcggacaagaggccacagacatagccctgctgctccgggatctggagactagttgttcagatatccgtcagttctgcaagaaaattcgcagaagaatgccaggcaccgacgccccagggataccagcggcactagccttcggtccacaagtatccgataccctactggactgtaggaagcacctgacgtgggtcgttgcagttctccaggaagtagccgctgccgctgcccagctgatcgcaccccttgccgagaacgaagggttactggtcgcagccctcgaggagttggccttcaaggcttctgagcaaatctacggaaccccctcttcttcaccctatgagtgcctgcggcagagctgcaacattttgatttctactatgaataaactggccacagcaatgcaggaaggggagtacgacgctgaacgaccaccctctaaaccacctcccgtggagctgcgagctgcagccctcagagccgaaatcaccgatgccgaagggctcggactgaagctggaagatagggagacagtgattaaggaactgaaaaaaagcttgaagattaagggtgaggagctcagtgaggccaatgtccggttgagcctgcttgagaagaaactggacagcgctgccaaggacgctgacgagcgaattgagaaggtccagacaaggctggaggagactcaagccctgcttcggaagaaagagaaagagtttgaggagacaatggacgctctacaagccgacatcgatcagctcgaagccgaaaaagctgagttgaaacagagactgaatagccaaagcaagaggaccatcgaagggttacgtggccctccccctagcggaattgcaacattggtgtccggtatcgccggagaagagcagcaacgcggagcaattccaggtcaagctccaggctcagtacctggcccaggactggtgaaagacagccctctgctgctgcagcaaatttcagctatgcgcctgcatatttctcagctccagcatgagaacagtattctgaagggtgcccaaatgaaagcctctcttgcaagtttgccgccactgcatgttgcgaaactctctcatgaggggccagggagcgagttgcctgccggagcactctatcgtaagacaagccagctgctggagaccctgaaccagctgtcaacgcacacccatgtggtggatatcacccggacaagcccagccgcaaaatccccctccgcacagctgatggagcaagttgcacagctgaaatccctgtccgacaccgtggagaagctcaaagacgaagtgttaaaggaaaccgtctctcaaagacccggagcgacagtgccaactgactttgcaacattcccctccagcgcattcctgagagcaaaggaagagcaacaagatgacaccgtgtatatgggaaaagttacattttcctgcgccgctggattcggccagcgccacaggttagttctgacacaagaacaacttcaccaattgcactctcgtcttattagctag

SEQ ID NO: 221373 - DNA, 3771 bp, Artificial Sequence
  Description of Artificial Sequence: Synthetic coding sequence
atgtccgctgaggccagtgccaggcctctgagggtcgggtcaagagtcgaagtcattggaaaaggccatcggggtactgtagcttacgtgggagcaacattatttgcaactggcaagtgggtgggtgtgatcctcgacgaggcgaaagggaagaacgacgggaccgtgcagggcagaaaatacttcacctgtgatgaggggcacggcatcttcgtaaggcagtcccagatacaggtcttcgaggacggagcagatacaacaagccctgagactccagacagttccgcgagcaaagttctgaaacgggaggggactgacacaactgccaaaactagtaaactccgtgggctgaagcctaagaaagctccaacagctcgaaaaactactacaaggagacccaagcccacacgacccgctagcactggggtggctggtgcttcctctagcctgggtccatctggctccgcttctgcgggagagctttcctcgagtgaacctagcactcccgcacagacccctctggccgctccaattatccccactccagttctgacctctccgggagcggttccacctcttcctagcccctctaaggaagaggaaggcctcagggcccaggtccgcgatttggaggaaaaactggaaacgcttcgactgaagagggcggaggataaggcgaagctcaaggaattagagaagcataagattcaacttgagcaagttcaagaatggaaatccaaaatgcaggagcagcaagccgacctccagcggaggttgaaggaagcaaggaaggaagcaaaggaggctcttgaggctaaagagaggtacatggaggaaatggctgatacagctgacgctattgaaatggcgacattagacaaagaaatggccgaggagcgcgctgaatcccttcaacaggaggtggaggccctgaaggagcgagtcgatgagcttacgaccgacctcgagatattgaaagccgaaatcgaagaaaaggggagcgacggcgctgcctcgagttaccagctgaaacaattagaggagcaaaacgcaaggctcaaggatgccctggtgcgaatgcgcgatctgtccagctctgaaaagcaagagcacgtgaagctacaaaagttaatggaaaagaagaatcaggaacttgaggttgttcgacagcagagggagcgtctacaggaggagctgagccaggccgagagtacgattgacgagttgaaggaacaggttgatgccgcactgggggcagaggagatggtggagatgcttacagatcggaaccttaatctggaggagaaagtccgcgaactgagggagaccgtgggtgacctcgaagctatgaacgagatgaatgatgagctgcaagaaaatgcacgcgaaacagagttggagttacgtgagcagctcgacatggcaggcgctcgcgtgagagaagctcagaagcgggttgaagccgcacaggaaaccgtggccgactaccagcaaactatcaaaaagtatcgccagttgactgcccatctccaggatgttaaccgggaactaaccaaccagcaagaagcttccgttgaaaggcagcaacagcccccacccgagaccttcgacttcaagatcaagtttgctgagacgaaagcgcatgccaaagcaattgagatggagctgcgacaaatggaggtggcccaggccaatcggcatatgtccctcctcaccgcattcatgcctgatagctttctgcgacccggtggggatcatgattgcgtacttgttctactcctgatgcctcgcctgatctgtaaagcagagttgattagaaaacaggctcaggaaaagtttgaactgtctgaaaattgtagcgaacggccagggctccggggagccgcaggggagcagctgtcttttgctgcaggccttgtgtattcactgtccttgctccaggccactctccaccggtacgagcacgcactgtcccaatgctcagttgacgtgtataagaaggtgggttccctttaccccgagatgtctgctcatgagaggtctctggacttccttatcgagttgctccataaggaccagctggacgagactgtaaatgtagagcctctgaccaaggctataaaatattaccagcatctgtatagtattcacctggccgagcagcccgaagattgcacaatgcagctggccgaccatatcaagtttacacaatctgcactggactgtatgtccgtcgaggtggggaggctcagggctttccttcagggagggcaggaagcaactgatatcgctctcctccttcgcgatctggaaacatcttgctcagatatccgccaattttgtaaaaaaataaggcgtaggatgcctggaaccgatgctccgggtatacccgctgctctcgctttcggccctcaggtcagcgatactttgttggattgtagaaaacatctgacctgggtcgtggctgtgttgcaagaagtggcggcagcagcggctcagctcatcgccccacttgctgagaacgagggactgctggtcgcagccctggaagaattggcattcaaggcctcagagcagatttatggcacccctagttcctccccttatgagtgcttgcgccagtcctgcaacattttaatttccacgatgaacaaactagcgacggctatgcaagagggggagtacgacgctgaacgtcctccctccaagccgccacctgtggagctgagggccgcagcacttcgtgcggagattaccgatgctgaagggctgggtctgaaactggaagaccgtgagacggtgattaaagagctgaagaagtcactgaagataaagggcgaggaactttccgaggcaaacgtgagactcagtctcctggagaaaaagttagattccgcagccaaggacgctgatgaacgcatagaaaaggtgcagactcgtctggaagaaactcaggcccttctccggaagaaggaaaaggaattcgaagagacgatggacgctctccaggccgatatagatcagctggaggctgagaaggccgagctgaagcagcgcctgaattcccagtcgaagcgaacaatcgaagggcttcgaggtcccccaccctccggcattgccacacttgtcagtggaatcgctggaggcgcaattccaggacaggccccaggatcagtgccaggcccagggctagtgaaggactcccctttgctgcttcaacagattagcgccatgcgcttgcatatcagccagcttcagcacgagaactctattctcaaaggtgcgcaaatgaaggctagcctggcttcattgccaccattgcacgtggcaaaactctcccatgaaggaccaggcagcgagctgccagccggagccttatatagaaagacttctcagctgctggagacattaaatcagctgagcacccatacacacgtggtggacattacccgcactagcccagcagccaaatcccccagcgcccagctcatggagcaggtggcacagctgaagtcattgtccgatacggtggagaaattgaaggacgaggtgctaaaagaaacggtgtcgcaacgaccaggtgccacagtgcccaccgactttgcaacgtttcctagttctgcttttctgagggccaaagaggagcaacaggacgacactgtatatatgggaaaggtgactttttcatgcgcggctggtttcgggcagagacaccggttagtactaacccaagagcagctccatcagctgcacagcaggcttattagctag

SEQ ID NO: 221374 - DNA, 2673 bp, Artificial Sequence
  Description of Artificial Sequence: Synthetic coding sequence
atgtccgctgaagcttccgctcgtccacttcgggttggaagcagagtagaggtcatagggaagggccatcgaggaaccgtggcatatgtgggtgctacattatttgcgactggcaagtgggttggtgtcatcctggatgaagccaagggaaagaatgacggaacggtgcagggtcggaagtactttacctgcgatgaaggacacggcatctttgtgcgacagtcacagattcaagtattcgaggacggagccgatactacttcccccgagacccctgacagtagcgctagcaaagtcctgaaaagagagggtacagatactaccgcgaagacttccaagctcccaacccgccctgcgtccaccggtgtggcgggagccagttcttccttggggcctagcgggagtgcttccgccggagaactgagcagctccgagcctagcacccccgcacagacacccctcgctgcaccaatcatcccaaccccagttctgactagccctggcgctgtccctcctctgccatctccctcgaaagaggaggaaggactcagagcgcaggtaagagacttggaggagaagctagaaacgctgcggctgaaacgggcagaggataaagcgaagctaaaagagctggaaaagcacaagattcagcttgagcaggtgcaagagtggaaaagtaaaatgcaggaacagcaggctgatctccagcgcagactgaaggaggctcgcaaggaagctaaagaagccctcgaagctaaagagagatacatggaagaaatggcagataccgccgacgctatcgaaatggctacactcgataaggaaatggccgaggagcgagctgaatctttgcagcaggaggtggaagcattgaaagaaagggtagacgagctgaccactgacctcgagatactgaaggcagagattgaagagaagggctcagacggggcagcctccagctaccagctcaagcagctagaggaacagaatgcccgacttaaagacgcacttgtgcggatgagagatctttcttcctccgagaagcaggagcacgtgaaactgcagaaacttatggagaaaaagaaccaagagctcgaagtggtacggcagcagcgcgagcgactgcaagaggagttgtctcaggcggagtccacaattgatgaactcaaggaacaagtagacgcggctctcggagcggaggagatggttgagatgctgactgataggaaccttaatttggaagaaaaggtccgggagctcagagagacagttggcgatctggaggctatgaatgagatgaatgacgaactccaagaaaacgctcgcgaaacagagctggaactgcgagaacagctggatatggccggtgcgagggtccgtgaagcccagaagagagtggaggccgctcaggagaccgtggcagattaccaacagacgatcaaaaagtaccgccagttaacagcccatctgcaagacgtgaaccgggaactaacaaatcaacaggaggcctctgtggaacgccaacagcagccgcctcctgaaacattcgatttcaagattaaattcgctgaaaccaaagcccacgcgaaagccatcgagatggagttgaggcagatggaagtggctcaggcgaaccgtcatatgtctctcttaacagctttcatgccagatagctttttgaggcccggaggtgatcacgactgcgttctagtgttgctactgatgccacggctcatctgtaaggctgagctgattcgcaagcaggcccaggaaaaatttgagctgagcgaaaactgctctgaaaggccgggtctgcgaggagcagcaggcgagcagttgtcattcgctgccggtctggtctactcgttgagccttctccaggccacacttcaccgatacgaacatgcgctgagccagtgcagtgtagacgtgtataaaaaggtgggcagcctgtatcctgaaatgagcgcacacgagagatccttggattttttaattgaacttctccataaggaccagttggacgaaactgtgaacgtggagcccctcactaaagccattaaatactaccaacacctttactcaatccacttggcggaacagcccgaagattgtaccatgcagctggccgatcatatcaaatttacacagtcagctttagactgtatgagtgtggaggtaggcaggctgcgggcttttctgcaaggcggacaagaggcaactgacatagccctgctactgagagacttagagacaagctgttctgacattcgacaattctgtaaaaagatacgccgaagaatgccagggacagatgcaccagggattcccgcagcactcgcctttgggcctcaggtatccgacacccttcttgactgtcggaaacacctgacctgggttgtggccgtgctccaggaagtcgccgctgcagctgcccagttaatagcccctctcgcagagaatgagggtcttctggtagcggctctggaagaactggccttcaaggcgagcgaacaagtgggtctggatgggtgggttgaaggcgttggaagagtttctgatcagtgtggggcattcacttcagcactgggctcttgtcgtagcatgggccctcctccagcagccccaatgtccgtgtgcgcttcacatgcgacaagcagctctgttccatag

SEQ ID NO: 221375 - DNA, 561 bp, Artificial Sequence
  Description of Artificial Sequence: Synthetic coding sequence
atgctgatgggcttactccggccatacattcttggcgaacgcggtaccgtgatgactccctctggctccaggatgagcgccgaggcatctgcaagaccactcagagttggatcacgcgtggaagttattggaaaaggacacagaggaactgtcgcctatgtgggcgcaacactgtttgccaccggcaaatgggttggtgttattctggacgaggcaaaaggtaagaacgacggaacagtgcaggggagaaagtatttcacttgcgatgagggtcacggaatatttgttaggcaaagtcagatccaggtgttcgaggacggagcggacactacctctcccgagacacctgactcaagcgctagcaaggtgctgaagagagaaggcacagacactaccgcaaagacttcaaagcttcgagggctgaaaccgaaaaaggctcctactgctagaaagacaactacgagacggccaaagccgacaaggcccgcatccaccggcgtggcgggagcaagtagctcgttgggaccctccggcagtgcgtccgcaggggagctgtcctag

SEQ ID NO: 221376 - DNA, 3711 bp, Artificial Sequence
  Description of Artificial Sequence: Synthetic coding sequence
atgtctgcagaagcttctgctcgcccactgcgtgtcggaagccgtgtggaagtcattggtaagggacatcgcggaaccgtcgcctacgttggggctaccctgttcgccacaggaaagtgggtcggagtgatccttgatgaagctaaaggaaagaatgatggaaccgttcaggggagaaagtatttcacatgcgacgagggtcatggaatattcgtcaggcaaagtcaaattcaagtttttgaagatggtgccgacactactagcccagagacaccggattcgagcgcctctaaagtgttgaagcgagaaggcacagacaccactgccaaaacaagcaaactgccaacaaggcctgcgtctaccggtgttgctggagccagctctagtctggggccatcaggctcagcctccgcaggtgagttatcctcctctgagcctagtacccccgcacagactccattagccgcacccattatccccacgcctgtgctcacctcacctggcgctgttccaccgctcccttccccaagtaaagaggaagagggtcttcgcgcacaggtgcgggacctcgaagaaaagcttgaaactcttcggctcaagcgagcggaggataaggcaaaactaaaagagctggagaaacataagatccagttggagcaagttcaggaatggaagagcaagatgcaagaacagcaggccgatttgcagcgcagactgaaagaggctcgtaaggaggctaaagaagcccttgaggcaaaagaacggtacatggaggaaatggctgacaccgcagacgcaattgagatggcaactttggataaagagatggctgaggagagagcagagagcctgcagcaggaagttgaggctttaaaggagcgggtggatgaactcactactgacctggagatcctgaaagcggagattgaggaaaagggatcggatggcgcagcttccagctatcaactgaagcagcttgaggagcagaacgcccgtctcaaagacgctttggttcgcatgagggacctcagttcatcagagaagcaggagcacgtcaagttacagaagctgatggagaagaaaaaccaggagctagaggtggtccgccaacagagagaaagactccaggaggaattgtcccaggccgaatctactattgacgagctgaaagagcaagttgatgccgcactgggcgcagaagagatggtggaaatgctcactgatcgaaacttaaacctggaagaaaaggtccgagaactgcgggaaactgtcggcgacctggaggcaatgaatgagatgaatgacgagttgcaagagaatgcacgcgaaacagaactggagctgagagagcaattggacatggcaggggctagagtgcgagaggcacaaaagcgggtggaggcggcacaggaaaccgtggctgactaccaacaaacaatcaagaaatatcggcagctgactgcccacctgcaggatgtgaatcgggagctgaccaatcagcaagaagcctctgttgagcgacagcaacagccaccgcctgaaactttcgacttcaagattaagtttgccgaaactaaggcgcacgcgaaggccatcgaaatggagctgcgccaaatggaggtcgcccaagcaaatcgacacatgtctcttctgactgcgttcatgccggattcattcctgaggcctggaggagatcatgattgtgtgctagtcctccttctgatgccaagactcatttgcaaagctgagttgattaggaagcaggctcaggagaagtttgagttaagtgaaaactgctcggaacgtcccggactcaggggtgctgctggagagcagcttagttttgcggctggcctggtttactcgctctcccttctgcaagccaccctgcaccgctacgagcatgcactctctcagtgctcagtggatgtgtacaagaaagtagggtccctttatccagagatgtctgcacacgagcgctccctggacttcctgattgagcttttacacaaagatcaattggacgagacagtgaatgtcgaacctttgactaaagccataaagtattatcagcacttgtactcgattcaccttgccgaacagcccgaagactgtacaatgcagctggccgaccacattaagttcacacagagcgcgctcgattgcatgtctgtagaggtggggagactgcgcgcatttctccagggtggtcaggaggcaacagacattgccctgctgctcagagatttagagacaagttgctctgacatcagacagttttgcaaaaaaatcagacgcaggatgcctggtaccgacgctcctggtatcccagctgcattagcctttggtccccaggtttctgatactctgctggattgcagaaagcacttgacctgggtggtcgccgttctgcaggaggtagccgctgccgctgcacagctgattgcccctctggccgaaaatgagggcctgctcgtcgctgccctggaagagttagcattcaaggcctccgaacagatatacggtacaccatcatcgtcaccctatgagtgtttaagacagtcttgtaatatcctgatcagcacaatgaataaactcgccaccgccatgcaggaaggggaatacgacgcagagagaccaccatcaaaaccccctcccgttgagctcagggccgctgccctgcgcgcagagatcaccgacgccgagggcttaggactaaagctcgaagacagagagactgttataaaggagctaaaaaaatcactcaaaattaagggggaagagttgagtgaggcaaacgttcgcttaagtctcttggagaaaaagctcgatagcgccgctaaagatgctgacgaaaggattgaaaaggtgcaaactaggctcgaggaaacacaggctctacttagaaaaaaagagaaagagtttgaagaaactatggacgcattgcaagcagatattgaccaactcgaggccgagaaggccgaactgaagcagcggctgaacagtcagagcaaaaggactatcgagggccttagggggcctccacctagtggaattgctactctagtgagtggcatcgccggtggagcaattcctggtcaggcacccggatccgtgcctggtcccggtttggtcaaggatagtcccctgctcctccagcagatcagcgctatgaggcttcacatctcccagctgcagcatgagaacagcatccttaaaggggcacaaatgaaggcatctctggcatctttaccccctttgcatgtcgccaagctgtcccatgaggggccaggctcagagcttcccgcaggggctctgtaccgtaaaacctcccagctgctcgaaacgctgaatcaattgagcacccacacacacgtagttgatattactcgcacctcaccggctgccaagtcaccatccgctcagcttatggaacaggtcgcccagttgaagtcattgagtgacaccgttgaaaaactgaaagatgaggtcctcaaggagaccgtctcacagcggcctggggcaaccgtgccaaccgattttgccaccttcccatccagcgcattcctgcgcgcaaaggaggagcagcaggatgacacagtttacatgggcaaggtgacattctcatgcgccgctggcttcgggcagcgccatcggctggtgctgacacaggaacagttgcaccagctgcactcccgtctgatcagctag

SEQ ID NO: 221377 - DNA, 3420 bp, Artificial Sequence
  Description of Artificial Sequence: Synthetic coding sequence
atgatgcggcaggcacccaccgcacgcaaaacaaccactaggaggcccaagccaacgagacccgcaagtacaggagtggcaggtgcaagctcttcactggggcctagcgggagtgcatcggcaggagagctgtcctctagtgaaccgtcaaccccggctcagacgcccctcgcagcccctataatccctacccccgtgctgactagcccaggtgcagtgcctccgctcccatctccttcgaaggaagaagagggcctacgagcacaggtaagagatctagaggagaagctggagacactgaggctgaaaagggccgaagacaaagctaagttgaaagaacttgagaagcataaaatccaattagagcaagtccaagaatggaagtcgaagatgcaggaacaacaggccgacctgcaacggaggctcaaggaagctcgtaaggaagccaaagaggcgctggaagcaaaggaaagatacatggaggagatggcagacaccgccgatgcgatcgagatggcaacccttgacaaagaaatggccgaagagcgcgctgagagtctgcagcaggaagtcgaggctctgaaagagcgagtggacgagctcacaaccgatctagagattctgaaggccgaaattgaggagaaagggagcgatggggctgcctcgagctaccaattgaaacaacttgaggaacagaacgcccgtctgaaggacgctctggtgcgcatgcgggacctctcttcctcagagaagcaggaacatgtgaaactgcagaaactaatggagaagaagaaccaggaattggaggtggtgcggcaacaaagagaacggctgcaggaggagttgtctcaggctgaatctacaattgacgagcttaaagagcaagtggatgccgctttaggcgctgaggagatggtggagatgttgacagataggaatctgaacttagaggaaaaggttcgcgagctaagagaaacggtaggagatctggaggcaatgaacgagatgaatgacgagcttcaagaaaatgccagggagactgagctcgagctacgggaacaactggacatggccggagcaagggtaagagaggcgcagaaacgggtagaagcagcacaggagacagtggccgattatcagcaaactattaaaaagtaccggcaactgacggcccaccttcaagacgtcaaccgcgaactcactaatcaacaggaggccagcgtagagcggcagcagcagccacccccagagacgttcgatttcaaaattaagttcgccgagacaaaggcccacgcaaaggccatcgagatggaacttcgccagatggaggtcgcacaagccaacagacacatgagtctgctaaccgctttcatgcccgattctttcctgcgccctgggggagatcacgactgcgtgcttgtgctcctactaatgccacgattaatctgtaaggctgagctgatccgtaagcaggcccaggagaaattcgagttgagcgaaaactgttccgaaagacctggcctgaggggggcagccggagaacagttgtctttcgcggcagggctagtgtattccctgtctctgttacaggccacattgcaccgatacgagcacgctctcagccaatgctcggtagacgtgtacaaaaaagttggctctctatatcctgagatgtccgcccacgagcgctcattggatttcctgattgaattgttgcacaaagaccaacttgacgaaactgttaatgttgagcccctgacaaaagcaattaagtactaccagcatctgtacagtattcatctggctgaacagcctgaggactgtactatgcaactggccgaccacatcaagtttactcaatccgccctcgattgcatgtcagtggaagtggggcgactgcgcgcatttctccagggagggcaggaagccaccgatattgcgctgctgcttcgtgatctagaaacttcttgcagcgacattaggcaattctgcaagaaaatacgcagacggatgccaggcacagacgctcccggaattcctgctgcacttgccttcggcccacaggtgagtgacacccttctggactgtcggaaacacctcacttgggttgtggctgtcttacaggaggtagctgccgctgcagcacaattgatcgctccccttgctgaaaacgaaggactgctggttgccgctttggaagaactggcatttaaggcgagtgaacaaatatatggcacaccaagctcgtcaccgtatgaatgtttgcgtcagtcttgcaacattctcatttctaccatgaacaaactagccaccgccatgcaggaaggtgaatatgatgcagagcggcctcccagtaaacccccacctgtggagctgagggcagctgccttaagggccgagataactgacgccgagggcctgggtttaaagttggaagacagagagactgtaatcaaagagctcaagaaaagtttaaagatcaagggcgaagaactgtctgaggccaacgtgcgcctgagcctgctggagaaaaagttagattctgcggcaaaggatgctgacgagcgaatcgaaaaggttcagacaagacttgaagagacgcaggctcttctcagaaagaaggagaaggaattcgaggagactatggacgcccttcaagccgacatcgaccagttggaagccgaaaaggccgaattgaagcagcggttaaattctcagagtaaaagaacgattgaagggctgagggggcctcctccctccggaatcgccactcttgttagcggtatcgccggtggcgcaatccccggacaggccccaggatccgtgccagggcctggcctggtcaaagattcacccctgctcttgcagcagatcagtgctatgcgtctgcatattagccagctacaacacgagaactcaatcctgaagggggctcagatgaaagcgtctctggcgtcacttcctcctctccacgtggccaagctgtcccatgagggtccaggaagcgagctgccagctggcgcactttatcgaaagacgtcacagttactggagaccctcaaccagctgtcaacccatacccacgtggtggacatcacacggacctctcctgccgcaaaatccccatcagctcagttgatggaacaggtggctcagctaaaatccctgtccgatactgtggagaagctaaaggatgaagtgctgaaagagactgtttcccagagaccaggcgcaaccgtccctaccgacttcgcaacattccccagctctgccttcctaagagccaaagaagaacagcaggatgatacagtgtacatgggaaaggtcacctttagttgcgcggctggattcgggcagaggcacagacttgtactcactcaggagcagctgcaccagctgcatagcaggctgatctcctag

SEQ ID NO: 221378 - DNA, 3762 bp, Artificial Sequence
  Description of Artificial Sequence: Synthetic coding sequence
atggcgcagtccaagcgccacgtttattcgcggacaccaagtggctcaaggatgtccgcagaggcgtccgctaggcccttgcgtgtaggaagtcgtgtggaagtgataggcaagggccatagggggaccgttgcctacgtgggggcaactctgttcgctacgggcaaatgggtcggcgtgattctggacgaagcaaaaggaaaaaacgacggcacagtacaaggtaggaaatacttcacatgcgatgaaggacatggcatcttcgtgcggcagtcccaaatccaggtcttcgaagatggagcggatactacatcccccgaaacgccagactccagcgcaagcaaagttctgaagcgcgaagggaccgatacaacagctaagacaagcaaactgcccactcgccctgcctcgactggcgtagctggtgcgtcttctagcttagggcctagcggtagtgcttcggccggagaactgtccagcagtgagccatcaacaccagcacagactcccctggcggctccaataatccccactcccgtgctgacgtcaccaggagccgtgccaccactgccgtccccaagcaaggaggaggaaggcttgcgggcacaagtgcgtgatttagaggaaaaactcgaaacgttacggctgaaacgggctgaggacaaagctaaactgaaagaattggagaagcacaagatccaattggagcaggttcaggaatggaagtcaaagatgcaagagcaacaggcagaccttcagcgaagattgaaggaagcccgtaaagaggcaaaagaagcccttgaagcaaaggaaaggtacatggaggaaatggctgacactgccgacgcaatagaaatggccactctcgataaagagatggctgaggagagagccgagtctttgcaacaggaagtggaagccctgaaagagcgagtggacgaactcacaacagaccttgagattctaaaagccgaaatagaagagaagggtagcgacggagctgcctcaagctaccagctgaagcagctggaggagcaaaacgcaagattaaaggacgctttagtacgaatgcgcgacctgtccagcagcgagaagcaggagcatgtaaaattgcagaagctaatggagaagaagaaccaggagcttgaagtggtccgccagcaaagggagagactgcaagaggaattatcgcaggcggaaagcacaattgatgaactgaaggagcaggttgacgcggctctgggtgcagaagaaatggttgagatgctaacggatagaaacctcaatctggaagaaaaagtgagggagctgcgcgaaacagtgggtgatctagaagcaatgaatgagatgaatgacgaactgcaggagaatgctagggaaaccgagctcgaactccgggagcagctggacatggcgggagccagggtccgtgaggctcagaagcgtgtggaggcagcccaggaaaccgtcgctgactatcagcaaaccatcaagaagtatcgccagctgacggcccatctgcaggatgtgaacagagagctgaccaatcaacaagaagcctccgtagaaaggcagcagcagccccctccggagacctttgacttcaagatcaagtttgctgagaccaaggcccacgcaaaggctatcgagatggaactgagacagatggaggtcgcccaagcgaaccgtcacatgtctctgctgactgccttcatgcccgatagctttctgcgcccaggaggagatcacgactgcgtattggtcctgctactgatgcctagactaatttgtaaggctgaattaatcagaaagcaggctcaagaaaagttcgagctgagcgaaaactgctccgaacgtcccggacttcgcggagctgctggcgagcagttgtccttcgctgcgggtctagtgtacagtcttagcctcttgcaggcaactctacacagatatgaacacgcccttagccagtgtagtgtagatgtgtataagaaggtcggcagcctgtacccagaaatgagtgctcacgaaagaagcctagacttcttgatagaactactgcataaggaccaactcgatgaaactgtaaatgttgagcccctgacaaaggctattaagtattaccagcacctgtattccattcatctagctgagcagccggaggattgcacaatgcagttggcggaccacattaaattcacccagtctgctctggactgcatgagcgtcgaggtgggcaggctcagagcattcctccaaggcggacaggaggctacggatattgcgcttcttctgagagatctggagacttcctgttctgacattcggcagttctgcaaaaagatcaggagaagaatgcccggaacagacgcccctggcatcccagccgcactcgccttcgggcctcaggtgtccgatacgctgttagactgccggaaacacctgacatgggtagtcgcagttcttcaagaggtcgccgcagctgctgcacagcttatagcaccacttgcagagaatgaagggctcctagtagctgctttggaagagctggccttcaaggcctcggaacaaatatacgggacaccatcttcgagtccctacgagtgcctgcgacaaagctgtaacattctgatttcgactatgaacaagctcgctaccgccatgcaagaaggcgagtacgatgctgaaagaccgccttcaaaaccccctcctgttgaattacgagctgccgctttaagagcggagattactgacgccgagggcttgggccttaagctggaggatcgagagacggtgataaaggaactaaaaaaatcactgaaaattaagggggaggaactgtcagaggcgaatgtgcggctgtcccttttggagaagaaacttgacagcgcagctaaggacgccgatgagcgtattgaaaaagtgcagactcggctggaggagactcaagcccttctgagaaaaaaggagaaagagttcgaggaaaccatggatgccctgcaagccgatattgatcagcttgaggctgagaaagctgagctcaagcagcggctgaacagccagtccaagagaacaattgagggtctgcggggtcctccgccttcagggatcgcaacgctcgtatctggaatagccggaggcgctatccccggacaggctcccggatccgtgccgggtcctggcctggtgaaagacagtccactcctcctgcagcaaattagtgccatgagactgcatatatcccagctccagcacgagaactccatcctgaagggcgctcagatgaaggcttccctagcaagcctgccgcctttacacgtggcaaaattgtctcacgagggccctggatctgagctgccagccggtgctctgtatcgaaagaccagccaactgctggaaaccctaaatcagttgagcactcacacccacgtggtcgacattacgaggacttccccagccgctaagagtccctctgcccagcttatggagcaagtggctcaattgaaaagtctctctgacacagtggagaaattaaaagatgaagttttaaaagagaccgtctcccagaggcccggtgccacggttcccactgattttgccacctttcccagctccgcatttctcagggcgaaagaagagcaacaggatgacaccgtatacatgggcaaagttactttctcgtgtgccgcaggcttcggtcagaggcaccggctggtgctcacacaggagcaattgcatcagctgcactcgcgtcttatcagctag

SEQ ID NO: 221379 - DNA, 1221 bp, Artificial Sequence
  Description of Artificial Sequence: Synthetic coding sequence
atggctgatcccaaatatgcagatttgccagggattgctcggaacgagcccgatgtgtatgaaactagtgatctgccggaagacgaccaggcggaattcgacgcctttgcccaagagctcgaggaactgacgagcacttcagtagagcacattattgtgaatcctaacgcagcatacgacaagtttaaggacaaacgtgttggcacaaaaggcctcgacttcagcgatagaatcgggaaaacgaagagaaccggatatgagtccggtgaatacgaaatgttgggtgagggcctgggagtcaaggagaccccccagcagaaataccagcgcctcctgcacgaggtgcaggagctcacaaccgaggttgagaaaattaagacgactgtgaaggagagcgcaacggaagagaagctcacacctgtgctccttgcgaagcagttggcagcgctgaaacagcagttagtggcatcgcaccttgagaaattgctggggcctgacgctgcaatcaacctgaccgatcctgacggagcattggcaaagcgactcctcctacaattagaagccacaaagaactccaaaggaggaagcggcggaaagaccacaggcaccccccctgattcctctctcgtcacctacgagttgcacagccggccagagcaagacaaattctctcaggccgcaaaagtggccgaactagagaaaaggttaacagaactggagacggcggtgcgctgtgatcaagatgcccaaaatcctctatcagcgggtctgcaaggtgcatgtctcatggagaccgtagaactgctacaggcgaaggtgtcagccttagatctggctgtcctggaccaggtggaggctagactccagagcgtccttggaaaggtgaatgaaatcgccaagcacaaggcatcagtagaagacgcagatacccagtcaaaggttcatcagctgtacgaaaccattcagaggtggtcccccatcgcctctacgctgcctgagctggtgcaacgtctagttaccatcaagcagttgcacgagcaggcaatgcaatttggccagctgctcactcacctggataccacccagcagatgattgcgaattcgcttaaagacaataccactctcctcacccaggttcagacgactatgcgtgagaatctggccactgtggagggaaacttcgcttctattgacgaacgcatgaagaaacttggaaaatag

SEQ ID NO: 221380 - DNA, 1137 bp, Artificial Sequence
  Description of Artificial Sequence: Synthetic coding sequence
atgtacgcccagggaacagaggattccagaacgctagaagagctcacctcaacttctgtggaacatatcattgtgaaccctaatgccgcttatgataagtttaaggataaacgcgttggcaccaaaggtttggacttctcagatcggattgggaagacgaaacgtaccgggtacgaaagtggcgagtatgagatgttgggggaagggcttggagttaaggagacaccacagcagaaatatcagcgcttgctgcacgaggtccaggagctcactaccgaggtggagaagatcaaaaccacagttaaagagagcgcaaccgaagaaaaactgactcccgttctcttggccaagcagcttgcggctctgaaacagcaactcgtggcctcacacctggaaaaacttcttggtccagatgccgctataaacctcaccgacccggatggggctcttgccaaacgtctgttacttcagctcgaagccaccaagaactcaaagggcggatccggagggaagacaaccggcactccgccagacagctccttggtcacatacgaactgcattcacggccagaacaggacaagttctctcaggccgcaaaagtggccgaactggaaaagaggctgactgagctggagacggcagtgcgctgtgaccaggacgcccagaatccgctgtcagctgggctgcagggcgcatgcctgatggagaccgtggagctgctgcaggcaaaagtctcagccctcgacctggctgttctggaccaggtcgaggccaggctccagtccgttttaggcaaagtcaatgaaattgcgaaacacaaggcatcagtagaggatgctgatactcagagcaaggttcaccagttgtacgaaactatccaaagatggagcccgatcgcctcaacgctgccggaactggtgcagcgtctcgtgacaattaaacaactccacgaacaggccatgcagttcggacaactgttaacacaccttgacacgactcagcaaatgatagccaactctctgaaggacaacacgactctgctgactcaggtgcagaccaccatgagggaaaacctcgccacagtggaaggtaactttgccagtatcgacgagaggatgaagaaactgggcaagtag

SEQ ID NO: 221381 - DNA, 945 bp, Artificial Sequence
  Description of Artificial Sequence: Synthetic coding sequence
atgctgggcgaaggacttggcgtgaaagaaacccctcagcaaaagtatcagcgcctcttgcacgaagtgcaggagcttactactgaggttgagaagatcaagaccacagttaaagaatccgctacagaggagaaacttaccccggtgttgctcgcgaaacagttggctgccttaaagcagcaactggtggcaagccacttagagaaactgctcgggcctgatgccgctatcaatctgacagatcccgacggcgctctcgccaaaagactcctgttgcagctggaagctactaaaaactctaaaggcggttctggaggtaaaacaacaggtacgccaccagattcttctttggtgacatatgaactccactctagacccgaacaagataaattttcccaggccgctaaagtggctgagctggagaagcgcttgacagaattagaaacggctgttaggtgcgatcaggacgcccagaacccgttaagcgcgggtctgcaaggggcatgtcttatggagaccgttgagctcctacaggccaaggtaagcgctctggatctggcagttctcgatcaggtggaagctcgccttcagtccgttctgggaaaggtaaatgaaatcgcaaagcacaaagcttctgtggaggacgctgatacacagtcaaaagtccaccagctatatgaaaccatacagaggtggtcacctatcgcttcaacgctgcccgaattggtgcagcgcctggttacgattaagcaattgcacgagcaggccatgcagttcggtcagctcctcacacatttggacactactcagcagatgatcgctaattcgctcaaagataataccacactcctgacccaggtgcagacgactatgcgcgagaacctcgcaactgtggagggcaactttgcatctatcgacgaaaggatgaagaaattgggcaagtag

SEQ ID NO: 221382 - DNA, 1221 bp, Artificial Sequence
  Description of Artificial Sequence: Synthetic coding sequence
atggccgaccccaagtacgccgatttgcccggaattgcgaggaatgagccagacgtctatgaaacaagcgacctcccagaagatgatcaggcggagtttgatgccaccgtccagcacttggaggaattgacctcaacgtctgtggaacatattatagtaaaccccaacgctgcttatgataaattcaaggacaaaagagttgggacgaaagggctagactttagcgaccggataggtaagactaagcggacggggtatgagtcgggggaatacgagatgctaggggaaggcctaggggtaaaggagacaccgcaacagaagtatcaacgtctcctgcacgaggtgcaggagttgacgactgaagtggagaagatcaaaaccacagtcaaggagtccgcgaccgaggagaagctgacacctgtactgttggcaaagcagctcgccgcacttaagcagcagctggttgcgtcacacctggagaagttgctcggaccagatgccgctatcaatctaacggatcccgacggcgcacttgcaaagcgccttctactccaactcgaggcaacaaaaaactctaagggcggatcaggcggtaagactaccggcacaccaccggactcttccttggtcacttacgagctgcactccaggccggagcaggacaagttttcccaggctgcgaaggtggccgagctcgagaagcggttgactgaactagagaccgcagttaggtgtgaccaagacgcccagaatcctttgagcgccggtctccagggcgcttgcctgatggaaactgtcgaactcctgcaggcaaaggtaagtgccctggacctcgccgtgctggaccaggtagaagctcggctgcagagcgtgctcggcaaagtgaacgagattgcaaagcataaagcatcggtcgaggatgccgacacacagagcaaggtacaccagctgtatgagaccatccagcggtggagccccattgcttcaacgctgccagagctggttcaacggttggtgactatcaaacagctgcatgaacaagccatgcagttcggacagctgctgactcacttagacactactcagcagatgattgcgaactctttaaaggataacactacacttctgacgcaagtccaaacaacaatgcgcgaaaatctggccacagtggaaggcaacttcgccagtatcgacgaacgcatgaagaagcttggcaagtag

SEQ ID NO: 221383 - DNA, 1206 bp, Artificial Sequence
  Description of Artificial Sequence: Synthetic coding sequence
atggctgaccccaagtacgccgacctgcctgggatagcaaggaatgaacccgatgtctacgaaacttcagacttacctgaggatgaccaagctgaatttgacgcagaggagcttacctctacttcagttgagcacattatcgtcaaccctaatgccgcttacgacaaatttaaagataagcgcgttgggaccaagggtctggatttttcagacagaattgggaagactaaaaggactggttatgaaagcggtgagtacgagatgctgggggaaggactcggtgtgaaagagacaccacagcagaagtaccagcggctcctgcacgaggtccaggaacttaccacagaggtagaaaagatcaagaccaccgttaaagaaagcgcgacagaagagaagctgacacccgtgctcctggccaagcagttagctgccctgaaacagcaacttgtggctagccacttggagaaactgcttgggcctgatgccgctatcaatctcacggaccctgatggtgctctggccaagcgcttgcttctccagttggaggccacaaagaactctaaaggtggcagcggcggaaagacaacaggcaccccccctgactccagtctcgtgacatatgagctccactcacgtccagagcaggacaagttctctcaggccgctaaggtcgccgaactggagaagcgacttactgagttagagacagcagtgcggtgcgaccaggatgcacagaaccctttgtcagccggtttgcagggcgcttgtcttatggagaccgtggaactcctccaggcaaaagtgagcgcgctggacttggccgtcctcgatcaggttgaagcacgcttgcagtcagtcctgggtaaagtcaacgaaattgccaaacataaggcgtccgtggaagacgctgacacccagagcaaagtgcaccagctgtacgaaaccattcagcggtggagccccatcgcaagcacgcttcccgagcttgtgcagcgacttgtgaccattaaacaactgcatgaacaggccatgcagtttgggcagctcctcactcatttggataccactcagcagatgatcgcgaattctctcaaagacaacactacattgttgacacaagttcagaccactatgcgggaaaatctggcaacagtggaaggcaacttcgcctccatcgacgagcgcatgaaaaaactgggtaaatag

SEQ ID NO: 221384 - DNA, 561 bp, Artificial Sequence
  Description of Artificial Sequence: Synthetic coding sequence
atggcaggtcttaccgatttacagcgcttacaggcgcgagtcgaggaactcgagcgctgggtgtacggacctggaggtgctcgaggaagtcgaaaggtggccgacggcttggttaaggtgcaagttgcgttggggaatatttcttctaagcgggaaagagtgaagattctgtataagaagatcgaggacctgatcaagtacctagatcccgaatacatcgaccgtattgctattcccgatgcctctaagctgcagtttatcctagccgaagagcagtttatactgagccaggtggccctgctggaacaggtgaacgcacttgtacccatgctggactccgcccacattaaagctgtgcccgaacacgcagctaggctgcagcgactggcgcagatacatattcaacagcaggaccagtgcgtggaaataaccgaagagtccaaggcgctcttagaggaatacaacaagactaccatgctgctgagtaaacagttcgtccaatgggatgagctgttatgtcagctagaagccgcaacacaggttaagcccgctgaagaatag

SEQ ID NO: 221385 - DNA, 531 bp, Artificial Sequence
  Description of Artificial Sequence: Synthetic coding sequence
atggccggactgactgatctgcagcggctccaggcacgggtggaggagctcgagcggtgggtttacggacctggaggcgctcgagggtcgagaaaagtggctgacggcctggtgaaagtgcaggtggctttgggtaacatttcatccaagcgggagagagtgaaaatactgtataaaaagattgaagatttaattaaatatctcgatcctgagtacattgacaggatagccatccccgatgcctcaaagcttcaattcattctggcggaggaacagtttattctctctcaggtggccctcctagagcaagtcaacgccctggtgccaatgctggatagcgctcatattaaggccgtgccagaacacgcagctagactccagcgactcgcccaaattcatattcaacagcaggcaccgtggggcgtcggagtgcgagacgaagctggaagcctggtggaagatgtcggcttcgcacagtttctgagtgtcctgcattttggccctaccggtcctgtgtgcggcaaccattag

SEQ ID NO: 221386 - DNA, 486 bp, Artificial Sequence
  Description of Artificial Sequence: Synthetic coding sequence
atggcagggctgaccgatctccagcggttacaggccagagtggaggagcttgagagatgggtctacggcccaggaggagctcgcggatccaggaaggtcgcagatgggctggtgaaggttcaagtggctctcgggaatatcagtagtaagcgtgagcgggtcaaaattctatataaaaaaattgaggacttaattaagtacctggaccctgaatacatagacagaatagctatccccgacgccagtaagttacagttcatcctagctggaaatgccggtctccacgtttatatgcacctccgaatgtgggtagtgggcgaggtaaagcaccgcgacgggctgagtattcagtcctccggtggttacaagccctggatgctgctgagcggaattgtcgcctggttctgggttgaagatccgatggatccattggtggacatcgaatatagcatccccctgcaccaacttcaggccatggttccatag

SEQ ID NO: 221387 - DNA, 315 bp, Artificial Sequence
  Description of Artificial Sequence: Synthetic coding sequence
atggccggactgacagacctacagaggctgcaagcgagggtcgaggagctggaaaggtgggtctatgggccaggtggagctcgcggatcccgcaaagtggccgacggactggtgaaagttcaggtagccctgggcaacatttcttctaaacgggaacgggtgaagatcctctataagaaaatagaggatctcattaagtacctggaccctgaatacatagatcggattgccatcccagacgcatcaaagttacagtttatcctggccgagcggtcctcactgtcattccctaggcttcactcatggtctcgatag

SEQ ID NO: 221388 - DNA, 477 bp, Artificial Sequence
  Description of Artificial Sequence: Synthetic coding sequence
atggcgggacttaccgacctgcagcgcctccaggccagggtcgaggagctcgagcgctgggtctatgggcctggcggagcacggggatctcgcaaggtcgctgatggattagtgaaagtgcaagtggcattaggcaacatctcttctaaacgagaacgcgtgaagattctctacaaaaagattgaagaccttatcaagtatctggacccagaatatatcgatagaatcgcaatccccgatgcgtccaagctacaatttatcctggcagccgtgcccgagcatgccgctcgactgcagcggctggcacagattcacatccagcaacaagaccagtgtgtcgagataacagaagaaagtaaggctcttttggaagagtataataagaccaccatgctgctgtctaaacagtttgtgcagtgggatgagctgttgtgccagttggaagcagcaacccaagttaaaccggctgaagaatag

SEQ ID NO: 221389 - DNA, 456 bp, Artificial Sequence
  Description of Artificial Sequence: Synthetic coding sequence
cagaggctacaggccagggtggaggagcttgaacgatgggtttatggacccggaggcgcacgaggctctcgaaaggtggccgatgggttggtgaaggtgcaagttgcccttgggaatatctcctcgaaacgggagcgggtaaagattttgtacaagaaaatcgaggacctgatcaagtacttggacccagagtatattgatcggatagccataccagacgcctcaaaactccaattcatcctggccgctgtccccgagcacgcagctcgcctccagaggctggctcagatccatattcagcagcaggatcaatgtgtcgaaatcaccgaggagtctaaagcgctgctagaggagtacaacaaaaccaccatgctactgtcgaaacagttcgtgcagtgggatgagttgctctgccaacttgaggccgctacccaagtgaaacccgcagaggaatag

SEQ ID NO: 221390 - DNA, 519 bp, Artificial Sequence
  Description of Artificial Sequence: Synthetic coding sequence
atggccggtctgacagatttgcagcggctccaggctcgggttgaggagctcgaaagatgggtttacggacccggaggagccagaggttcacggaaagtggctgatggattggtgaaagtgcaagtcgcactaggtaatatcagttcaaaacgtgagagagttaaaatcttgtacaaaaagattgaagatctgatcaagtatctcgatcccgagtacatagacagaattgcaatccctgatgcctccaaacttcagttcatcctggccggaaatgccggtctgcatgtgtatatgcacctaaggatgtgggtggtcggtgaggtcaaacaccgagatggcctgagcattcaatctagcgggggttataagccctggatgctcctatctggcatcgtagcctggttttgggtcgaagatcctatggatcctctagtcgacatagagtattctattcctctgcaccagctccaggcaatggttcctgcaaccgtaggcgcttcacctgtgttctatcagtag

SEQ ID NO: 221391 - DNA, 549 bp, Artificial Sequence
  Description of Artificial Sequence: Synthetic coding sequence
atggagctgggcgagctcttatataacaagagtgaatacatcgagaccgccagcggaaataaggtttcccgacaatctgttctctgcggatctcaaaatatcgtactcaatgggaaaactatcgttatgaacgactgtatcatcaggggggacttggcaaacgtcagagtcggcagacactgcgtggtgaaaagcagaagtgtaatcagaccacccttcaaaaaattctccaaaggcgttgccttttttcctctgcacataggggaccacgtgtttattgaagaggattgcgtggttaacgccgctcaaataggctcctatgttcatgtgggaaagaactgcgttattggcaggcgctgtgtgttaaaggactgctgtaagattctggacaatacagtgctcccccctgagacagtggtgcccccattcactgtgtttagcggctgccctggactgttcagcggggagctgcctgaatgcactcaggaactgatgatagatgtcacaaaaagctattaccagaaatttctcccgctcactcaggtatag

SEQ ID NO: 221392 - DNA, 255 bp, Artificial Sequence
  Description of Artificial Sequence: Synthetic coding sequence
atggagctgggcgaacttctctacaataagtccgagtacatagaaacggctagtggtaacaaagtttctcgacagagcgtgttgtgtggtagccagaatattgttttgaatggaaaaaacttcgttatttctgtgttcctgtcaccctacattcggtgtcactctgcctgtagggacagaaagcgctctgacgagagcgtgcgcctgagcgtcaataaccgggagtggtgggggctcgttaattggcgtatgtag

SEQ ID NO: 221393 - DNA, 1650 bp, Artificial Sequence
  Description of Artificial Sequence: Synthetic coding sequence
atggaattcgctgagttgatcaagaccccaagagtggacaacgttgttctgcatcgacccttctatcctgcggtcgaggggacactgtgtttgaccggacaccacctgattctctcttctaggcaggataatacggaagaactctggctcctgcacagcaacattgacgctatcgataagcgatttgtcggctcgctgggtacaatcatcattaagtgcaaagactttaggatcatacagctcgatatccctggcatggaagagtgtctgaacattgcaagctcaatcgaagcattaagcacactggactcgatcaccctgatgtacccattcttttatcgcccaatgttcgaggtaatcgaggacggctggcattcattcctcccggaacaggagtttgaactctacagctctgccacgtcagagtggcggctgtcctacgtcaataaggagttcgctgtgtgtccatcttatccccctattgttaccgttcctaagtccattgacgatgaggcccttcggaaggtggcaacgttcagacacggcggtcggtttcctgtgttatcctactatcacaagaagaacggaatggtgattatgcgaagtggccagccactgacaggaaccaacggaagacggtgtaaggaggacgagaaactcatcaacgcgactcttagagcaggcaagcgaggatatataattgatactagatcgctcaacgtcgctcagcagaccagagcgaagggtgggggatttgaacaggaggcgcattatccgcagtggagacgaatccataagtccattgagcgctaccatatcctccaggagtccctcattaagctcgttgaggcctgtaacgatcagacccacaacatggacagatggctaagtaagttagaggctagcaactggctgacccacatcaaagagatactgactacagcgtgcctggcggctcagtgtatcgatagagaaggggcttcaatccttattcacggtaccgagggcaccgactcaaccctgcaagtcactagcttagcccaaattatactggagccccgatctaggaccattagaggattcgaagctttgatagaacgcgaatggctgcaggctggacaccccttccagcagcggtgtgctcagtcagcctattgtaataccaagcaaaaatgggaggcccctgtctttcttcttttcctcgactgtgtgtggcagattctccgccagtttccatgctcttttgaattcaacgagaattttttgattatgctgttcgaacacgcgtacgcctctcagttcggaaccttcctagggaataatgagtctgaacggtgcaagctgaagctgcaacagaaaaccatgtcattatggtcttgggtgaatcaaccctccgaattgtctaagttcacgaacccactctttgaggccaacaacctcgtcatatggccgtccgttgccccacagtccctgcccctgtgggagggaatctttttgcggtggaatcgcagcagcaaatatctggacgaggcgtacgaggagatggtaaacatcatagagtataataaggagctgcaggctaaggtcaatattctgcgccgtcaactggcagagctggaaactgaagacgggatgcaagagtcaccgtag

SEQ ID NO: 221394 - DNA, 2556 bp, Artificial Sequence
  Description of Artificial Sequence: Synthetic coding sequence
atgggcaacaggggcatggaggatctgatccccttagttaatcgactgcaggacgcatttagtgctattggacagaacgccgatctggacctgccacagattgccgtggtgggaggacagtcggccggaaagagttcagtactggagaacttcgtggggagggattttctgccgaggggaagcggaattgtcacccgtagaccactcgtacttcagcttgttaacgccacgacagagtatgcagaatttttgcactgcaaggggaagaagttcactgactttgaggaagtccggcttgaaatagaggcagagaccgacagggtcacaggtacaaacaaagggatttctcctgttccaattaacctcagggtgtactcccctcacgtgctcaatctgactctagtagatctccctggaatgaccaaagtccccgttggagaccaacctccagatatagaattccaaatccgggacatgctgatgcagtttgtgacaaaggagaactgtttgattctagcagttagccccgctaacagcgatcttgctaactcggacgcgctgaaagtagccaaggaggtagatccacagggccagaggaccatcggcgtcataactaaactggacctgatggacgagggcaccgatgcacgagatgtcctcgaaaacaagttgctgccacttagaagaggatacatcggggtggttaacagaagtcagaaggatattgacggcaagaaggacatcaccgccgctctggcagctgaaaggaaattcttcctatctcatccgagctaccgccatctagctgatcgtatggggactccatacttgcagaaggtgctcaatcagcagctgacaaatcacatcagagatactctgcctggactgagaaataagctccaatctcaattactgtctatcgaaaaggaagtggaagagtacaaaaattttcgacccgacgatcctgcacggaagacaaaagctctactccagatggtccagcagttcgctgttgactttgagaaacgtatagaaggctccggcgaccaaattgacacttacgagctcagcggcggagccaggatcaataggatcttccatgaaagattccctttcgagctggtgaagatggagtttgacgagaaagaactgcgtcgggagatcagctatgcaatcaaaaatatccacggaatccgaactggtttgttcacccctgacatggctttcgagacaatagtgaagaagcaagtcaaaaaaattagggagccctgtcttaagtgtgttgacatggtgattagtgagttgatctctacggtccgacagtgtacaaagaagctacagcaatacccacgactaagagaggagatggaaagaattgtcaccacccacatccgagaaagggagggccgaacaaaggagcaggtgatgttgctcatagatatcgagctcgcatacatgaatacaaaccatgaggattttatcgggtttgccaatgctcagcagcgctccaaccagatgaataagaaaaagacctctggaaaccaggacgagatcctggtcattaggaagggttggctgacgatcaataatattggcatcatgaagggcggaagtaaggaatattggttcgttctgaccgctgagaatttatcatggtataaagacgacgaggaaaaggaaaaaaagtacatgctgtctgtggataacctgaagctgagggacgtggagaagggcttcatgagttctaagcatatcttcgcactgttcaatacggaacagcggaatgtatataaagactataggcagctcgaactggcctgtgagacccaagaggaggtcgacagctggaaggcctcttttctccgggctggagtataccctgagcgcgtgggcgacaaagaaaaggctagtgaaacggaggagaacgggtcagattcctttatgcactctatggacccacagcttgagagacaggtagaaaccattcgcaacttggtggatagttacatggccattgtcaacaagacagtgagggacctgatgccgaaaactatcatgcacttgatgatcaacaacacaaaagaattcattttcagtgaattacttgcaaacctgtattcctgtggtgatcagaacactttaatggaggagtctgctgagcaggctcagcgtagagatgaaatgttacggatgtatcacgccttaaaggaagccctatctattatcggcgatatcaacacaacaacagtgtcaacacctatgccacccccagtcgacgactcctggcttcaagtccagagcgtccctgccggtcggagaagccccacctcaagcccaacacctcaacgccgtgctccggcagtgccacccgcacggccaggttcccgcggacctgctccgggacctcctcctgccggaagtgccctggggggagcacctccggtgccatcgcggcctggggcttccccagacccttttggaccacctccacaggtgccatcccgtcctaatcgagcacctcctggtgtccccagaatcaccatctctgatccttag

SEQ ID NO: 221395 - DNA, 2595 bp, Artificial Sequence
  Description of Artificial Sequence: Synthetic coding sequence
atgggtaatagaggcatggaagacctgatcccgctggtgaaccggctgcaggacgcgttttcagccatcggccagaatgccgaccttgatctgccgcaaatcgctgtggtcggaggtcagagtgctgggaagagctccgtcctggagaatttcgtcgggagggacttcctccccagagggtccggcatcgtcacgaggagacccctcgtccttcagctggttaacgccaccactgaatacgcagaattcctccattgcaagggcaaaaaatttactgatttcgaagaggtccgtctcgagatagaagctgagaccgatcgcgtgacgggtactaataaagggataagccccgtgcccataaacttgagagtttacagtcctcatgtcctgaacttgaccttagtggacctccctgggatgaccaaagtgcccgtaggggatcagccccctgacattgagtttcagatacgggatatgttaatgcagttcgtcaccaaagagaactgcctgatactcgctgtttcgcccgctaactccgacctcgcaaactcagatgctctgaaagtcgcaaaggaggtggatccacaaggccagcggacaatcggagtgatcactaagctggacctaatggacgaaggaacagacgctagagatgtattagaaaacaaactcctgcccctccgccgtggttatatcggagtggtcaacagatcccagaaggatatcgacggcaaaaaggacataaccgccgctttggcggctgaacgtaagttctttctgagccaccccagctaccgtcatctggcagataggatgggaaccccatatctacagaaggtgctcaaccaacagctcaccaaccatatacgcgacacactgccagggttaagaaacaaactgcaatcccaattgctgtctatcgagaaagaagttgaggagtacaagaattttcggccagacgatcctgctcggaaaactaaagcattattgcagatggtacaacagtttgccgttgattttgagaaaaggattgaaggatccggagatcaaattgatacatatgaactcagcggaggggcacgcattaaccggatctttcatgagcgctttccattcgaattagtgaagatggaattcgatgagaaagagcttcgccgagaaatttcctatgccatcaaaaatatacacggaatccgcaccggcctcttcacacctgacatggcatttgagaccatcgtgaaaaagcaggtcaagaagattagagagccatgccttaaatgcgttgatatggtgatctctgaactgattagtaccgtacgacagtgcacgaagaaactgcagcaatatccgcgacttcgcgaggaaatggagagaatcgtcaccacccacatacgtgaaagggagggacgcacaaaggaacaagtgatgctgcttattgatatagagctggcatacatgaacaccaaccatgaggatttcataggctttgctaatgcccagcagagatcgaaccagatgaataagaaaaagactagtggcaaccaggacgagattctggtgatcagaaaggggtggcttaccatcaacaacatcggaatcatgaaaggaggaagtaaggaatactggtttgtcttaacggctgagaatctaagctggtacaaagatgacgaggagaaggaaaagaaatacatgctgtccgtggacaacctgaagctgagagacgttgaaaaaggatttatgagtagtaaacacatcttcgccttgtttaacaccgagcagcgaaatgtttataaggattatagacagttggaacttgcctgcgagactcaggaagaggtggattcatggaaagcctcattcctgcgcgctggggtataccctgagcgcgtgggcgacaaggaaaaagcatcagagactgaggagaatggttccgattctttcatgcactcaatggacccacagttggaaaggcaggttgaaacaattcgcaacctggtcgatagttatatggccatcgtgaataaaactgtgagagacctgatgccaaaaactataatgcacctaatgattaacaacacaaaggaattcattttctccgagcttctggcgaatctgtacagctgtggcgatcagaatacccttatggaggagagtgcagaacaagcgcaacgccgagacgagatgcttcgcatgtatcacgcactgaaggaagccctgtccataatcggcgacatcaatactaccactgtctcaacacccatgcctccccctgtcgacgactcatggctccaggttcagagcgtcccggcaggcaggagatcccctacttcatccccaacgccccagcgacgcgctcccgctgtgccgccagctcgtcctggtagcagggggcctgctccaggcccaccccctgccggaagcgctctcggaggcgcaccccctgtgccttccagacccggtgcctcccctgacccattcggtcctccccctcaggtgccatctagacccaatagagcgcctcctggggtgccatccaggagtgggcaggcctctccttctcgacctgagtctccaagacccccattcgacctgtag

SEQ ID NO: 221396 - DNA, 1989 bp, Artificial Sequence
  Description of Artificial Sequence: Synthetic coding sequence
atggaggaccttataccccttgttaataggcttcaggatgctttctcagcgattgggcaaaacgcagatctggatctgcctcagatcgctgtcgtggggggtcagtctgctgggaaaagctccgtcttagaaaattttgttggcagagatttcttacccaggggttccgggattgtgacaagacggccactagtccttcagctggttaatgccactactgaatacgcagagttcctgcattgtaagggaaaaaagttcaccgattttgaggaggtcagacttgagatcgaggccgaaacggatagagtcactggaaccaacaaagggatctctccagtacccattaatctgcgcgtttattcgcctcacgtgcttaatcttaccttggttgacttaccaggaatgacgaaggtccctgtgggcgaccagcctccggacatcgaattccagatcagagacatgctgatgcagttcgttaccaaggaaaattgcctgatactggctgtgagtccggcaaacagcgacttggcaaactctgacgccctgaaggtcgctaaagaagttgacccacagggccagcgaaccatcggtgtgattactaagctcgatctaatggacgaggggacagatgcccgagacgtgctggaaaataagctcctccctctcaggcgagggtacattggcgtcgtgaatcggagccagaaagatatcgatggaaagaaagatataacggccgctctcgctgcagagaggaagttctttctaagccatccttcatacagacacctcgccgaccgaatggggacaccatacctgcagaaggtgctgaatcagcagttgactaatcacattagggatacactgcccggactgagaaacaagttgcagtcacagcttctgagtattgagaaagaggtcgaagagtataagaacttccggcctgatgatcccgctcgtaaaacgaaggctttactgcagatggtgcagcagtttgctgtagacttcgaaaaacgaatagaaggtagtggtgatcagatcgacacctacgaattaagtggtggtgcaagaattaaccgcatttttcacgagcgctttccatttgaattagtcaaaatggagtttgacgagaaagaattgcggcgtgagatatcctacgcgatcaaaaatatccatggcattaggaccggcttgttcactcccgatatggccttcgagacaatagtgaagaaacaagtgaaaaaaatccgcgagccgtgcctcaagtgcgtggacatggtcattagcgaattaatttcaaccgtccgacagtgcacgaaaaagctgcagcagtatccgaggctgcgcgaagagatggagagaattgtgactacccacattcgggaacgcgaaggacgaactaaagagcaggtgatgctgctgattgacattgagctggcttatatgaacacaaaccatgaagacttcatcgggttcgctaacgcacaacaacgatcaaatcagatgaacaagaagaagacttctgggaaccaaatcacactgcaggtaatccgcaaaggatggctgaccatcaacaacatcggtataatgaagggcggaagtaaagaatactggttcgttctcaccgccgagaatctgtcatggtacaaggatgatgaggaaaaggagaagaaatatatgctgtctgttgacaaccttaagttgagggatgtcgaaaaggggttcatgtcttcaaagcatatttttgcccttttcaacactgagcagcgaaacgtgtataaggactaccggcaactggagctggcatgtgagacccaggaggaggtggattcctggaaggcctcatttctgcgtgccggagtctatcccgaacgcgttggggataaggagaaggtttctgtgcctttctcttgtctgttgccagggatctgttcccttgccccagcgccagcacgtttttctagcaaagggccaggggacgtccttttctag

SEQ ID NO: 221397 - DNA, 2556 bp, Artificial Sequence
  Description of Artificial Sequence: Synthetic coding sequence
atgggcaaccggggaatggaggatcttatcccactagtcaaccgactccaagacgccttttctgctatcggccagaacgctgatttggaccttccgcagatagccgtggtgggtggtcaatctgcgggaaagtccagcgttctagaaaactttgtgggacgagattttctgccacgtggcagtggcatcgtgacaagacgcccacttgtactgcaactggtgaatgccaccactgaatatgctgagtttctacactgtaaaggcaaaaaatttaccgatttcgaagaagtgagactggagatcgaggctgagaccgatcgggtgactggaacgaataaaggcatttcgccagttcctatcaacctcagagtgtactctccccacgtcctgaatctgaccctggtggacctacctggcatgaccaaagtgcccgtgggggatcagcccccagatatcgagttccagatccgagacatgttgatgcagtttgtcacaaaagagaactgcctgattttagcagtttctcctgccaacagtgacctggcaaatagcgacgctctgaaagtggccaaagaagttgatcctcaggggcaacgaactatcggtgtcattaccaagctagatctgatggatgaagggaccgatgctagagatgttctggagaacaagctcttgcccttaagacgcggttacatcggagtggtaaaccggagccagaaagacatagacgggaagaaggatatcaccgcagcgcttgccgctgaaaggaagtttttcctttctcatccgtcatacagacacttagcagatcgtatgggcactccatatttacagaaggtgcttaaccagcagctcaccaaccatattcgagatacactgccagggctgcgaaataaactgcaatcacagcttctttctattgaaaaagaggttgaggagtataaaaattttcgcccagatgaccccgcaaggaaaaccaaagctctgctgcagatggtgcagcagtttgcagtcgacttcgaaaaacgcatcgagggcagtggcgatcagatagacacctatgaactgtctggaggcgcacggattaataggatttttcatgaaagattcccctttgaacttgtgaagatggagtttgacgaaaaagaactgagacgggagatttcctacgccattaagaatatccatggcatccggactggcctcttcacgcctgatctagcgttcgaggccacggtcaaaaagcaggtccagaagctgaaagagccatccataaagtgtgtggacatggttgtcagtgaactcacggctaccataaggaaatgttccgaaaaactgcagcagtacccccgtctcagggaagagatggagcgaattgttaccacccatatccgagaaagagagggaaggacaaaagaacaggtgatgttgctaattgacattgagcttgcatacatgaacacaaaccatgaggactttatcgggtttgcgaatgctcagcagcgctccaatcaaatgaacaaaaaaaaaacttccggaaaccaggacgagattctcgttatccgtaagggctggctgaccattaataacattggcattatgaaggggggaagtaaggaatactggttcgtactgactgcagaaaacctgagctggtataaggatgatgaggaaaaggagaaaaaatacatgctttcagtggacaacctgaagctgcgggacgtcgaaaaaggctttatgtcaagcaagcatatttttgccctgtttaataccgaacagcgaaacgtatacaaagactatcgccagttagaattggcctgtgagacacaagaagaggtggatagttggaaggccagttttcttcgggcaggggtgtacccggagagggtgggggacaaagaaaaagcatccgaaaccgaggagaacggtagcgatagcttcatgcacagcatggatcctcagctcgagcgacaggtggagacaattcggaacctggtcgactcctacatggcaatcgtcaataagacagtacgtgaccttatgcctaagacgattatgcacttgatgatcaacaacacaaaagagttcatctttagcgaattgttggctaatctgtactcatgcggggaccaaaacacactgatggaggagagcgctgagcaggcccagcgcagggatgaaatgttaagaatgtaccacgccctcaaggaggccctgtccatcatcggagacattaatactactactgtatcaacccccatgcccccacctgtggacgattcatggctgcaagtacagtcggtccctgctggtcggagatctccaacctcctccccgaccccgcaaagaagagcccctgctgttccacccgcacggcctggctcgagaggtcccgctccaggacctcctccagcaggaagcgcgctcggtggcgcacctccagtgccctctcggccaggagccagccctgatcctttcggaccaccaccacaggtgccatctcgacccaaccgggctccgccaggggtgcctcggataacaatttccgatccttag

SEQ ID NO: 221398 - DNA, 2556 bp, Artificial Sequence
  Description of Artificial Sequence: Synthetic coding sequence
atgggcaatagaggcatggaagacctgatcccgcttgtcaaccgccttcaagacgcttttagtgcgattggccagaatgctgacttagacttacctcagatagctgtggtgggaggccaatccgccggaaagtctagcgttctagaaaactttgtgggcagggattttcttcccagagggtctgggatcgttaccaggcggccactagtcctgcagctcgtcaatgcaaccacggagtacgccgagttcctgcattgcaaagggaaaaagttcacggacttcgaggaagtcagactggaaatcgaagccgagaccgatagggtaactgggaccaataaggggatttcaccagtgccgatcaatctgagggtatactcaccacacgtcctgaacctgacattggtagacctcccgggaatgactaaggtacctgttggagaccagcccccagatatagagtttcagattagagacatgctcatgcagtttgtgactaaggaaaactgcctgatcctagccgtgtcccctgccaactcagacctggcaaacagtgatgctctgaaagttgctaaggaagtcgacccccaggggcagcggaccatcggagtcatcaccaagctggaccttatggacgaggggaccgacgcacgtgatgtgctggaaaacaaacttttgcctctgcgcagaggctatattggagtggtgaaccgcagccagaaagacattgacggaaaaaaggatataactgctgctctggccgctgagcggaagttcttcctgagtcaccctagctacaggcacctggcggaccgaatgggaactccttatttgcagaaggtactgaatcagcagctgacaaaccatatccgagacaccctccccggactaagaaacaagttacaaagtcagctgctttccattgagaaagaagtggaggaatacaaaaatttcaggccagacgatcctgccaggaaaactaaggcccttctccagatggtgcaacagtttgcagtggatttcgagaaaagaatcgaagggtcaggagatcaaatagacacctacgagttaagcggcggagcgaggatcaaccgcatattccatgagaggtttccattcgagctggtcaagatggaatttgatgaaaaggaattgcgacgcgagattagctatgctataaagaatattcacggaattcgcaccgggctgttcactccagacctggcttttgaagctacagtgaagaaacaggtgcaaaagctgaaggaacctagtattaaatgtgtagacatggttgtctcagagctgacagctacaatccgaaaatgttctgaaaagctgcaacagtacccccgtctccgcgaagagatggaacggatcgtcaccactcacatccgggaacgcgagggtaggaccaaagagcaggtgatgcttttaattgatattgagttagcttacatgaacactaaccatgaggacttcattgggttcgccaacgcccaacagcgatctaatcagatgaacaagaagaaaacctctggaaaccaggacgaaattttggttattagaaagggctggctgaccatcaataatatagggatcatgaagggcggtagtaaagagtattggtttgtcctgacagccgagaatctgtcatggtataaagatgatgaagaaaaagaaaagaagtacatgttatccgtcgacaatcttaagctgagagatgtcgagaaaggctttatgagtagtaagcacatttttgccttgtttaacacagaacagagaaacgtgtataaagattaccgccagctcgagttagcgtgcgagacccaggaggaggttgatagttggaaggcatcatttttacgcgctggagtctatccagagcgggtcggggacaaggaaaaagcctccgaaactgaagagaatgggagcgactcattcatgcactcaatggatccccagctcgagcggcaagttgaaacaatccgaaacctggttgacagttacatggccatcgtgaataagacggtaagagacctgatgccaaagaccattatgcatcttatgatcaataacacaaaggagtttatcttttctgagcttctggctaatttgtattcctgcggggatcagaatactctgatggaagaaagtgccgaacaggcacagcgaagagacgaaatgctgcggatgtaccacgcactgaaggaagcactttccatcatcggtgatatcaacaccactactgtatcaaccccgatgccacctccggtggacgattcatggctgcaggttcagagtgtccctgccggacggagatccccaacgtcgagccccaccccccagcgcagagctccggcagttccacccgctcgccctgggagtaggggaccagccccagggcctccccctgcaggaagcgctctgggtggagcccctcctgtcccaagtcgcccaggtgccagtccggatccattcggacctccaccgcaggtaccctccaggcccaaccgcgctccgcctggcgtgccacggattactatttcagacccttag

SEQ ID NO: 221399 - DNA, 2595 bp, Artificial Sequence
  Description of Artificial Sequence: Synthetic coding sequence
atggggaatcgcggaatggaggacctcatcccgttagtcaatcgcttacaggacgccttttctgctataggccagaacgccgacctcgacctgcctcagatcgcagttgtgggaggtcagagtgctgggaagtcaagcgtccttgaaaacttcgtgggcagagactttctacctcggggtagcggcatcgtgactcgcagacctttagttctgcaactggtaaacgccactacagagtacgcagagttcttgcactgcaaaggcaagaaatttacagattttgaagaggtccggcttgagatcgaggcggagactgaccgtgtcacagggacaaacaaggggattagccctgtacctatcaacctccgcgtgtatagcccccacgtgcttaatctgactctagtcgatttacccggtatgaccaaggtaccagtgggagaccagccacccgacattgagttccaaatccgggacatgctgatgcagtttgtgaccaaggaaaactgcttgattttagctgtgtcacccgctaactctgatctggcgaactctgatgccctgaaggtcgcaaaagaggtggatcctcaaggccagagaaccattggcgttatcacaaaactcgacttgatggacgaaggcacagacgccagggatgtcctagagaacaagctcttgccactcaggcggggatacatcggggtcgtaaacagaagccagaaagacattgacggcaagaaggacataacagctgccttagctgccgagcgtaaattctttctgtcgcatccgtcatacagacacctcgcggatagaatgggcaccccttacctccaaaaggtgctcaaccagcagctgacgaaccatataagagatacattacccggtttgcggaataaactacagtcacagcttttatccatagaaaaagaggtcgaggagtacaaaaactttcgtcccgacgatcccgcacgtaaaacgaaggcactgttgcagatggtgcaacagttcgccgtcgactttgaaaaacgcatagagggaagcggggaccaaatcgatacttatgaacttagtggcggagcccgaattaatagaatctttcatgaaagattcccattcgaattagttaagatggaatttgatgaaaaagagttgcggagagagatctcgtacgccatcaaaaatattcatgggatccggaccggcttatttacgcctgatcttgccttcgaggccaccgtaaagaagcaggtgcagaaactcaaagaacccagcattaaatgtgtcgacatggtagtaagcgagctgaccgctaccattcggaaatgtagtgagaaactgcagcagtacccacgactgagggaggaaatggaaaggattgttacaacccatatacgggaacgggaagggagaacgaaggagcaggtgatgttgttaattgatattgaactcgcgtacatgaacaccaaccatgaagactttattggatttgctaacgctcagcagaggagcaaccagatgaataagaagaagacaagcgggaatcaagatgaaatcctggtgatccgtaaggggtggctcaccatcaataacatcgggatcatgaagggcggatccaaggagtattggtttgtccttaccgccgagaacttaagctggtataaggatgatgaggagaaagaaaaaaaatatatgttgtccgtggacaatctaaagctgagggacgtggagaaaggcttcatgtcaagtaaacatatctttgcgcttttcaatacagaacagagaaacgtgtataaggattatcggcagttagagctggcatgtgagactcaggaggaggtagattcttggaaagctagctttcttcgggcaggtgtgtacccagagcgggtcggagataaggaaaaagcatccgagactgaggagaatgggtctgactcctttatgcacagcatggatcctcagctggaacggcaggtcgaaaccatcagaaatctggtggacagctacatggccatcgtgaacaaaaccgtgcgcgaccttatgcctaaaactatcatgcacctgatgatcaataatacaaaggagttcatcttttctgaacttctggctaatttgtacagctgcggggatcaaaataccttgatggaggagagtgcagagcaggcccagcgaagggatgagatgctgaggatgtaccatgccctgaaagaggcactctctatcatcggggatatcaataccacgaccgtgtccacccctatgccacccccagtcgacgacagttggctgcaggtacaatcagtccccgcaggaaggaggagcccaacctcttctccaaccccacagagacgggctccagcagttcccccagcgaggcctggaagcagggggccagcaccaggtccaccgcctgcaggatccgccctgggtggtgcccctcccgtgccatctaggcctggtgcgtcccctgacccttttgggcctccaccccaggtcccctcgaggccgaatagggcccctcccggagtgcccagtcgaagcggccaggcctctccaagccgccctgaatcacctcggcctccttttgatttatag

SEQ ID NO: 221400 - DNA, 1191 bp, Artificial Sequence
  Description of Artificial Sequence: Synthetic coding sequence
atggagagaattgtgacgactcatatccgggaaagggaaggtcgaacaaaggagcaggtgatgctgctgatcgacattgaactagcctatatgaatacaaaccacgaggattttattggttttgcgaacgcacaacagcgcagcaatcagatgaataaaaagaaaacatctggcaatcaagatgaaatcctggtcatccggaagggatggctgaccataaacaatatcggaatcatgaaggggggaagtaaggagtactggtttgttctgactgctgagaatctctcatggtacaaggatgatgaggagaaagaaaaaaagtacatgctgtcagtcgacaaccttaagttgagagacgtggagaaagggttcatgtccagcaaacatatattcgctctgttcaacacagagcagcgtaatgtatacaaagattaccgccagttggagcttgcttgcgagacgcaggaagaggtggactcttggaaagccagtttcctgcgagccggtgtctatcctgagagagtgggcgacaaagaaaaagcctctgaaacggaggagaatggatccgattcattcatgcatagtatggatccccagttagagcgccaggtcgaaacaattaggaatcttgtggatagctacatggctatcgtcaacaaaacagttcgcgacctgatgcccaagacaattatgcatcttatgatcaacaacaccaaagagtttatcttctccgagttgctggcaaatttatactcgtgcggagaccaaaatacattgatggaagagtcagccgaacaggcacagcgcagagatgaaatgctcagaatgtaccatgcgctaaaggaggccctgagcatcatcggcgacattaatacaacaactgtttcaaccccaatgcccccacccgtcgacgactcttggctacaggttcagtccgtgcctgcgggaaggagaagcccaacaagttctcctacacctcagcggcgagcacctgccgttccaccagccagaccgggtagtcgcggtcccgctccaggaccgccaccagcaggatcagcactgggaggcgcaccacccgtgccctccaggcctggcgcttctcctgatccctttggcccacctccacaagtgccatcaaggccgaaccgcgcaccgcctggggtccctcgaatcactattagtgacccctag

SEQ ID NO: 221401 - DNA, 1728 bp, Artificial Sequence
  Description of Artificial Sequence: Synthetic coding sequence
atggaggccctgatccctgtgattaacaaactgcaggatgtcttcaacacagtgggagcagacatcatacagctgccacagatcgtggtggtcggaacccagagctcgggaaaaagctccgtgctggagtcactagtcggacgcgacttgctgcccagagggacaggaatagtaaccagaaggcctctaatccttcagcttgtccacgtgtctcaggaggataagcggaagaccactggagaggagaacggagtagaggctgaggaatgggggaaattcctgcacacaaaaaacaagctttacaccgactttgatgaaataagacaagagattgagaacgagaccgagcggataagtgggaacaataagggagttagccccgaacctatccacctgaaaattttttcacccaacgtggtgaaccttactctcgttgacttgcccggtatgactaaagtgcccgtgggcgatcagccaaaggacatcgagctccagattcgtgaactcattttgcgctttatatccaatccgaacagcattatcctagccgttacagctgcaaataccgacatggccacttctgaggccttaaaaatctcaagagaggtcgacccggacggacggaggaccctcgctgtgatcacgaaacttgacttgatggatgcaggtacagacgcaatggatgtcttgatgggaagagttatccctgtgaagctgggcattattggcgtggtgaaccggagccagttagacatcaataataagaagtccgtgacagactccattagggacgaatacgccttcttgcagaaaaaatatccttcactagctaaccggaatggaaccaagtacctggcgagaaccctgaatcgactcctgatgcatcacattcgcgattgcctgccagaactgaaaactcgcataaatgtactggccgctcagtatcaatcgttactgaatagttatggcgagcctgtggacgacaaaagcgccaccctcctgcagcttatcaccaagtttgccaccgagtactgtaataccatcgaaggtacagccaaatatattgagactagcgagctttgtggtggggcaaggatttgctacatatttcatgaaaccttcggtcgcacactcgagtctgtggatcccttagggggactgaatacaatagatatcctaacagcgatcagaaatgccactggccctcggccagctctgttcgtacccgaggtgtcattcgagctgttggtgaagagacagatcaagcgactagaagagccgtcgttaaggtgcgtagagttagtacacgaggaaatgcagcgaataattcaacattgttccaattacagcacccaggaacttctaaggttccctaagctgcacgacgctatagtggaagtggtgacctgtctgctgagaaagcgccttcccgtcacaaacgaaatggtgcacaacctggtggccatcgaattagcttatatcaatactaaacaccctgacttcgcagacgcttgcgggctaatgaacaataacatcgaggagcagcggcgtaataggcttgccagagaattgccctccgcagtgagccgggacaaggtggcctctgggggaggcggagtgggcgacggcgttcaagaacctacaaccgggaattggcgaggcatgcttaagacaagcaaggccgaggagctactagccgagaagaagaaaaaaaagaaaaaaaaatag

SEQ ID NO: 221402 - DNA, 2100 bp, Artificial Sequence
  Description of Artificial Sequence: Synthetic coding sequence
atggaggctttaatccccgtgattaataagctgcaagatgtgttcaacaccgtgggagcagatatcattcagctgccacagattgttgtggtaggtacacaaagctcaggtaagtcttcggtgctggagtctctggtcggcagagacctgctgccgagaggaacaggcatcgtcacgcggcgtcctctaatactgcagctggtccacgtttctcaggaggacaagcgcaagacaacgggagaggagaacggcgtcgaggcggaggagtggggaaaatttttgcacaccaaaaataagctgtacacagattttgacgagatacgccaggagattgaaaacgaaaccgaacgtatttctggcaataacaagggagtgtcccccgagcccatacacttgaagatctttagccctaatgtcgtcaacttgacactggtggatttgccagggatgaccaaggtccccgtgggcgaccaaccaaaagatattgaactgcagatccgggagttgatcctgcgctttatctccaatccaaacagtatcatcctggcagtgactgcagctaatactgacatggctacctccgaagctctgaagatctctagggaagtcgaccctgacggccgacgaaccctggccgtgataaccaagcttgatctcatggacgcaggcactgacgctatggacgttctcatgggcagagtgatccccgtcaagctcggtattattggcgtcgttaacaggtcccagctggatataaacaacaaaaaatccgttaccgatagtataagagatgagtatgcatttttgcaaaagaaatatcccagtctcgcgaataggaatggaacaaagtatctggcacgtaccctgaaccgcctgctcatgcatcacattagagactgtctaccagagctcaaaacccgtataaacgtcctggcagctcagtaccagagtctgttgaactcctacggcgagcccgtggatgacaagtcggccacattactgcaattaataaccaagtttgcaaccgagtattgcaatacgatcgagggcacagccaagtacattgagacgagcgaactctgcgggggagctcggatatgttatatcttccacgagaccttcggcagaacgctggagagtgtggatccacttggtggcttgaacacaattgatattcttaccgctatacggaatgcaactggcccaaggcctgcgctgttcgttcctgaagtttccttcgaactccttgtgaagcgccagattaagcggctggaggaaccctccctccgctgcgttgagctcgtgcatgaggagatgcaacggataatccagcactgctctaattacagcactcaagagctgctacggttccctaaactgcacgacgctattgttgaagtggtcacctgtctcctccgcaagagactgcccgtcacgaacgagatggttcacaacctggtcgctattgagcttgcctatattaacactaagcacccagatttcgcggatgcttgcgggctgatgaacaataatatcgaagagcaaagacgcaaccggctggccagggaactgcccagcgcagttagtagggacaaggtggcttccggagggggaggggtaggcgatggggttcaagaaccaacaaccggcaactggcggggaatgttaaagaccagtaaggccgaggaactgctcgcagaggaaaagtcaaaaccaatccccataatgccagcatcccctcagaaggggcatgcagtcaatctactcgacgttccagtgccggtcgccaggaaattatccgcgcgtgagcagcgggattgtgaagtgatcgaacgtctgatcaagtcctatttcctcatcgttagaaaaaatatccaagatagtgtccccaaggccgtaatgcacttccttgtcaaccacgtcaaagataccctgcagtctgagttggtggggcagctttacaaatccagcctgctggacgacctccttactgaatcagaggatatggcccagcgtcgcaaggaagcagccgatatgctgaaagcccttcagggcgctagccagatcatcgccgaaataagggaaacacatttatggtag

SEQ ID NO: 221403 - DNA, 2376 bp, Artificial Sequence
  Description of Artificial Sequence: Synthetic coding sequence
atggcttgtcgagaaggagctggatcccgacgcgctcgatcaaatggctgccggttgcccagacgcggtcggagacgcggagggaggaggcgcacagtcggccctggtcctattcactgcagaggacgccgagctctcggtcccagggtttttagggttatggaggccctgattcctgtaataaacaaactacaggacgtgtttaacacagttggtgccgacattatacaactccctcaaatcgtcgtagtgggaacgcagtcctccggtaaatcgtccgtgttagagtcactcgtgggtcgcgatctgctcccacgaggtaccggcatcgtgacccgaagaccactcatcctgcagctggtccacgtgtctcaagaagacaaaagaaaaacaacgggagaggaaaacgacccagccacatggaagaactcccgacacctgagcaaaggagtagaggccgaagaatggggcaagttcttgcacacgaagaataagctgtacacggacttcgatgaaattcggcaagagattgagaacgagacagaacgcatttcgggtaataataagggagtgagccctgaacccattcatttgaagattttctccccaaatgtagttaacttgactctcgtggacctgccagggatgacaaaagtgccggtgggtgaccagcccaaagatatcgaattacaaatacgggagctcatcctgcggttcatctctaatccaaactccataatcctggctgtgacagccgctaataccgacatggccactagcgaggctctgaaaatctcacgcgaggtggaccccgacggtcggagaactttggccgttattactaagcttgaccttatggatgcaggtacagacgcaatggacgtgctcatggggagagtaataccagtgaaactcggaatcatcggcgtggtgaataggtcccagttggatattaacaataaaaagagtgtgaccgactcaatcagagacgagtatgcatttttacagaagaaatatcctagcttggctaaccgtaatggaacaaaatacctggctcggaccttaaatcggctgctgatgcatcacattagagattgtctccctgagctcaagacacggattaatgtgctcgccgctcagtatcaatccttgttgaacagctacggggagcccgttgatgataagtctgccacactactgcagctgatcaccaaatttgccacggagtactgtaatacaatcgagggcaccgcaaaatatatcgaaacgtctgagctgtgtggaggcgctagaatctgctatatcttccacgagactttcgggcgaacactggaaagcgtggacccgctgggcggactgaataccatcgatatcttaaccgccattcgcaatgccacgggaccccgtcccgcactattcgtgcctgaggtcagttttgaactacttgtgaaaaggcaaataaagcgtcttgaagagcctagtttgcgctgcgtcgaactggtgcacgaggagatgcagaggattattcaacactgtagtaactatagcacgcaagagctcttgcgattccctaagttacatgatgctatcgtggaggtggtcacgtgcctcctgagaaagcgcctgccggtgactaatgaaatggtgcacaacttagtagcaatcgagctggcctacatcaacactaagcatcctgactttgctgacgcttgcggccttatgaataataacatcgaagaacaacgcagaaatcgcctggccagggagctcccctctgcagtatctcgggacaagagctccaaagtcccttcagcactggcacctgcttcacaggaacccagtccagctgccagcgccgaggctgacggcaaggttgcctcgggagggggtggagtgggggacggtgtccaggagccgacgacaggaaattggaggggaatgctgaagacaagcaaagcagaggagttgctagctgaagaaaagagcaaacctatacccatcatgccagccagtccacagaaaggacatgctgtgaacctgctggacgtgcccgtcccggtagcacggaagctgtcagcaagggagcagagggattgtgaagtaattgaacggctcatcaagtcgtacttcctcatagtccgaaagaatatccaggacagcgtgcccaaagccgttatgcactttctggtcaaccacgtgaaggataccttacagtctgaactggtaggccaactttataaatcatctcttctggatgatctgctgactgagtccgaagatatggcacagcgccgtaaagaagctgcagacatgctgaaggcactacagggcgctagccagatcatcgccgaaatccgcgaaactcatctatggtag

SEQ ID NO: 221404 - DNA, 1602 bp, Artificial Sequence
  Description of Artificial Sequence: Synthetic coding sequence
atgttccacaaaaagatcaacgggaaacagcaggaaaagaagatgacactgctccacggcaaaactcaggacacgtttctaaaaggctggaagcagaaaaacggcgtaaacttctttactcccaagataagaagtcagctcgacatcaataataagaagtcggtgaccgactctatcagggatgagtacgcattcctgcaaaaaaaatatccgagccttgctaatagaaacggtactaagtacctcgccagaaccctaaataggctgctgatgcaccacatccgagactgtcttccagaactgaagacaaggatcaacgttcttgcagcacagtatcagtccctcctgaactcttacggagaacccgtcgacgataaaagtgccaccctcctccaacttattactaaatttgctactgagtattgtaatacaatcgaagggaccgccaaatacatcgagacctccgaactttgtgggggagcaagaatatgttacatctttcacgagactttcgggcgtaccctcgaatccgtcgatcctctaggcggactgaatactatagacattctgaccgcgattcgtaacgcaacagggccacgtccggcactttttgtgccagaggtgagcttcgagctgctcgtgaaaaggcagatcaagcgcctagaagaaccttctcttcggtgcgtggaactggtccacgaggaaatgcagcggattatccagcactgttcaaactattctacacaggagcttctacggttccccaaactgcacgatgccattgtcgaggtcgtcacctgcctcttacgcaagagacttcctgtgacaaatgaaatggtgcacaatctggtggccatcgagctggcctacattaacaccaaacaccctgatttcgccgacgcctgcggacttatgaataataacattgaagagcagcgacgtaacaggctggctcgagagttaccatccgcggtgagtagagataaaagcagtaaggtcccgagcgcccttgctcctgcaagccaggagccaagcccagctgcaagtgccgaggccgacggcaagctcatccaagacagccggcgagagacaaagaacgttgccagtggcggaggcggagtgggggacggcgtgcaggagcctacgacaggcaattggcgaggaatgctcaagacctccaaggccgaagagctcctcgccgaggagaagtccaagcccattcccataatgccagcgtcccctcagaaggggcatgccgtgaacctgcttgacgttcctgtgcccgtggccagaaaactatccgcccgtgaacagagagactgcgaggttatagagcgcctgattaagagctacttcctaattgtcagaaaaaacatccaagattcagtgcctaaagcagtcatgcattttctagttaaccatgtgaaggatacactgcagagcgaacttgtgggccagttgtacaagagctccctgctggatgacctcctgaccgagagcgaggatatggcccagcgcaggaaagaggctgcggatatgctgaaggcactgcagggggcatctcagataattgccgagattagggaaacacacctgtggtag

SEQ ID NO: 221405 - DNA, 2133 bp, Artificial Sequence
  Description of Artificial Sequence: Synthetic coding sequence
atggaggcgctgattcctgtgattaataaacttcaggatgttttcaataccgtgggagccgacattatacagctcccgcagattgttgtggtagggacgcagagcagcggtaagagctcagtgcttgaaagccttgtcggaagggatttattgccgagggggaccgggatagtcacacgcagacctttgatactacagctggtgcacgtctcgcaagaagacaaaagaaagaccaccggcgaagaaaatggagtggaagcagaggaatggggaaagttcttgcacacaaaaaataagctgtacacggacttcgacgagatcaggcaggagatcgagaacgagacagaacggatcagcgggaacaataagggcgtgagccctgagcctatacaccttaagattttcagcccaaatgtggtcaacctgacactagtggacctccctggtatgaccaaggtccccgtgggtgatcagcccaaggacattgaactgcagataagagagcttatcctgcggttcataagtaaccccaattccattatcctggcggtgaccgcagccaacacagacatggcaacctccgaagcgctgaagattagtagagaggtagacccggacggtcgcagaactctagccgtgatcaccaagttggatctcatggacgcagggacggacgccatggatgtgctgatgggccgagttatcccggtcaaacttggcattatcggggtggtgaacaggtcccagctcgacataaataacaagaaatccgtgactgactccatccgggacgagtacgcgttcctgcagaagaagtatccaagccttgctaacaggaatggcacgaaatacctagccagaactctgaatagacttcttatgcaccacattagagattgcctgccagagcttaagactagaatcaatgtcctggctgcccagtaccagtctctgttgaacagttatggcgagccggtggacgataagtcagctactctgctgcaattaattaccaagttcgcaaccgagtactgtaatacaatcgaaggcaccgcgaagtatattgaaacatctgagctgtgcggtggggcacggatctgctacatctttcacgagacatttggccgtaccctcgagtcagtcgatccactgggaggacttaacactatcgatatcctcaccgctatccgaaatgccaccggaccaagacccgctctttttgtgcctgaggtgtcgttcgagctgctggtgaaacgtcagatcaagaggctggaggaaccttccttgaggtgtgtggaactggtacacgaggagatgcagcggattatccagcactgtagcaactactccacccaagagctcctccggtttcccaagctgcatgatgctatcgtggaggtggtcacatgtctgctgcgaaagcggctgcctgtgacaaatgaaatggtgcataacttggtagccattgagttggcgtacataaacactaagcacccggacttcgctgatgcctgcggactcatgaacaacaacatcgaggagcaacgcaggaacagactcgcccgagagttgccctcagccgtgtcacgcgacaaactgatccaagatagcagacgggaaactaaaaacgtggcatccgggggaggcggtgttggcgatggagtgcaggagcccacaaccggtaactggaggggaatgctcaaaacttccaaggccgaggaacttctggctgaggagaaaagcaagccgattccgatcatgccagcctctcctcagaagggtcatgcggtgaatctccttgacgtgcccgtgcccgtggccaggaagcttagtgccagggagcagagggattgtgaggtgattgagcggttgatcaagtcctacttccttattgtgcggaaaaatattcaggacagcgtcccgaaggccgtcatgcactttttggtcaaccatgtgaaggacactttgcagtctgagcttgtcgggcaactgtacaaaagtagcctgctggatgatctcttaacagaatccgaagatatggcacagcgcaggaaggaagctgctgatatgcttaaggccttgcaaggcgctagtcagataatcgcagagatcagggaaacccatctgtggtag

SEQ ID NO: 221406 - DNA, 2178 bp, Artificial Sequence
  Description of Artificial Sequence: Synthetic coding sequence
atggaagccctgatccctgtcatcaataagctccaggacgtgttcaacacagtcggagccgatattatccaacttccgcagatcgtagttgtcggaacgcagtccagtggcaaaagcagcgttctggagtccctggttggaagagatctcctcccaagaggaaccggcatcgtgacacggagaccattaattctacagttggtgcacgtctctcaggaggacaagcggaagacaactggggaggagaatggcgttgaagcagaggagtgggggaagttcctccataccaagaacaagctctacactgattttgacgagataaggcaggagattgagaacgaaaccgaacgtatcagcggcaacaacaagggagtctccccagagcctatacacctgaagatcttctcaccaaacgtggtcaatctgactctggtggatttacccggaatgacaaaagtgccagtaggagaccaacctaaagacattgaactgcagatcagagagttaattctgcggttcataagcaatccaaattccataattttggccgttacggctgctaacactgatatggccacaagtgaggcattgaaaatctccagggaagttgacccagatggtcggagaacattggctgttattacaaagctcgatttgatggacgcagggactgacgccatggacgttctcatgggtcgtgtgatccctgttaaactggggataatcggggtggtgaacagaagccagctcgacatcaataataagaagtccgtaactgactccatcagggatgagtacgcttttctgcagaagaagtacccaagcttggctaaccgaaacggcacgaaatatctagcacgcacactgaacaggctgctcatgcaccatatcagggactgcctgcccgagctcaagactcgaattaatgttctagctgctcagtaccaatcattactaaactcctacggggaacctgttgacgacaaaagcgcaactctcctgcagctgatcaccaagtttgcgactgagtattgtaatacgatagaggggaccgccaagtacatcgaaactagcgaactctgtggtggggctaggatctgttatattttccatgaaacctttggtcggacacttgagtctgtcgaccctctggggggtctcaatacaattgacatcctgacagccatcaggaatgccacagggcctagaccagctctctttgtgcctgaggtgagctttgagcttcttgtgaaaaggcagatcaaacgccttgaggaacccagccttcggtgcgtggagctcgtccatgaggagatgcagaggattatccagcactgctcaaactactctacccaagaacttctccgttttcctaagctccacgatgctatcgtggaggtggtcacatgtctgctccggaagcgtctgcccgtgaccaatgaaatggttcataatctggtggccatagagttggcttacattaataccaagcatcctgattttgctgacgcttgcggtttgatgaataataacattgaggagcaacgcagaaatcggttggctagggaacttccatctgctgtatctcgagataaaagctcaaaagtgcccagcgccttagctcccgctagccaagagccatcccctgcagcaagcgcagaggctgatggaaaggtggcatcgggtggcggtggagttggggacggcgtgcaggaacctactactggaaactggcgtggcatgctcaagacctctaaggctgaggaactcctggcagaggagaaatcgaagcccatccctatcatgccagcgagtccccaaaaggggcacgccgtgaacctgctggatgttcctgtgcctgttgcgcgaaagttaagcgctcgggaacagcgcgattgtgaagtgattgagcgactgattaaaagctacttcctgattgtgcggaaaaacattcaggacagcgttcccaaagctgtgatgcacttcctggtgaaccatgtcaaagacaccctgcagtctgaacttgtggggcagctgtataagtcatccctcctggatgacctgctgactgagtcagaggacatggcacaacggaggaaggaagcagctgatatgctgaaggctctgcagggagccagccagattatagccgaaattcgagagactcacctatggtag

SEQ ID NO: 221407 - DNA, 2211 bp, Artificial Sequence
  Description of Artificial Sequence: Synthetic coding sequence
atggaggcgctaattcctgtgatcaacaagctccaagacgtcttcaacactgtgggcgctgacattattcagctcccgcagatcgttgtcgtcggcacacagagttctggtaaaagcagtgtgctggagtctttggtggggcgtgatcttctgcctcgagggacgggaatcgtaacgagacgaccattgattcttcagttggtgcacgtgtctcaggaggataagcggaagactacgggggaggaaaacggcgtggaggcagaggaatgggggaagttcctgcataccaaaaacaagctatacaccgattttgacgagattagacaggaaattgaaaatgaaactgaaaggatctccggtaacaacaaaggtgtatcccctgaaccaatacatctgaagatctttagccccaatgtggtgaatcttaccctagtagacctaccaggaatgacaaaggtccctgttggcgaccaacccaaggatatagaactgcagataagggaactgattctacggttcatctcaaatccaaatagcattattttagccgtgacggctgccaataccgatatggctactagcgaggctctgaagatatcccgagaagtggacccagacggaagacggactctggccgtgattacaaaactggaccttatggacgcagggaccgacgccatggacgttctgatgggacgggtaattcctgttaagttgggtatcatcggagtagtaaaccgaagtcaactggacattaacaataaaaagtcagttacagatagtatcagggatgaatatgcttttcttcagaagaaatacccatccttggccaataggaatggaactaaatacctcgctcggaccctcaacagacttttgatgcaccacataagggattgtctgcccgagctgaaaacccggatcaatgtgttggcagctcagtaccagtccctcctgaattcctacggggaacctgtggacgataagagtgccacgttgctccagttgatcactaaattcgcaaccgagtattgtaacacgattgaagggactgctaaatatattgaaacgtctgaactgtgcggcggagcgagaatttgttatattttccatgaaacctttggaaggacgcttgagtcagtcgacccactaggtggcctgaacaccattgacatcttaacagcgatccgtaacgctactggaccgagaccagctctgtttgtgcctgaagtcagttttgagctcttagtgaagcggcagataaaaaggctggaggagcctagtctacggtgcgttgaactggtgcacgaggaaatgcagcggattatacaacactgttcgaattactccacccaggagcttctaagatttccgaagctgcacgatgccatcgttgaagtggttacctgtttactgagaaagcggttgcctgttactaacgaaatggtccataacctcgtggcgattgagctagcttatatcaacacgaaacatcccgacttcgccgacgcctgcggactaatgaataacaacattgaagaacagaggcgcaaccgcctggccagggaactcccatctgccgtgtctcgagataagtcctctaaggtacctagtgcactcgccccagcttcccaagagccttcccccgcagcctccgcggaagcggatgggaaacttatacaggactcccgtagggagacaaaaaacgtcgcgtccggcggtggtggagtcggcgatggcgttcaggaacccactaccggcaattggcggggaatgcttaagacatccaaggccgaagagttgctggcagaggagaagtcaaagccgatcccgatcatgcccgctagcccccagaaaggccatgccgtcaatctgctggatgtgcccgtccccgtggccagaaagttgagtgccagggagcagagagactgcgaggtgattgaacgactaatcaagtcgtactttctgatcgtgcgcaagaatatccaggattctgtccctaaggccgttatgcattttttagtgaaccacgtaaaagacaccctgcagtctgaactcgttggacaattatacaaatcctccctgttggacgatcttctcactgaatccgaagatatggcacagcgacggaaagaagcggcagacatgttgaaggctctgcagggagcatcccaaattatagccgaaatacgcgagacgcacctgtggtag

SEQ ID NO: 221408 - DNA, 2250 bp, Artificial Sequence
  Description of Artificial Sequence: Synthetic coding sequence
atggaggccctcataccagtgattaacaaactgcaagacgtgtttaacaccgtcggcgctgatataatccaactccctcagatcgtggttgttgggacccagagtagcggaaagtcatcagtgttggagtcactggtggggagggatctgttgcctaggggcacaggcatcgttacccggagaccattaatcttgcaattggtacatgtgtctcaggaagacaagagaaagaccacaggagaggaaaacgatcccgctacatggaagaacagccggcatctcagtaagggggtcgaggccgaagagtgggggaagttcctccacacaaagaacaagttgtacactgattttgatgaaatccgccaagagattgagaacgaaaccgagcggatctcaggcaataataaaggcgtcagtcccgaacccatacacctgaagatcttcagtcccaatgtggtaaatcttaccttggtcgatctgcctggtatgaccaaagtgcctgttggggaccaacctaaggatatcgagctgcagattagggaactcattcttagatttatttccaacccgaatagcatcatactggccgtcactgctgcgaataccgatatggcaacaagcgaagcgcttaaaatatccagagaggtcgacccagatggacggagaactctggctgtgatcacaaagctcgatctcatggacgccggtactgacgcgatggacgtcctaatggggcgtgttatcccagtcaagttaggtatcattggggtcgtgaatcggtcccagctcgacattaacaacaaaaagagcgtgactgactcaatcagagatgaatatgcattcttacagaaaaaatacccctcactggccaatagaaatggaaccaagtatctggcgagaactctgaataggctattgatgcaccatattagagactgcctgccagaactgaagactcgcatcaatgtgctggcagcacagtaccagtcgctactcaactcttacggcgaaccggtagatgacaagtctgcaaccctgttgcagctgattacgaaatttgctacggaatactgcaacactattgagggcaccgcaaaatacatcgagacatcagagctgtgcggcggagccaggatctgttacatattccacgagacattcgggagaactttagagtcggtggacccactgggtggactgaatactatcgatatcttaaccgcgattcggaatgccacaggacctcgacccgcactgttcgtccctgaggtcagcttcgaacttctggtgaaacgtcagatcaagagattggaagagcctagtctgcggtgtgtggagctcgtgcacgaggagatgcagcggattattcagcattgctcgaactactcaacacaggagctactgcgttttcctaagctacacgacgcgattgtagaggttgtgacttgtttactgcggaaaaggttgccagtgaccaatgagatggtccacaacctcgtggccattgaactggcctatatcaataccaaacatcctgatttcgctgatgcctgcggcctgatgaataacaacattgaagagcagcgtcgcaaccgactggccagagagctgccgtccgcagtcagccgcgacaagagcagcaaagtgccttcagccctggctcctgcaagccaagagccgagccctgccgcatccgctgaggcagacggaaaactcattcaagactctcggagagaaacaaaaaacgttgcttctggaggcggaggagtgggcgatggcgtgcaggaaccgaccacgggtaactggaggggcatgttaaagacttcaaaggcagaggaactcctagcagaggagaagagtaagccaattcctatcatgcccgcatctcctcagaaaggtcacgcagtgaaccttctggatgttccagtacccgtggcaaggaaactgtcagctagagagcagcgtgattgtgaggttatagaacgactaattaaatcctatttcctgattgtgcggaagaacattcaagattctgttccaaaggcggtcatgcattttctggtcaatcatgtgaaggatacccttcaatccgaactggtcggacagctgtataaatcaagcctgctggatgacctactcaccgagagcgaagatatggctcagagacgtaaagaggctgccgatatgctcaaggccctgcagggggcatcccagatcatagcagagatacgtgagacacatttgtggtag

SEQ ID NO: 221409 - DNA, 2613 bp, Artificial Sequence
  Description of Artificial Sequence: Synthetic coding sequence
atggggaacagagggatggaggagctgattccgttagtgaacaaactgcaggacgcgttctcctcaattggtcagtcttgtcatcttgatcttcctcagattgctgtagtaggaggccaatccgcgggaaagagttccgtcctggagaacttcgttggccgtgatttcctacctcgtgggtccggcatcgtgaccaggaggcccctcatactgcagctgattttctcaaagacagaacatgccgaattcctgcactgcaaatctaaaaaatttacagacttcgatgaggtgcgacaagagattgaagccgagactgaccgcgtgaccggaaccaataagggaatatcacccgtccccatcaatcttagggtctactctccgcatgtgctaaatctcactcttattgacctccctggaatcaccaaggtccccgtgggggatcagccacccgacattgaataccaaatcaaagacatgattttgcagttcatctcaagggagtcaagcctgatcctcgccgtgacccccgcaaatatggatttagccaactccgatgcactcaaactagccaaggaagtcgatccacaaggtctgaggacaatcggtgtcattactaaattggacctaatggatgaggggaccgatgcaagagacgtgctggaaaacaagttactccctctgaggcgcggttacatcggagtggtgaaccgaagccagaaagatatagaaggcaagaaagacatccgcgctgcgcttgccgcagaacggaagttctttctgagccatccagcatatcgtcatatggccgatagaatggggaccccccatcttcagaagacgttgaaccagcagttgaccaaccatattcgggagagtcttccggctcttcggagtaagcttcagtcacagctcctgtcccttgagaaagaagtggaggaatataagaatttccggcctgacgatcctacaagaaagacaaaggctctgctacagatggttcagcaatttggcgtcgattttgagaaacggatcgaggggtccggcgatcaggttgatacattagagttgtctggcggagctaggattaataggattttccacgaaaggttcccgtttgagcttgtaaaaatggagttcgatgagaaggatttgaggcgcgaaatctcatacgcgatcaaaaatatccatggcgtgcggaccggcttattcactcctgatatggcttttgaggcaattgtgaagaagcagatcgttaaacttaaggaacctagcctcaaatgtgtggacttggtggttagtgagttggcaacagtaataaagaaatgcgctgaaaagcttagctcataccctagactccgtgaggaaacggagaggatcgtgaccacctacatccgggaacgggagggcagaacaaaagaccagatcctgctcttgatcgatatagaacagtcctacatcaatacaaaccacgaagatttcattggtttcgccaacgcccagcagcggagcacccagctcaataagaagagagcaattcctaatcagcctgaaacgctcgtaattaggcgcggatggctgaccatcaataacataagcctaatgaagggaggctctaaggaatattggttcgttctcacagctgaatccttgtcctggtacaaggacgaggaggagaaggagaagaagtacatgctgccacttgataacctcaaaatacgtgacgtagagaagggattcatgtcaaataagcacgtctttgcaatcttcaatactgagcagcggaatgtttacaaggaccttcgacaaatagagttggcttgcgattctcaggaggatgtcgatagctggaaggcttcatttcttagggctggggtgtaccccgaaaaagatcaggctgaaaatgaagacggcgcacaggaaaatacgttctctatggacccacagttggaacgccaagttgagaccattcggaacctggttgatagttacgtggccatcattaacaagtcaatcagagatctgatgccaaaaactattatgcatttgatgatcaataataccaaggcctttatccaccacgagctcctagcctatctctactcttccgctgatcagagcagcctgatggaggagtcagccgaccaggctcagaggcgggatgatatgctgagaatgtatcatgccctcaaggaagcactcaacataatcggtgatattagcacatcaacagtgtccacccctgtgccacctcctgtggatgacacctggctacaatcagccagtagtcattccccaacgccccaaagaagacccgtatccagcatccaccctcccggaagaccccctgctgtaagggggccaacgccgggaccacccctgatccctgtccccgtcggggcagccgctagcttctcggcacccccaataccctccaggcccggtccccagagcgtgtttgctaattccgatctgttccctgctccaccccagatcccttcacgcccagtccgaattcccccaggtattccgcctggagttccatcaaggcgccctcctgctgcacccagcagacctacgattatccgtccggctgaacctagcctcctcgattag

SEQ ID NO: 221410 - DNA, 2601 bp, Artificial Sequence
  Description of Artificial Sequence: Synthetic coding sequence
atggggaatcggggaatggaggagctaataccacttgtgaacaagctccaggatgcctttagtagtatcggacagagctgtcacctagatttgccgcagatcgccgttgtcggaggccaatccgccggaaaaagctccgttctagaaaatttcgttggccgagattttcttccacgcggttcgggaattgttacgaggcggccacttatcctgcaactcatttttagtaagactgagcatgccgagttcctgcactgtaagtcgaaaaagttcactgacttcgatgaagtgagacaggagatagaggctgaaacagatcgagtgacgggtaccaacaagggcatttctcccgtccccattaaccttcgggtatactccccacatgttttaaatctaacccttatcgatctccctggtatcaccaaggtccctgtgggtgatcaaccccctgatatagagtatcagattaaagacatgatccttcagttcattagcagagagagctcactgatcctggccgtgacacccgcaaatatggacctggcgaattccgacgctctgaagttagctaaggaggtggatccccaaggccttcggacgattggtgtcatcacgaagttagaccttatggacgagggcacagatgccagggacgttctcgagaacaagctcctgccgctgaggagaggctatattggagtggtgaatcgttcccaaaaggatatcgagggcaaaaaggatatccgcgctgcactggccgcagaaaggaaatttttcctgtctcatcctgcctatagacacatggctgaccgcatggggacccctcacctccagaaaacacttaaccagcagcttaccaatcacatccgggaatcactgccagccctcaggtccaaacttcaatcacagttgttgtccctagaaaaggaggtcgaggagtacaagaacttcagaccagatgaccctacacgcaagacaaaagcacttcttcagatggtgcagcagtttggtgtggacttcgaaaaacgcatagaaggatcaggggaccaggtggacacactggagttgtctggaggggctaggatcaaccgcatttttcatgaacggtttccgttcgaactcgtgaagatggagttcgacgaaaaagacctcagacgagagatttcctatgccatcaagaacatccatggggtgcggacaggcctctttactccagacctggcattcgaggctatagtgaaaaagcaggtcgtcaaactgaaggagccttgtttgaagtgtgtggacctcgtgatccaagaattaattaacaccgtcaggcagtgtacttccaaactgagttcgtacccacggctgagggaagagacagaacgcatcgtcacaacctatatccgggaacgggaagggcgtacaaaagaccagattctactgttgatagacatcgaacagtcttacatcaacacaaaccatgaagactttattggatttgccaacgctcaacagcgctcaacgcaacttaataagaagagggcaattccaaaccaggtgatcaggcgcggttggttgacgattaataacatctctcttatgaaagggggaagtaaagagtactggttcgtgctgaccgccgaaagcctctcctggtataaagatgaggaagagaaggagaagaagtacatgctgccattagataatctcaaaattcgcgacgtcgaaaagggatttatgtctaataagcacgtgtttgcgattttcaatactgagcagcggaacgtgtataaagacctgcgccagatagagttggcctgcgattctcaggaagatgtcgattcatggaaggcttccttccttcgagcaggagtgtaccctgagaaagatcaggctgaaaatgaggacggggctcaagagaatactttctcaatggatccccaactcgagcgccaggttgagaccattcgaaacctggtcgatagctacgtggctatcatcaacaagtccatccgagacctgatgcctaagacaattatgcacctgatgattaataataccaaagctttcattcaccatgaactgttagcttacctctactcatcagctgaccagagttccttaatggaggaaagcgctgatcaagcacagagaagggacgatatgctaaggatgtatcatgcgctgaaagaggctctgaacatcataggcgatatcagtacatcaacggtctcaacgccagtcccaccgcctgtggatgatacatggctccaatctgctagctcccattctcccactcctcagagacgtcctgtgtcctccatacaccctcctggtaggcctcccgcagtgaggggtccgacacccggacctcctctcatccctgttcctgtcggcgctgcagcatccttttccgcgcctcctatcccttcaagacctggccctcagtccgtgttcgccaacagcgatttatttccggcaccgccacagattcctagtagaccagtgaggatcccccctggcatcccgcctggcgtgccatctcgaaggcctcctgctgccccatctagaccaaccataattaggccggcagaaccttcactcctcgactag

SEQ ID NO: 221411 - DNA, 2613 bp, Artificial Sequence
  Description of Artificial Sequence: Synthetic coding sequence
atgggtaatcggggtatggaagagctgatcccactggttaacaagcttcaggacgcattttcctcaattggccagtcatgtcatctggacttgcctcagatcgctgttgtcggaggccagtcagccggtaaatcaagtgttttggaaaacttcgttgggagggacttcttgcctagaggctctggtatagtcacaagaaggcctttaattctgcagctcattttcagtaaaaccgagcatgccgaatttcttcattgcaagtcaaagaaatttactgactttgacgaagtgcgtcaagagatcgaggccgaaaccgacagagttacgggtacaaacaagggtataagtcctgtaccaatcaaccttcgtgtatatagtccccatgtgctaaatctcacacttattgacctgcctgggatcactaaggtccccgtcggggaccaacccccagatatcgagtaccagatcaaggatatgatcctgcagttcatcagccgagagtcctccctaatcctggcggtgacaccagctaacatggacctggcgaactccgacgccttgaagttagcaaaggaagtcgatcctcagggcctgagaaccataggcgtaataactaagctcgacttaatggacgagggaaccgacgccagagacgtgttagagaacaaactgctacctctgaggaggggatatatcggcgtagtgaatcgatcccagaaggatatcgaggggaagaaagacatccgggcagcacttgcagcggagagaaagttcttcttgagtcatccggcatacaggcacatggcagacagaatggggacaccccatcttcagaaaacgctgaatcagcagctcactaatcacatccgggaaagtctgcctgcattgagatccaagctgcagtcccagttgttatctctggagaaggaagtagaggaatacaagaacttccgtccagatgaccctacgaggaagacgaaagccctgctgcaaatggtccagcagtttggcgtggactttgaaaagaggatcgagggctctggcgatcaggtagatacactggagctgagcgggggtgcccgtattaaccgaattttccacgagcgatttccctttgagttggttaagatggagttcgatgagaaagaccttcgtagagaaattagttacgctataaagaacattcatggcgtgcggaccgggctgttcaccccggatctggcgtttgaggccattgtcaaaaagcaggtggtcaaattaaaggaaccttgtctcaaatgtgttgatctggtgattcaagagcttattaataccgtgaggcagtgcactagcaagctgtccagttaccctcgcttaagggaagaaaccgagcggatagtgacaacctacatacgggaacgggaagggaggaccaaagatcaaatcctgctcttgatagatatagagcaaagctatattaacactaatcacgaggatttcattgggtttgcgaatgctcagcaacgctctactcagctgaataagaagagagcgattccaaaccagggggagatcctcgtcatacgaagaggctggctcacgatcaacaacatcagtctgatgaagggaggctcgaaggagtactggttcgtcctcaccgctgaaagcctaagctggtacaaggatgaggaggagaaagaaaaaaaatacatgctccccctggataatttaaaaattagagacgtcgaaaaggggtttatgtccaacaagcacgtgttcgccatctttaacaccgagcagcgaaatgtgtacaaggacctgaggcaaatcgagctcgcatgcgatagccaggaggacgtggattcctggaaggcatcattcctacgcgcaggcgtctaccccgagaaggatcaggcagaaaacgaggacggagctcaagagaataccttctctatggacccccagctagagcggcaggtggagactatcaggaatctggttgattcttacgtggcaatcataaacaagtccataagagacttgatgcctaagaccattatgcatctgatgatcaacaatacaaaagcatttattcatcatgagctcctggcctatctatacagcagtgccgatcagtcttccctgatggaagaatctgccgaccaagcccagaggcgagacgacatgctgcgcatgtatcacgctctgaaagaggcactgaatatcatcggagatatttctacaagcaccgtcagcaccccggtgcctcctccggtcgacgatacatggctgcagagtgcgtccagccacagccccacaccccagcgcaggcctgtctccagtattcacccacctggtagaccgccagctgtccgcggaccgactcctggcccaccactcatccccgtgccagtgggcgctgctgcctctttctctgctcccccaattccttccaggcctggaccccagtccgtgttcgccaactcagacttgttccccgctcctccacagatcccaagcagaccagtgcggatccctccagggattccccctggagtgccgtctagacgacctcccgcagcgccttctcgacccacaattatcaggcccgcagagcccagcctgctggattag

SEQ ID NO: 221412 - DNA, 1461 bp, Artificial Sequence
  Description of Artificial Sequence: Synthetic coding sequence
cacgtcacagtagcagcagccgattcgtggaaacccccagccagcgctcaacacgtcgggcgagcgccaagagctggcgcagccacatgtttccttggaccacggccaccctcgcatctaggtggcagagacttccttccacggggatccggcatagtcactagaagacccctgattttacagctgatcttcagtaagacagagcacgctgagttcctgcactgcaagtctaagaagttcaccgactttgatgaggtaaggcaggaaatcgaagctgagacggatcgcgtgactggaaccaacaagggcatctcaccggtacccatcaatctgagggtgtattcccctcatgtgttgaatctgaccctcattgacctccctggaataaccaaggttcccgtgggcgatcagccgcctgacatcgaataccaaataaaagacatgatcctacagttcatttcccgcgagagctctctcattctagccgttacccccgctaacatggaccttgctaatagcgatgcactaaaactggcaaaggaagtggatccccaggggctcaggaccatcggagtcattaccaagctggatctgatggatgagggaacggatgcgcgtgacgtcctggagaacaaacttttaccccttcgacggggatacatcggtgtagtgaatcggtcccaaaaggacatcgaaggcaagaaggatataagagccgctcttgccgctgagcgcaagttcttcttgagtcatcccgcatatcggcacatggcagaccggatgggtactccacaccttcagaagaccctgaaccagcaactgaccaaccatattcgagagtcactccctgctctcaggtcaaagttgcagtctcagcttttgtcactggaaaaggaggtagaggaatataaaaactttcgcccagatgaccccacaagaaaaacaaaagcattactgcagatggttcagcaatttggggttgattttgagaagagaatagagggcagtggggatcaggttgatactctggagctgtcgggaggggctagaataaataggatatttcatgagagatttcctttcgagcttgtgaagatggaatttgacgaaaaagacttacgacgtgagataagctacgctataaaaaatatccatggcgtgcgaaccggcctgtttacccctgatatggcctttgaagcaattgtgaagaaacagatagttaagctgaaagagccttctttaaagtgtgtagatctggtagtttccgaattagcaacagtgattaaaaagtgcgccgagaagctctcctcttacccgaggttgagagaagaaacggaaaggatcgtgacaacatacattcgagaacgggaaggccgtaccaaggatcagatattgctcctgatcgacatagaacaaagttatatcaataccaatcatgaagactttataggctttgcttag

SEQ ID NO: 221413 - DNA, 2613 bp, Artificial Sequence
  Description of Artificial Sequence: Synthetic coding sequence
atgggtaatcgaggcatggaggagctcatcccactggtgaacaagttgcaggacgcctttagcagcattggtcaatcctgccaccttgatctaccacaaatcgccgtggtcggaggtcaatctgctggaaaatctagcgtgctcgagaactttgtgggcagggactttttgccccgtggctctggcatagttacgcggcgacctctgatcttacagctcatattcagcaagactgaacatgccgagttcttgcactgtaagtctaagaaattcacggactttgacgaagtacggcaggaaattgaggctgagactgatagagtgacgggaacaaacaaaggaatttcccctgtccccatcaacctgcgggtatacagcccacacgtcctgaacctgaccttgatcgacctgccagggattacaaaggtccccgttggcgaccagcctcctgatatcgagtaccaaattaaggacatgatcctgcagtttatcagccgggaatcgtcgctgattctggcggttactccagccaatatggatcttgccaactccgacgctctgaagttggccaaggaggtcgatcctcagggcctcaggactattggcgtaatcactaagctggacttgatggacgagggtactgatgcacgagacgtccttgagaataagctgctccctctgcgaaggggatacatcggcgtggtgaataggagtcagaaggatatagaaggcaagaaggacattagagctgccctagccgcagaaagaaagttcttcctgagccaccccgcttaccgacatatggctgaccgcatgggaacccctcacctgcaaaaaactctgaatcagcaactgaccaatcacattcgtgagagtctccccgcattaaggagtaagctgcagagtcagctgctgagcttggaaaaggaagtggaggagtataagaattttcgcccagacgatcccacgcggaagaccaaggcgctgcttcagatggttcagcagtttggagtcgactttgaaaagcgaatcgagggttctggggatcaggtcgacacgctggagctttccggtggggctcggatcaatcggatcttccacgagaggttcccatttgagttggttaagatggagttcgacgagaaggatctcaggcgggaaattagttatgctatcaaaaacatacacggcgtccgtacaggcctttttacacccgatatggcattcgaggccattgtgaagaagcagatcgtgaagctgaaagagccctccctaaagtgtgttgatctcgttgtgtcagagctcgccacggttatcaaaaagtgcgccgaaaaattgagtagctaccctcgactgagggaggagactgaaagaatcgtgacaacatatatcagagaacgggaggggagaactaaggaccagatcttactccttatcgacattgaacagtcgtacatcaatactaaccacgaggattttatcggtttcgccaatgctcagcagaggagtacacagttaaataagaaacgcgctataccaaatcagggggaaattctagtgattaggcgtggctggttaactatcaataatatttcactaatgaaaggtggcagtaaagagtactggttcgttctgacagctgagtccttgtcatggtacaaggacgaggaggaaaaagaaaagaagtatatgctgcctctggacaatcttaagatacgcgacgtggagaagggctttatgtcgaataaacacgtatttgccatcttcaataccgaacaacgcaacgtgtacaaagatctgcgccagatcgagcttgcctgtgactcacaggaggatgtagatagttggaaggctagctttctgcgtgccggtgtctatcctgaaaaggatcaagctgaaaatgaagacggcgctcaagaaaatacattctccatggacccccagctcgagcgacaggtggaaactattaggaatctagtggattcttacgtggctataattaataagtcaattcgggatctaatgccgaaaaccatcatgcaccttatgatcaacaatacaaaggcctttatccaccacgagctgctcgcttacctttacagttctgcggaccagtcctctctgatggaggagagcgccgatcaagcccagcggagggacgacatgctgcgaatgtatcatgccctgaaggaagcgctgaacatcatcggggacatatccacatctaccgtgtcgactcctgttccaccccctgtagatgacacttggctccagagtgcctcatcccattctcctactccacagcgccgtcccgtcagttctatacatcctccaggccgacccccagccgtcaggggcccaaccccgggtccacccctgattccagtgcctgttggcgcagcagccagttttagcgcccctcccattccctccaggccaggccctcagagtgttttcgcgaacagtgatctgttccccgcacctccccagatacctagccgacctgtccggattccaccaggcattccaccaggtgtgccaagtcgtcgcccacccgcagccccaagcagacccaccatcatcagaccagcggaaccttcgttactcgactag

SEQ ID NO: 221414 - DNA, 2601 bp, Artificial Sequence
  Description of Artificial Sequence: Synthetic coding sequence
atgggaaatcgtggtatggaggagttaattcccctcgtcaataaattacaagatgcctttagttctatcggacaatcctgccaccttgacctaccacaaatcgccgtagtggggggacagtccgccggaaaaagtagtgtgctcgagaactttgtgggacgcgatttcttgcccagggggtccggaattgtgactagacgccctctgatcttgcaactgattttttccaagaccgaacacgcggaattccttcattgcaagagtaaaaagtttactgactttgacgaagtaaggcaagaaatcgaagcagagacggatcgggtgaccgggacaaacaaaggcatcagccccgtgccgattaatcttcgtgtgtacagtccacacgtgctgaatctgacgctaattgatctgcccggtattacgaaggtccccgtgggcgaccaacccccagacatcgaataccagatcaaggatatgatactccagtttatttcaagggagtctagcctgattttagccgtcacgccagccaatatggatttggctaattccgatgccctcaaattagccaaggaagtggacccgcagggccttaggacaatcggcgtgattaccaagctggacttgatggacgaggggaccgatgccagggatgtgctggaaaataagctgctccccctgcgtagagggtatatcggcgtggtgaaccggtctcagaaagatattgagggaaagaaggatatacgggcagctttggctgcagaacggaaattttttctgagtcaccccgcttatcgccacatggccgatagaatgggcacaccccatctgcagaagaccctaaatcaacaacttacaaaccatatcagggagtccctgccagctctgcggtctaaactccagagtcaattgctgagcctggaaaaggaggtggaagaatataagaattttcgcccagacgaccctacgagaaagaccaaggctctgttacagatggttcaacagttcggggtcgattttgaaaagagaatcgaaggtagcggggatcaggtggacaccctcgaactgagcggtggggcacgcatcaatcggattttccatgagcgttttccttttgagctggtgaagatggaatttgatgaaaaagaccttcgccgagagatttcttacgccattaaaaacattcatggggtgcgcaccgggctgtttactcccgatatggcttttgaggcgattgtgaaaaaacagattgtaaagctcaaggagccgtccctcaagtgtgtggacctggtagtgtctgagctcgctactgtgatcaaaaaatgtgccgaaaagctatcgagctatcccagactccgcgaggagacagagcgcatcgtcactacctatatacgcgagcgagaaggcaggaccaaggatcagatcctccttctgatcgacattgaacagtcctacataaacaccaaccatgaagatttcattggtttcgcaaacgcccagcaacggtctacgcaactgaataagaaacgcgcaattccaaatcaagtaatccgaaggggttggttgactattaacaacatatcactcatgaaagggggaagcaaagaatactggtttgtgctgaccgccgaaagcctgagctggtataaagatgaggaggagaaagaaaagaagtacatgttacccctggacaatttaaaaattagagacgtggagaagggattcatgtccaataagcacgtgtttgccatcttcaacacagaacagcgcaacgtctataaggacttgcgccaaatcgagctggcatgtgacagccaggaggatgtggatagctggaaggccagctttctgcgcgcaggagtatacccggagaaagaccaggctgaaaatgaagacggcgcacaggaaaacaccttcagcatggaccctcagctggaacgccaggtcgaaaccatccgcaacctggtcgattcctacgtcgcaattattaacaagagtatccgcgatctgatgcctaagacaatcatgcatcttatgatcaacaataccaaagcctttatacaccacgagcttctggcttacttatatagctccgcggaccagtcttcccttatggaggagagcgccgatcaggcacagagaagagacgacatgctgagaatgtaccacgcactgaaggaagctctcaacattataggcgacatttcgacgtctactgttagcacacctgttcctccacctgtggatgatacctggctgcaaagcgcctcatcccactccccaacgccccaacgcaggcctgtaagctcgatccacccccctggaaggcctcctgccgtgcggggtcccaccccaggcccacccctcatacccgtgccagttggcgcagcagcctcctttagtgcaccccctatccccagccggccaggaccacaatccgtcttcgccaattcagacctgtttcctgcaccccctcagattccaagtaggcccgtgcgcatcccacccggaattccacctggggtcccttcacggcgtcctcctgctgccccatctcggccaaccataattaggcccgctgaacccagcttgctggattag

SEQ ID NO: 221415 - DNA, 1200 bp, Artificial Sequence
  Description of Artificial Sequence: Synthetic coding sequence
atgctcccactggagccatacttgacccagactagcgccgtgccgcaaatgtcacattttatgtgccactcacccacgcacaagccacagggcctgctgccatgggccccattccaccaggcctcagtgtccctgtaccccatctctccttggccctcagagtccgtctgccctcctacctgtcccggtggagcgtcttgctggttccccgctgggaatgcatgggatagagtggagcttgggttcctagggttcggggcagggggagttagcatcgctgtgcccggttttccgctgtcatgcgggcaaggctgctgtgccggaggctggctggggcatggcgctcgattccctgctaaacttcgggcatttccacaagtaatcaggaggggctggctcaccataaacaacatctccctgatgaaaggagggtctaaggaatattggtttgttctaactgctgaatcactgtcttggtacaaggacgaagaggaaaaagagaagaaatacatgcttccgctcgacaatttaaagatccgagacgtggaaaaaggctttatgtccaataagcacgtgttcgctatttttaacaccgagcaaaggaacgtctacaaggatcttcggcagatagagctggcgtgcgacagccaggaagacgtcgacagctggaaggcctcttttttacgggctggagtatatcccgaaaaagaccaggccgaaaacgaggatggcgcacaagaaaacacattctccatggaccctcaacttgaaagacaggtggagaccatccggaatctggtggatagctacgtggcaatcatcaataagagtatccgagatctgatgccaaaaacgattatgcatctgatgattaataatacaaaggcctttatccaccatgaacttctcgcgtatctttatagctctgcagaccaaagttctttgatggaggagagcgccgatcaggcacaaaggcgggatgatatgctgcgcatgtaccacgccttgaaggaagcattaaacattatcggcgatatatcaactagtaccgtttccactcccgttccaccacctgttgatgatacttggctgcagagcgcctcctcacacagtcccacaccacagcgccgtccagttagtagcatccatcctcctggacgacccccagctgtccgaggtcctacccctggccctccgtag

SEQ ID NO: 221416 - DNA, 13284 bp, Artificial Sequence
  Description of Artificial Sequence: Synthetic coding sequence
atgtcttcaaaagccgaaaaaaaacaacggcttagtggacgcggatcaagccaagcgtcgtggtccggtagagcgacgcgggcagctgtggccacgcaggaacaagggaacgctcctgctgtttccgaaccagagctgcaggccgagctacccaaggaagaacccgaaccaagactggaaggcccacaagctcagagcgaggagagcgtggaacctgaggccgacgttaaacccctgttcttgtcccgcgctgccctaactgggctagccgacgccgtgtggactcaagagcacgacgcaatcctcgagcacttcgctcaggaccccactgagtccatcctcacaatctttatcgacccctgctttggccttaagctcgaacttgggatgcccgtgcagacccagaaccaactggtatacttcatccggcaggccccagtgcctatcacctgggagaatttcgaggccaccgtgcagttcggcactgtgagaggcccttacatccccgctctgctcagactgctggggggtgtctttgcgccacagatcttcgccaataccgggtggcccgaaagcatacggaaccattttgcctctcatcttcataagttcctggcatgcctgaccgatacacgatataaactcgaaggccacactgtgttgtacattcccgctgaggctatgaacatgaagcccgagatggtcattaaggacaaggaactcgtgcaacggctggagactagcatgatccactggacaagacagatcaaggagatgctttctgcccaggagacggttgagacaggcgagaacctgggtccactggaagagatcgaattctggcggaaccggtgcatggacctgtccgggatctccaaacagctcgtgaagaaaggcgttaagcatgtggagtccattctgcacctagccaaaagttcttatctagccccttttatgaagttagcacagcagatccaggacggttcccggcaggctcaaagcaacctgaccttccttagcatacttaaagaaccttaccaagagctggccttcatgaagccaaaggacatctcaagcaaattacccaagctcatctccctgattagaataatctgggttaattctccccattacaacacccgggaacgtctgacaagcctgtttaggaaagtctgcgactgccagtatcattttgccaggtgggaggacggcaaacagggaccccttccgtgtttcttcggtgcccaagggccacagatcaccagaaacttgttagaaattgaggacattttccataaaaaccttcataccctgcgtgccgttcgcggaggaattctggacgttaaaaacacatgctggcacgaagactataacaaattccgggctggaattaaggatctggaggtcatgacgcaaaacctaataacctctgcgtttgaactggttagggacgtcccccatggtgtgctcctgctcgatacctttcatcggctggcatctcgggaagctattaaaagaacttacgacaaaaaggccgtggatctatatatgctgttcaatagcgaactggcgttggtgaatagagaaaggaataagaaatggcccgacctggagccgtatgtcgcccagtactctggcaaagcaagatgggttcacatccttcgcagacgtatcgaccgcgtcatgacttgcctggccggtgcgcattttcttccgagaataggtaccggcaaagagagtgtacacacttatcaacagatggtccaagcgatagacgaacttgtccgtaaaaccttccaggaatggacctcgagccttgacaaagactgtattagacgactcgatactcctttgttaagaatcagccaagagaaggccggaatgctggacgtgaattttgacaaaagcttgctgatcttatttgcagagattgactactgggagcgcctcctcttcgaaactcctcactatgtggtgaatgttgcagagcgggctgaggatctaaggattctcagggagaacttactcctggtggctcgagattataacagaattatagcgatgctcagcccagacgagcaggccctgtttaaggagagaatcagacttcttgacaagaagatccacccgggacttaaaaaactccactgggccctgaagggtgcttccgcatttttcatcaccgaatgccgcatccacgcctccaaggtgcagatgatagtcaatgaattcaaggcctccacactcaccattggatggcgcgctcaagaaatgagcgagaagcttctagtgcggatctccggaaaaagagtttatagggatctcgaattcgaagaagaccagcgtgagcatagagccgcagtccagcagaagctgatgaacctgcaccaggatgtggtgaccattatgactaactcatacgaagtcttcaagaacgatggaccggaaatccagcagcaatggatgctgtatatgatcagactcgaccgcatgatggaggacgctctcagactgaacgtgaaatggtcgttgctggagctgagcaaggccatcaatggcgacgggaagacttcacctaaccctctttttcaggtgcttgtgatcctcaaaaacgatctccagggctccgtggctcaggtcgagttctctcccaccctgcaaacgctggctggggtagtgaatgatattgggaaccatttattttcaacaatcagcgtattctgccatctgccggacatcctcacaaaacgcaagctgcaccgcgagcccatacagactgtagtagaacaggacgaggacataaagaagattcagacccagatttctagtggcatgactaacaatgcatcgttactgcagaattatctcaagacctgggacatgtatcgcgagatctgggagatcaataaagattcatttattcacaggtaccaacgcctgaatcccccagtgtcgtcattcgttgccgacatcgcacggtatacggaggtcgccaataatgtgcagaaggaggagacggtcaccaacattcagttcgtgctactcgactgttctcatcttaaatttagtctggtccagcattgcaacgagtggcagaataagttcgctaccctcctacgcgaaatggccgcagggagactgcttgagctgcacacctatttaaaagagaatgccgaaaagatctcgcgaccacctcagacattagaagaactcggtgtgtcgctgcagttagtggatgcactgaaacatgacctcgccaatgtggagactcagattcccccaatacatgaacagtttgctattcttgagaagtatgaggttcctgtcgaagatagcgtgcttgaaatgttggactcattgaacggggagtgggttgtgtttcagcaaacactccttgatagcaaacagatgctgaagaagcacaaagagaaatttaaaacaggtctgattcacagtgcagatgattttaaaaagaaggcacatacactgttggaagacttcgagttcaaagggcacttcacctccaacgtcggatatatgtccgcccttgatcagattacgcaggtgagagccatgctgatggccatgcgagaagaagagaatagcctcagagcgaatctgggcatattcaaaatcgaacagccgcctagtaaggacctgcagaacctagaaaaagaactcgatgctctccaacagatatgggagatcgcccgtgattgggaggaaaactggaatgaatggaagaccggccgattcctgatccttcagaccgagaccatggagactaccgctcatggactcttcagaagactaacaaaactggccaaagaatataaggatcgcaattgggagatcattgaaacaacccgatctaagattgagcaattcaagcgcacaatgcctctgataagtgacctgcgcaaccctgccttaagggagcggcattgggatcaagtgcgcgacgagattcagagagagttcgaccaggagtccgagagtttcacactagagcaaattgtagaacttggtatggaccagcatgttgaaaagattggggaaattagtgccagcgccacaaaggaactcgctatcgaggtcgcacttcagaacatagcaaaaacctgggatgtaacccagcttgacattgtcccctacaaggataagggccatcaccggctccgcggaacagaagaggtgtttcaggccctggaggacaaccaagttgctctgagtaccatgaaagcatccaggttcgtgaaggcctttgaaaaagacgtggatcactgggagcgctgcctttcccttatcctcgaggtcatcgagatgattctgaccgtgcaacgtcagtggatgtatcttgagaatatctttttgggtgaggacatccgcaaacaactgcccaacgagtcaactctattcgaccaagttaattctaattggaaggcaatcatggatcgtatgaacaaagacaacaacgcgctcagatctacccaccatccgggtcttctggacactctcatcgagatgaatactatcctggaagacatccagaaatccctggacatgtacctggagaccaaacggcacatctttcctcgcttttatttcctcagcaatgacgacctcttggaaatcctaggtcagtctagaaatcctgaggccgttcagccacacctcaagaaatgctttgataatatcaaactcttgcgaatccagaaagtgggagggccatcttccaagtgggaggccgttggtatgttctccggcgacggcgagtatatcgattttcttcattcggttttcctcgaaggcccagtagagtcatggctgggcgatgtcgaacagaccatgcgtgtgactctgagagatctcctcaggaactgtcacctggctctacgcaaatttctgaacaagagggataaatgggtgaaggagtgggcaggtcaggtagtgattaccgcctctcagatccaatggactgctgacgttaccaagtgtctcctcaccgctaaggaaagggcagataagaagatcctgaaggtgatgaagaagaaccaggtaagcatacttaataagtatagcgaggctatccgcggaaatctcacgaagattatgcgcctgaagatcgtcgctctagtcaccatcgaaattcacgcaagagatgttttagagaaactctacaagtcgggcctgatggatgtgaatagttttgactggctctctcaactgcgtttctactgggaaaaggatctggatgactgtgttatccgccagacaaacactcagtttcagtacaattatgagtatttgggaaattcagggagactggtaatcacaccgctcacagacaggtgttatatgactctaaccacggctttacacctgcacagaggcggaagcccaaaaggccctgctggcacaggtaaaacagaaacagtaaaggatctcggaaaggcacttgggatttacgttattgttgtgaactgctccgagggattggattataagagcatggggagaatgtactccggcctggcccagactggcgcatggggatgcttcgacgaatttaatcgcataaacatcgaagtgcttagcgtggtggcgcatcaaattttatgcatcctttcagccctggctgccggactgacacactttcacttcgatgggtttgagatcaaccttgtgtggtcctgcggaattttcatcacgatgaatcccggatacgctggcagaacggaactacctgagaacctgaaatctatgtttaggcctattgctatggttgtgcctgacagcactctgatcgccgaaatcatactcttcggcgaggggtttggtaactgcaagatactcgcaaaaaaagtctatactttgtattccttggcagtgcagcagctcagtagacaggaccactatgactttggtctgcgggctctgacaagcctgctgaggtatgccggaaagaagagaagactgcagcctgacctcaccgacgaagaagtgcttcttctttccatgcgtgatatgaatatcgccaaactgacaagtgtcgatgcaccattgttcaacgcgattgtccaggacctctttccaaatattgagctgcccgtgatagattatgggaaactcagagaaaccgtcgaacaagaaatccgggatatgggattgcaatctacacccttcacactgaccaaagtttttcagctctacgagacgaaaaattcccggcatagtaccatgatagtcggctgcactggctctggcaagacagcgtcttggcgtatactccaggcctcactatcctctctgtgtagagctggcgatccaaacttcaatatagtacgtgaatttccactgaaccccaaggccttgtcactgggcgaactctacggcgaatacgatttgagcaccaatgagtggacagacgggattctgtccagcgttatgcgcacagcgtgcgccgacgagaagccagatgagaagtggatactgttcgacggccctgtggataccctgtggattgagaacatgaattccgtgatggacgataataaggtgttgacattgatcaacggcgaaagaattgccatgcccgaacaggtctccctgctgtttgaggtggaggacttagctatggcaagccccgctacagtgtcccgatgtgggatggtgtacaccgactacgctgacctaggctggaagccatacgttcagtcttggctggagaagcgaccaaaggcggaggtggagcctctgcagcgcatgttcgaaaaactcatcaacaaaatgctcgccttcaaaaaggacaactgcaaggagttagtgccgcttcccgagtactccggcatcacctccctgtgtaaactctacagcgctctcgccacaccagagaatggagtaaatcctgccgatggcgagaactatgttactatggtggagatgacttttgtgtttagcatgatttggagcgtctgcgcgagtgttgacgaagagggtcgaaagcgcattgatagctacctccgagagatcgagggctcatttcccaataaggacaccgtgtacgaatactttgtggatcccaagatccggtcatggacttcttttgaggacaaactccctaagagctggcggtaccctcccaacgccccattttataagatcatggtcccaactgtggacaccgtcaggtacaactatctggttagcagtcttgttgctaaccagaaccctattctgctggtgggacccgtaggtaccgggaaaaccagcattgcccaaagcgtactccagtcactaccatctagccaatggtctgtcctcgttgtgaatatgtcagcccaaaccaccagcaacaacgtgcaatcaatcatagagtccagagtggaaaagaggaccaaaggagtttatgtacccttcgggggaaagtctatgattacatttatggacgatttaaatatgcccgcaaaggatatgttcggctcccagcctccgctagaactgatccgcttgtggatcgactatggcttctggtatgataggaccaagcaaactattaaatatatcagggaaatgtttctcatggccgctatgggccctccgggaggcggacgcaccgtcatctcccccagactgcggagcagattcaacatcataaatatgaccttcccgaccaagtcacaaatcatcagaatattcggcactatgatcaaccagaaactccaggactttgaggaagaggttaagcccattggcaacgtcgtaactgaagccacccttgatatgtataataccgtggtgcagcggtttttgcctactcctacgaaaatgcattacctattcaatctgagagacatcagcaaagttttccagggcatgcttagagctaacaaagatttccatgatactaaatccagcattactcgcctgtggattcacgaatgcttccgggtgttcagcgaccgactggtggatgccgcagacactgaggcctttatggggatcattagcgacaaactcggttcgttctttgacctcacattccatcacctttgtccatcgaagagaccacccatatttggagatttcttgaaagagccaaaagtttacgaagatctgacagatttgaccgtcctgaagaccgtcatggaaaccgctctgaacgaatataatctgagcccatccgtggtccctatgcaactcgtgctttttagagaggcaatagagcatatcacgaggatcgtgagggttatagggcaacctcggggaaacatgcttcttgtcggtataggcggaagcggcaggcagagtctagctaggcttgcgagttcgatttgtgattataccacttttcagatcgaagtcaccaagcactaccgcaagcaggagttccgggacgacattaagagactgtatcgccaggccggagtcgaattaaagacaaccagtttcattttcgttgacacacagatcgccgacgagagctttctcgaggacattaataacatattgagctccggcgaggttcccaacctctacaagccagacgagttcgaagaaatccagagccatatcatcgatcaggctagggtggaacaagttcctgaaagctcagatagcctcttcgcctatcttatcgaacgggtgcagaacaacctgcacatcgttctgtgtctatcacccatgggtgacccttttcggaattggatcaggcagtatccagcactggtaaattgtacgacaatcaactggtttagcgaatggcctcaagaagcactgttagaggtggcggagaagtgccttattggtgtcgatcttggcactcaggaaaacattcatagaaaagtcgcacagattttcgtcaccatgcactggagcgtagcccaatactcccaaaagatgctgcttgagttgcgcaggcataactacgtcacaccgaccaagtatctggaactactgtctggatataagaaattgctgggcgaaaagcgtcaggagttactcgcccaggctaacaaactgcggacaggcctttttaaaattgatgaaacccgggagaaggtgcaggttatgtctttagagctggaggacgccaagaaaaaagtggcagagtttcagaagcagtgcgaggaatacctggtaatcattgtgcagcagaagagagaagccgatgaacagcagaaggccgtcactgccaattccgagaaaattgctgtcgaggaaattaagtgtcaggccctggccgacaacgcacagaaagacctcgaagaggctctgcctgccctagaagaggccatgagagctctcgagtccttgaataagaaggatatcggggagatcaagtcgtacgggaggccacctgctcaagtagaaatcgtgatgcaagctgtcatgattttgcgaggcaacgaaccgacatgggccgaggccaagcggcagctcggggagcagaattttatcaagtctctgattaacttcgataaagacaatataagcgacaaagtactgaagaagattggcgcttattgtgctcaaccagacttccaacctgatataataggtagggtatctcttgccgcaaaatcgctgtgtatgtgggtgagggccatggaactctatggcagactttaccgtgttgtagaacccaaacgcatccgtatgaacgcagctcttgcccagttaagagagaagcaggccgctttagccgaagcccaagaaaagttgagggaggtagccgagaaactcgagatgctgaagaaacagtatgacgagaaattagctcagaaagaggagctgaggaagaagtccgaggagatggagctgaagctcgaacgcgctggcatgttagtttcaggccttgccggagaaaaggcacgctgggaagagaccgtgcaaggcctagaggaggacctgggatacctggtgggtgactgtcttcttgccgctgcttttttgtcctacatgggaccattcttgactaattacagagacgagatcgtgaaccagatctggatcggaaagatctgggagctgcaggtgccgtgtagcccaagcttcgcaatcgacaatttcctctgcaacccgaccaaagttagggattggaacatacagggtttgccttctgatgccttctccaccgagaatggcatcattgtcaccagaggtaatcggtgggccttaatgatcgacccacaggcccaggctcttaaatggatcaagaacatggagggcggacaagggcttaagataattgaccttcagatgtctgattatctgcggattctggagcacgcaatccatttcggctatcctgtgttgctccagaacgtgcaagagtatcttgaccccacgctcaatcctatgctgaataaatcggtagccagaattggaggacgactgctgatgcggatcggcgacaaggaagttgaatacaacaccaattttcggttttacattaccaccaagctctctaatccccactactctcccgaaacgtcagccaaaacaactattgttaacttcgccgtgaaggaacaaggcctggaagcgcaattgttgggtatcgtcgtccgaaaggagcgtccagaattggaggagcagaaagattccctagtcattaatattgcagcaggcaagaggaagctcaaggagctggaggatgaaatcctgagactacttaacgaagccactggttccctattagatgacgtgcagttagttaatacattgcacacatcgaaaatcacagctacagaggtgactgaacaactggaaacatcggaaaccacggaaattaacactgacctggctcgggaggcatatagaccatgcgcccagagagccagcatcctgttcttcgtcttgaatgatatgggatgtatcgacccaatgtatcagttctctctggatgcatatatctcgctttttatcctcagcatcgacaaaagccatagatcgaacaaactggaggaccgaattgactacctcaacgactatcacacatatgctgtgtaccgatacacctgcagaacgctgtttgagagacataaactattgttttcctttcatatgtgcgcaaagatactggagacatcaggcaaattgaacatggatgaatataacttctttctgcgaggaggtgtggttctagaccgggagggccagatggataacccatgctcttcctggttggccgacgcatattgggacaatataacagagctagataaactcaccaacttccacggtctgatgaactcttttgagcaataccccagagattggcatttgtggtataccaacgccgctcctgaaaaagccatgttgcccggtgagtgggagaacgcctgtaatgagatgcagcgcatgctcatagttcgatcgctgcggcaagaccgagtcgcattttgcgtgacttccttcatcataactaacctgggatctcgcttcattgaacccccagttctgaatatgaagtctgtgttggaggattctaccccgagatctcccctcgtgtttatactttcccccggagtggatcccacgtcagctctcctgcaacttgcagagcatatgggaatggctcagagatttcatgctctgtccctggggcaggggcaggcaccaattgcggcacggctgcttcgagagggggtgactcaggggcattgggttttcctggcaaactgccacctctccctgagctggatgccaaatctagacaagctagtggaacagcttcaggttgaagacccccacccaagcttccgcctctggctgtcgtccatccctcatccagattttcctatctccattcttcaggtgagtattaaaatgaccacagaaccacccaaaggactgaaggctaatatgacccgcctgtatcaactgatgtcggagccacagttctcgaggtgtagcaagccagcgaaatataagaagcttctgttttccctgtgtttttttcactccgtgctgctggagcgaaaaaagttcctgcagcttggatggaacatcatctacggatttaatgattcagactttgaagtgtctgaaaatctgctgagcctgtatctagatgagtacgaggagacgccttgggacgctctcaagtacttaatcgcaggcatcaactatggtggtcacgtcactgacgattgggatcgaagacttctcacgacctacataaacgactatttttgcgaccagagcctgtctactcccttccataggctgtctgcactcgagacatattttatccctaaggacggctctctcgcgagctacaaggagtacatctccctgctgccaggaatggatccacccgaagccttcggccaacatcctaacgcagacgtcgcttcccagatcactgaagcccagaccctgtttgatactctgcttagcctgcagcctcaaattaccccaacccgggctggtggccaaaccagagaagagaaggttctggaactggcagcagatgtgaaacagaagatcccagaaatgatcgattacgaggggacccagaagttgctagcgctggatccttcacccctcaatgtggtgttactgcaggagattcagaggtataataccctgatgcaaactatcctcttttcactcactgacctcgagaagggaattcaaggcctcatcgtgatgagtacaagcttagaggaaatcttcaactgcattttcgatgcccacgtgccccctctctggggtaaagcgtatccaagtcagaaaccactcgctgcatggactcgcgacctagctatgagggtagagcagtttgagctctgggcaagcagggcccgtccccctgtcatcttctggctctcaggttttacattccccaccgggtttctcaccgccgtgctgcagagctccgcaaggcagaataatgtttcggtggactcactcagctgggagttcatagtgtcaacggtcgacgacagcaatctggtttatccgcctaaagatggcgtgtgggttaggggcctctatctcgagggcgctggctgggacaggaaaaattcatgtcttgtggaggctgagcctatgcagcttgtttgtctgatgccgactatccatttcaggcctgcagagtcccgcaagaaatctgcgaagggtatgtacagctgcccatgctactattatcccaaccgggctggtagctctgatcgtgctagcttcgtgatcggcatcgaccttagaagtggcgctatgacaccagatcattggattaagcgcggtacagcactcttgatgtccctggatagctac

SEQ ID NO: 221417 - DNA, 1782 bp, Artificial Sequence
  Description of Artificial Sequence: Synthetic coding sequence
atggaaattgtctacgtatacgtgaagaagcgctccgagttcggaaagcaatgtaacttctctgaccgccaggcagagctgaacattgacataatgcccaatcccgagctggctgaacaatttgtggaacggaatcctgtggacactggaattcagtgtagtatctcgatgtcagagcacgaagcgaatagcgagcgtttcgagatggaaactaggggagtgaatcacgtcgaaggcggatggccgaaagacgtcaatcccctggagctcgaacagactatccgctttcggaaaaaagtggaaaaagatgaaaactatgtaaacgctatcatgcagcttggctctatcatggaacattgtatcaagcagaataacgccattgacatttacgaagaatacttcaatgacgaagaggcgatggaggtgatggaagaagaccccagcgccaagaccattaatgtgttccgcgatcctcaggagatcaagcgggcagctacacacctgtcttggcacccagacgggaacaggaagcttgccgttgcctattcatgcttggactttcaaagagctccagttggcatgtcctctgattcttacatatgggacctggagaacccgaacaagcccgaactggcgttgaagcctagttctcccctggtcactctggagttcaaccccaaagactcccatgtactacttggtggatgctacaacggacagattgcgtgttgggatacacggaagggctcactggttgccgaactgtcaaccatagagtcatcacaccgcgatccggtttatgggactatttggctgcagagcaagaccggcaccgaatgcttttccgcttccactgatgggcaagttatgtggtgggatatacgcaagatgtctgagccaaccgaggtggttattctggatataacgaaaaaggagcagctcgaaaacgccttgggcgcaattagcttggaattcgaatccaccctgcctacgaagtttatggtggggacggagcagggaatcgttatcagctgcaatcgcaaggcaaagacctccgccgagaagatcgtatgtacatttccaggccaccatggtcccatctatgcgttgcagagaaaccctttctaccctaagaacttcttgaccgttggcgattggaccgccaggatttggagcgaagattctagggaaagttctataatgtggactaagtaccatatggcttacctgaccgatgccgcatggtctccggttcggccaaccgtgttcttcactaccagaatggatgggacgctggacatttgggattttatgttcgagcagtgcgaccctaccttgagcctgaaagataacggttgccttattgcttgcgggagccagctggggactacgaccctgttggaggttagcccaggccttagcacattgcagagaaacgagaaaaacgtagcttcttctatgtttgaaagagagacccgtcgagagaagatactcgaagccagacatagggagatgcggcttaaggaaaaaggaaaggcggagggaagggacgaggaacagacagacgaggaactcgcggtcgatctcgaagctctggtatctaaggcagaagaagagttctttgatatcattttcgcggagctgaaaaagaaggaggctgacgccatcaagttaaccccagtccctcagcagccttctcctgaagaagaccaggtggtggaggagggcgaggaagcggcaggggaggagggagacgaagaagtggaagaggacctggcctag

SEQ ID NO: 221418 - DNA, 2676 bp, Artificial Sequence
  Description of Artificial Sequence: Synthetic coding sequence
gagaaggacaacgggttggatgtctttaagctcagcgatcgcgattttctgagatctatggaaaacgccatccggtttggcaaaccttgtctgcttgaaaacgtgggcgaggagctggaccccgctcttgagcccgtgcttctgaagcagacttataaacagcaaggcaacacagtgcttaagctgggtgacactgtcattccctaccacgaggattttagaatgtacatcacaactaagctaccgaatccccattatactcccgagattagcacaaagcttacattaattaattttacactaagcccttctggccttgaggaccagctgctcggccaggttgtggcagaagagagacctgatctggaagaggctaagaaccagcttatcatttcaaatgccaagatgcgccaagagctaaaggacatcgaggaccagatcttgtacaggctgtcttcatccgaggggaatcccgtggatgacatggagttgattaaagttctggaagccagcaagatgaaggctgccgaaatccaagctaaggtacgaattgctgaacagacagaaaaagatattgatcttacccgtatggaatatattccagtggccattcggactcaaattctgttcttttgcgtgtccgacctggctaatgtggatccaatgtaccagtactcactcgagtggttcctgaacatctttctgtccggaattgcaaattccgagcgagctgacaacctaaagaagcgaattagtaacatcaacagatatcttacctactctctgtattcaaatgtgtgcaggtcccttttcgaaaagcataagcttatgtttgcttttttactctgtgttcgcataatgatgaacgagggtaagattaatcagtctgagtggcgctatctactgtccggcggatctatctccattatgacggagaacccagcgccagactggctctctgatcgggcttggcgggacatccttgccctgagcaacctacctacattttcaagtttcagttctgacttcgtgaaacacctatccgaattcagggtcatattcgacagcctggagccccaccgtgagcccctgcctgggatctgggatcagtatctggatcagtttcagaagctgttggtgctcaggtgcctgaggggcgacaaggtgacaaacgccatgcaggactttgttgccaccaatctggagcccaggtttattgagcctcagactgctaatctgagtgtggtgtttaaggattccaattctactaccccactgatctttgtgctcagtcccggaacagaccccgctgccgacctgtacaagttcgcagaggagatgaaattctcaaaaaagctcagcgccatctccctgggacagggacaggggccacgcgctgaggctatgatgcgaagctccattgagcgtggtaagtgggtgttcttccagaactgtcatttggccccatcttggatgcctgcgctagagagactgatcgaacacatcaacccagacaaagtccatcgagattttcgcttatggctgacgtccttgccctcgaacaaatttcctgtctccattctccagaatggttcaaagatgaccattgaaccaccacggggagtgagggccaatctgctgaagagctatagcagtttaggagaagactttctgaacagctgtcataaagttatggaatttaaaagcctactgttgtccctctgtctgttccacgggaacgctcttgaacgtcataagtttggtccccttggatttaacatcccatatgaattcaccgatggtgacttgcggatctgcataagccagttaaagatgtttctggatgagtacgacgacatcccctacaaggttttgaagtacacggccggtgagattaactatgggggacgagtgaccgatgattgggaccggcgatgcattatgaatatcctggaagacttttacaacccagatgtgctgtctccagaacacagctacagcgcctcgggcatttatcaccaaattcctccaacctacgaccttcacgggtatctgtcatatattaaatctctccctctgaatgatatgcccgaaatctttggtctgcacgacaatgcaaacatcacatttgcccagaacgagacgttcgcgttgctcggcactatcatccaactgcagccaaagtcctcttcagcgggttcccagggccgtgaggaaattgtcgaagacgttacccagaatatcctgctgaaggtgcccgagcccattaatctccaatgggtcatggctaagtaccccgtgctttacgaggagagcatgaacacagtactggtgcaagaagtcatacgctacaatcggctgttgcaggtaattacccagaccttacaggatttactcaaggccctcaagggcctggtggtcatgtcgtcacagctggagctcatggctgcttctctgtataacaatactgtgcctgaactgtggagcgctaaagcctacccaagcctgaaacctctcagcagttgggtcatggatctgctccagcgtcttgatttcctccaagcctggatccaggacggcatccctgcagtgttctggatcagcggctttttttttccccaggctttcaatcggcacagtgcggaattctgcccccagatttgccacctccattag

SEQ ID NO: 221419 - DNA, 12798 bp, Artificial Sequence
  Description of Artificial Sequence: Synthetic coding sequence
atggaacaacccaatagcaaggggtactcactgggcagaaccccccaggggccagagtgctcaagcgcccctgccgtgcaggtcggcacccatcggggactcgagtataaccccggaaaaattctgcctgggtcggactacggccttggtaatccgcctgctctggatcccaaattacctcatcttccccttcctcccgcacccccaaccctctccgatctggggcaaccacggaagagtccactaactggcaccgataaaaaataccccttgatgaaacagagaggcttctacagcgacatcctgagtcctggcactcttgaccagctcggtgaggtgtgccgaggccctaggatgtcccagaatttgttgcgacaggcagatctggacaagttcactcccagggtcggatctttcgaggtgccggaggacttccaagaacggatggagcaacagtgcattgggtcaacaacaaggctcttggcacagacagactttcccctgcaagcgtacgagccaaagatgcaggtaccttttcaggtgttgcccggacagcatcccaggaaaattgaaattgagcgccgaaaacagcagtatctcagcctggatattgagcaactgctcttctcacagggcatagatagtaataagttgatgccgaggcacttggatcaccagcaccctcagaccatcgagcagggccacgaccctatatttccgatttacctgccccttaaggtgttcgacaacgaagatttcgattgtcgtactcctcgggagtggataaacatgggcttagagcctggctcccttgaccgcaagcccgtgccgggaaaggccctcctgccaacagatgactttctgggccacgaagatccaaaaagccaaaagctcaaatataagtggtgtgaggttggtgtgctggattacgatgaggaaaagaagctctacttagtgcataagaccgatgagaaggggctggttcgtgacgagatgggtaggcctatcttgaatgccggagtaaccaccgagggaaggccccctctgcaagtgtgccagtattgggtcccacggatccaactgctgttttgcgcggaggatccgtgcatgttcgctcaacgggttgtccaggccaatgctctgcgcaagaataccgaagctctgctactgtacaatttatatgtcgattgcatgccatccgatggccagcacgtgatctcagagcagtcactgtcgaagatcaaacagtgggctctcagtaccccgaggatgagaaagggaccatctgttctggaacatctgtcatccttggcgcgagaagtctctttggattacgaaaggtcaatgaataagatcaacttcgaccatgtggtcagtagcaagcccgagactttcagctacgtgactctgcccaagaaagaggaggaacaagtcccagagagggggttagtaagtgtgcccaaatatcacttttgggagcagaaggaggatttcacattcgtttctcttctcacgcgcccagaagtgatcactgcactaagtaaggtgcgggctgagtgcaacaaagtgacggccatgtccctttttcactcctctctgtccaagtactcacatctggaggagttcgaacagattcagtctcagacttttagccaggtgcagatgtttctgaaagattcttggatctcatcgctcaaggtcgcaatgagatcaagtctccgggacatgtcaaaaggttggtacaacctgtacgagactaactgggaggtctatctcatgtcaaaattaagaaaacttatggaactcgttaaatacatgctccaagatacacttcgcttcctagttcaggattccttggctagtttttcacaatttatcagtgatacatgctgctctgtgctgaattgcacagatgacatggtctggggggacgatctgataaactctccctacaggcccaggaagaacccattgtttattatggatctggttctggacagtagcggggtccactacagcactcctcttgaacagtttgaggcatcccttctgaacttatttgataaaggcatccttgccactcacgcagtgccacagctagagaaactcgttatggaagacatctttatttccggagacccattactcgaatccgttggattgcacgagccactggttgaggagctacgggctacaatagctagcgccgtttcaaaggctatgatcccgctgcaagcctacgcaaaagaatatcggaagtatttggaactgaacaacaacgatattgcttcattccttaaaacttatcagacgcagggactgttggcccaagaagtccgcgaggtagttctaacacacctgagagaaaaagagatcttggactctagtctgccaagttctattattatcgggcctttttatattaacactgataatgttaaacagtctcttagcaagaagcggaaagccttggccactagcgtgctagatatactggcaaagaacttacacaaggaggtggactccatctgcgaagagtttagatccatctcaaggaaaatatatgaaaaaccgaattcaattgaagaactcgcggagttgagggaatggatgaagggcatacccgaacgcctcgtcggcctcgaagaaaggatagtgaaagtgatggatgattaccaggttatggacgaatttctgtataatctctcttcagacgacttcaacgacaagtggatcgcttccaactggcctagcaagatcctgggtcagatagaactggtgcagcaacagcatgtggaagacgaggagaagtttagaaagatacagatcatggatcagaataatttccaggaaaaactggaaggactccagctggtggtcgccggatttagtatacacgttgagatcagtagagcccacgagatcgctaacgaggttcgccgtgtcaagaagcagctgaaggattgtcagcaactggccatgttgtacaacaatcgcgaaagaattttttccctgcctatcaccaactatgataagctgtcacgaatggtgaaggaattccaaccctacctggacctgtggaccactgccagcgattggttacgctggtcagagagttggatgaacgacccgttaagcgccatcgatgctgagcagctggagaaaaacgttgtggaagcttttaaaacaatgcacaagtgcgttaagcagttcaaagatatgcctgcatgccaggaggttgcacttgatattagagccaggatagaagaattcaagccttacatccctctgatccagggcctacggaatccaggcatgcgtatacggcattgggagaccctgagcaaccagataaatatcaatgtgaggccaaaggccaatctaacgttcgccaggtgcctcgagatgaatctccaggaccacattgaatctattagcaaagtcgccgaggtggcaggcaaggaatacgccattgaacaggccctcgataagatggaaaaggaatggtcaactatcctgttcaatgtgctgccatataaagccacagacacctatatcctcaaatcacccgacgaagcctcccaactgcttgatgaccatatagtaatgacacagaatatgagtttttctccttataagaagccttttgagcagcggattaactcatgggaaaataaattaaagcttacgcaggaagtcctggaagaatggttaaactgccagcggtcttggctttatttggagcctattttctccagcgaggatatcaatcagcagctgcctgtcgagtccaagcgctatcaaacaatggagaggatctggaaaaagataatgaaaaatgcttacgagaatagggaagttataaacgtttgtagcgacctgaggatgctggattccctgcgcgactgtaataagatcctcgatttagtccaaaagggcttaagcgaatacttagaaaccaagcggtcggcctttcctcgcttctactttttgtctgatgatgagctcctggaaattctgtctcagactaaggatcccaccgcagtccagccacaccttcggaagtgcttcgaaaatatcgctcgtttgctattccaggaggaccttgagatcacgcacatgtactccgccgaaggagaggaggttcagttatgctttagtatctaccccagcagcaacgtagaagattggctgcgggaggtggagcgctccatgaaagcttccgtgcatgacatcattgaaaaggcaattagggcttaccctactatgcctcgcacccaatgggttcttaattggccaggccaggtcacaattgcgggatgtcagacatactggactatggaggtggccgaagccctggaggctggcaacctgcgttcgcagttgtttcctcagctgtgccagcagctgtcggatctcgttgccctggttcggggaaaacttagtaggatgcagcgcgcagttctgtcagctctgatcgtgatcgaagtccatgccaaagatgtcgtatctaagctaatccaggagaatgtagtcagtgtgaatgatttccagtggatctctcagctgcggtactactggacaaacaacgacctgtacatcagggctgtcaacgcggagttcatttatgggtacgaatatctcggaaacagtgggcgtctcgtgattaccccattgaccgatagatgttacctgacactgaccggtgctctccatctgaaatttggcggagcgcctgctggccctgcaggaaccggcaaaacagagacaactaaggacctcggcaaggcactggccattcaaactgtcgtctttaattgctcagatcagttagactttatggcaatgggcaagttctttaagggactcgccagcgcgggagcctgggcttgtttcgatgagttcaaccgcatagacatcgaagtactctctgtggtggcccaacaaatcacaactattcaaaaagctcagcagcaacgcgtggagcgctttatgtttgagggtgtggaaataccacttgtgccgtcgtgtgcagtcttcatcaccatgaaccctgggtatgccggtaggactgaactccctgataatctcaaagctctgttccggcctgtcgcaatgatggtgccggactatgcgatgattaccgaaatcagcctgtactcttttgggttcaatgaagcgagcgtcctcgcgaagaaaattaccactacattcaaactatccagtgagcaactcagcagtcaggatcactacgactttggcatgagggccgtcaagaccgtcattagcgccgcagggaatctgaagagagagaacccttcgatgaacgaggaactgatttgccttagggcaatacgggatgtcaatgttcccaagtttctgcaggaagacttaaagttattttccggcatcgtatctgacctgttccctacaatcaaagaagaggacactgattacgggatcctcgacgaagccattcgtgaagcctgccgtaattctaatcttaaggacgtcgaaggattcctgacaaaatgtatacagctctacgaaaccaccgtcgttaggcacggattgatgttggtgggaccaacaggctcgggcaaaagcacctgctacagggttctcgccgctgcgatgacatcattgaagggccagccaagtatatctggaggcatgtacgaagccgtaaactactacgttctgaatcctaaatccataaccatgggtcagctgtatggcgaatttgaccttctgacccatgaatggacggacggaatcttctctagctttatccgggcaggggctatcacaagcgacacaaataagaaatggtatatgttcgacggacccgttgacgcaatttggatcgaaaatatgaataccgttcttgacgataacaagaaactctgtctctctagtggggaaattatcaagctaacagaggcgatgacgatgatgtttgaggtgcaagatctggcggttgcatctcccgctaccgtgtctaggtgcggcatggtttacctggagcctagtatcctgggtttgatgcccttcattgagtgctggcttagaaagctgcctcctctgctcaaaccttatgaagaacacttcaaagctctgttcgtttcctttttagaagagtcaatttcttttgtgaggtcatctgtcaaagaggtgattgcctctacaaattgtaatctcacaatgtcactcctgaagctactcgactgtttcttcaagcctttcctgcctagagagggtctcaagaagattccatcagagaaacttagcagaattgtcgaattgatcgagccatggtttatattctcccttatctggtccgtgggtgcgaccggggacagttcaggcagaacaagttttagccactggctgcggctgaagatggagaatgagcagctcactctgttgttcccggaagaggggttagtgttcgactatcgcttggaggatgcgggtataagcggcactaacgacagcgaggacgaagaagaagagtacaagcaggttgcttgggtcaagtggatggactctagtgccccttttactatggtgccggatacgaactattgtaacatcattgtacccaccatggacacagtccagatgtctcacctgctggacatgctgctcacaaataagaagccggtgctttgcatcggtccaaccggtaccggcaagaccctcaccatttcagataaactgctaaagaatttggccctggattatatttcacatttcctgacattttctgcaagaacgtccgccaaccaaactcaggatttcattgatagcaaactggataagaggcggaaaggggtgtttggaccccctcttgggcgaaactttatttttttcatcgacgatctcaatatgcctgcgctggagacctatggcgctcagccccctatcgagctactgaggcaatggatggatcacggaggctggtatgaccgtaagattatcggcgctttcaaaaacctcgtggatatcaattttgtttgtgccatgggcccacccggagggggtcgaaatacagtaacacccaggttgatgcgacacttcaattacctgagcttcgcagaaatggacgaagtaagcaagaagcgcatcttttctaccatcctgggtaactggctggacggactgttgggcgaaaagtcctatagggaacgcgtccctggggctccccatattgcacattttaccgagcccttggtggaggcaacaattatggtatacgccaccattaccagccagctccttccaactccagctaagtctcactacacatttaatctgagagatctgagcaaagtgttccagggcatgctaatggccgatcccgcaaaggtcgaggatcaagtgcaactactgcggctttggtatcatgagaattgccgagtgttcagggaccggctggtcaatgaagaagacaggtcatggttcgatcagttgttaaagagatgcatggagcagtgggaagtgacatttaacaaagtctgtcctttccagcctatactttacggggacttcatgagccccggtagcgatgtaaagtcatacgagctgataaccagcgagtcaaagatgatgcaggtcatcgaagaatacattgaggattataatcagatcaataccgcaaagttgaagctagtgctgtttatggacgctatgtcgcatatttgccgaatttccagaactctgagacaggctttgggcaatgccctcttgctgggtgtgggcggtagcggcaggtcgagcttaacacgcctggcttcccacatggcagaatacgagtgtttccaaattgagctctccaagaattatggtatgagcgagtggagggacgatgtgaagaaagtacttctcaaagctggcctgcagaacctgcccatcacattcctgttttccgacacccagattaaaaacgagagctttctcgaggacatcaacaatgttctcaactctggtgacattcctaacctctataccgcagacgagcaggatcagatcgtgtctacaatgcgaccctatatccaagagcaggggctgcagccgaccaaagctaatctaatggcagcttatactggacgggtgcgcagcaacattcatatggttctgtgtatgtcccccatcggcgaggttttcagggccaggttgaggcagttcccatccctggtcaattgctgtactattgattggttcaatgagtggccagctgaggctctgaagtccgtcgctaccgtgttcctcaacgagattccggagctggaatcttcccaggaggagatccaagggcttatccaggtgtgtgtctatattcatcaatcagtaagcaaaaaatgtattgagtacttggccgaattgaccagacataactatgttacacccaagtcctatctcgaactcctgcatatttttagtatcctcatcggccagaagaaactagaactcaagaccgctaaaaaccgtatgaagagcgggctcgacaagctcttgcggaccagtgaggatgttgccaagatgcaggaggatctcgagtctatgcatccactgctggaagaagctgcaaaggatactatgctgaccatggaacaaataaaggtagacacagcaatcgcagaggaaacacggaactctgttcagacagaggaaataaaagcaaatgaaaaagccaaaaaggcacaggcaattgccgacgatgcccagaaggatctcgatgaggcattgccagctttggacgctgcgctcgcaagtctgcgcaatctgaacaaaaacgatgtgactgaagtccgagcgatgcagcggccacctcctggagtgaaactggttatcgaggccgtttgtattatgaaaggcatcaagcctaaaaaggtgcctggggagaaacccggaacaaaggtggatgattattgggagccaggaaagggtttgctacaggacccaggacactttctggaatctctgttcaagtttgataaggataatatcggggacgtggtgatcaaggctatccagccttacatcgataacgaggaattccaacctgctacaatagccaaggtatcgaaagcctgcacttccatctgccagtgggtaagggcgatgcataaataccattttgttgcgaaagccgttgagcccaagaggcaggcgctgttggaggctcaagatgatctgggagtaacacagcggattctcgatgaggccaagcaaaggttgcgggaggtggaggatgggattgccaccatgcaggccaaatacagggaatgcatcacgaaaaaggaagaacttgaacttaagtgcgagcagtgcgaacaaagactcgggagagctggaaagctgattaacggcctgtctgacgagaaagtgcggtggcaagaaacagtggagaatcttcagtatatgctaaataatatatccggggatgtgttagttgccgcaggctttgtggcatacctgggtcctttcacaggacagtatagaactgtgctgtatgattcatgggtgaagcaacttcgatctcacaatgttccccacacaagtgagcccactcttatcggaacactcggtaatcctgttaagatacggtcctggcagattgcagggctgcctaatgacacgctctccgtcgaaaatggtgtgattaatcagtttagtcagcgctggacacatttcatcgacccacaatctcaggccaataagtggatcaagaatatggaaaaagacaatggcttagatgtgtttaagttgtccgatagagactttctcagaagcatggagaacgccatccgttttgggaaaccctgcttgcttgagaatgttggagaggagctggaccccgctctggagcctgtgcttctgaaacagacctacaaacagcagggtaatacagttttgaagctgggcgataccgtgatcccctatcatgaggactttagaatgtacatcaccacgaagctgcctaacccacattatacgcctgaaatcagcacaaagcttacactgatcaacttcaccctgagcccaagtggactcgaagaccagttgttgggacaggtggtagccgaggagcgacctgacctagaagaggccaaaaatcagttgatcatttccaatgctaaaatgcggcaagagcttaaagatatagaggatcagattctctaccgccttagttcctcagaagggaatccagtggacgatatggagctgatcaaagtgctggaggccagtaaaatgaaggcggcagaaattcaggctaaagtgagaatcgcggagcaaaccgaaaaagatatcgatctgacccgaatggaatatattccggtggctatccgtacccagatactgtttttctgcgtttcggacctcgccaacgtggatccaatgtaccaatacagtctggaatggttcctgaacatcttcttatctggcattgccaatagcgagcgcgctgataatctgaagaagcggatctcaaatataaacagatatctaacatattctctctacagcaacgtgtgccgcagcctgttcgaaaaacacaaattaatgttcgcatttctcttgtgtgtgagaatcatgatgaatgagggcaagattaaccagagtgagtggcgctatctgttgagcggagggtctatttctatcatgaccgagaatcctgcacccgattggctctcagatcgagcatggagagacattctggcattatccaatttacccactttcagtagctttagttctgacttcgtgaagcacctgagtgagtttagggtcatatttgactccctcgagcctcacagagagcccttaccaggcatttgggaccagtacctggatcaatttcagaaactgcttgtgttgcggtgcttaagaggggacaaggttacaaatgcaatgcaggatttcgtcgccaccaacctagagccacgtttcatagaaccacagaccgcgaacttaagcgtggtgtttaaagactccaactcaaccacgccactaatctttgtacttagtccaggaacagatcccgctgccgacttatataagtttgcagaagaaatgaagttctccaagaaactgtctgctattagtctgggacagggtcagggacctcgagcagaagcaatgatgcgctcctcaatcgaacggggaaaatgggtgttcttccagaattgccacctcgcaccgagttggatgcctgcactggagaggctgattgagcatatcaacccagataaagtccaccgggacttccgcctgtggttgaccagcctcccatccaataagtttcctgtgagtatcttgcagaacggatccaaaatgacgatcgagcccccacgcggtgtccgagcgaacctgctaaagagctacagcagcctcggggaagattttctcaacagttgccataaggtgatggaatttaaatcactacttctttctctctgcctctttcacgggaacgctctggagcgccataagtttgggccactcggtttcaacattccatacgaatttactgacggcgatctcaggatttgtatatcacagctgaagatgtttttagacgagtacgatgacattccttacaaagtactgaaatatacggccggtgagataaactacgggggtcgtgttacagacgactgggacaggcgctgcataatgaatatcctagaggatttctacaaccccgatgttctgtcccccgagcatagctattccgcctctggtatctatcaccagattccaccaacctatgacctgcacggatatctgtcctacatcaaatcactccccctcaatgatatgccagagatcttcgggctccacgacaacgcaaacattactttcgctcaaaacgagacttttgcactgctgggcacgataatccaactgcagccaaagagttccagtgcgggttctcagggacgcgaggagatcgtggaagatgtaacgcagaatatcctgcttaaggtcccagagccgatcaacctccagtgggttatggcaaagtacccagttctttacgaagagagcatgaatacagtactcgtccaggaggtcattcggtataaccggttgttgcaagtcatcacacaaacattgcaggacctcctgaaggccctgaagggcctggtggtcatgagctcccagctggagctgatggccgcatctctctataacaataccgtgcccgagttgtggtcggctaaggcctatccctctctgaagcctctttcaagctgggtaatggatctcctgcagcggctggactttctacaagcctggatacaggacgggatacccgctgtgttctggatttccggcttcttttttccccaagcctttctcactggtactctccagaatttcgccaggaagtttgtcatctccattgacactatctcctttgactttaaggtcatgttcgaagcaccctctgaacttactcagcgaccacaggtgggctgttatatacatggcctattcctcgaaggcgctagatgggaccctgaggccttccagctggccgagtcacagcctaaagagctgtacaccgaaatggccgtcatctggctgctgcccactccaaacagaaaggcccaggatcaagatttctacctttgccccatctacaaaacactgacgcgcgctgggaccttgagtaccacgggtcatagtaccaactatgtcatcgcagtagagatcccaacccaccagccacagcggcattggatcaagcgaggcgtagcgctgatatgcgccctcgattactac

SEQ ID NO: 221420 - DNA, 13416 bp, Artificial Sequence
  Description of Artificial Sequence: Synthetic coding sequence
atggtgccagaagaggtggaagtggaaattgacgagatccctgtgctctcggaggagggcgaggaggaggaagagacttattcccagaaggtcgagtccgtcgataaagtacgggctaaaagggtgagcctgagaaccgaaagcctcggccagccactcaatagggaagatgaagaaatggacaaggagatcagcgaaaaactcccctccaagcgcacagcaaaacacatcatggagaagatgcacctccacatgttatgcaccccccttcccgaagaatttctcgaccagaatgttgttttctttctgcgaaatacaaaagaggcaatctctgaggcgacagatatgaaggaggctatggagatcatgccagagacactggagtatgggattataaatgctaatgtgctgcattttctgaagaatattatctgtcaggtttttttaccggctctgtcttttaatcagcatcggacctctaccaccgtgggggttacaagcggagaggtgtctaattcatctgaacacgagtcagacctacctcctatgccgggagaagcagtggagtaccattcgatccagttaatcagagatgaattcctgatgaatgtgcagaaatttgcatcaaacatacagcgcactatgcagcaacttgaaggggagatcaagttggagatgcccattatcagtgtggagggggaggtgagcgacctcgcggctgatccagagaccgtggacatactggaacaatgcgttattaactggcttaaccaaattagcacagccgtggaggctcagctcaaaaagacaccccagggtaaagggcctctcgccgagattgagttttggagagaacggaacgctactctgagcgccttgcacgagcagactaagctccccatagtgaggaaggtattagatgttatcaaggagagcgatagcatgctggtggccaatctccaacccgtattcacagaattgttcaagtttcataccgaggcctctgacaacgtgagattcctgagtactgtggagagatacttcaagaacattacccatggcagcgggttccacgtagtgttggataccattcccgcaatgatgagcgccctgagaatggtgtggatcatctcacgccactataacaaggatgagcgaatgattccactgatggagcgcatagcctgggagatagccgaaagagtgtgcagggtggtgaacttgcgtacactgttcaaagaaaatcgcgcatcagcacagtctaaaacgctcgaagctcgcaatactttgcgattatggaagaaggcgtatttcgatactcgcgctaaaattgaagccagtggtagggaagacagatgggagtttgacagaaagcggctatttgaacgcaccgactatatggctacgatatgtcaggatctgtcagacgtgctgcagatcctagaagaattttacaacatttttggtcccgagttgaaggcggtcacgggggacccgaagcgtatcgacgatgtactatgtcgagtcgacggtcttgtaactccaatggaaaacctgaccttcgaccccttttctatcaaaagttcacagttctggaaatatgttatggacgagtttaaaattgaagtactaatagatatcattaataaaatttttgtgcagaacctggagaatccccctctgtataaaaaccaccccccagtagcaggcgctatttattgggagcgctccctgtttttcaggatcaaacacactattcttcgttttcaggaggtacaggaaatccttgattccgataggggacaggaggtcaaacagaaataccttgaggtgggaagaaccatgaaagagtacgaggaccgaaaatatgaacagtggatggaggtcacagaacaagtgctccccgcactgatgaagaaatcactgctgaccaagagtagtattgccactgaagaaccatccacccttgagcgcggtgccgtgttcgccattaattttagtcccgcactgagggaaatcatcaatgagactaaatatctggaacagcttggattcacggttccagagttggccagaaacgtggccctacaagaggacaaattcctcagatatactgcagggatccagagaatgctagatcattaccatatgctcatcggaaccttaaacgacgctgaaagtgtgctcctgaaagaccattcccaagagctgttgagagtattccgttccggttacaaaagacttaattggaatagtctcggcatcggagactacatcactggctgtaagcaggcgattggaaagtttgaatcccttgtgcaccagatccataagaatgctgacgatatatcctcccggttgactctgatagaagccatcaacctgttcaaatacccggctgcaaagagcgaggaggagctccctggtgtaaaggagtttttcgagcacattgagagagagcgggcaagtgatgtggatcatatggtgcgctggtacttagctatcggcccactactcacaaaggtcgaaggcctcgtcgtccatacaaataccggaaaagcacccaagctggcatcctattataagtactgggaaaagaagatctacgaagtcctcaccaagttaattctcaagaacctccagtctttcaattcgcttatcttgggcaatgtgcctctgtttcacacagaaaccatcttaactgctcccgagatcattctccacccaaacacaaatgagatcgacaaaatgtgcttccattgcgtcagaaattgtgttgaaattaccaagcacttcgtacgctggatgaacgggtcatgtattgagtgcccgccacagaaaggagaggaagaagaggttgtcattattaacttctacaacgacatcagcctgaatcctcagatcattgagcaggcggtgatgattccacagaatgtacacagaattttaatcaacctgatgaagtatctgcagaaatggaagagatacaggccactgtggaagctcgacaaggccatcgttatggagaagtttgccgctaaaaaaccgccatgcgtcgcttacgatgaaaagctgcagttctatagcaagattgcatacgaagtgatgcggcatcctcttatcaaagatgaacattgcatccgactccagctccgacatttggctaacaccgtgcaagaaaacgccaaatcttgggtcataagccttgggaaattgctaaatgagagcgctaaagaggagctctacaacctccatgaagaaatggaacacctcgccaaaaatctgcgaaaaattcccaacaccctggaagacttaaaattcgtgctggcaactatcgccgagatccgcagcaagagtttggtaatggaacttagatatagggatgtccaagagcggtataggactatggccatgtataatctgtttccaccagatgccgagaaagaactagtggataagatcgagtccatctggagcaacttgtttaatgacagcgtgaacgtcgaacatgccctcggcgacataaaaagaacttttacagaattgacgagaggcgaaattatgaattatagggtgcagatcgaagagtttgccaagcgattctactcggagggcccagggtcggttggggacgacctggacaagggagtagaactgttaggagtctacgagcgcgaactcgcacgccacgagaagtcgcgtcaagagctagcaaatgctgagaaactgtttgatctccctatcactatgtaccccgaactgcttaaggtccaaaaagaaatgagcggactccggatgatttacgagctctacgagggcctgaaggtggcgaaggaagagtggtcacaaacactctggattaatctgaatgtgcagatcctgcaagagggcatcgagggattccttcgggcactccgcaaactcccgagacccgtgcgcggtctgtctgtcacttattacctggaggcaaaaatgaaggcttttaaggactcaattccgcttctgcttgacttgaagaatgaggcgctgcgagaccgccattggaaagaactgatggagaaaacaagcgtgtttttcgagatgactgagacttttactctggaaaacatgttcgccatggaactccacaagcataccgacgtcttgaatgaaattgtgaccgcggcaattaaagaagtcgccatagaaaaggccgtcaaggaaattttggatacctgggagaacatgaagtttaccgtagtgaaatattgtaagggcactcaagagagaggctacatacttggcagtgtagatgagataattcagtccctcgatgataacacattcaacctacagagtatttctggatcccggttcgtgggccctttccttcagacggttcacaaatgggagaaaactctgagtctgatcggcgaagtcatcgagatctggatgcttgtgcagcggaagtggatgtatcttgaatccatcttcattggaggcgacatccgctcccagctacccgaagaggccaaaaaatttgataatatcgacaaggtgtttaagagaattatgggtgagactctgaaagaccccgtcattaaacgatgctgcgaggctcctaatcggcttagcgacttacaaaacgtaagtgaaggactggagaagtgccagaagtccctgaatgattatctggactcaaagagaaatgcgtttccacgctttttcttcatatccgatgatgaattgctgtcaattctcggaagctcggatcccctgtgcgtgcaggagcatatgatcaaaatgtacgataacatcgcttcccttcggttcaacgatggtgattctggggaaaagctggtgtccgcgatgatcagcgcagagggggaggtgatggagtttagaaaaattctccgagccgaggggcgagttgaggactggatgacggcggtcctgaatgaaatgcggcgtacaaaccggctgattactaaagaggctatctttagatactgtgaggatcgatctcgcgtggattggatgttgctgtatcagggcatggttgtgctggctgcctcgcaggtctggtggacgtgggaagtagaggatgtgtttcataaagcgcagaaaggggagaagcaggcaatgaagaactacgggagaaaaatgcaccgccagatcgatgagttggtcacccggatcactatgcccctttctaagaacgaccgaaagaaatataacaccgtgctcattatcgacgtgcacgccagagacatcgtggatagttttatccgagggagtatcttggaagccagagagtttgattgggaatcgcaacttcgcttttattgggaccgggagccagatgaactaaacattcgccaatgtacaggcacctttggctacggatatgaatatatgggtcttaacggccgattggtgattaccccactcacagacaggatctacctgactctaacacaggcccttagcatgtacctgggcggtgctcctgctggcccagcagggacgggaaagactgaaactactaaagacctcgcaaaggctttgggcctcctgtgcgtggttaccaactgtggcgagggcatggattaccgcgctgtgggaaagatcttcagcggtttggctcaatgcggtgcttggggatgtttcgatgaatttaatcggatcgatgccagtgtgttatcagtgatcagcagccaaatacaaacaattaggaatgccttgattcatcagctgacaacgttccagttcgaggggcaggaaatatctctggacagtcggatgggcatctttatcacgatgaaccccggatatgctggtcggacagaactgccggagagtgttaaagccttgtttcgccctgttgtagtgattgtacccgatctgcagcagatttgtgagattatgctcttttccgaaggcttcctcgaagctaaaaccctcgctaagaagatgacggttctgtataaattagctagagaacagctctctaagcagtaccattatgatttcggcctcagggcgctgaaatcggttctcgtgatggctggtgagctcaaacgaggcagcagcgacctcagggaggacgttgtactgatgagggccttgcgtgatatgaatttacctaagttcgtgtttgaggatgtgcctttgttcctgggcctgattagcgatctttttcccggtcttgactgtccacgcgttcgctaccccgactttaatgatgcggtcgagcaggtccttgaggagaatggctatgcagtgctgccgatacaggtggataaggtcgtgcagatgtttgagacaatgttgacacggcatacaacaatggtggtgggaccgacccgcggaggcaaatcggtcgttatcaataccctgtgtcaggcccagaccaaactgggcctgaccaccaaactttatattctgaatcctaaagctgtgtctgtgattgaactgtacggtatcctggatcccactacccgtgattggaccgacggagttctgtccaacatcttcagagaaatcaacaagccaaccgataaaaaggagcgtaagtacattctgttcgacggcgacgtggatgcgctgtgggtggaaaacatgaactcggtgatggatgataatcgtctgctcactctcgccaacggggaaaggattagattgcaggcacactgcgcccttctgtttgaggtcggagatttacagtatgctagccccgcaacggtcagtcggtgcgggatggtgtatgtggatccaaagaacctcaaatacaggccctattggaaaaaatgggtcaaccagatacccaataaggtggaacagtacaacttaaactcactctttgagaagtacgttccatatctcatggatgtcattgtggagggaatagtggacggccgtcaggcagaaaagctgaaaacaatcgtcccacagactgacctgaatatggtgacgcagctggccaagatgctggacgctctcttggagggggaaattgaagacctggatctactagagtgctacttcctggaggcactctactgttctcttggggcatccctgctggaggatggtcgcatgaaattcgatgagtacatcaaaaggctggccagcctctctactgttgatactgaaggagtctgggctaatccaggggagctgcctggccagcttcccaccctgtacgattttcacttcgacaataagcggaatcaatgggtgccctggagtaagctcgtgcctgagtacatacacgccccagagcgcaaatttatcaacatcctagtgcacaccgtggatacaacgagaactacctggattctcgaacagatggtaaagataaagcagccggtaatctttgtgggtgagtcagggacgtcaaaaactgcaactacccagaacttcttaaaaaacctgagcgaagagacaaatatcgtgctgatggtgaacttctcttcacgaaccacatcaatggacatccagaggaacctggaggccaacgtagaaaaacggactaaggatacctacggcccacccatgggaaaacgattgcttgtgttcatggacgatatgaatatgccgagagttgacgagtacggcacccaacaaccaatcgctctgctgaagctgctcctggagaagggttacctgtacgatcgcggaaaggagctgaattgcaaaagcatacgtgatctaggctttatagcggcaatgggtaaggcgggtggcggacggaacgaggtggatcccagatttattagtctgttctcagtttttaatgtgcccttcccttccgaagaaagcctgcacctgatttactcctcaatactgaaaggccatacatcaacgtttcatgaatccattgtcgcggtgtcaggtaaattaactttctgtactttggctttatacaaaaatattgtgcaggatttgccacctaccccctccaagttccactacatcttcaacctgcgcgacctgtctcgtgtcttcaatggcctggtgctaaccaaccctgagagattccagacagttgcccaaatggtgcgcgtctggaggaacgaatgtctcagggtgtttcacgaccgacttattagcgaaaccgacaaacagttggttcagcagcatatcgggtctttggtagtggagcatttcaaagacgacgtggaagttgtcatgagagatccaattctcttcggagattttcaaatggcccttcacgagggtgaacctagaatttacgaggacatccaggattatgaggccgctaaggcgctgtttcaggagattctagaagagtacaacgagagcaacacaaaaatgaacttggtgctttttgacgatgcccttgaacacctgacgagggtgcaccgcatcattaggatggatcgtggtcatgccttgctggtcggggtgggcggttctggcaagcagagcttatccagactggcagcctttactgcctcttgcgaggttttcgagatactcctctcccgaggatactccgagaattcctttcgagaggatctgaaatctctgtatctgaagctgggcatcgagaataaagccatgatatttctcttcaccgatgcccacgtcgcagaggagggattcctagagctgatcaacaatatgctgacaagtggaattgtgccggcactgttcagcgaagaagaaaaagagtccattctgtctcagattggtcaggaggcactgaagcagggaatgggcccagcaaaagagtctgtctggcagtactttgtcaacaagtcagcaaacaatttgcacatcgtgctggggatgtctcccgtcggcgataccttacgaacttggtgccggaatttccctggcatggtgaacaatacaggaattgactggtttatgccttggccacctcaggcccttcatgccgtcgctaagagctttctgggctacaaccccatgataccggcagagaatattgagaatgtagttaaacatgttgtcctggtgcaccaatcggtggaccactactcacagcaattcctccagaaactaagacgcagcaactatgttacaccaaaaaactacctagattttattaatacatacagtaagctcctggatgaaaaaactcaatgtaacattgctcagtgcaaacggctggatggaggactagacaagcttaaagaagcaaccatacagctggacgagctcaatcaaaaacttgccgagcagaaaattgtgctagcagagaagagcgctgcatgtgaagctctgctggaagagatagccgtcaacactgcagtggctgaagaaaagaaaaagttggccgaggagaaggctatggaaatcgaggaacaaaataaggtcatcgccatggagaaggcagaggctgagaccacgctcgccgaggtcatgccgatcctcgaagctgccaagctggaactgcagaagctagacaagtctgatgtgacagaaatcaggtctttcgctaagcctcctaagcaggtgcaaaccgtctgtgaatgcatcttgattatgaagggatataaggaactcaattggaaaacagcgaagggggttatgtcggacccaaattttttacgttctttaatggagatcgattttgacagcatcacacagtcacaagtaaaaaacataaagggactcctgaagaccctcaataccactaccgaagagatggaggcggtgagcaaggcgggactgggcatgctaaaatttgttgaggccgtcatggggtattgtgacgttttcagagagataaaaccaaagcgcgagaaagtcgcacgcctcgaacgcaatttctaccttactaagagagaacttgaacgcattcagaacgagctggcagctattcaaaaagagttggaaacactgggtgccaagtacgaggctgctatcttggaaaaacagaagctgcaggaggaagctgagattatggaaagacgcctaattgccgcagacaaacttatatctggcttgggatctgaaaacattagatggctgaatgacctagacgaattaatgcaccgccgtgtgaaattgcttggcgactgtctattgtgtgcagccttcctcagctacgagggtgccttcacttgggagtttcgggacgagatggtcaataggatctggcagaatgatatcctggaacgagagatcccgctgtctcaaccatttagacttgaaagcctcttaacagacgacgtcgaaatatcccgctggggcagccaggggctgcccccagacgagctatccgtgcagaatgggatcctgactactcgtgcgagccgcttcccgttgtgtattgaccctcagcaacaggctctgaactggattaaaagaaaggaggaaaagaacaacttacgagtcgcaagctttaatgatcctgattttttgaagcaactcgagatgagtataaagtacgggaccccttttctcttcagggatgtggacgaatatattgatccagtgatcgacaacgttcttgagaaaaatatcaaggtttcccagggtaggcagttcataattttgggagataaggaagtggattatgattcaaacttcagattgtacctgaacacaaaactggcgaacccacgatattcccccagcgtcttcggaaaggccatggtgatcaactataccgtcaccctcaagggattggaggaccaactgcttagtgtccttgtcgcctacgagaggagagagctcgaagagcagagagagcacttgatccaagaaacatcagaaaacaagaatctactgaaggacctggaggacagtctcttaagagagcttgccacaagtaccggtaacatgctggataatgtggacctcgtgcatacattggaagagaccaaaagtaaggctactgaagtttcagagaaactgaagctagccgagaagacagccctggatatcgaccgtctgcgggatggctaccggcctgcagctcgcaggggggctatactgttctttgtgctgtccgagatggctctcgtgaattcaatgtatcaatattcgctgatcgcctttttagaagtcttccgtctaagtctcaagaagagtttgccggactccatcttgatgaagcgtcttagaaacatcatggacacgttgaccttcagtatctataaccacgggtgtaccggcctttttgagcggcacaagctcctattctctttcaatatgactatcaagattgaacaggccgaggggcgtgtgccccaggaggagctggatttctttctgaaaggcaacatatcactggaaaaaagcaaacgcaagaagccatgcgcttggctttccgatcaaggatgggaggatattatccttctgtctgagatgttctccgacaatttcgggcagctccccgacgatgtagagaacaatcaaaccgtttggcaggagtggtacgatctggacagcctagaacagttccctgttccgcttggctatgacaacaatatcacaccattccagaagctgctgattctgcgatgcttccgtgtcgatcgagtgtaccgggctgttacagattacgtgactgtgacaatgggggaaaagtacgtccagccaccaatgatttcctttgaggccatctttgagcagtctactcctcactctcctatcgttttcattctgtccccaggatcagacccagcaacagatctgatgaagctggccgaaaggtctggttttggcggaaaccgactcaaattcctcgcaatgggacaaggacaggaaaaggttgctttgcaacttctcgaaacggcagtggcccgtggtcaatggctaatgttacaaaactgtcacctgttggtcaagtggctgaaggacctggaaaaaagcctggagaggattaccaagccccaccctgacttccgcctttggctaaccactgaccccaccaagggatttccaattgggattttgcaaaagtccctgaaggttgtaacggagcctcccaacggactgaagcttaatatgagagccacatattttaagatctcacatgaaatgctggatcagtgcccccatccagccttcaaacccctcgtctacgttctcgcctttttccacgccgtggtacaggaacgaaggaaattcgggaagatcggttggaacgtctattatgactttaacgagtccgatttccaggtgtgtatggaaatcctaaacacttaccttaccaaagctttccaacagcgcgatccccgaattccatgggggagtcttaagtatctgattggtgaagttatgtacggcggaagagctattgacagtttcgaccgtcgaatattgaccatctacatggacgagtatttgggagatttcatctttgatacgttccagcccttccatttcttccgcaataaagaggtcgactacaagatacctgtgggcgacgagaaggagaagtttgtggaggcaatagaagcattgcccctggccaatacacccgaagtttttggtctgcatccaaacgccgaaatcggatactatacacaggctgccagggatatgtgggcccaccttctcgagttacagcctcaaacaggcgaatcttcttctggaatttcacgggatgattatatcggccaggttgctaaggaaatcgagaataagatgcctaaggtgttcgacttggatcaggtgcgcaagaggctgggtacaggccttagtccgacttcagttgtgctactgcaggagctggagcggtttaataaactcgttgtgaggatgacgaagtccctggctgagctccagcgggctctagccggagaggtcgggatgtcaaacgaactggacgacgttgcccgatcgctgttcattggtcatatccctaatatctggcgtcgtctcgcccctgatacgctaaagagccttggaaactggatggtgtacttcttgcggaggttctcacaatacatgctgtgggtaactgagtctgagcctagcgtcatgtggctgagtggactgcatattccagaaagctacctaacagcacttgtccaggcgacgtgtcgcaagaatggctggcccctggacagatcgaccctctttacgcaggtcaccaaatttcaggacgcagacgaagttaatgagcgagccggacaaggctgttttgtttccggtctctacctggaaggagccgattgggacatcgaaaaggggtgtttgattaaatccaaacctaaggtgcttgtcgtagacctgcccattctcaagatcatacctattgaagcacataggttgaaactacaaaatacttttagaacacccgtgtatactacctctatgagacgaaacgctatgggggtcgggctcgtatttgaggctgatctcttcactaccagacatatctctcactgggtgctgcagggggtgtgtctcacacttaacagtgattac

SEQ ID NO: 221421 - DNA, 13572 bp, Artificial Sequence
  Description of Artificial Sequence: Synthetic coding sequence
atggccgcacaggtggctgccagagaggccagggacttcagggaagcacctactctgaggttgaccagtggcgctgggctggaggcagtgggcgctgttgaactggaggaggaggaggaaaatgaggaggaggccgcagcacgcagggcgagaagcttcgcccaggacgctcgcgtaaggtttttaggtggaagactggctatgatgctaggattcaccgaggagaaatggagccagtacctggagtccgaagacaaccggcaagtgctgggagaattcctggaatccacctcccctgcttgcctcgttttttcattcgccgcatctggaagactggccgctagtcaggaaatacctagggatgctaatcacaaactggtgtttatctcaaagaaaattacagaaagtatcggagtgaacgacttttcccaggtggtgctgttcggagagctgcccgcattgagtctcggccatgtgagcgctttcctggatgagattcttgtgcctgtactctctaacaaaaataatcacaaatcctggtcttgtttcaccagccaagacatggaatatcacatcgaggtcatgaagaagaaaatgtatatattccggggaaaaatgtccagacggacgttactccctattcctaccgtagccggaaagatggatttggaccaaaactgttccgaaaacaaacctccttcgaatgagcgaataatcctccacgccatcgagtccgtcgtgattgaatggtctcatcagatccaggagattattgaaagggattcggttcagcgtcttttgaatggactgcatttaagtccccaggctgagctggatttttggatgatgagacgagaaaatctgagctgtatctacgaccagctccaggccccagtcgtcttgaagatggtcaagattttaactaccaagcagagttcctacttccccaccttaaaggacatttttctcgcagttgagaatgcactgttagaggcgcaggatgtggagctgtacctgcgccctctgcgcagacacatacagtgtctgcaggagaccgagtttccacagactagaatcctgatcgcccctcttttccataccatatgcctgatatggtcccactctaaattttataacacaccagctcgagtaatcgttctgctgcaggagttttgcaacctatttattaaccaggctaccgcctatctatcacctgaggatctgctgagaggcgagatagaagagagtctggagaaggttcaggtagccgtaaacattctgaagactttcaagaatagcttcttcaattatcgtaagaagcttgcatcctacttcatgggcagaaaactgcgaccctgggatttccaaagccatttggttttctgtaggttcgataaatttctggaccggctaatcaaaattgaagatattttcgctacaacgctggaatttgagaagctcgagcgcctggaattcggcggaaccaaaggggctatcctaaatggacaagtccatgagatgagcgaggagttaatggaactatgcaagctttttaagcaatctacgtacgatccatcagattgtaccaatatggagtttgaatccgattatgtggcatttaagtctaagacactggaattcgatcggaggctcggcactattatctgcgaggcattcttcaactgtaacggcctggaggccgctttcaaactacttaccatttttggaaacttccttgagaaaccggtcgtaatggaaattttctccttgcactactccacactggttcatatgttcaatacagagctcgatgtatgtaaacagttatacaatgagcacatgaagcagatagaatgcgggcatgtggtgctgaacaaaaatatgcctttcacctcaggaaatatgaaatgggcgcagcaagtgctgcaaagattacagatgttctggtcgaactttgcaagtttaaggtacctttttctgggaaatccagatcatgctctggtgtatcagaaatatgttgagatgaccacacttctggatcaatttgaatccagaatctacaacgagtggaagtcaaatgtcgacgagatttgtgaatttaacctgaaccagccattagttaagtttagcgccattaatggcctgctgtgcgtcaattttgatcccaagctggtcgcagttctccgtgaggtgaagtatcttcttatgttaaaaaagcaggacatccctgacagcgcgctggccatctttaagaagcggaacaccattcttaaatatattgggaatcttgatcttttggtgcaggggtacaataagttgaagcaaaccctccttgaggtagaatatcccttgatcgaagatgaactgcgggctatcgacgagcagctaaccgctgcgaccacatggctgacctggcaggacgattgctggggctacattgagcgtgtcagagccgcaaccagtgaactcgagcaccgtgtcgaacgcacccagaaaaatgtgaaggtgatccaacagaccatgaggggctgggccaggtgcgtgctcccccctcgcagagagcaccgcagagaggcagctttcactctggaggataagggcgacctctttactaagaaatataagctgatccagggtgacggatgtaagattcacaacctggtggaggaaaataggaagctctttaaggcaaatccaagcctagatacctggaaaatctacgtggaattcatcgacgacatcgtggttgagggctttttccaagcaatcatgcacgatctggatttctttctgaagaacaccgaaaagcagctgaaaccagcaccattcttccaagcccaaatgatcctcctcccacctgagattgtgtttaagccgtctctagatcgtgaagccggtgacgggttctacgatcttgtcgaagaaatgctttgcaactcgtttcggatgagcgcccagatgaaccggatcgccacccacctggaaattaaaaattaccaaaatgatatggacaacatgctggggttggccgaagtcagacaggagatcatgaatagggtcgtgaacgtcattaacaaggtgctggactttcggaacaccctggagacacatacatatttgtgggtcgacgaccgggcagagttcatgaaacacttcctcctatacggtcacgctgtctcctcggatgaaatggatgcacacgcaaacgaggagatccctgaacagccccctaccctggaacagttcaaagaacagatcgatatctacgaagctctgtacgtccagatgagtaaatttgaggattttagggtcttcgactcttggttcaaagttgacatgaagccatttaaagtgtcccttctcacaatcatcaaaaagtggagctggatgtttcaggaacaccttctgagatttgtgattgattcactcaacgagctccaggaattcatcaaggagaccgactccggtctgcagcgggaactcaatgaaggcgatcacgacggtctcgtggatatcatggtgcacttgctcgctgtcagaagccggcaacgggctaccgacgagctattcgagcccctgaaagagactatcacactgctggagtcctacgggcagaaaatgcctgaacaggtgtacatccagctggaggagctccccgagaggtgggagaccactaagaagatcgctgctacggtaagacacgaggtgagccccttgcacaacgccgaggtaactctcatcagaaagaagtgtattttattcgacgctaagcaggccgaatttcgtgagcgattccgtcattatgcccctctcggtttcaatgctgaaaacccttatactgctctggacaaagcaaatgaagagctggaagcactggaggaggaaatgctccaaatgcaagaatcgacccgtctgtttgaggttgccctcccagaatacaaacagatgaagcagtgtcggaaagaaatcaaactgctcaagggcctgtgggacgttattatctatgttcgacgttccatcgacaattggaccaaaacacagtggcggcaaattcatgtcgaacagatggatgttgaattgagacgctttgctaaggcatcctctattacagagatctggagtctgaataaagaggttcgagtgtgggacgcatataccgggctggaaggtaccgtgaaggacatgaccgccagcctcagggccattactgagctgcagagtcccgctttaagggatagacattggcaccaattgatgaaggcaattggggtgaagtttctaatcaacgaagccaccactctggctgatctcctggccctgaggttacatagggtcgaggatgacgtgcggaggatagtcgacaaggctgtgaaagagctcgggactgagaaggtgatcactgaaatcagtcagacctgggctacaatgaagttcagttatgaagttcactacaggactggaattccactgttaaagagtgatgaacagttgttcgagacactggagcacaatcaggtgcagctgcaaacactattgcagtccaagtatgtggagtattttatcgaacaggtgctcagttggcagaacaaactgaacatagctgacttagtcatttttacatggatggaagtgcagcggacttggtcccacctagagagcatttttgtctgcagcgaagatatcagaatacagttagtcaaggatgcgagacgattcgacggagtagatgcggagttcaaggagctgatgttcaaaacagccaaagttgagaacgtgctcgaggcaacctgcagacccaatctttatgagaagctaaaggatctgcaaagtcggctgtccctgtgcgagaaggcactcgcagagtatctggaaaccaagcgcattgctttccccaggttttacttcgtctctagcgctgatctgctggatatcctctccaagggcgcacaacccaagcaggtgacctgtcatctggcaaagctctttgactcgattgcagatttgcagtttgaggataaccaggatgtgtcagcccacagagctgttggcatgtactccaaagagaaagaatatgttcccttccaggccgagtgtgagtgtgttggccatgttgaaacctggctcctccaactggagcagaccatgcaggagaccgtgaggcattctataactgaggctattgtcgcctacgaagagaagccaagggagttatggatctttgacttcccagctcaagtggctctcaccagctcacagatttggtggaccaccgatgtggggatcgcttttagccgccttgaggagggatacgaaacagctctgaaagactttcacaaaaagcagatctctcagttgaataccctgattacactcctgctaggggaactgccacccggtgatagacaaaaaatcatgaccatctgtaccatcgacgtccacgcccgtgacgtggtcgctaaattgatttcacagaagcaggttgtcgtttctccacaggcattcacgtggttgagtcaactccgacatcgatgggaagacacacagaagcactgcttcgtgaatatctgtgatgcacagttccaatatttctatgagtacctcggcaattcacccaggctggtgatcacaccccttacggaccgctgttatataactctgacacagagcttgcacctgacaatgtctggcgctccggcaggacctgccggtacaggcaagacagagaccactaaggacctcgggagggcgctgggtatgatggtttacgtattcaactgtagtgaacagatggattataagtcaataggcaacatatacaaaggcctggtgcagacaggagcctggggatgtttcgacgaattcaaccggatcagtgtcgaagttctctccgtggtggcagtccaggtaaagatgattcacgacgcgattaggaacagaaaaaagcgcttcgtgttccttggagaagctatcactctcaagccatccgtgggaatctttattaccatgaaccccggttacgccggtagaactgagcttccagaaaacctgaaagctctgttcagaccctgtgcaatggtcgcccctgacatcgagctaatttgcgaaatactgttagtggctgagggattcgttgacgctagggcactggctcggaaattcatcacactgtacactctgtgcaaagagctgcttagtaaacaggaccactatgattggggacttcgagcaatcaaatctgtgcttgtagtggcaggatctctgaagcgtggcgataagaacaggccggaggaccaggtcctgatgcgcgctttgcgcgacttcaacatgcccaagatagtgacagacgacatacctgtgttcctggggcttgttggtgacttattcccagccctggacgttccacgaagacgaaagttgcattttgagcagatggtgaggcagagcacactggagcttaggttacaaccagaggaatcatttatacttaaggtagtccagctggaggagctcttggcagtccggcatagcgtttttgtggtcggtaacgcaggcacggggaagtccaaaatcttgcggactttgaatcgcacctacgtaaatatgaagcagaagccagtgtggaatgacctgaaccccaaagccgtcacaacagatgagctgttcggatttatccaccatgccactcgtgaatggaaagacggaaaaatcgtgtactcgtacttcatagggctgttcagctccatacttagggagcaggctaaccttaagcacgacggcccaaaatggatagtacttgacggggatatcgaccctatgtggattgaatctttaaacacagtcatggatgataacaaggtgttgactctggcctccaacgagagaatagccttgactccctttatgcggctgttgttcgagattcaccatctgcgaagcgccacgcccgctacagtcagccgtgctggtattctctacgtgaacccccaggatctgggctggaacccttatgttgcttcttggatcgacagaaggaggcatcagtccgaaaaagctaacctcacaatcttattcgacaaatatgtgccagcttgcctggacaaactgaggactagttttaaaacgataacaagtatacccgagagttctcttgttcaaactctgtgtgtgctcctcgagtgtttattaactccggaaaacgtgccttctgactccccaaaagaggtttacgaggtgtactttgtgttcgcatgtatttgggctttcggagggacacttctgcaggatcaaatcagcgattatcaggccgacttttcgcggtggtggcagaaagagatgaaagcagtaaaattccccagccagggcaccatatttgactactacgtggaccacaagactaagaaactgctgccctgggccgacaagatagctcagtttacaatggatccagacgtgccgctgcagacggtgttggtgcataccacagagactgcccgactgcgctattttatggaactgctgttggagaaggggaagccgttgatgctcgtagggaacgcaggagtcggtaaaactgtcttcgtaggcgatacactagcctccctctctgaagattatatcgtgtcccgtgttccatttaactactatacaacatctactgccctgcaaaagatcctggaaaaaccactggagaaaaaggctgggcataactacggcccaggcggaaataaaaagctcatttattttatagacgatatgaatatgcccgaggtggatctgtatggaaccgtgcagccccatacgttgatacgccaacatatcgactacggtcactggtacgacaggcagaaggtcatgcttaaggagattcacaactgtcagtatgtcgcttgcatgaacccaatggtgggttctttcacaatcaacccccgtctccagaggcactttacagtatttgcttttaacttcccaagtctcgacgctctgaataccatttacggccagattttctccttccacttccagcaacaggccttcgctcctagcatcctgcgatccggccctacactgattcaggctaccatcgcatttcatcaaactatgatgtgcaactttctgccgacagcgataaaattccactacatctttaaccttcgcgatctgtccaatgttttccaaggtatcttatttgcctctcctgagtgcttgaaaggacctctcgacctgattcacctttggctccatgagagcgctcgggtgtacggcgataaactgattgataagaaagattgcgacttatttcaacgtaggatgctggaaacggcctataagtacttcgagggaatagatagtcacatgctgcttcaacagcctcttatatattgtcatttcgcagataggggtaaggatcctcactacatgcctgtcaaagactgggaagtgctgaaaacaattctcaccgaaacactcgacaattacaatgaattgaatgccgcaatgcaccttgtcctcttcgaggatgccatgcagcatgtgtgcagaatctcaaggattcttaggacaccacagggctgtgcccttcttgtcggagtgggcggatcaggaaagcagtctttgtcccgcctcgccgcatacctgaggggcctggaagtgtttcaaataacactgactgagggttacggcattcaggagctgcgggtcgatctcgccaatctttacattagaactggcgctaagaatatgcctacagtgtttttgctcaccgacgcgcaggtgctggacgaaagtttcctggttctcattaacgatcttctagcatctggggaaatccccgacctgttcagcgatgaagacgtggataagatcatttcagggatccacaacgaagtgcacgcactggggatggtggactccagagaaaactgctggaaattctttatggctagggtgcgccttcaactgaaaataatcctgtgcttcagcccagtaggcaggactttacgtgtgagggccaggaaattccccgctattgtgaactgcactgcaatagattggtttcacgcttggccgcaagaggccctggtgtccgtgtctcggagatttattgaagaaacaaagggcatcgaaccagttcacaaggacagtatctcactattcatggctcatgtgcacaccacggtgaacgaaatgagcacccgctactaccagaacgagaggaggcacaattacaccacccccaagtcgttccttgagcagatttccctatttaaaaatctcctcaagaaaaagcagaatgaggttagtgaaaagaaggagagactggtcaacggtattcaaaaattaaaaactaccgcttctcaggtgggggacctgaaagccaggttagcgagccaggaggctgagttacagctgcggaaccacgacgcagaagccctgatcaccaaaattggcttgcagacagaaaaggtctccagagaaaagactatcgccgacgccgaagagaggaaagtgaccgccattcagacagaggtattccagaaacaaagggagtgtgaggcggatctgttgaaggcagagccagcgctcgtggctgccacagccgcactcaatacactgaatagggtcaatctgagtgagctaaaggccttccctaacccacccatcgccgtcactaatgtcacagcagcagtcatggtcttactggcccctcgcggacgcgtgccgaaagacaggtcctggaaggctgccaaggtattcatgggcaaagtggatgactttctccaggccctgatcaactacgacaaggaacatatccctgagaactgccttaaagtcgtgaacgaacattatctgaaggatcctgagttcaaccctaatttgatcagaactaagagctttgccgctgcagggctctgtgcctgggtcatcaacatcattaaattctacgaggtgtattgtgatgtggaacccaaaaggcaggcgcttgcgcaggctaatctggaactcgctgccgctacagagaagctcgaggctattcgaaaaaaactggttgatctggaccgaaacctgagccgcctgaccgcttccttcgagaaggcaaccgccgaaaaggttcggtgtcaggaagaggtaaaccagacaaataagactataaaactggcaaaccggttggtgaaggaactggaagcgaaaaaaatcagatggggccagtcaatcaagagcttcgaggcgcaagaaaaaaccttgtgcggtgatgtacttttgacagcggcattcgtttcctatgtcggaccattcactcgacaataccgccaggaactggttcactgtaaatgggtccccttcctgcagcaaaaggtgagcatccctctgaccgagggactcgacctgatttcaatgctgacagatgatgctactatcgcggcttggaacaatgagggcttaccaagtgatagaatgagtaccgaaaatgcggcaattctcacccattgtgaacgttggcccctcgtcattgacccacagcaacaggggatcaaatggatcaagaacaagtacgggatggatctgaaagttacacatctggggcagaagggcttcttgaatgccattgaaacagccctggctttcggcgatgtgatcttaatagagaacctggaagagaccattgaccccgtgctggaccctctcctgggtcgcaacaccattaagaaagggaaatacatccgcattggggacaaagaatgtgaattcaacaaaaactttagattaatccttcacacaaagctggcgaatccgcattataagccagaactgcaggcccagactaccctgctaaacttcactgtgacagaagatgggcttgaggcccagctgctcgctgaggttgtctcaattgagcgcccagatctggagaagctcaaactagttcttactaaacatcaaaacgatttcaagattgagttgaagtacttggaagatgacctgcttcttcggctctcagcggcagaaggatccttcctcgacgacacaaagctggtcgagagacttgaagccacgaaaactactgtggccgagatagagcacaaggtgatagaagccaaggagaatgagcgaaaaatcaacgaagctcgcgaatgttatcgaccggtggctgcccgagcaagcttgctttacttcgtgataaatgacctgcagaagattaacccactctaccagttcagcctcaaagctttcaatgttctgtttcatagagctatcgaacaagctgacaaagtggaagatatgcaaggccgaatttctattctaatggagtcaattacacacgcagtttttctgtacacttctcaagcactgttcgagaaggataagctgacgttcctgagtcagatggcttttcagattttgttaagaaagaaggaaatagatccactggaattggacttcctgctccgctttactgtggagcacacgcatctgagcccggtggactttttgacctctcagagctggagcgctatcaaagccatagccgtcatggaggagttcaggggcattgacagggatgtcgagggctctgctaagcagtggaggaagtgggtcgagtctgaatgtcctgaaaaggagaaattaccgcaggaatggaagaaaaagagccttattcaaaagcttatccttctacgagctatgcggcctgaccggatgacatacgctctgaggaatttcgtggaggaaaagctgggcgcaaaatacgtcgagcgtactaggctggatttggttaaggctttcgaagagagcagtcccgcaacccccatcttctttattcttagtcctggggtggacgcactgaaagatctggagattctcggaaaacggttgggcttcaccatcgatagtggtaaatttcataatgtgtctctggggcagggccaagagaccgtggccgaagtggctctggaaaaggcatcaaaggggggacattgggtcattctacagaatgtacatcttgtagctaagtggttggggacgcttgaaaaactgctggaacgcttcagccagggtagtcatcgagattaccgagtattcatgtcagccgaatctgccccaactcccgacgaacatatcataccccagggcctcctcgaaaacagtattaagattaccaatgagcctcctactggtatgctcgcaaacctgcatgccgcactctataacttcgatcaggacacactcgaaatctgcagcaaagagcaggagttcaagtctatcctcttttccctttgttattttcacgcctgcgtggccggacggttgcggtttggccctcagggctggtctagaagctaccctttcaatcctggggatttgaccatttgcgccagtgtgctgtataattatctagaggctaacagtaaagttccgtgggaggatttgcgctacctgttcggagaaattatgtatggaggccacatcaccgatgactgggatagaaaactctgccgcgtttaccttgaggaattcatgaaccctagccttacagaggatgagctcatgttggcacccggttttgctgcccctccgtatctggattatgctggctaccaccagtatatagaagagatgctgccccctgagtctcctgccctctacggtctccatcctaacgccgagattgagttcttgactgttacgagcaatacactgttccgcacccttttggaaatgcagcctagaaatgccctatcgggcgatgagcttgggcagagtaccgaggaaaaggtcaaaaatgtgcttgatgacatcctagagaagcttcccgaggaatttaacatggccgagattatgcaaaagaactcaaataggtctccatacgtgcttgtctgcttccaggaatgcgagcgaatgaacattctaatccgggagattaggataagcctcgagcagctagacctctccctcaaaggtgaactcgcgctgtctcctgctgtggaagcgcaacaattcgcactctcctacgatacagtgccagacacctggagtaaactggcataccccagcacctatggtttggcccagtggttcaatgatttacttttacggtgcagggagctcgatacctggactcaagaccttaccctgcccgctgtggtgtggttaagcggcttcttcaacccacagagtttcctgaccgccattatgcagaccatggccagaaagaacgagtggccactcgataagacccggcttacagccgacgtgactaaaaagacgaaggaagattatggacatcctcccagagagggtgcatatttgcacggcttgttcatggaaggcgctcgatgggacactcaagccggtacaattgttgaagcgcgactgaaagaacttgcctgccccatgcccgttatcttcgcaaaggctacaccagttgacagacaggaaaccaaacagacgtacgaatgtccagtataccgcacaaagctgcggggaccttcctacatctggactttcagactaaagtcagaagagaagactgcaaagtgggtcctcgctggagtggccctgctgctagaggcctac

SEQ ID NO: 221422 - DNA, 1374 bp, Artificial Sequence
  Description of Artificial Sequence: Synthetic coding sequence
atgagcgacgccaataaggcagccattgccgctgagaaggaagccctgaacctgaagttacctccaatcgttcaccttcctgaaaatataggggttgacactccaactcaaagcaagctgctgaagtaccgccgttctaaggagcagcagcaaaaaatcaatcagctcgtcatcgatggcgctaaaagaaatttggatcggactctgggtaagcgcactcctctattgcctcccccagattatccccaaacaatgaccagtgaaatgaagaaaaaaggttttaattatatctatatgaagcaatgcgtcgagtcatcaccgctggtgccgatccagcaggagtggttagatcacatgctgcgtctgattccagagtccttaaaggaagggaaggagcgcgaagagcttctggaatcgctgattaacgaggtttccagtgatttcgagaactcaatgaaaagatacttagtgcagagtgtgctggtcaagcctccagtcaagtcactggaagacgaagggggtcccctacctgagtcgcctgtggggctggactactctaacccttggcatagctcctatgtgcaggcgaggaatcaaatcttctctaatctgcacattatccatccgacaatgaagatgctgctggacctcgggtatacgactttcgccgacacagtccttctagacttcacaggcattagagctaaagggcctattgactgcgagtctttaaagaccgacctgtcaattcagacccgaaatgcagaggagaagatcatgaatacatggtatcccaaagtcatcaacctgtttacaaagaaggaggccctcgagggagtgaagccggagaagctcgatgccttttatagctgtgtgtccaccctgatgtcaaatcagctaaaagatttgctccgacgcaccgtggaaggcttcgtcaagttgtttgatcctaaggatcagcaaagactacccatcttcaaaattgaactaaccttcgacgatgacaagatggagttttaccccacgtttcaggacttggaagataatgtgttgtcactggtcgaacggattgccgaagcactgcaaaacgtccagactattccctcctggctgtctggtacgtctacccctgtgaatctggacactgagttgcccgagcacgtgctgcactgggccgttgataccttaaaggctgccgttcacaggaatctcgagggtgctcggaagcactacgaaacatatgtggaaaaatacaactggcttctcgacgggactgctgtggagaacatcgagacatttcagacagaggaccacaccttcgacgagtatactgaggagctggactgctgggtagtatgggaagtctatttttag

SEQ ID NO: 221423 - DNA, 2040 bp, Artificial Sequence
  Description of Artificial Sequence: Synthetic coding sequence
atgttccttctgacgggtggtgtgtctctgaaatcagcagaaaaaaacccagatcccacctggctccaagataagtcttgggaggagatatgtcgcgcttctgagttccccgcattccgtggtctgcgccagcacttctgtgaacacatctatgaatggagggagatctacgactcaaaggagcctcacaacgcgaagttcccagctccaatggataaaaacctgaatgaactccagaagataatcatacttcgatgcttgaggcctgacaaaattaccccagcgattaccaattatgtgacagacaagctgggtaaaaaatttgtggaaccgccaccattcgacttgactaaaagttacctggactcgaattgtactattccacttatcttcgttctttcaccaggcgcagaccccatggcctcccttcttaagtttgctaatgacaaatctatgtccggcaacaagttccaggctatatcgctagggcaaggacagggccctattgccgctaagatgatcaaagcagctatagaagagggaacctgggtgtgcttacaaaattgccacttggctgtgtcctggatgccgatgctggagaagatttgcgaggatttcacctccgagacgtgtaatagttcttttaggttatggctcacaagctatccaagctctaagtttccggtcaccattctgcagaatggcgtgaaaatgactaacgagccgcctaccggccttcgcctcaatctactgcagagctatttaacggatcctgtttcggacccagagttttttaagggatgcagaggtaaggaactgctgttcatcaacgagtacgataccattccattcgaagctattagttacttgaccggagaatgcaactacggtggtagggtgaccgatgattgggaccgtcgcctgttactgaccatgctggcggatttttacaacttgtacattgtggaaaatcctcattataagttttcacccagtggcaactacttcgcccctcctaagggtacatatgaggactacatagagttcattaagaagctcccttttacccagcacccagaaatttttgggttacatgagaatgtcgacatcagcaaggacctacagcagacaaaaactttatttgaaagccttcttctgacacaaggcggttctaagcagacaggcgctagtggttcaactgatcagatccttcttgaaatcactaaagatatcctgaataagctaccctccgatttcgacatcgagatggcactccgtaagtatccagtccgatatgaagaaagcatgaacaccgtgcttgtgcaggaaatggagagattcaataatttgatcatcacaatcaggaacacgttgcgagatcttgagaaagccataaaaggagtggtggttatggatagcgccttagaagcactatccggatcgctgcttgttgggaaagttccggaaatttgggccaaaagatcatatccaagtttgaagccgttggggtcttatataacggatttcttagctcggcttaacttcctccaggactggtataatagtggaaagccctgcgtgttctggctctcaggtttcttttttactcaggccttcctaactggagccatgcagaattacgcaagaaagtatacgaccccaattgacctgctggggtatgagttcgaagtgattccttctgacacctcagacacctcccctgaggacggcgtgtacatccacggtctgtatctggatggggcaaggtgggacagggagtcaggacttcttgcagaacagtatcccaaactgctgtttgacctcatgccaattatttggataaaacccactcaaaagagtcgcattatcaagtccgatgcctatgtttgccccctgtacaaaaccagcgaacggaagggcacattatctaccaccggtcacagcacaaattttgtcatcgccatgcttttgaaaaccgaccagccaacaagacactggattaagcggggtgtggccctcctctgtcaactggatgattag

SEQ ID NO: 221424 - DNA, 9278 bp, Artificial Sequence
  Description of Artificial Sequence: Synthetic coding sequence
atgtccgatgccaacaaggccgctatagctgccgaaaaagaggccctcaacctgaaactgccacccatagtgcacttgcccgagaatatcggggtcgatacccccacccagtctaaactgcttaagtaccgcaggagcaaagaacagcaacagaagatcaatcagctggttatcgacggagccaaaagaaatctcgatcggaccttgggcaaaagaacgccgctgttgcccccaccggactaccctcagacaatgacatctgaaatgaaaaaaaagggttttaattacatatacatgaagcagtgtgttgagtcatcccctttagtccctatacagcaggagtggctggatcatatgctgcgacttattccagaatccttgaaggaaggaaaagagagggaggagctgctggagtctctgattaacgaagtctcttctgacttcgaaaatagcatgaagcgttacctggtgcaatctgttctggtgaagcccccagtcaaatctctcgaggacgaggggggacccctccccgaatcaccagtgggcctggattattctaacccatggcactcaagctacgtccaagcccgtaatcagattttcagtaatctccatattattcacccaacaatgaagatgctcttagaccttgggtatacaacatttgctgacacagttcttctggacttcaccggcatacgggcaaaaggccctatcgattgtgagtccctcaaaactgacctgagcatccagacgcgcaacgccgaggaaaaaattatgaacacgtggtacccaaaggtcataaacttgtttacgaagaaagaggccttggaaggcgtcaaaccggaaaagctggacgcattttatagctgtgtgagcaccttaatgagcaatcaacttaaggacctcctacggcgaactgtggaaggattcgtcaaactgttcgaccctaaggaccagcaaaggcttccgatttttaaaatcgaactgacatttgacgacgataaaatggagttttaccccacctttcaggatttagaagataacgtactctccctggtagagaggattgccgaagcattacagaatgttcagacaatcccatcttggctctctggcacctccactccagtgaatttggacacagagttacctgaacacgttctccactgggcagttgatacgctgaaggccgcagtgcaccggaatcttgagggagcaaggaagcactacgaaacttacgttgagaagtacaactggctgctcgatggcactgccgtcgaaaacatagagacgttccagacggaagatcacacttttgacgaatataccgagttcatcgaaaagttcctttcacttgcttcagaaatcatgctactgccacagtggattcactacaccatggtccgattagactgcgaagatctcaagactggactcacaaataaggcaaaggctttcgccaacatcttgctaaatgatatcgcctcaaagtacagaaaagaaaatgagtgtatctgcagcgagtttgaggccattaaggaacatgcactgaaagtgccagagacgaccgaagagatgatggacctgattagttacgtggaaaaggcacggacggtgggtatcgaagaactgatccttcgcatccaagagagtaaaagacagatgagttacttcctcgacgtcttcctgtttccccaggaggacctcgctttgaacgcaacagtcctcatgtggcctcgaaagataaatccgattttcgacgagaatgatgagctgattgagaatgcaaagcataaaaaagagaatgagttgatggccaagagagaaaaactcatcctggagattgagaaggagtcccgccgaatggaggaattcaccgaatttgccgagctagagcgcatgcagcagtatgtcacagatgtcagacagctccagaagcgcattcaggagtctgaagaagccgtccagttcatcaataaggaagaggaactttttaaatgggagcttacgaagtaccccgaattggacaaattgaaagtgaatattgagccataccagaagtttttcaattttgtactgaaatggcaacggtctgagaagcggtggatggatggcggtttcttagaccttaacggcgaatccatggaagccgatgttgaagagttctctcgggagatttttaaaacactgaagttctttcaaacaaaactgaaaaaggagcttcaagaaaagcgtaaggcagcccgtaagaggtctctggaggaggaaaagattgaagaagaaccaaaggacaacgcaactattacaatgtgcagaatgcgagcacggcattggaaacaaatctccgagatcgttggatacgacttgactccggattcaggaacgaccctacgaaaagttctgaagctcaatctgacaccgtatctcgagcaatttgaagtcatctccgcaggggcttctaaagagttctcactcgagaaggcgatgaacaccatgatcggtacatgggaggatatcgcattccatataagcttatatcgcgataccggcgtttgtattttgtcttccgtcgatgaaatccaagcgattctggacgaccagataatcaaaacgcagaccatgcgtggctccccctttatcaagcctttcgagcatgagatcaaggcttgggaagatcggctgatcaggattcaggagactattgatgagtggctcaaagtgcaagcccagtggctgtacctggagccaattttttgtagtgaggacatcatgcagcagatgcccgaagaaggtagacaatttcaaactgttgaccgacactggagggacataatgaagttctgtgccaaagatccaaaagtgctcgctgctactagcctgactgggttactcgagaagttacagaactgcaatgagctcctggaaaagattatgaaagggctgaacgcatatctggaaaagaaaaggctgttcttccccagatttttcttcctctcaaacgacgaaatgctggaaatactgagtgagactaaggatcccttaagggttcagccacacttgaaaaaatgtttcgagggcattgcgaagcttgagtttttgcccaacctggatatcaaggctatgtactcaagtgagggggagcgagtcgaattgatcgcgctaatttccacttctgctgcaagaggtgctgtcgaaaagtggcttatacaggttgaggacctgatgttacggtccgtgcatgatgtgatagccgctgccagactggcttatcccgaatcggccagacgggactgggtgcgagagtggccagggcaggtagtactgtgtataagtcaaatgttttggacaagcgagacgcaggaggtcatttctggaggaaccgagggcctcaaaaagtactataaggagttgcagaaccagctaaacgagattgtggagctagtgcggggtaagttgtccaaacaaactcggacaaccctgggcgctttagtgaccatcgacgtgcacgctcgggacgtggttatggacatgattaagatgggtgtatcacatgatactgacttcctgtggctggctcaactacggtattattgggagaacgagaacgctcgtgtccgaataatcaactgcaacgtgaaatatgcctacgagtacctgggaaacagccctagactggttatcacacctctgacggatagatgctacagaaccctgattggagccttttacctgaacctcggcggtgcgcctgagggaccagcagggacaggcaagactgagactacaaaagacctcgccaaagcactggccgtgcaatgtgttgtcttcaactgttccgacggccttgattacctcgctatggggaaattcttcaagggcctggcctcatctggggcatgggcttgttttgacgaattcaaccgcattgagttagaggtgctgtcggtagtggcccagcagatcctttgcattcagagagccattcagcagaagctcgtcgtgttcgtcttcgagggcaccgaattgaagcttaaccctaactgcttcgtggccattaccatgaacccagggtacgctggccgatcggagctcccagacaatctcaaagtgcttttcaggacagtggcaatgatggtaccgaactacgccttaatcgccgagatctcgttgtattcctacgggtttctgaatgcccgacctctcagcgtcaagatcgtaatgacataccgcctgtgtagcgaacagctgtcctcccagttccattacgattacggcatgagagctgttaaggccgtactcgttgctgctggtaacctgaagctaaaataccccaacgaaaacgaggatatcctgcttctccggtctatcaaagacgtgaatgagcccaaatttctgagccatgacatacctctcttcaatgggattacctcagatctgttcccagggatcaagctcccagaggccgattatcatgagttcttggaatgcgcccatgaggcatgtaacgtgcataacttgcaacccgtgaagtttttcttggagaaaatcatccagacatacgaaatgatgattgttaggcatggatttatgttagtgggggagccttttgctgccaaaactaaagttctgcatgtgctcgcagacacgcttacactgatgaatgagcatggctatggcgaagaagagaaggtgatctatcgaaccgttaatccaaaaagcattacaatgggacagctcttcggccagtttgatcccgtctcccatgagtggacggacgggattgtggctaacacctttcgcgaattcgcactttccgaaacacccgatcgcaagtgggtggtttttgatggacctatagataccctgtggatcgagtcaatgaatacggttcttgatgacaacaaaaagttatgcctgatgtctggtgaaattatccagatgtccccacaaatgtccttaatctttgaaacaatggacctgtcccaggcctcaccggcaaccgtttcccgttgcggaatgatttatctagagcctagccaactgggatgggaaccccttgtttcctcctggcttaactcccttaaggggcctttgtgtgagccggaataccaggctctgttgcggggactgttcgcctggttaatcccacccagtctgaatcaaagggtcgagctttttcagctcaattatctgtataccacaattgtttccaaaatactaaagatattaattacattccggatttcaaattacttcaagtacgtgcctctcaagacacaatgcacttttatcaagttctttctacatcagcaggcctgttttatctttagtctgatctggagcatcgggggtagctgtgacaccgatgggaggcgggtgtttgacacattcatccggctaatcattcttggaaaggacgacgaaaaccctgtcccagatagcgtagggaaatgggaatgtccgtttgacgagaaagggttggtgtacgattacatgtatgagctgaaaaataagggcaggtgggtgcactggaacgagcttatcaagaataccaatttgggggacaagcagatcaaaattcaggatataattgtacccactatggatacgatccggtatacatttcttatggatctaagtatcacttacgctaagcctctgctattcgttggccctaccgggacagggaaaagcgtgtatgtgaaggataaactgatgaatcatcttgaaaaagaccagtatttccccttctatattaatctgtccgcccgtacatctgcaaatcaggtgcagaacatcatcatggccagacttgacaagcggagaaagggggtgtttgggcctcccatggggaaaaagtgcattatcttcattgacgatatgaacatgccagccttggaaaaatatggcgcacaaccgcctatagagctcctgcgccagttctttgactgtggacactggtatgatctgaaggacacaagcaagatcacactggttgacatcgagctgatcgcagccatgggcccaccaggcggtgggcgtaatcctgtaacgcccagatgcatccggcatttcaacatctgctctataaacagcttcagtgacgaaacgatggtgcgaatattctctagtatcgttgccttttacctgcggacccacgagtttcctccagagtattttgtgatcgggaaccagatcgtgaacggaaccatggagatttacaagcagagcgtggagaatctgctgcctacccccaccaagtcccactacacattcaatctgagagacttctcaagagttattagagggtgtcttcttatagaaagggatgcggtagctaataagcacactatgatcagactgtttgttcacgaggtgcttcgtgtattctacgatcgattgatcaatgacgatgatcggaggtggttgtttcaactcaccaagaccgtcataaaagatcacttcaaagagtccttccactcaatctttagtcatcttcgcaagcagaatgccccagtaactgaggaagaccttagaaatctgatgtttggcgattacatgaatccagacctggaaggagacgacagagtctatattgaaattcccaatatccaccatttctctgacgttgtggaccagtgtctggacgagtacaatcagacccacaagacgcgtatgaatctcgtcatctttcggtatgtacttgaacacctgagtagaatttgcagagtcctgaaacagagtggcggtaacgcactcctggtgggactgggcggatctggacgacaaagcctcacacgcctcgccacaagtatggctaagatgcacattttccagccagaaatttcgaaaagctacggaatgaacgaatggagggaggatatgaagtccttcatcgccgtccctgtcacgaaccgcatcgtcgacaacaagtcgaaaatcttagagaaacggctcagataccttaatgatcatttcacctataacctgtactgtaacatctgccgcagtctcttcgagaaagacaagctactcttttcctttctgctgtgtgccaacctgttgctggccagaaaggaaatcgaataccaagaactcatgtttctcctgaccgggggagtctctctgaagagtgccgagaagaatccggatccgacctggctgcaagacaagtcctgggaggagatctgtcgcgcttctgaattccctgcattcaggggactaaggcagcatttttgcgaacatatttacgaatggcgggagatctatgactctaaggagccacacaatgcgaagttcccggcacctatggacaaaaacctgaacgagctgcagaagatcatcattctcagatgcttgagacccgataaaattacaccagccatcacgaactatgtgaccgataagctcgggaagaaattcgttgagccgccaccctttgatttgaccaaaagctatttggactccaactgtacgatccctcttatctttgtgttgtctccgggagccgatcctatggcctccctgctgaaattcgcgaatgataagtcaatgtcggggaataagtttcaggcaatttctttgggtcaaggccaaggaccgatagcagccaagatgattaaggccgctatcgaagaggggacgtgggtatgtttgcaaaattgccatctcgccgtgtcttggatgcccatgttggagaaaatctgcgaagattttaccagtgaaacttgtaactctagcttccgcctgtggctaacgtcatacccaagttctaagtttcctgtgactatcctgcagaatggcgtgaagatgacaaatgaaccgcctacggggctccgcctgaatttactccagagctatctgaccgacccagttagtgatcccgagttctttaaggggtgcagaggcaaagagctcgcgtgggaaaagttgcttttcggggtgtgctttttccacgcccttgtgcaagaacgcaagaagttcggcccacttggttggaatatcccttacggtttcaacgaatcagatcttcggattagcatcaggcagctacagctgtttattaacgaatatgacaccattccatttgaagctatcagttaccttactggggagtgtaactacgggggtcgggtgacagatgactgggatcggcgtttgctgttgacaatgttagctgatttttataacctttacatagtggagaacccacactacaagttttctccatctgggaactacttcgccccaccgaagggaacgtacgaagactacatagagttcatcaaaaagctcccatttacacagcacccggagatctttggcttgcacgagaacgtggacatttccaaagacctgcagcagactaagaccctcttcgaatcccttcttttaactcaaggcggatccaagcagaccggtgcgagtggctctactgaccaaattcttctggaaatcaccaaagacattctcaataagctcccctccgattttgacatcgagatggcacttcgaaagtatcctgtcagatatgaagagtctatgaatacagtcctcgtgcaggagatggaacgctttaataatctcataatcactatccggaatactctcagggacttagaaaaggcgatcaagggagtggtggtgatggactcagctctggaggccctgagcgggtcgctcctggtcgggaaggtaccagagatatgggctaagaggtcatatccatcactaaaacctttgggcagctacatcacagacttcctggcgcgtctgaatttcctacaggattggtacaacagtggcaagccctgtgtgttctggctgtctggctttttctttacacaagcttttctaaccggcgcaatgcaaaattacgcacggaaatacacaacccctatcgacctgctggggtatgaattcgaagtgatccctagtgacacatccgacacatcgcctgaggatggggtttatatccacggattgtatctggacggcgcaaggtgggacagagagagtggacttctggccgaacaatacccaaagctgctctttgatttgatgcccatcatctggatcaagccaacacagaaatctagaatcatcaagagtgatgcctacgtgtgccccctctacaaaacctctgagagaaaaggtaccctgtctacgaccggacactccaccaactttgtcatcgcaatgctgctgaagactgaccagcccactcgtcactggattaaacggggagtcgccctcctctgtcagctggatgacta

SEQ ID NO: 221425 - DNA, 2355 bp, Artificial Sequence
  Description of Artificial Sequence: Synthetic coding sequence
atgagtgatgccaacaaggctgctattgcagcagaaaaagaggcccttaatctgaagctgccacccatcgtgcatctgcctgagaacatcggtgtggacactcctacacagagtaagcttctcaagtacagacgcagcaaggaacaacagcaaaagattaaccaactggtcattgacggcgcaaagcgtaatctcgatcgcactcttggtaagagaactcccctgctgccaccaccagactatccacaaacaatgacatccgaaatgaagaagaaagggtttaactacatctacatgaaacagtgcgttgagtcttctccactggtcccaatacagcaggagtggctggatcacatgcttcggctgatccctgaatccttgaaggaaggcaaagagagagaagaattactggagagcctgataaacgaggtgagttcagattttgaaaatagtatgaagaggtatctggttcagtcagttttggttaaaccccctgtgaagagcttagaagacgagggcggtcccttaccagagagcccagtcgggcttgactacagtaacccttggcacagctcttacgtccaagctcggaatcagatttttagcaatctgcatatcatccacccaacaatgaaaatgctcttggacttaggttatacaacatttgctgataccgtcttactggattttaccggaatcagagcgaaagggccaatcgattgtgagtcccttaagacagatctatcaatccagacccgtaacgctgaggaaaaaatcatgaatacctggtaccccaaggttatcaacctatttaccaaaaaggaggccctggaaggagttaaaccagaaaagctggacgcattttactcatgcgtatcaaccctgatgagtaaccagctaaaggacctccttcgacgtacagtcgagggctttgtcaagctgtttgaccccaaggaccagcagcggctaccgatctttaagatcgagcttacgttcgatgacgataagatggaattctaccctacattccaggatctggaagataatgttctgtcactggtagaacgcatcgctgaagctctccagaatgtccagaccatcccatcctggcttagcgggacctccaccccagttaatcttgatacggagctgccagagcacgttctgcattgggctgttgacacactcaaggccgcagtacatcgtaatctagaaggagcaagaaagcattacgagacatacgtggaaaagtacaactggctgctggacgggaccgcagtggagaacattgagacgttccagactgaagatcatacctttgacgagtacacagagttcatcgaaaagttcctcagcctagcatccgagattatgctactcccgcagtggatccactatactatggtgcgcctggactgtgaagatctgaagaccggtctgactaataaagccaaggcatttgctaacatcctgctgaacgacattgctagcaaatatcgaaaggaaaacgagtgtatatgtagcgagttcgaggctatcaaagaacatgccctcaaggtccccgagactacggaggaaatgatggatttaattagttatgtcgagaaggcccgtacagtgggtatagaagagctgatcttaagaatccaggaaagtaaacgacaaatgagctactttctggacgtctttctatttcctcaggaagatctggcccttaacgctacagtgctcatgtggccacgaaagataaacccaatatttgacgagaacgatgaactcatcgagaatgccaagcacaagaaagagaacgaactgatggccaagcgggagaagctgatattggaaattgagaaggagtcgcggagaatggaggagttcaccgaattcgccgagctggagagaatgcagcaatacgtgactgacgtgcggcagctccagaagagaatccaggagagcgaagaggctgtccagttcataaataaagaagaagagctgtttaaatgggagctgactaagtatccagagttagataaattgaaggttaatatagagccgtaccagaaattctttaatttcgtgctcaagtggcaaaggagcgaaaagaggtggatggatggtggcttcctggacctgaatggggaaagcatggaagctgacgtcgaggagttttcccgtgagatttttaaaactttgaaattcttccagactaaattgaaaaaagaacttcaggagaagcggaaggccgcacgtaaacgaagcctggaggaggagaaaattgaggaggaacccaaggacaatgctacaattaccatgtgctcaacagtaatggagcagattaaagcctttaaagtttag

SEQ ID NO: 221426 - DNA, 687 bp, Artificial Sequence
  Description of Artificial Sequence: Synthetic coding sequence
atggagacctttattcctattgaccttaccaccgagaatcaagagatggataaagaggagacaaaaaccaagcccagactgctcaggtacgaggagaaaaagtacgaagacgtcaagcccctagaaacacagcccgctgagattgccgaaaaggagacattagagtataagacagtccgcacgtttagcgagagccttaagagtgaaaaaaccgaggattaccttcgcgagtctataatccagcaacacatggtgagccctgaaccagccagcctgaaagagaagggaaagtcccggaggaaaaaagatcagactcacgcttgccccaatgtgcggaaagccaggccagtgtcctacgaccgaactgaaccaaaggatgacgacgtgatacggaatataatcaggctaagagaaaaactgggatggcagaccatcctgcctcagcattctttgaagtacggttcctctaaaatcgctattcagaagatcaccctcaaaaagcctttagaggatgatggggaattcgtctattgcctgccccgaaagtcccccaaaagcttgtacaacccctatgatctgcaggtcgtctccgctcataccgccaagcattgtaaggaattctgggtaattaccgccagtttcatatctaaacggtatttagtgatatgtggtgccgtgtatatatag

SEQ ID NO: 221427 - DNA, 687 bp, Artificial Sequence
  Description of Artificial Sequence: Synthetic coding sequence
atggagacttttattcctatcgatttgaccactgagaaccaagaaatggacaaagaggagacgaagacaaaaccgagactgctcagatacgaagaaaaaaagtatgaggatgtcaagcctctggagactcaacctgccgagattgcagagaaggagaccctcgaatataaaacggtccgcacctttagtgagtcccttaagtctgaaaagacggaagactatttacgtgagtccatcatccagcaacacatggttagccccgaaccagcaagccttaaagagaagggcaagagtcggagaaagaaggatcagacccacgcatgcccaaatgtgcgcaaggctcgaccagtctcctatgacagaaccgagccgaaggacgacgacgtgatccgaaacataatccggctgcgcgagaagcttggctggcagaccatcctccctcaacatagcctgaagtatggatcctcaaaaattgccattcaaaaaatcacgctgaaaaagccccttgaagatgacggcgagtttgtgtattgtctgccgaggaaaagccccaagagtctgtacaatccttacgacctgcaagtcgtaagcgcgcacacagctaagcactgtaaagaattttgggttatcactgctagtttcatctcgaaacggtacctggtgatttgtggggctgtgtatatatag

SEQ ID NO: 221428 - DNA, 1362 bp, Artificial Sequence
  Description of Artificial Sequence: Synthetic coding sequence
atggagaccttcattcctatcgatctcacaaccgagaaccaggagatggataaggaggagacaaaaaccaaacctaggctgctccggtacgaagaaaaaaagtatgaggatgtaaagcctctggaaacgcaacccgctgagattgccgaaaaggagaccctcgaatacaagacagtgagaaccttctcagaaagcctgaagagtgagaagactgaagattaccttagagaaagtatcatccagcagcacatggtcagccccgagccagctagcctgaaggaaaaaggcaagagtagacggaagaaagaccagactcacgcttgcccgaatgtgcgaaaggctaggccagtctcgtatgaccgaacggaacccaaagatgacgacgtgattcgtaatatcatcaggcttagagaaaaactgggatggcagactatcctccctcagcatagcctgaaatatggttcctctaaaatcgccatccagaaaataactctgaagaagccacttgaggacgatggcgagtttgtgtactgcctgccaagaaaatcccccaagtccctgtataatccatacgacctgcaggtggtgtccgcccatacagcaaaacactgtaaggagttctgggtcatcactgcttcctttatctccaaagtcattaacatagtaggctccgtgaaagaagtggaattgatcccaactctcgaatggctgtcagaaagaagacactattatcttttgcgtcagttcaagatcttttcagatttccgaatgaacaaagcattcgttacatggaaattgaatgtcaagcggattaaaacggagaagtcaagaagttttttatatcatcatctgtttctcgcagacgacctgtttcagacatgcttagtatacatccggggactgtgcgaggacgcaatcaacctcaaaaattataacgaccatgagaacaacttgtctgcgatctgcttagttaaattagactcatctcggacatactcattggacgaattttgcgaagaacaacttcagcaggccactcaggctctgaaacagctggaggatatacggaataaggcgatttcagagatgaagagcaccttcctgaaggtcgccgaaaaaaatgagattaaagagtattttgagagcaagttaagtgaggatgatacaactcactttaagctgcctaagtaccggaggttgctagagactttcttcaagttcgtgatgcttgtcgactatatcttccaggaactcatccggcagcttatgaacaccgcagtaacgctactacttgagctgtttaatgggagtgcgggaatgccttttagcgttgaaaagaagaacgaaaatttaattcgttag

SEQ ID NO: 221429 - DNA, 13548 bp, Artificial Sequence
  Description of Artificial Sequence: Synthetic coding sequence
atggagacattcattccaatcgacctgacaactgaaaaccaggagatggacaaggaagaaacaaagaccaagccaaggttgctgaggtatgaggaaaagaaatatgaagacgtgaaaccactggaaacccagcctgctgagatagctgagaaggagactctcgaatataagactgtgcggaccttctccgagagtctcaaatcggagaagacagaagattaccttcgggagagtatcattcagcagcatatggtgtctccggaacctgcgtcactcaaagagaagggtaaaagccgaaggaaaaaggatcagacacatgcctgcccaaatgtgagaaaagccagacctgtgtcttacgatcggaccgagcccaaggacgacgacgtgatccggaacatcattagactgcgtgagaagctcggctggcagaccatactgccccagcactccctgaagtatggctcctccaaaattgcaattcagaaaatcactttgaaaaagcctttggaagatgacggcgaatttgtctactgtctacctcgcaaaagcccaaaatcactgtacaacccctacgaccttcaggtcgtcagcgcacacacagcgaagcactgtaaggagttctgggtgatcaccgccagctttatcagcaaggtgatcaatattgttggatctgtgaaggaggtggaactgatcccaacactcgaatggctttcagaacgaaggcattactacctgctgcgtcagttcaaaatcttcagcgacttccgcatgaataaggcctttgtgacctggaagctgaacgtgaagcgcattaaaaccgaaaaatctcggtcctttctttatcatcatctgtttctggctgacgatctgtttcaaacctgtctcgtatatatccggggtttgtgcgaggatgctataaacttgaagaattataatgaccatgaaaataacctgtctgcaatttgtctggtaaaactggacagcagcagaacatattcattggacgagttttgtgaggagcaacttcagcaggcaacacaggccctgaaacaattggaggatataaggaacaaagcgatctcagaaatgaagtcaacgtttcttaaggtcgcagaaaaaaacgagatcaaggaatacttcgagtccaaactgagtgaagatgacacaactcacttcaaactgcctaagtacagacgtctgctggaaacattcttcaagttcgtgatgctagtggattacatcttccaggagttgatcagacagctgatgaacacagcggtaaccctgctactagagctgttcaatggcagcgctggtatgccttttagcgtagaaaagaagaatgagaacctcataagaacctttaaggacaattccttcccaaccgggaaaactaccaacgattgtgaagaactggttgacaattctaaattgcacgctatatcagtccaaaaatcagaagtgaagaccgatactgacatcaacgagatcctgaactcggttgaggtgggtaaagaccttagaaagacctacgcgcctatcttcgaggtaaatttatgtctgaggattcccgcagaaagcgactcgtctgagaattccaaagaaaactttcatgaatctgatcaatgtcctgaagagtgtgttatgtttgaagacgaaatgtctgaaaataaggataattgcgtgaaaaagcactcctccgaagagctcttgccaaaggccaagaaatccaaagagattagctataaccttgaggatattatttccgacactgaaatagaaactgaatttgagaataagtacatgtactatgaattccccgagttccctactaatcttttcatcgaccctaaccgcctggaattcagcgttaagatccagaacatgctcaccaatatggagaagtgtataactaccatcacccctctctgccaggacccacaattgagcatattcatcgatctcgtgtcgatcatggacctccccaataagaccgggagcattatacattataaagaacagacccggtggcccgattgccacattctgttcgagacggacccagcctaccagaatatcattgttaacctcctaaccattatcggcaattccatgggcctggtgaacgcctattcccataaatttatcaaatattgtactatgactgagaaggcgaaaattatgagcatgaagataagcagtatgggcgagctgacctctaaggagtttgaggccattctgaatcgatttagaaactacttccgccatatcgttaacatggccatcgaaaaacggatcggtatttttaacgtcgtatccctggactaccagagtgaatgtctcctgtacatagacaatgtgattcatatgagtcacaccctcatccaaagcgtgattgaaaaaaagaataaaaacctgctcgaggtagtcgaatcctctctgcagcagttggagtgtgatccgaccgagatagaggagtttttagaacactttatctttttaaatgctatatcctctaagatctcaaaactggaaaaagagtttctaactatgagccagctatattctgtagcaaaacaccatcagatccacatctccgaggagcagatagccatatttcaggtcttgcttctcaagttcagccaattgaaatcctcaatgaaacttagcaagataaacaaagatactgccattactaaattcagagacaatctcgaagcttgtatatcggggttgcatgtcgatgtaggcaacttgaaagccaaaatccgcaccccactgcttctgtgcgctggcactcaggtttctaccgctatggaaatgattcaaactctgagcggtgaagccgcatcccttaccaataaagcaaaggcgtactcccattatcaagactgtttttctgactctcagagccacatgcattcagtgaatgtcgaagagatcacccagatagtgctgtccgaaatcagcgacatcgagggtgacctcaccctccggaaaaagctatgggaagcccaagaagagtggaagcgggcatcctgggagtggcgtaatagtagtctccagtctattgacgttgagagcgtgcagcgcaacgtgtctaagctgatgcacataatttccgtcttagagaaaggactccccaaatcagacatggtgactcatcttaagcaagtagtgaccgaatttaaacaggaattacccatcattatagccctcggcaatccctgcctgaagcccaggcactgggaggcactacaggaaataataggcaagtcagtgcccttagataagaactgcaaggtggagaacctacttgccctgaaaatgttccagtacgaaaatgagataaacgatatgagcacgtctgctacaaacgaggccgcactggagaaaatgctgttcaagatcatcgacttctggaacaccacacccttgcctctaatactccaccataccgaaatttacagtattttcatcatcccctccatagatgacatctccgcccaactagaagaatctcaagtgatcttggctacaatcaagggcagtccacatatagggccaatcaaagatttggtgaacgaatgggaccagaacttgactctttttagctatacgttagaggagtggatgaattgtcagaggaactggttatacctcgaacccgtgtttcactcatccgagatacggcgtcagctgccggcagagaccgaactcttctcccaggttatttcaatgtggaagaaaatcatgagcaagattcagaataagcagaatgcattgcagataactacatctgcaggggtcttagaaattttacaaaactgtaacattcacctcgagcacatcaagaaaagtctggaagactacctcgaggtgaaacggttaatctttcctcgtttttactttctgagcaacgccgagttacttgacatcctggctgactcacgaaaccccgagtctgtgcaacctcatctagtgaaatgttttgaaaatatcaaacagctcctgatttggaaacaagacattggaccacccgctgtaaaaatgttgatctccgccgagggcgagggtctggttctgccgaaaaagattcgagtgagaagcgctgtcgagcagtggttggttaatgtggaaaagagtatgttcgacgtcctgaaaaaagagcggtatatctacaatataatacttttgtttcagagtcagataatgttttacaatgactgtgtgaaatctttcgtcagctcatattccagggaaaagctggagaaggtacacgcaggccttatgtgtcacctggaggaggtggccgatctggtggtgctggacacctccaattccagaacgaaggccatcttgggcgcactgttgattttgtatgtgcattgtcgggatatcgtcatcaatctcctacttaaaaacatttttaacgcggaagatttcgagtggaccaggcacttacagtataagtggaacgagaagcagaagttgtgctacgtttctcagggaaatgcttcttttacttatgggtatgagtatctgggatgcacatcacgcctggtgatcactcccctgacagatcgctgttggctgacattaatggaagccttgcatctaaatcttggcggatgcccggctggaccagcaggaaccggaaagactgaaacagtcaaggatctggctaaaagccttggcaaacactgcgtggtgtttaattgcttcgaggatttggactacaagatcgtgcgtaaattcttctttgggctggtgcagtcaggcgcatggtcctgttttgacgaatttaacctgattgacctggaagttctgagcgttatcgcctctcagatcttgaccatcaaagcagccaaggacaactattccgcacggttcgtgctggagggcaaagagatacggatcaatatgtcctgcgccgttttcatcaccatgaatccaagatatggtggaggagtcgagctgcctgataatcttaagtctcttttccgaccggtggctatgatggtaccccattaccagatgatagctgagattattctcttctccttcggattcaagagcgctaacagtctgtccggcaaactgacaaatctttatgagctggctaggaagcagctgagtcagcaggatcattacaactttggtctgcgcagcctgaagattgtcttaattatggctggtacgaagaaacgcgaatttaagtgcctgagcgaggccgatgaaaccctgatagtgattgaggcaatcagggaggcatccttacccaagtgccccccagaggacgtgcctctgtttgagaatataatcggcgatatcttccctgaagtgaccgtgctgaaagtgaatcagctcgccctggagaaagttatctataccgcgacccagcaattgggcctgcagaattggagctcccagaaggagaagatcatccagttctacaaccaactccaggtgtgtgttggagtgatgctggtaggccctaccggcggagggaagacaacggtgaggcggatccttgagaaagcgctcactttgttgccaattgcagatttcttgagcgttgctgagcgtaaatccgcctctaagatatctgagaggaaaggtaaagtggacatttgtgtgttgaaccctaaatgtgtcaccctgagcgagctttacggtcaactcgatccaaatactatggagtggacggatggactcctgtcagcaactatccgctcatacgtctactttaacacccctaagaacaccaaaaaggacattgacctgcgcttgaagtcccggatcagtgacctgtcaaatgtgttcaagttagattcttcagacactaccgagacggacgataacatcttcgaggagatcgaaaaggtggtgaaaatccccgagaatcacaactttgactggcaatggatcattttggatggtcccgtggataccttttgggtggaaaaccttaattccgtgctcgacgacacccgcaccctttgtttggccaatagtgagagaatcgccctgactaataagatcagagtgatcttcgaggtagacaatctgagtcaggcttcgcctgccaccgtgtcccgatgtgccatggtgtacatggatcctgtggatctcgggtgggagccatatgtgaaaagttggctgctcaagactagcaaaatcatctcacagtcaggggtggactgtttagagttcatgattaagaatagtgttacagacggactgcagttcatcaggaatcggcagaagttccaaccctatcctatggaagacatcactgtggtcataaccctttgtcgaatcttggatgcatttttcgacttcatgggaaagaacggcggatttgagcagtccgatgaccttaatgacaccagttctaaagaagccaatagccagagagagtccgtgaccttcaaggatatcgagaaacgggacgaaaacacctggtaccctgagaaaaatcctgataagctgactaaaattattcaaaagctgttcgtgtttgcctttacttgggcctttggaggggctttgaatcgcgaagatgaacatagggagaatatccctttttgtccgagcctggagccggattccctcgcaaaagtaacatatgatttcgacaagttggtccacgaattatttggaaacagttcccaggtgggatggaagcactggggtcagtcccaaggacggagacgcaaaggaaactgtattaacttgcccacaggtgaatgcagtatcttcggatatttcgtagatattgagcaatgcgaatttattccgtggtccgacctggttccaaatgatcaaaccctgatccagcgaggaactagtctcttaacaaatttacagagatctgggggtaactttctaaaaattaccgaatgtggtgaatgcatcaattatactgccacccgggataccacttgtctctcattccttatgtctcttctgttgaaaaattcatgcccagtgctccttactggagagagcggcgtgggcaagactgcagccataaatcaaatgttggaaaagctcgagggtccaggcgcattcgatattaagcatggaagcatccttggagacacattattatactccgaaatcaagaaatctagtagtttaaagcagaacataacgattcttattcccgaaacccataagacggcaaccggctcatctgacaaccccacaaagaagcccgaagtcaggacaaacaagaagcttctgaaaaataatgaccacaagggcgtcgtcgtgagcacaatcaatttttcgactaatgtgaccgccgcaaagaccaaagagatgatactgaaaaagctgatcaggcgaacaaaggatacccttggggctcccaagaacaatcgcatactcatctttatcgacgatatgaatatgcctgtgagcgacatgtacggcgcacagccgccactggagctgattagacagctgttggacctggggggtgtctacgatacagaaaaaaatacttggaagaatatccaggacctaagtattgtggccgcttgtgtgcccgtagttaacgacataagccccagactgttgaaacatttcagtatgctggttctgcctcaccctagccaggacattctttgtacaatctttcaggcccacttgggcatttacttttctattaacaatttcacacccgaggtgcagaaatccaaggaccagatcatatcctgcagccttgcgatctatcaccaggtccggcagaacatgctgcctacgccgacaaaatgccactatatgttcaacctcagagacatgtttaaactcttgctcggcctcctccaagccgaccgcactgtggtgaatagcaaggagatggcagctcttcttttcgtacacgaggcaacacgtgtcttccacgacaggctgattgatttcactgacaagtctcttttctatcgtctgctgtctagggagctggagaactgtttccagatcgggatcgatggctgcggcaaaaagacatgtgccaccctggcctgctatttgaccgacaataagctctacagagtacctatctcacacaaatgcgcgtatattgagtttaaggaggtgtttaaaaaagtatttatacatgcgggtctgaagggcaaacccactgtattgatggtaccgaacctcaacatcgaacaggactccttcctggaagatctaaactatatcataagcagcggacgaatacccgatctgttcgagaatgtggaacttgatagtattgccatgaagatcagatacctgaccgagcagtcaggacatatggataacagacagtctctcctgagcttcttccaaaaaagaatctataaaaacctacacatcttcgttataatgagtccggagggaccctccttccggcaaaattgtagagtgtatcctagtatgatcagtagctgcactatcgattggtatgagcgctggccggaagaggccttgctgatcgtggccaattcgtttctgaaggagaaagttaacttcgagaatagggaaaatctcaaagagaagctggctcctacatgtgtgcaaatccacaaatctatgaaggacttgaatcgtaaatacttcgaagaaactggtcgcttttattacactacccctaactcttacttacagtttatggagacctttgcccacattctgcgagcccgagaggaggaaatgcaaaccaaaagggacagattccacatgggactatcaacgatcctggaggcgacgacactcgtcaccgagatgcaggaggaactacttatcttgggcccacaggtcgaacagaagactaaagaaaccgagacactgatggaaaaacttcgaaaagattctcaagttgtagagaaagtgcagatgcttgtcaaacaagacgaagagatcgtggcagaggaggtaaggattgtcgaagattatgcccagaagaccgcaaatgagctcaaaagtgtgctgccagcttttgacaaggccatagtcgctctgaatgccctggataaagccgatgttgctgagctgagagtttacaccagaccaccattcttggtcctcaccgtcatgaacgccgtgtgcattctgctgcaaaagaagcctaactgggcaaccgcgaagctcctcctctccgaaacagggttcctgaaaaaactaatcaatcttgataaagacagcattcccgacaaggtctttgtaaagctgaagaaaattgtcactctgcctgacttcaatcctcacaaaatatcactggtaagcgtcgcctgttgcagtctttgccagtgggtaatcgcattgaataactatcacgaagtgcagaaagtggtcgggcctaaacagatccaggtcgccgaggcgcagaatgtactgaaaatagccaggcagcgcctcgccgaaaaacagcgcggactgcagctcgtggaggaacacctgttatttctccaggcagcttataaggatacggtggccgaaaagcaattgcttgccaacaggaagaccatggcttcgcgacgctttcagtgtgccagcgtcctgctgacggtgttagaagacgagaagacgcggtggcaggagacgataaaccagatcgacaacaagctagaaggcatcctcggtgacatcctgcttagtgccgcttgcatcgtttacagtggcatcctgacacctgaattccggcaacttattgtcaacaagtgggagactttttgcattgagaacggtatctctctttcatcaaagttttccctgatcaaagtgatggcccagaagtatgagatcagtcggtggcacaatcagggtctgcctcatgggcagtactccgtcgagaacgccatccttatcaaaaacggccagcaatggcccctcctaatcgatccgcacagacaggcacacaaatggatccggcagatggaggggagccggttgcaaaagctcagcatcgaagacagcaattacactaagaagattgagaacgcaatgaagaccggtggttcagtgctgctgcagaatctactcgagacactcgctcccggactgaaggccatcctgaaaaaggatatctatcagaaaaaggggcattatttcatccgggtgggcgatgccgagtttgagtataattctaacttcaggctgtacctaagcacggagattgacaaccctcatttcctgccgagcgtctacaactttgtaaccatgatcaacttcaccgtgacttttcaaggcctgcaggaccagctgcttagcacagtggtgacgcatgaggtaccacatctagaagatcaacgctccaaacttctggaatcgatttcactcgacgctattactctcgaggagctcgaggaaaagacgctgaatctgctccaaaaggcactggggagcatcttggacgatgataagatcgtggacactctcagaaaatcaaagatgaccagcaatgagatcagtaagcgtattgaagctaccaaaaaagcggaatccgaaattcaggccattcgcaagaattatttaccgatcgccacaaggggtgcactcctctattttcttgttgctgatttgactcagattaattacatgtatcagttctcactagactggttccatcaggtgttcgtaagcagcgtggtgtcaaaatctaaggaacaggagcacagtttcaaacgggaaaaggtttcccccaaggaagttcacgaattcatttcgatttcaaaggagccaaacctggagaacgaaaagaatctgctcgacaaacatatcaaatcggcgatagacatgctgaccaaaagtatcttcaaggtcgtatctagcgccctgtttaacgaagataagctttgcttttcgttccgtctgtgcacagttatcatgcagaataacgctaatggcaatctcatacaggatgacattggattcctgccagaggaagaatggaacatcttcctgtattccggcattttgataaacatcaagtcagccctatcacagtcacggttgacttcaacgtttgaaattggagagtctcagcatctgcagtggctgtcggatagtagatggcggcagtgccagtacgtgtccacgcaccttgagccgttttccctgctctgtaagtcccttctgagcaatgtctcccagtgggatactttcaaaaactctaaggcggtctactccttgatctccacaccttttagtagcgagaacgctagccttgaggagaacacgaagcctccagaggagacagagttactcaatgagaataaggagacctgtaacccaatcaattttccatgggaaaaactgacaagtttccaacggttgatactcgtcaaagtgctgcgccctgagagcctgaataacagcgtgaggaaatttatcacagagaaaatggggaataagtacctccaaaggaccggtgtaaacctcaaagatgcgtacaaagggtccaatgcccgaacaccgctgattctgatccagactcatgggatcgatctaacaaacatactcctccgctttgcccaggagctgaaaggaacaacacatcacgttaccattatttccttagggagagatcaggctgccaaagccgaggacctgatcctgaaagccctgaccaagacccagcagtgggtgtttctgcaaaactgccacctggccacatcttttatgccacgactgtgcaccatagttgaatctttcaactcgcctaacgtgactattgaccccgaatttcgcctgtggctgtcatcgaagtcttactcttccttccccatccctgtcctgaagaaggggctcaaaatcgccgtcgagtcgccacaaggcttgaaatctaatttgcttcagacctttggttgcacagggtctggtgaggttactgaggagatctttgaaaacccagactgtggccagtggtggaaaaaactgctttttagcctttgcttttttaatgcggtgataaatgagagaaagaattatggcattttaggctggaacatcgcttacaaatttaattctagcgacttgggagttgccatcaaagtgctagaaaatagtctgaggggccagccctctatttcctggcaggctctcaggtatctgataggagaggtgatttatggcggacgcgtgattgacaactgggacaaaaggtgtctaaagactcttctgtataaattctgcaacccagaagtactgaaagacgacttttcgttttcaagatctgccagtatcaaggattacattcacatcattcagtccctgcccgacgatgatcttcctgaggtgctcggcatccacccggaagccatcagatcttgctgggaaacgcagggcgagaaatttatcgagaacctaattgcaatgcaaccgaagaccaccaccgccaatctgatgattcgacccgagcaatcgaaagacgagcttgtaatggagatccttagcgacttgctcaaacgcttgccattgacagtggagaaggaagaaatcgccgtgggcacaccctccacactgaaaagcatgatgagcagctcaatctgggaaagcctgagcaagaaccttaaagatcacgatcctctgattcactgcgtcctgctcactttcctgaagcaagaaattaagagatttgacaaattattgttcgtcatacataagtcactgaaagacttacagctcgcaatcaagggcgagatcatcctgactcaggaactggaagagatcttcaattccttccttaacatgcgggtgcccacactgtggcaaaagcacgcgtacagatcttgcaaacccttatcatcatggatagacgacctgatccaacgtctcaatttcttcaatacttgggcgaaagtggcatatacagccatccaaagaagatatatgcgcttcgtgacggtgtggaagcagtccattccatccacctcccagaagtgcaagcacccagaggattcagaaaacaacttctttgaggggtttcccagcaggtactggctccctgccttttttttcccccaggcctttctcgccgctgttctgcaggattacgggagaagtcggggaatcgccgtggatgcgttgactttcactcaccatgttatctccaacaccactgacaaggatgagaagttctctgtcttcatgcccaagaagctgaatattgtccgacgggctttcaaaggctctgcatcaagtcacacaggcgtctatatcttcggtttgttcatcgagggggcacgttggaatcgcgagcagaagattctggaagactcactgccgctggaaatgtgctgcgactttcccgatatttactttttaccgacaaagatcagcacaaaaaccccaaatgccagcaaccagacagattccgaactgtacgcctttgagtgccctgtttaccaaacccctgagcgcagtaggattcttgcgacaacagggctgccaactaattttctcactagtgtctaccttagtacgaaaaaaccccctagccactggattacgatgagggtggctctgctctgcgagaagaacgagaagtac

SEQ ID NO: 221430 - DNA, 13548 bp, Artificial Sequence
  Description of Artificial Sequence: Synthetic coding sequence
atggaaacttttatcccaattgaccttaccacagagaatcaggagatggataaagaggaaaccaagacaaagccacgcttattaagatacgaagagaaaaagtacgaagacgttaaacctttagaaactcagccagccgagatcgcagagaaggagaccctggaatataaaactgtgcggacattttctgaatctctgaaatctgaaaagacagaggattatctgcgggaatcaatcatccagcagcatatggttagtcctgaacccgctagtctgaaagaaaaaggaaagtcccgcaggaagaaggatcagacacacgcttgtcctaacgtgcggaaggccaggccagtgagctatgataggacagagcccaaggatgatgatgtgatcagaaatattatcaggctgcgagaaaagctgggctggcagactattctgccacagcacagtctgaagtatggatcatctaaaatagctatccagaagatcactttaaagaaacctctggaggacgacggagagtttgtgtactgtctacctcgcaaaagtcctaaatctctgtataacccatacgatctccaggtggtttctgcccataccgccaaacattgcaaagagttttgggttataacggcgagctttataagcaaggtgataaatatcgtaggctccgtcaaagaggtcgagctaatcccaaccctggaatggctgagtgagagacgccattactacttactcagacagtttaagatcttttccgacttccgtatgaacaaggcttttgtcacctggaagctaaacgtgaagcgtattaaaaccgaaaaatctcggtcctttctgtaccaccacctattcctcgccgacgacttgttccagacctgcctcgtttacattcgaggcttgtgcgaagacgctatcaatttaaagaactataacgatcacgagaataacctgagcgccatatgtcttgtgaaactggacagtagccggacctacagccttgatgaattttgcgaagaacagctccaacaggccacccaggcgctcaaacagctagaggatattagaaacaaggctatatctgagatgaagtcaacatttctgaaggtggcagaaaagaatgagataaaggagtacttcgagtcaaagctttccgaggatgacaccactcatttcaagctaccaaagtaccgccgactcctggagaccttcttcaaattcgtcatgctcgtcgattacatcttccaggagcttatacggcagctcatgaatacagccgtcacacttctcctggaactgttcaacggcagtgccggtatgcctttctctgtcgagaaaaagaacgaaaatctcataaggactttcaaggacaactcttttccaaccggtaaaaccacaaatgactgcgaggaactcgtggataactctaaacttcacgcaatatctgttcagaagtctgaggttaaaacagacactgacatcaatgagatccttaactcggtcgaggtgggtaaagatctgaggaagacctacgcacccatttttgaggtgaatctttgcctgcgcatccccgctgaaagcgatagttcagagaacagcaaagagaacttccacgaatcagaccagtgcccagaagaatgcgtcatgttcgaggatgaaatgtctgagaacaaagataactgtgtaaagaagcactcaagtgaggagttattgccaaaggctaaaaagagcaaggaaattagctacaatcttgaggatattatttcagacactgaaatcgagacggagttcgagaacaaatatatgtattacgaattcccggaattcccaaccaacctgtttatagatccgaataggctcgagtttagcgtcaagatccagaacatgctgactaatatggagaaatgcattacgaccataactcctctctgccaggacccccagctctcaattttcatcgatttggtgagtattatggatctgcctaataaaaccggaagtataatccattacaaggagcaaacaagatggccggattgtcatattttgtttgagaccgatcccgcataccagaacatcatcgtgaacttgctgacaatcatcggcaatagcatgggcctggtgaatgcatattcacacaaatttatcaagtactgcacaatgactgaaaaagctaagattatgagcatgaaaatatcatccatgggggagttgactagcaaggaattcgaggccatcttgaatcgatttagaaactatttcaggcacatagtaaatatggccatcgaaaaacggatcggtatttttaatgtcgtgtctctcgactaccagtctgagtgcctgctatacatcgacaacgtgattcacatgtctcacacactgattcaatcagtgattgagaaaaaaaacaagaacctactagaggtagtggaaagcagcctccagcaacttgaatgtgatcccacagagattgaggaatttctggaacattttatcttcttaaacgccatttcatcaaagatttctaaattggagaaagagttcctgacgatgagtcaactatacagcgtggcaaaacatcaccaaattcacatttccgaggaacagattgctatcttccaggtactgcttctcaagttcagccagctgaagtcttcgatgaagctttctaaaattaataaggacaccgcaatcacaaagtttagagataacctggaagcttgcatcagcgggctacacgtagacgtgggaaatttaaaggctaaaataaggacaccactcttactctgcgccggtacacaagttagtaccgcaatggaaatgattcaaacactgtcgggcgaagccgcatctcttaccaataaggctaaggcctactcccactaccaagactgcttctctgatagccaaagtcatatgcatagcgtgaacgtggaggagattacgcagatcgtcctaagcgagattagcgatatcgagggtgacctgacattgaggaagaaactatgggaggcccaagaagaatggaaacgagcaagctgggaatggaggaattcatccctgcaaagtattgatgtggagagcgtgcaaaggaatgtgtccaaactcatgcatataatctccgtgctggagaagggtcttccaaagtccgacatggtgactcacttgaagcaggtcgttaccgaattcaagcaagagctgcctataataatcgcactcggaaacccctgcttgaagcccagacactgggaagcgctgcaggaaatcattgggaagtcagtccccctggataagaattgcaaggtcgagaacttactagccttgaagatgtttcagtatgagaacgaaattaacgatatgagcacctcagctacaaacgaggccgcacttgaaaagatgctcttcaagataatcgatttctggaatacaacacccctgcccttgatcctccaccacacggaaatttacagcatttttatcatcccttccatagatgatatctccgcacagctggaagagtctcaggtcatccttgccacgattaaaggaagcccccacattgggccaattaaggacttggtcaacgagtgggaccagaatctaaccctcttctcatacactctggaagagtggatgaactgccagagaaactggctgtacctcgagccagtgttccactccagcgagatccgtcggcagctgcctgccgagactgagctcttctcacaggtgatatctatgtggaagaagatcatgagcaagatacagaacaagcaaaacgcccttcagattaccaccagtgccggtgttctggagatacttcaaaattgtaacatacatctcgagcatatcaaaaagtccctcgaagactatctcgaggtgaagcggttgatattcccaagattttactttctatctaatgccgaacttcttgatatcctggccgatagccgcaatcctgagagcgtgcagcctcatctggtgaagtgttttgagaacattaaacagctgcttatttggaaacaggacatcggacctcccgctgttaagatgttaatcagcgccgagggtgagggcctagttctgcccaagaagattcgcgttcggtcagccgtggaacaatggctggtaaatgttgagaaatcaatgttcgatgtccttaagaaggaaagatacatctacaatattatactgctgttccagagccagattatgttttacaatgattgtgtgaagagctttgtctctagttacagccgcgagaagttagagaaggtgcatgcaggactcatgtgccacctagaggaggtggcggacttggtagtattggataccagcaatagccggacaaaagctatcctgggcgctctgcttatactgtatgttcattgtagagatattgtgattaatctgcttttaaaaaacattttcaatgccgaggactttgagtggaccaggcacctccaatataaatggaacgagaaacagaaactatgttacgtgtcccagggcaacgcttctttcacttacggatacgaatatctggggtgcacctctcgcctagttatcacccccctaacagaccgctgctggcttactctaatggaggccctccacttgaacttggggggatgccccgcaggaccagccggaacaggcaagacagaaaccgtgaaagatctggcgaagtctctggggaaacactgcgtagtcttcaattgtttcgaagacctcgactataaaatcgtgcgtaaattttttttcggactcgtccagtcaggagcctggtcttgtttcgatgagttcaaccttattgatcttgaggttctcagcgttatcgctagccagatccttacgattaaggctgccaaggacaactattccgcacggtttgtcctggaagggaaagagatacggatcaacatgtcctgcgcagtattcattacaatgaaccccaggtatggaggcggagtggagctccccgacaatctcaaatctttgttccgccctgttgctatgatggtgccccactatcagatgattgcagagatcattctgttctcttttgggttcaaatccgccaactcactgtctggcaaactaactaacctctacgagttggcaagaaagcagctgtctcagcaggatcattacaactttggcctgcggagcctgaaaatcgtcctgattatggcagggaccaagaagagagagtttaaatgcctgtccgaagccgacgagaccctcatcgttatcgaggccatccgcgaagcgtccctgccaaaatgccccccagaggatgtgccgttattcgaaaatataattggtgacattttcccagaagtgaccgtcctgaaggtcaatcagttagcgctggagaaggtgatctacaccgccacacaacagttaggactacaaaactggtcctcccagaaagaaaaaatcattcagttttataaccagttgcaagtatgcgtcggcgttatgttggtgggacctacaggcggaggcaaaacgaccgtccggcgaattttggagaaagccttgacgcttctgccgatcgccgattttctgtcggtcgctgagcgcaagagcgcaagcaaaatctcagagcgtaaaggtaaggtcgatatctgtgtgctgaatcccaaatgcgtcactctcagtgagttgtacggacagctcgatccaaataccatggagtggacagacggcctcctatccgctaccattaggagctacgtctactttaacactcctaagaatacaaagaaagatattgatttacgcctcaagagtcgcatttcggacctgtcaaacgtctttaaactagacagcagtgacacgaccgagaccgacgacaacatttttgaggagattgaaaaagtggtgaaaataccagaaaatcacaattttgactggcagtggattatattagatgggccagtggacacgttctgggttgaaaatctcaactctgtcctggatgatacacggactctgtgtttggctaactcagaaaggatcgcactgacaaacaagatcagggtcatcttcgaagtggataatctcagccaggcctcccccgcaaccgtttcacgatgtgcgatggtatacatggacccagtggaccttggctgggagccttatgtcaaaagttggttgttgaagacgtccaaaattatctcacagagtggcgtggactgccttgaatttatgataaagaattcagtgaccgatggcctgcagttcattcggaacagacagaagtttcagccctatcctatggaggacatcaccgtagtgatcactctctgccggatcctggacgctttctttgattttatgggtaagaacggcggtttcgaacaatcagatgatttgaatgacacatcatccaaggaagccaacagccagagggagtccgttacattcaaagatatcgagaagcgggacgagaacacctggtatccagaaaagaatccggacaagctcacaaaaataatccagaagctgttcgtattcgcctttacctgggcgttcggaggggctctcaaccgggaggacgagcaccgcgagaacattcctttttgtccatccttagagcctgactctctggcaaaagtcacatatgatttcgacaagctcgtgcatgagctcttcggcaacagctcccaagtgggttggaaacactgggggcagtctcaggggcgtcgccgaaaaggcaactgcatcaatctaccaaccggagagtgctctattttcgggtacttcgtggatattgagcagtgcgagtttatcccatggtcggacctggtcccaaatgatcagactctaattcagcgagggactagcctgctgactaatttacagcgtagcggtggcaatttcctgaagatcactgagtgtggcgagtgtattaattacaccgcaactcgggataccacctgtttgtcttttttgatgtctcttcttctcaagaattcttgcccggtgctactgacaggagaatctggggtggggaagacagcagcaatcaaccagatgcttgaaaagctcgaaggacctggagcttttgatattaagcacggcagtatcctgggcgataccctgttatactcagaaattaaaaaatctagcagtctaaaacagaacatcacaatactcattcccgagacgcacaagactgctaccggctcttccgacaatccaacaaaaaaacccgaagtccgcactaataaaaaactactcaaaaataatgatcacaagggcgttgtggtaagcaccattaatttttctaccaatgtcacggccgcaaagacaaaggaaatgattttgaagaagctcattcggaggacaaaagacacactgggcgcacctaagaataatcggatcctgatcttcattgatgatatgaacatgcccgtgagtgacatgtatggcgctcagccgccattagaactgatcagacagttacttgacctcggaggtgtttacgataccgagaaaaacacttggaagaacattcaagacctgtccatcgtcgccgcttgcgttccagtggttaatgatatcagtcctcgcctgctcaagcacttttcaatgctagtgttgcctcatccgtcacaggatattctctgcactatctttcaagcccaccttggcatctatttttccattaacaattttacacctgaagtccagaagtctaaagatcagataatttcatgcagtctggcgatttatcatcaagtgcggcagaatatgctacccaccccaactaaatgccactacatgtttaacctgcgcgacatgttcaagctattgctaggcctcctacaggcggatagaactgtggtgaactcaaaagagatggccgcattactgtttgtgcatgaggccacccgagtgtttcacgacagactgatcgatttcactgataagtccctgttttaccgactcctgtcccgcgagttagagaactgcttccagatcggcatcgatggctgtggcaaaaaaacatgtgcaacattggcctgctacttgactgataataagctatatagagttccaatttcccataaatgtgcctacatcgaattcaaagaggtgtttaaaaaagtgttcatccatgccggactgaagggaaaacccacagttctcatggtccctaatctgaatatcgagcaggattcctttctggaagatctgaattacattataagctccggacggatcccagacctgtttgagaacgtggagctggattccattgcaatgaagatccgctacctcacagagcagagtggtcatatggataataggcagtcactactgagttttttccagaagaggatatacaaaaacctacatatctttgtgatcatgagccctgaaggccctagcttccgccagaactgtcgtgtgtacccatccatgatcagctcctgtaccatcgattggtatgagcgttggcctgaagaggcgctcttgatagtggcaaattcctttctcaaggagaaagtcaactttgagaacagagagaacctcaaagagaaactagcccctacatgtgtgcagattcataagtccatgaaggacctaaacaggaagtatttcgaggaaaccggtcgattttactacacaactcccaacagttacctgcagttcatggagaccttcgctcatattctgagggctcgagaggaggaaatgcaaacaaagcgcgaccggttccacatgggactgtctacaatacttgaagccacgaccctcgtgacggaaatgcaggaagaattgctgatcctgggccctcaggtggaacagaagaccaaggagaccgaaaccctcatggaaaaattaagaaaagatagtcaggtggtcgagaaggttcagatgctcgtgaagcaggacgaggagatcgttgcagaggaagtcagaattgttgaggactatgctcagaagacagctaacgagctgaagtctgttttacccgctttcgataaagctattgtggcattaaatgctttggacaaagcggatgttgcagagttaagagtttataccaggcctcccttcctagttctgactgtgatgaacgctgtgtgcatcctcctccagaagaaacctaactgggctactgctaaactgctgctttcagagaccggcttcctcaaaaaactgatcaacctagacaaagacagtatcccagacaaggtgtttgtgaaactcaaaaaaatagtgaccctcccagatttcaacccacataaaatatcgctcgtgtcagtggcatgctgtagcctgtgccaatgggttattgctctgaacaactatcatgaggtgcagaaggtggtgggtcctaaacagatccaggtggcagaggcgcagaatgtattgaaaatagcgcgtcagagactggccgaaaagcagcgcggtctccagctggtggaagagcatctgctgtttctgcaggcggcatacaaggacacggtagctgagaagcagctgctggcgaatagaaaaacaatggcttcgcgtcggtttcaatgcgcatccgtccttctgaccgtgctggaggatgaaaaaacgaggtggcaggagacaataaaccaaattgataataagttagaaggtatactgggcgatatccttctcagtgccgcatgcatcgtctattcaggaattctaacacctgagtttaggcagttgatcgtcaataaatgggagacgttttgtattgagaacggaatttctctgtctagtaaattctcactgataaaagttatggctcagaagtatgagatctcgagatggcacaatcagggattgccacatgggcagtatagcgtggaaaatgctattttgatcaaaaatggtcagcagtggccgcttcttatcgatccgcatagacaggcccacaagtggatccggcagatggagggttcaagattgcagaaattatccattgaagactccaattataccaagaagatcgaaaacgcaatgaaaactggaggtagcgttttgctgcagaacctcctggagacacttgcacccggtctgaaagcgattctcaagaaggacatctaccaaaagaagggccactatttcatccgtgtcggcgatgcagagttcgagtataatagcaattttcggctatacttgtcaaccgaaattgacaatcctcattttctgccctcggtttataatttcgtcaccatgataaattttacagttacctttcaggggttgcaagaccagctgctctctaccgtcgtgacccatgaagtcccccatctggaggaccagagaagcaagttacttgaatcaatcagcttagatgccatcaccctcgaggagcttgaagaaaagacccttaacctgctgcagaaggcacttgggtccatcctggacgacgataaaattgtcgacacattgcggaagagtaagatgacctccaatgaaatctctaagagaattgaagccaccaaaaaagctgaatccgagatccaggccatcagaaaaaattatttgcccatcgccacacgaggcgctttgctctattttctggtggccgacctcacccaaataaactacatgtatcaattctctctcgactggttccaccaggtgtttgtcagtagcgttgtatccaaaagtaaagaacaggaacattccttcaagcgcgagaaagtctccccgaaagaagtgcacgaatttatcagcatatcaaaggagcctaatctggaaaacgagaagaatctgctcgataagcacatcaagagcgctatcgatatgttgacaaaatcgattttcaaggtcgtatctagtgcgctgtttaatgaagataagctctgctttagtttcaggctctgcaccgtgatcatgcagaacaatgccaacggaaatctgatacaggacgatattgggttcctgcctgaggaggagtggaatatcttcttatatagcggaattcttattaacatcaagtctgcgctctcacagtcccgcctgacctcaacgttcgagataggcgagagccagcatctgcagtggctgtccgatagcaggtggcgccagtgccaatatgtctctactcacttggagccatttagtcttctttgtaagtcactgctttctaacgttagtcaatgggacaccttcaagaattccaaggcggtgtattcccttatcagtacacctttcagcagcgagaatgcttctctggaggagaatactaaaccaccagaagaaactgagctcctgaacgagaacaaggagacgtgtaacccaatcaactttccgtgggagaaactcacgagtttccagcggctgattctggtgaaggtgctgagaccggagagcctgaataactcagtgagaaagttcatcactgagaagatgggaaataaatacttgcagcggaccggagtgaaccttaaagacgcttacaaaggctctaatgcgaggacacctctgattctaatccaaacccacggaatcgacctgaccaatatcctgcttcggtttgcccaggagcttaaggggacaactcatcatgtaacaatcatcagtttgggaagagatcaggccgcaaaagctgaggatcttattcttaaggcacttacgaaaacacaacaatgggtgtttctccaaaactgccatctggcgacaagctttatgcctagactgtgcactatagtggaaagctttaatagccccaatgtaacaatcgaccctgaattcaggctatggctgtcctccaaatcctacagctcattccccatcccagttcttaagaagggcctcaaaattgcagtggagtctccacagggcctgaagtctaacctcctacaaacctttgggtgtaccggctccggtgaggtgacagaagagatcttcgaaaatccagattgcggccagtggtggaagaaattgctgttctcactctgcttttttaacgccgtaattaatgaacggaagaattacggcattctgggttggaatattgcatataagttcaactcttctgacttgggggtggccatcaaggtccttgagaattccctaaggggccagcctagtatctcatggcaggcactgcggtaccttatcggcgaggtgatttacggagggagagtcatagacaattgggataagcggtgtctgaagacattgctctacaagttttgtaatcccgaagttttgaaagatgacttttcgtttagtcggagtgcttcgatcaaagattatatccacatcatacagtccctgcccgacgacgatttgcccgaggtcctagggattcacccggaagccattcgctcttgttgggagacccagggagagaaattcattgaaaatttgattgctatgcagcccaagaccaccacggcaaacctcatgattcgccctgagcagtctaaggatgagctagtcatggagattcttagtgacctcttaaagcgtttgccattaaccgtggaaaaggaggaaattgctgttggcaccccttccactttgaaatcgatgatgtcctcatccatttgggagagtttatccaagaaccttaaagaccacgaccccctcatccactgcgtgctgctcacttttttgaagcaggagattaaaaggttcgacaaactcctgttcgtgatccacaagtccctgaaagacttacaattggccattaaaggggaaatcatattaacccaagagttagaagaaattttcaacagctttctcaatatgcgagtgccaactctttggcagaagcacgcttaccgcagttgcaaaccactgagctcttggattgatgatctgatacagcgcttgaactttttcaacacctgggctaaagtcgcgtatacagctattcaaagacggtatatgcggtttgtgaccgtgtggaaacagtcaattccctccacaagccagaaatgcaaacaccctgaggactccgaaaacaatttttttgaaggatttcccagccggtattggttgcctgccttcttctttccacaagcttttttggccgctgtgctgcaagactatggacgctccaggggtatcgccgtcgacgcactcactttcacccatcatgtgatctctaacacgactgacaaggatgagaaattctccgtgtttatgccaaagaagctcaatatcgtgcgcagggcattcaagggttctgcctcttcccatacaggggtgtacatctttggactgttcatcgagggggcaagatggaacagggagcagaagatccttgaggactccttgcccctggaaatgtgctgcgattttcccgatatttactttcttcctacaaagatcagtacaaaaacaccgaacgcgtctaaccaaacggattctgagctgtacgcatttgagtgtccagtgtaccagacgcccgaacgaagccgcattctggctactactgggctcccgactaacttcctgacctccgtatatttatccactaagaaaccaccttcacactggattaccatgcgcgtggcactgctctgtgagaaaaacgagaaataa

SEQ ID NO: 221431 - DNA, 10524 bp, Artificial Sequence
  Description of Artificial Sequence: Synthetic coding sequence
atgggtaggcggagccaatggatctgggccatgaggtgtcagatgctagtgcccgtactatccctccatattggcttagcacgggctctgggctgtggctgtatagcgtccaagatcgagtgcctaatcaggtgcaacgctccttttccattactggatgccgtgggaagcgttgcgtctcaagagctgcagagtctgacgggcactgttggggtgacgtccggagccgctgcatatccaaggtggaacctcgcaagggcaagagcccctccgcacctccctggcacccaggatcccctgcgaagggtccgcgaccctacacctatcgttgcaagttctcctggtcgaagaagaggatcatggtcaggcggatacggccaggaggcgtccgagcctggcgttgtcggcttatgttgcgccgtgttaccaatccatccttctctggcgctcgcaggcgttggaggccctgatttgagacggtttcaggaaggaccgcagcgccctagcgatcacggtgccgcagagaaacacatggagactttcattcctatagatctcaccactgagaaccaggagatggacaaggaagagaccaagacgaaacccaggctcctgagatatgaggagaagaaatatgaggatgttaagccgttagagacacagcctgccgaaattgctgagaaggaaacgttagagtacaaaaccgttcgcaccttctccgagtccctcaagtccgagaagactgaggagccgaaagacgatgacgtcattcgcaacatcatcaggctgcgggaaaaactcggctggcagactatccttccacagcattcattaaaatatggaagctctaagatcgctatccaaaagattacattgaagaaacccctggaagatgacggcgagttcgtatactgcctgcccaggaaatccccaaaatccttatacaatccatacgatctacaagttgtgtcagctcatacagctaagcactgtaaggagttttgggtcatcacagccagttttatctccaaacttgattcttccagaacctactccctcgacgaattctgcgaagaacagctgcagcaggcgacgcaagccctgaaacagctcgaggatatcagaaacaaggcaatttcggagatgaaatccacttttctgaaagtcgcggagaagaacgagataaaggagtacttcgagagcaagctgtctgaggatgacacgacacacttcaaattgcccaagtaccgcaggctcctggaaactttctttaagtttgtcatgttggtggattacatctttcaggagctaatcaggcaacttatgaatactgccgtgacccttctcctcgagctcttcaatgggagtgccggaatgcccttctcagtggaaaagaaaaacgaaaacctcatcagaacgtttaaggataatagcttccctacaggtaagacgaccaacgattgcgaggagctcgtagacaatagcaagttacacgctatcagtgtacagaagtctgaggtgaaaaccgataccgacatcaatgaaatcctgaactccgtcgaagtcgggaaggatctccggaagacctatgcgccaattttcgaggtgaacctgtgtctacgcatccccgcagagagtgatagctccgagaacagcaaagaaaatttccatgaatctgaccaatgcccagaggagtgcgttatgttcgaagatgagatgtcggaaaataaggataattgcgtcaagaaacattcatcagaggaacttctccctaaagccaagaagtctaaggagatttcttacaatctggaagacatcattagcgccaccatcacccctctgtgccaggacccgcagctgtctatttttattgatctggtgtctatcatggatttacccaataaaactgggagtatcattcactacaaggaacagaccagatggccagactgccacattttgttcgaaacagacccggcataccaaaacattattgtcaatctcctcacgattatcggaaattctatggggctggtcaatgcctatagccataaattcattaagtactgtacaatgaccgaaaaagccaaaattatgtccatgaagatttcgagcatgggcgaactgacatccaaggagttcgaagccattctgaacagattcagaaactatttcaggcacattgtcaacatggccatcgagaagcggatcggaatcttcaacgttgtcgtcgagtccagcctgcagcagcttgagtgtgacccgaccgaaatcgaggagttcttggagcactttatatttctcaacgccatttcgtcaaaaatctcaaaactcgaaaaggaattcctgacaatgtcacagctgtactccgttgctaaacaccatcagattcatatcagtgaggagcaaatagcaatttttcaagtgcttctactaaagttctcccagctgaagtcatcaatgaagctgtcaaaaataaacaaagataccgccatcacaaaattccgcgataatcttgaggcttgcattagtggtctgcatgtcgatgttggaaatctgaaagccaaaatcagaacccccctgctgctatgtgcaggcacgcaggtatccacggctatggagatgatccaaactctgagcggcgaggcggcatccctgactaataaggctaaggcgtactctcattatcaggattgctttagcgacagtcagtcacacatgcattctgttaacgtcgaggagataacccagatagttctgtccgaaatctccgacatagaaggtgacttaacacttcggaagaaactgtgggaggctcaagaagaatggaaaagagctagttgggagtggaggaactcatctctccagagcatcgacgtcgaatccgtacagcggaacgtgtccaaattgatgcacatcatatcagtcctggagaaggaaatttatagcatcttcatcataccatctattgatgacatctctgcccaactcgaggaatcccaggttatactcgccaccattaaagggtcaccacacataggacccataaagagccagatcatgttctataacgactgcgttaagagtttcgtttcaagttactcacgggaaaagctcgagaaggtgcacgcgggtctgatgtgtcatctggaagaagtagcagatttggtcgtgctggacacgtccaactctagaaccaaagccatcctgggagcgctgttaattctgtatgttcattgtagggatatcgtcataaacctgctcctgaagaatatcttcaacgccgaggattttgaatggacccgccacctgcagtacaagtggaacgaaaagcaaaaactctgctacgtgtctcagggcaatgccagcttcacctatggttacgagtacctgggatgtacttcccgtctggtgatcacacccctcacagataggtgctggctcactctcatggaggctctgcacctgaacctaggtgggtgcccagcaggcccagcgggaacagggaagaccgagaccgtgaaggatttagccaaatgcgctttgtttgccttcaagtgcaacacagctctgatcaagctgccaaatagcctcatagttctgacgtgttttggcttggagaaaactgtcctggtgatgaatacggtgatgtccttcaggtttgtcctggaaggcaaagagattagaattaatatgtcctgtgcagtgttcattactatgaacccacgctacgggggtggagtcgagcttcctgacaatttgaagtccctctttaggccagtcgctatgatggttccccattaccagatgatcgctgagatcatactgtttagtttcggattcaaatccgccaatagtctgagcggcaagctcacaaacctatatgagttagcaagaaagcagttgtcgcagcaggatcactacaacttcggtctcaggtcactgaaaatcgtgttgattatggccggaaccaagaagcgcgagtttaaatgcgatacaagtgattcactatcggaagccgatgagacactgatcgttattgaagcaattcgcgaagccagcctgccaaaatgtcccccagaagatgtaccactatttgaaaacataataggcgacatctttcctgaagtgaccgtgctgaaggttaaccagttggccctggaaaaggtgatttacaccgccacacagcaactgggcctccaaaactggagcagtcagaaggagaagattatccagttctataaccagctccaagtgtgcgtgggggtgatgcttgtggggccaacagggggaggtaaaacaactgtcaggcgtatccttgagaaggcattgactctgttgccgattgctgatttcctctcagttgcggagaggaagtcagcaagtaagattagtgaacgcaagggtaaagtggacatctgcgtgttgaaccccaaatgcgtgacactgtcagagctctatgggcagctggaccccaatactatggagtggaccgatgggcttctatcagctactatcaggtcatatgtttattttaacactcccaaaaatactaagaaagacattgatttgcggctaaaaagcaggatctcagacctgtctaatgtctttaagctggactcctcggatactaccgagacagatgacaacatcttcgaagaaattgagaaggttgtcaagatccccgagaatcacaactttgactggcagtggataattctggatggaccagtcgacaccttctgggtggaaaatctgaactccgtcttggacgatactcggactctgtgcctggccaattcggaaaggattgccctaacaaataagatacgagtgatcttcgaagtggataacctttcacaggcatcgcctgctaccgtgtcacggtgtgccatggtatatatggatcctgtggatctggggtgggaaccatatgtcaagtcatggctcctgaagacctccaagatcatctctcaatccggagtggattgtctggagtttatgataaagaattccgtcactgatgggctgcagtttataagaaatcgtcaaaagttccagccctatcctatggaggacatcaccgtggtgattaccctctgtcggattctcgacgctttctttgattttatgggaaagaatggtgggtttgagcagtctgacgacctaaatgacactagctcaaaggaagccaactcccagcgcgaatccgtcacattcaaggacatcgagaaaagggatgagaacacttggtatcctgaaaaaaacccagacaaactgaccaaaatcatacagaagctattcgtgtttgcgttcacctgggcatttggtggagcactcaaccgggaggacgaacatcgagaaaatattcccttttgccctagcctggaacccgactctctggctaaagtgacctacgactttgacaagctcgtgcacgagctgttcggaaactcttctcaggtcggaatcaatctgcccaccggggaatgcagtattttcggttatttcgtcgatatagaacagtgcgaattcatcccatggagcgaccttgtgccaaatgaccaaacattgatccagagggataatcccacgaagaaaccagaggtgagaactaacaagaaactgctcaaaaataacgatcacaaaggagtagtggtgtctacaattaatttttccaccaacgtcacagctgcaaaaaccaaggagatgatcctgaaaaagctgatcaggagaaccaaggacacgctgggcgcacccaaaaacaacaggattctcatctttatcgacgacatgaatatgccagtgtctgacatgtacggggctcaaccgcctctggagctcatccgtcagttgttggacttaggcggtgtgtacgatacggaaaagaatacttggaagaatatccaagatctgtcaatcgtggccgcatgtgtgcccgtcgtcaacgatatctcccctaggctgctaaaacacttcagcatgctcgtcctgccacatccgtcgcaagatatcctgtgcactattttccagatcggaattgacgggtgcggtaaaaaaacctgtgccacgctggcctgttacttgacagataacaagctgtaccgcgttcccatctcccacaagtgcgcctatattgagtttaaagaggtctttaagaaagtgttcatccacgctggattgaaaggaaagcccacagtcctcatggtacctaacttaaacatcgagcaggactcatttctcgaggatcttaactatattattagttccggcagaatccccgatttattcgagaatgtcgaattagactccattgcaatgaaaattaggtatcttactgagcagagtggtcatatggacaacaggcaatccctgctgagcttctttcagaaacgcatatacaagaacctgcacatttttgtgataatgagtcctgagggaccatcttttcgccagaactgtagagtctatccaagcatgataagctcctgcaccatcgactggtatgagcggtggcccgaagaagcgcttctcatagttgctaactcatttctaaaagagaaggtcaatttcgagaaccgagaaaatctcaaagaaaaactggcccctacctgcgtgcagatccacaaaagtatgaaggacctgaatcggaaatattttgaggagacagggaggttctattatacaacacctaattcttatctgcagtttatggagacatttgctcacatcctacgcgctcgggaagaggagatgcagaccaaaagagataggttccatatgggcctgtccaccattctggaagccactaccctcgtgactgagatgcaggaggagctcttgattttgggaccacaggtcgagcagaaaactaaagagaccgagactcttatggaaaaattgcgaaaggattcccaggtggttgagaaggtgcaaatgctggtcaaacaggatgaggagatagtggccgaagaggtaaggattgtagaagactacgcgcaaaagacagcaaatgagctgaagtccgtcttacccgcttttgataaagctatcgtggccctgaacgccctcgacaaggcagacgtagccgaactgcgggtgtacactcgtcctcccttcctggtcttgacagtgatgaatgcagtgtgtatcttgctacagaaaaaaccaaactgggcgactgccaagctgctgctgagtgagaccgggttcctgaagaagctgataaatctggacaaggacagcatacctgacaaagtattcgttaaactcaagaagatcgtcacactgcccgacttcaacccacataaaatctctttagtcagcgttgcatgttgttctctgtgtcagtgggttattgccctgaacaattaccacgaggtccagaaggtcgtcgggccaaaacagatccaggtagctgaagctcagaacgtgttgaaaatcgcgcgtcagagacttgctgaaaagcagagggggctgcagctcatctccagatggcacaaccagggcctgccccacggacagtatagtgtcgaaaatgctatcctgatcaagaatgggcagcagtggcctctgcttattgacccccatagacaagcacacaagtggattaggcagatggagggatccagattacagaagcttagcatcgaggatagcaactacacaaagaaaatcgagaatgccatgaagactgggggatctgtgctgctgcaaagctgtcaggcaagcacgtggagaaagaaactctatttgtcaactgaaatcgataatcctcatttcctcccaagcgtgtataattttgtgaccatgatcaacttcactgttacttttcaagggttacaggaccagctgctgagtaccgtcgtgacacatgaagttccccaccttgaggaccaacgctccaagttgttagagtctatttctcttgacgccataacgctggaagagttggaggaaaagaccctgaatctgctgcagaaggctttgggcagtatcttggacgatgataagattgtggacacactacgcaaaagtaaaatgacctctaatgaaatctcaaagaggatcgaggccaccaagaaggcagagagcgagatacaagcaatccgcaagaactaccttccaatcgcaaccagaggcgcactactgtactttttggttgccgatctgacacagatcaactatatgtaccaattttcccttgactggttccaccaagtgttcgtctcatcggtggtaagcaaatcaaaggagcaggagcactcattcaagcgggaaaaagtgtcaccaaaagaggtacacgaattcatatcgatctcaaaggagcccaacctcgaaaacgaaaagaatctgctggacaaacacatcaaaagcgctattgacatgctaacaaagagcattttcaaggtggtctcatcagcccttttcaacgaagacaagctgtgttttagcttccgcctttgcacagttatcatgcaaaacaacgctaacggaaacttaattcaggacgatatcgggttcctcccagaggaggagtggaacatctttctgtacagtggtattttaataaacattaagagtgctctctcacagagccgcctaacatctaccttcgaaataggcgagtcgcagcacctccagtggctcagtgacagtcgttggagacagtgccagtatgtaagtacccacctcgagccttttagtctcctttgtaagagcctcctctccaacgtttcacaatgggacactttcaagaactcgaaggccgtttactccttgatttcaacaccattcagttcggaaaatgccagcctggaggagaacaccaagccccctgaggagaagcacacgttctgccttttgttgcgcgcaatcaaccataccgggaccgacctgggacccgttggcagagggcagtggctgacttctaccgcatgcgatcgacacaccgacgtatgctcttttagcttcgccctcaatgatggagtccctgacgtggaacacgtccaggatatcttctacgggcactgtgtcgacaaatatcacgtgaaggttctgcgccctgagtcactgaataattccgtgcgcaaattcattactgagaaaatgggaaataagtatttacaaagaacgggggttaatctgaaagatgcctacaagggatcaaatgctcgaacacctcttatcctgatccagacccatggaagcgccagtataaaggattacatccacatcatccaatccttaccagatgacgacttgccagaagtgctgggtatccatcctgaagctattcggtcttgctgggaaacccagggagaaaaatttatagaaaacctgattgctatgcaaccaaaaactacaactgccaacctgatgatacgcccagaacaatccaaggacgaattggtgatggagattttatccgacctgctgaaaaggctgcccctgaccgtcgaaaaggaggaaatagctgtgggcactccctcgaccctgaagtctatgatgagttctagcatttgggagtctttgtctaaaaacctcaaggaccacgacccgctcatccattgcgtgctgttgaccttcttgaaacaggaaatcaaaagatttgataagttgcttttcgtcattcataagagtctgaaggacctccaactggccattaagggggagattattttgactcaggagcttgaggaaatcttcaacagttttttaaatatgagagtgcccacactttggcagaaacacgcgtatcgctcctgtaagccactctcatcttggatcgatgatttaattcagaggctgaatttctttaacacatgggctaaggtagcttacacagctattcagcggcgatatatgaggtttgttaccgtgtggaagcagagtattccgtcgaccagccaaaaatgtaagcacccggaggacagtgagaacaactttttcgaaggatttccatctagatactggttaccagcctttttctttcctcaggcgttccttgctgcggtgctacaggattacggacgctcaagaggtatcgccgtcgacgccctcacgtttacacaccacgtcattagcaacactaccgacaaggatgaaaaattttccgtttttatgcctaaaaaactcaatatcgtacgacgggctttcaaaggatcggcctccagccacaccggggtttatatcttcggtctttttatcgagggcgcacgctggaaccgagagcagaaaattctggaagatagtctacctctagagatgtgttgtgatttcccggatatttacttcctgcccactaaaatttccactaagacacccaacgccagcaatcagactgactccgaattgtacgcgtttgagtgtccagtctaccagactccagagcggagtcggatcctggccaccactggattacctactaacttcttgaccagtgtgtacctctccaccaagaaaccgcctagtcattggatcacgatgcgtgttgcccttctgtgcgaaaaaaacgaaaagtat

SEQ ID NO: 221432 - DNA, 2619 bp, Artificial Sequence
  Description of Artificial Sequence: Synthetic coding sequence
atgtccagcaaggccgagaagaagcagaggttgtccggacggggttctagccaggctagttggtccggaagggctacacgtgcagcagtggccactcaggagcagggaaacgcccctgctgtgagtgaaccagagctgcaggccgagctgcctaaggaagaaccagagcctagactcgagggtccacaggcccagtcagaagagagcgtggaacctgaagcagacgttaagccactctttctgtctagggcggcacttacagggctagctgacgctgtctggacacaagagcacgacgcaattctcgaacatttcgcccaggatccaacagagtcaattttgactatattcatcgacccatgttttggtctgaaactcgagctcggcatgcccgtgcagacccaaaaccagcttgtgtactttattagacaggcaccagtgcctatcacctgggagaatttcgaagccacagtgcagtttggtacggtgcgaggcccatacattccggcactgctgagacttctgggaggggtgttcgcacctcagatatttgccaacaccgggtggccagagagcatcaggaatcatttcgctagccacttgcacaagtttctcgcatgcttgacagatactaggtacaagctggagggacatactgtgctctatatcccagccgaggcaatgaacatgaaaccagaaatggtcattaaagacaaggaattggtacagcgcctggagaccagcatgatccattggactcgacaaattaaagaaatgctgtccgcgcaggaaaccgtagaaaccggcgagaacctcgggccactggaagaaattgagttctggcgtaatcggtgtatggacctgtccggaatctctaagcagttagtcaaaaagggggtaaagcacgtagaatcgattctgcacctggccaaatcttcatatcttgccccatttatgaagctggcccaacagatccaggacggctctcggcaagctcagtcaaacctgacatttctcagcatcctgaaagagccataccaggagcttgcctttatgaaacctaaagacatcagttccaagctgcccaaattaatatcgctgatcaggatcatctgggtgaatagtccacattataatacccgggaacggctgacctctcttttcaggaaaatgtccaacgagataatcaggctctgctgtcacgccatcagcttagatcgtatctttgagggatatgtcagttccagcaaagaagatctgcaaggctgtatactttgctgccacgcctggaaagaccactatgtacaggccgttcagatgcatatccagtttagttcacgtgggtgggttctcgatcagacaagtattttcgcccaagtggacgcattcgtacagcgctgtaaagacctgatcgaggtgtgtgactgccagtaccattttgcaaggtgggaggacggcaaacagggcccactaccatgtttcttcggcgctcaggggcctcagatcaccaggaacctgcttgaaatcgaggacatctttcataaaaacctacacaccctccgtgccgtaaggggcggtatcctcgatgtgaagaatacctgctggcatgaggactataataaatttagggcgggaattaaggatctagaagtgatgacccaaaatttgatcaccagcgctttcgagctcgtgagagatgtgccgcacggcgtcctgttactggatacgttccaccggctggcgtcccgggaagcaattaagagaacctatgacaaaaaggctgtggatctgtacatgctgttcaactctgaactggctttagttaatcgggagaggaacaagaagtggcccgaccttgaaccctatgtagcccagtattcaggtaaagcaagatgggtgcatattctgcgacgacgaatcgatcgggtgatgacatgcttggccggagcacactttctcccgcgaattggaactgggaaagagtccgtccacacataccaacagatggtccaggccattgatgagttggtgcggaagacgtttcaggaatggacaagctccctcgacaaggactgcatcaggcggctagacaccccgctccttaggatttctcaggagaaagccggaatgctagacgtgaattttgacaagtacagaagccacctggctccgttcccctacacgccactactgcagctaagccaagaatttcacagccacctgctgacccctctcttcataattcttagtttatcccataccatatgcctcctgtccagcttctattttttcttttcttctttcatcttcgtttccccacacctgcctccctgttaccagcactttaatttcacgacctatcttaagacccagcagaataagaccatgatcggacaagctcgctggctaactcctgttattcccgcactgtgggaggccgaagttggagcctcactcgaaccaaggtcattaaggaccgcctgggccacttggcagaatcccgttagcgcaaagaataccaaaatctcttgggcctggtggcacaagcccgtggtttcagccacctgggagggggaagttgggggatcaccagaaccagggagacagcgtctgcagtag

SEQ ID NO: 221433 - DNA, 12591 bp, Artificial Sequence
  Description of Artificial Sequence: Synthetic coding sequence
atgagtagcaaagccgaaaaaaaacagagattgtccggcagaggatcctctcaggccagctggagcggacgggctacaagggccgcagtggcaactcaggagcaggggaatgccccagctgtgtccgaacctgaactacaagccgaactccctaaggaagagcctgagcctagactggagggcccacaagctcagagtgaagaatctgttgagccggaggccgacgtgaaaccactgtttctgagtagggcagccttgaccgggttggctgatgccgtgtggacccaggagcatgacgcaatcctggaacactttgctcaggaccccacagagtctatcctgaccatatttatcgatccctgctttggattaaagctagagctcggcatgccagtccagacccagaatcaactggtgtatttcattcgccaggccccagtgcccatcacttgggaaaatttcgaggcaactgtccaatttgggacggtcaggggtccttacatcccagcactgctgcggttgctgggcggtgtgttcgcacctcagatctttgccaatactggatggcctgaatctataagaaatcacttcgcgtcacacctgcacaaatttcttgcttgcctgactgacacgagatacaaactagagggccataccgtgttgtacattcctgctgaagccatgaacatgaagccggaaatggtgatcaaagataaggagctcgtccagagactcgaaacttctatgatccattggaccaggcaaattaaagaaatgttgagcgcccaggagacagtcgagacaggagagaatctcgggcctctggaagagattgagttctggaggaatcggtgtatggacctgagcggtattagcaagcagctagtgaagaagggagtgaaacatgtcgagagcatcttacatctcgcaaaaagtagttacttagcgccatttatgaagcttgcccagcagatccaagatgggagtaggcaggcacaatccaatctgacttttctgagtattctgaaggagccttatcaggagctggccttcatgaaaccaaaggatatctccagcaaactgcccaagctgattagcctaataagaattatttgggtcaattccccccactacaacacacgcgagcggctgaccagcctgttccggaaggtctgtgactgtcagtaccactttgctcggtgggaggatggtaagcagggccctttgccttgcttcttcggcgctcaggggcctcaaatcactcgtaatcttctggaaatcgaggacatttttcacaagaatcttcacacactccgggctgtccgcggaggcattttggacgtgaagaatacttgctggcatgaggactataacaaattcagggccggaattaaggatctcgaagtgatgacccagaatctgattacatccgcctttgagttggtgcgggatgttccccacggcgtgctcctgctcgacacattccatcgcctggcgtcaagggaggctattaaaaggacctatgacaagaaggccgtggacctgtacatgctgtttaactccgaactggccctcgtcaacagggaacgcaataaaaagtggccagatctcgaaccctacgtggctcagtacagcggtaaagctagatgggtgcatattctgaggaggcgaattgaccgggtgatgacctgtctggccggagcccatttccttcccaggattgggacagggaaggagtccgtacacacataccagcagatggttcaggctatcgatgaactggttcggaagacattccaggagtggacttctagtttggacaaagattgcattaggcgtctcgatactcctttgttgcgcatctctcaggagaaggcgggaatgctcgatgtgaactttgacaagagcctcttaattctattcgcggagatcgattactgggagcgcttactgttcgaaactcctcactacgtggtgaacgtggcggagcgagccgaggatctccgcatccttcgggagaacctgttattagtggctcgggactacaataggatcatagcgatgctgagcccggacgagcaagcactattcaaagagagaatcaggctactcgataaaaaaatccacccaggccttaaaaaactgcactgggcgctaaaaggggctagcgccttcttcataactgaatgccgaatccatgcctcaaaggtccagatgatcgtgaacgagttcaaggcgagtacgctcactatcgggtggagggcccaggagatgtctgaaaagctactggtcagaataagtggcaagcgcgtttaccgagatctggaatttgaggaggaccaacgagaacaccgcgcagctgtccagcaaaagctaatgaacctgcaccaagatgtggtcaccatcatgacgaactcctacgaggtgtttaaaaatgatggcccagagatccagcagcagtggatgctctatatgatccgcctcgataggatgatggaggatgctctaagactgaatgtaaagtggagtttgctagaacttagtaaggccatcaatggagacggcaagaccagtcccaaccctctcttccaggtcctagtcatcctgaaaaatgacttacaaggcagcgtggcgcaggtcgagttttccccaactctccagacattggccggagtggtcaatgacatcgggaaccatctctttagtacgatatccgtgttctgccatcttccagacattctcactaaaagaaaattgcacagagaacctattcagaccgtggttgaacaggatgaggacataaaaaaaattcaaacccaaatctccagcgggatgactaataacgcgagccttcttcagaactatctgaagacatgggatatgtatcgcgagatctgggagattaataaggatagtttcattcaccgatatcagcggctaaatccaccagtctccagtttcgtggctgatatcgctcgatacaccgaggtggccaataacgtgcagaaagaggaaactgtcacaaatatccaattcgtgctgctggattgctcccacctcaaattttctctggtgcagcactgtaacgagtggcaaaacaaatttgcaactctcttgcgggagatggctgccggacgattgctagagcttcacacatacttaaaggagaatgcggagaaaatctctagaccacctcagacactcgaggagttaggcgtctctctgcaattagtcgatgcattaaaacacgatctggcaaatgtcgaaacccaaattccaccgatccatgagcagttcgcgatcctcgagaaatatgaagtaccagtagaggactccgtgctcgagatgcttgattcactaaacggtgaatgggtggtctttcagcagactttgctcgactcaaagcaaatgcttaagaagcacaaggagaaattcaagactggcctgattcattctgcggatgattttaaaaagaaagcccatacgttgctagaagactttgagttcaaaggacatttcacctccaatgtcggctatatgagcgccctggatcaaatcacccaggtcagagccatgcttatggccatgcgggaggaggaaaattctctgagggccaacctggggatctttaagattgagcaacctccatcaaaggatctacaaaatctagagaaggaattagatgcactccagcaaatttgggaaattgctagagattgggaagagaactggaacgagtggaagaccggacgttttcttatcttgcagaccgagaccatggagaccactgctcatgggctcttccggcgactcacaaaactggctaaggaatataaggatagaaactgggagataatcgaaactacccggtccaagattgaacagttcaagaggaccatgccactgatcagcgacctccgcaatccagccctgagggagaggcactgggaccaggtgcgagatgaaatccagagggaatttgaccaggaaagcgagagttttacattggaacagattgtggaactgggtatggatcaacacgtggagaagattggtgaaatctccgcgtcagcaactaaggaactggctatcgaggtggccctgcagaatatcgccaagacgtgggatgtcactcagctggatatcgtaccctacaaagataagggacaccatcggctgagaggaaccgaggaagtttttcaggccttggaagacaaccaggtggcactctctaccatgaaggccagtcggtttgtgaaggccttcgagaaggacgtggaccattgggaacggtgcctgtccctcatcctggaagtgattgagatgattctgaccgtgcaacgacaatggatgtacttagagaacatttttctgggggaggacatacgcaaacagctgccgaacgaaagtaccctctttgatcaggtgaattctaactggaaggccattatggataggatgaacaaggacaataatgcgctcagaagtactcaccatccaggcttgttagacacactgatcgaaatgaatactattctggaggatatacaaaagtcgctggatatgtacttagagactaagaggcatattttcccgagattctattttctcagcaatgacgacctgctagagattctcgggcagagtcggaatccggaagctgtacagccccatctgaagaagtgcttcgacaatattaaactcctgagaattcagaaggtcggcggtccctcatctaagtgggaggcagtgggtatgttttcaggcgacggcgaatacattgacttcttacatagcgtcttccttgaaggacccgttgaatcctggctgggggatgtggagcagacaatgcgcgtgaccttgagggacctgttgagaaattgccacctggccctacgtaagtttctgaacaaacgggataagtgggttaaggagtgggcaggacaagtcgtgataacggcttctcaaatacagtggacagcggatgttacaaaatgcctgctgaccgccaaagagagggcagacaaaaagattctcaaggtgatgaagaaaaaccaggtctcaatcctcaataagtacagtgaagctattagaggaaacctcaccaaaattatgaggttaaaaatagtcgctctggtgaccatcgagatccatgctcgtgacgtactggagaagctgtataagagtggtttgatggacgtaaatagttttgattggttgtcccaattgagattttattgggagaaagacttggatgactgcgtgatcaggcagacaaacacccagttccaatacaactacgagtacttggggaattcaggcagactggtcataacacctctgaccgatcgttgttatatgactttgactacggctctgcacctccatcgagggggatcccccaaaggcccagctggcacaggaaagaccgagacagtcaaggacctcggaaaagcacttggtatctatgtcatagtcgtcaactgcagcgagggtctggattataaatcaatgggcaggatgtacagtgggttggctcagacaggcgcatgggggtgctttgacgaatttaaccggattaacatcgaagtgttaagtgtggtggcccaccagattctgtgcattctgtctgccctggctgcgggacttactcactttcatttcgacgggttcgagattaacctggtatggagttgtggtatatttattactatgaacccaggatatgccggtcgcacagagctccccgagaatctcaagtcaatgtttagacccatcgctatggtcgtccccgactccacactgattgcagaaatcatcctcttcggcgagggattcggaaactgcaaaatacttgctaaaaaagtctatacactctactctttggccgtacagcaactaagtcggcaggatcactatgatttcgggctccgagctttaacgtctctgctaagatacgcaggtaagaagaggcggctgcagcccgacctcacagatgaggaggtgcttcttctgtctatgagggatatgaacatcgcaaaattgacctctgtggacgctcccctgtttaacgcaattgtgcaggacttattccctaacattgagctgccagtgatcgattatggaaagctgcgggagactgtggagcaggagatccgcgacatgggcctacagtctacgcctttcactttgacaaaggtgtttcagctgtatgaaacaaaaaacagtagacactcaacgatgatcgtggggtgtacaggaagcgggaaaacggctagctggcgcatcctccaagcaagcctcagctcactgtgcagagcaggcgatcctaattttaacattgtgagagaattcccgctgaatccaaaggctctgagccttggagagctttatggagagtacgacctgtctaccaacgaatggacggatggcatcctctcatcagtgatgaggactgcctgtgcagatgagaagcccgatgagaagtggatacttttcgatggccctgtggataccctgtggatcgaaaatatgaatagtgttatggatgacaacaaggtgctgacgctcattaacggcgagcgcattgcaatgccagagcaagtgagcctgcttttcgaggtagaagatctggctatggcaagccctgcgaccgtttctcgttgcgggatggtgtacactgactacgccgatctgggctggaagccgtatgtgcaatcctggctggaaaagcgccctaaggctgaggtggaaccgctgcagaggatgttcgaaaagctcatcaacaaaatgttagcctttaaaaaagacaattgtaaagaattagtcccactcccagaatactccggcattacctctctgtgtaaactgtattctgctcttgctacaccagagaacggggtgaatccggctgatggcgaaaattacgtgaccatggtggagatgactttcgtcttttcaatgatatggagtgtgtgcgcttctgtagacgaggaggggaggaagcggatcgactcttatctgagggagatcgagggatcatttccaaataaggacacggtttacgaatatttcgttgacccaaaaatccgctcttggacaagcttcgaggataagttaccaaagtcttggaggtatccccctaatgctccattctataagattatggtgcctacagttgatactgtgaggtacaattacttggtgtcatctctggtggctaaccagaacccaatcctgcttgtgggccctgtgggcacaggaaaaactagtatcgcacagagtgtgcttcagtctctccccagttctcaatggagcgtgctggtggtcaatatgagtgcccagaccacttctaacaatgtccagagtatcatcgagtctagggtggaaaagcgtacaaagggtgtatatgtcccatttggcggaaagtccatgattacctttatggacgaccttaatatgcctgcgaaggatatgtttggaagccaacccccattggagcttatacgtctttggatcgactacgggttctggtacgatagaaccaagcaaaccataaagtacatcagagagatgttcttaatggcagcaatgggtccccctgggggaggacggacagtaatatcccctcgcctgcgctcccgattcaacattatcaatatgacattccccactaaatctcagatcattagaatctttggcacgatgattaatcaaaaattacaggacttcgaagaggaagtcaaaccgatcggaaacgtagtgaccgaagcaaccctggatatgtacaacacagtggttcaacgctttctgcccacccccacaaagatgcactacttattcaatttgcgcgatatatctaaggtcttccaaggtatgctgcgagccaacaaagatttccacgacacaaaaagctctattactcgattatggatacacgaatgcttccgggtcttttccgacagactggtggacgcagctgatacggaagcctttatgggaatcattagcgacaagttagggtcttttttcgatctgacgtttcaccacctctgcccctcaaagcgacctccaatttttggcgattttctgaaagagcccaaggtctacgaggatcttacagacttgactgtgctgaaaacagtgatggaaacagccttgaatgaatacaatctctctccttccgtggtgccaatgcaactcgtgctttttcgggaagccattgaacatataacccggattgtgcgcgtgataggccagcctcggggaaatatgctgctagttggaatcggcggatctggaagacagtctctcgctcgactggcctcttcaatttgcgactacaccactttccagattgaagtcaccaagcactatcggaaacaggagttccgagacgatatcaagcgtctctaccggcaagcaggcgtcgaactcaagactaccagctttatcttcgtagacacccagattgccgatgaatcattccttgaggatattaacaacatcctgtccagcggagaggttcccaacctttataagccggacgagttcgaggaaatccagtcccatattatcgatcaggctcgcgtggagcaagttcccgaatccagcgacagtctgtttgcatatctgatagagagagtgcaaaacaatctccatatcgtgctttgcttaagccctatgggtgatccttttcgcaactggattcggcagtatccagctctggttaactgcacaacaattaactggttttctgagtggccacaggaagccctgctggaggtggccgagaaatgtcttattggcgtggacctcggaacacaggaaaacatacaccgaaaagtcgcacagattttcgtcaccatgcactggagcgtagctcaatatagtcagaagatgctgctagaacttagacgacacaactacgttaccccaactaaatatctcgaacttctgtccggctacaagaagctgcttggcgaaaagaggcaggagttgctggctcaggcaaacaagctgcgtacgggcctgtttaaaattgatgagacgagggagaaagtccaggttatgagccttgaactagaggatgctaagaaaaaggtggcggaatttcagaagcagtgtgaggagtacctcgtgatcatcgtgcaacagaagagagaggcagatgagcagcagaaagccctggagtcattaaacaagaaagatattggggaaatcaaatcctacggccgaccacccgctcaggttgaaatagtgatgcaggctgtcatgattctccggggaaatgaacctacctgggccgaggctaaacgccagctgggagaacagaattttattaaaagtttaattaatttcgataaggataatattagcgacaaggtcctcaaaaagatcggcgcttactgtgcccagcccgacttccagccagacatcatcggtagagtatccctcgccgctaagtcgctgtgcatgtgggtgcgtgccatggaactgtacggaaggctgtaccgcgttgtagagccaaaaagaatccggatgaacgctgccctggcgcagttgcgcgaaaagcaggctgcactggccgaggctcaggagaaactgcgagaggttgctgagaagttggaaatgttaaaaaagcagtacgacgagaagttggctcagaaggaagaactgcgcaaaaaatccgaagaaatggaactcaagctggagagggccggaatgctggtctccggcctagccggtgaaaaagcacggtgggaagaaaccgtccagggcttggaagaggaccttggttatttagtcggggactgtctgcttgccgcagcatttttatcctatatgggaccctttttgacaaattacagagacgaaatcgttaatcaaatctggattggaaagatctgggagctgcaggtaccctgctcaccttcctttgcaatagacaacttcttgtgcaaccccactaaggtgagggactggaacattcagggcctccctagcgatgcattttctactgagaacggcatcatagtgacacgcggaaatcggtgggcgctcatgatcgatccgcaagctcaggcactcaagtggatcaaaaacatggaaggtgggcagggtctcaagattattgacctgcagatgtctgattacctcaggattctggagcatgcaatccacttcggatatccagtccttctgcagaatgtacaggaatacctcgatccgactcttaatccaatgctaaacaagtcagttgccaggattggaggaaggctgttgatgcgaattggggacaaagaagtggagtataacaccaactttaggttttacatcaccacaaaactctcaaatccgcattactctccagaaacttctgccaagaccacaatcgtgaatttcgccgtcaaggaacagggcctggaggcccagctgctgggcatcgtggttaggaaggagcggcctgaactggaggaacagaaagacagcctggtcataaacatcgcagccggtaaacgcaaactcaaggagcttgaagatgagatcttgcgcttgttgaacgaagctactgggtctctgcttgatgacgtgcaactggtgaataccctccacacctctaaaattaccgcgactgaagtgaccgagcaactcgagacatctgaaacaaccgagataaacacggatttggccagagaagcgtacagaccatgcgcccagcgcgcaagcattctgttctttgttctaaacgatatgggctgtattgacccaatgtatcagttcagcttagacgcatacatatcactgtttatcctgagcattgataagtcccatcgaagcaacaaactagaggatagaattgactacctgaacgactatcacacttacgctgtctaccgatatacttgcaggacactgtttgagcgacacaaactgctcttttcatttcacatgtgtgcgaaaattctcgagaccagtggaaaattaaatatggacgaatataattttttcctgcgaggcggtgtcgtgttggacagagagggacagatggataacccatgcagctcatggttggctgacgcctactgggataatataactgaacttgataaactcactaacttccatggactgatgaacagcttcgagcaataccccagggactggcatctgtggtatactaatgcagctcccgagaaagccatgcttcccggtgaatgggaaaacgcatgtaacgaaatgcagagaatgctgatcgtccggtccctacggcaggaccgggtagcattctgcgtaacatctttcattattaccaacttaggaagccggtttatcgaaccacctgttctcaatatgaagtcagtgctggaggactctacaccccgttcgcctctggtcttcatcttgtctcctggcgtggatcccacaagcgccctcttgcaactcgccgaacacatgggtatggcccagaggttccatgcgctatccctgggccagggtcaggcacctattgcagccagactcctccgcgaaggagttacgcagggccactgggttttcctggctaactgccacctcagcctgagttggatgcccaatctcgacaagctggtggaacagttgcaagtcgaagaccctcacccatccttccggctgtggctgtcaagtattccccacccggactttcctatctctatactacaggtctctatcaaaatgacgacggagccgcctaagggcctaaaagccaacatgactaggctgtaccagcttatgtcagagccacagttcagccggtgtagcaagccagccaagtataaaaagctgttattcagtctgtgttttttccattcagtcctcctggaaagaaagaagttcctacaattgggctggaacattatttacgggttcaacgactctgatttcgaggtgagcgaaaacctgctgtctctgtacctcgacgaatacgaagagacgccttgggatgccttaaagtacctgatcgcaggtattaattacgggggtcacgtcaccgacgactgggataggcgattgctgaccacctacatcaatgactatttttgtgatcaatcactgtccacacccttccaccggttgtctgctttggagacatacttcatccctaaggatggaagcctagcctcttataaggagtacatttctcttctgccaggtatggaccccccagaagccttcggacaacatcctaatgcggacgtggcctcacagattactgaggctcaaacactgtttgacaccctcctgtccctgcaaccacagataactcctacacgagctggtggccagacccgagaggagaaggttctggaattggcagcagatgtcaaacagaaaattccggagatgattgactatgaaggtacgcaaaagctactggcgctggatccttcaccactgaacgtcgtcctgttgcaagaaatacagagatacaacacgttgatgcagaccatcctgtttagcctgaccgacctggaaatcccttcatgtgtatcccataagtccgagcgagtggtactcgaattgtcggcagtcaaacaccctagacagtag

SEQ ID NO: 221434 - DNA, 13284 bp, Artificial Sequence
  Description of Artificial Sequence: Synthetic coding sequence
atgtctagcaaggccgagaaaaagcagcgactctctggccgagggagcagtcaggccagttggtccggacgggctactagagccgcagtggctacccaggaacaggggaacgctcctgctgtctctgagccagagctacaagctgaactaccaaaagaggagcccgagcccagactggaaggtccccaagcacagagcgaagaatctgtggagccagaggccgacgtaaaaccactgttcctaagtagagccgctctcacaggcctggcggatgctgtgtggacacaggagcacgatgccatacttgagcactttgcgcaagacccgaccgaatctattctgactatctttatagacccgtgttttggactaaagctcgaactgggaatgcccgtgcagacacaaaaccaactggtgtacttcataagacaggctccagtccctatcacgtgggaaaatttcgaagctaccgtccaattcgggacggtgcgcggaccatacataccagccctgctgcgacttctgggcggtgtttttgccccacagattttcgccaatactggctggcctgaatccatccgcaatcatttcgcgtcacatctccacaaatttctggcctgtctaaccgatacgcgctacaagttggaaggacacactgtgctgtacattccagcggaggccatgaatatgaagcctgagatggtgatcaaagataaagaactcgtccagaggctggagacttcaatgatccactggactcgacagataaaagaaatgctttcggcccaggagactgtggaaactggagaaaaccttggccctctcgaggagatcgagttttggcggaatcggtgtatggacctgagcggcatttctaaacaactggtgaagaaaggcgtgaaacacgtggagagtatcttgcatcttgctaaaagttcctatcttgcccctttcatgaagcttgcgcaacagattcaagatgggagcaggcaggcccaatcaaacctgaccttcttatccatcctgaaagaaccttatcaggagctagcattcatgaagcccaaggatatcagtagcaaactgccaaagctcatcagcctcataagaatcatctgggtgaactcaccccactacaacacccgggagcggctgacgagcctgtttcggaaagtctgtgactgccagtaccacttcgccagatgggaagacgggaagcagggccctctgccctgcttttttggagcccagggacctcagatcacaagaaatctcctagagatcgaggatatattccacaagaatctgcataccttacgagcagtgcgcggtgggattctggacgtgaagaatacttgttggcatgaggactacaacaagttccgagcaggaatcaaggacctggaagtgatgacacagaatctgataacctcggcttttgagctggtgagggatgtcccgcatggagtcctcctgctggatacttttcaccgcttagcctctcgagaggcgataaaacgaacatatgataagaaagcagtggacctttacatgcttttcaattctgagttggcactcgttaatagggagcgcaataagaagtggccggacctggaaccctatgttgcacagtactcagggaaagctagatgggtccacattctgagaaggagaatagatcgcgtcatgacttgccttgcgggtgcacactttctgccaaggattggtaccggaaaagaatcagtgcacacctaccagcagatggtacaggccatagatgaattagtgcggaagacatttcaagaatggacatcatcattggacaaggattgcatcagacgacttgatactcccctcttaagaatttcacaggaaaaggcgggtatgctcgatgttaattttgataagtccttactaattctgtttgctgagattgattattgggaacgtctgctttttgagacacctcactatgtcgtgaatgtagctgagagggccgaggatttgaggatcttgcgtgaaaacctcttattagtggccagggactacaataggattatagccatgctgtcccccgatgaacaagctctctttaaggaacgtatccgccttttggataaaaaaatacacccaggtcttaagaaactacattgggctttgaagggggcttcagcattcttcattactgagtgtaggatacacgcaagtaaagtgcaaatgatcgtaaacgaattcaaggctagtaccctcacaattggttggcgcgcacaggaaatgtctgagaagttgctggttcgtatatcagggaaaagagtgtatcgcgacttggagtttgaagaggatcagcgggagcatcgagccgcagtgcagcagaaactgatgaacttacatcaggacgtggtgacgatcatgaccaactcatacgaagtttttaagaacgacgggcctgagatccagcagcagtggatgctttatatgatccgactagacagaatgatggaagacgcactacggctcaacgtgaaatggtccctgctggagttgagcaaggccatcaacggcgacggaaagactagtccaaacccattgtttcaagtgcttgtgattctgaaaaatgacctccagggtagtgtggcacaggtggaattttcacccactttgcaaacactggccggagtggttaatgatatcggcaatcatctgttctctactatctctgtcttctgccatctacctgatatcttaactaaacgcaaactgcacagagaaccaatccaaacggtcgtggagcaggatgaggatatcaagaagatccagacccagatctccagcggtatgacaaacaacgcctcactgctgcagaactatctgaaaacctgggatatgtacagggagatctgggaaattaacaaggatagttttattcaccggtatcagagactcaaccccccagtgtcttcgttcgtggctgatattgcccgatacaccgaggtcgcgaataatgtccaaaaggaagagacagtaacaaatatacagtttgtgctgttggactgcagccacctcaagttcagcctggtccaacactgcaatgagtggcaaaataagttcgcgactctattgcgcgagatggccgctggcaggctgctggagctgcatacctaccttaaggaaaacgctgagaagatctctcggccacctcagacgctcgaagagctgggggtgtcgctgcagctagtggatgcactgaaacacgacctggccaatgtggagactcagatcccccctatccacgaacagtttgccattttagaaaaatacgaggtgcccgtggaagatagtgttctcgaaatgttggacagtctcaacggcgaatgggtggttttccaacagactcttctggactctaagcagatgttaaagaagcacaaggagaaatttaaaaccgggctgatacacagcgcggacgactttaaaaaaaaggcgcatacccttcttgaggattttgaattcaagggtcacttcacaagcaacgtgggatatatgtccgccctggaccagataactcaggttagagccatgttaatggcgatgagagaggaggagaattcacttcgagcaaatcttggcattttcaaaattgagcagcctccatcaaaggaccttcagaatttggaaaaggaattggacgcgctgcagcagatttgggagatagcaagagattgggaagaaaattggaacgagtggaaaacagggaggtttttgatccttcagaccgagactatggagaccactgcacatggcctgttcaggagacttactaaacttgctaaagagtacaaagaccgaaattgggagatcatagaaaccacccgatcaaagatcgaacagtttaagcgaaccatgccacttatatccgatctgcgtaatcctgccctacgcgaacgccactgggaccaggtgagagacgagattcaacgggagtttgatcaagagagcgagtctttcaccctggaacagattgtggagctgggcatggaccagcatgtggagaagatcggggaaatctctgcgtccgctactaaagagctggctatcgaggtggctctgcagaacatcgcaaagacctgggatgtgacccagctggacattgttccatacaaggacaaagggcaccaccgcctgcgaggtactgaagaagtattccaggccctggaggacaaccaggtcgccctatcgactatgaaggcctccagatttgtgaaggcatttgagaaggacgtggatcattgggaaaggtgtctgtcactcatcttagaggtgattgagatgattcttacagtgcagcgtcagtggatgtatttagaaaatatttttctgggagaagatatcaggaagcagcttcccaacgaaagcacgctcttcgaccaagtgaattcaaattggaaagcaataatggacagaatgaacaaagataacaacgctctgagatctacccatcatccagggctgctggacacactaattgaaatgaatactattctggaggatatccagaagagcctggatatgtatcttgaaacaaagagacatatctttccccgtttttacttcttgtctaatgacgatctgctagaaattcttggacagagcagaaaccccgaagctgtccagccacacctgaaaaagtgcttcgataacattaaactgctgcgtattcagaaagtgggtggacccagctctaagtgggaggctgtcggaatgttctccggcgacggcgagtacattgactttttgcattctgtgtttctggaaggtcccgtggagtcctggttgggcgacgttgagcaaaccatgagagtgacactccgcgacctgctgcgcaattgccacctcgcgctgagaaaattcctaaacaagcgcgataaatgggtgaaggaatgggctggacaggttgtgataaccgcatcacagatccagtggactgccgatgtgactaagtgtctgttgacggcaaaggagagggctgataaaaagatcctgaaggtcatgaagaaaaaccaggttagcattttgaacaagtactccgaagccatcaggggaaatctgacaaagattatgagactaaagatcgtcgcactggtgactattgagatacatgcgcgtgatgttttagagaagctgtacaaaagcggactcatggatgtgaattcattcgattggctgtcccaactccggttctactgggagaaggaccttgacgactgcgttatccgccagacaaatacccagtttcagtacaactacgaatacctcggtaattccggcaggttggtgataacgccactcacagatagatgctatatgactctcacaactgcgctgcacctccaccgcggaggaagtccaaagggacccgctgggaccgggaagactgagaccgtcaaggatctaggtaaggctctgggaatctatgttatcgtggttaactgttcagaggggctggattacaagtcaatgggcagaatgtactccggtctcgcgcagaccggtgcttggggatgctttgacgagttcaacagaatcaacatcgaggtactgagtgtggtggcgcaccagatcttgtgtattctgtccgctctcgctgctggccttacgcactttcattttgacggcttcgaaataaacttagtgtggtcatgcggtatctttattactatgaaccccggttatgcaggacggacagagctgcccgagaacctgaaatcgatgtttcgccctattgccatggttgtgccggatagtacacttatcgcagaaatcatcctgtttggagagggattcggcaactgcaaaattctggccaaaaaggtatatactctgtactcactggccgtacagcagctgagccgccaggatcactatgattttggcctcagggctctcacgtccctgttacgatatgccggtaagaagaggcggttgcagccagatctgactgacgaggaagtactgctactgtccatgagggacatgaatattgcaaaactgacaagcgtggacgcccctcttttcaatgccatcgtgcaggacctgttccccaatattgagctgcctgttattgactatgggaagctcagggagactgttgaacaggagattcgagatatgggcttgcagtctacacctttcaccctaactaaagttttccagctatacgagaccaaaaacagtcgacacagcactatgatagtggggtgtacaggctctgggaagactgcctcctggaggattctgcaggcttctctgagttccctctgtcgggctggcgacccaaatttcaacatagttagagaattccctcttaatcccaaggcactctctctgggtgaactgtatggcgagtatgatcttagcactaatgagtggacagacggcatcttgtcaagcgtgatgagaaccgcatgcgccgatgaaaaacccgatgagaaatggatcttgttcgacgggccagtggacaccctgtggatcgagaatatgaactcagtcatggacgacaacaaggtcttgactctgatcaacggcgagcggattgcgatgcctgagcaggtgtcgttgctctttgaagtcgaagatttggccatggccagcccggctactgtgtctcggtgcggcatggtgtatactgattacgctgacctgggatggaaaccctacgttcagagttggttagaaaagcggccaaaagcggaagtggaacctctgcaaaggatgtttgagaagctgataaacaagatgctcgcatttaagaaggataactgtaaggagttggtacccctcccagagtacagcggaattacttccctctgcaaactgtactctgccttggccactccggagaatggcgtcaatccggctgatggggagaattacgtgaccatggtggagatgacattcgtgtttagtatgatatggtctgtctgcgcgagtgtggacgaggagggacgaaaaaggatcgattcttaccttagagagattgaggggtcatttcctaataaggacaccgtgtatgagtatttcgtcgatccgaaaatcaggtcttggacgagctttgaggataaattaccaaagtcttggcgctatccgccaaatgcccctttttataagattatggtcccgaccgtcgatacagtgcgctacaactatctagttagcagtttggtcgccaaccagaatcctatcttactggtagggcctgtggggactggaaaaacgtctattgcacaaagtgtgctacagtctttgccttcctcacagtggagtgtactcgtggtgaatatgtccgcacagacgaccagcaataacgtgcagtctatcattgaatctagggtcgaaaagaggacaaaaggggtgtacgtaccattcggcggaaaaagtatgatcacctttatggatgaccttaacatgccagccaaagatatgtttggctcacagccccctctcgagctcatacgactgtggattgactatggtttttggtatgatcggaccaagcagaccatcaagtacatccgagaaatgtttctcatggcggcaatggggcctccgggaggaggcaggacagtgatttccccgcgtcttcgatcaaggttcaacattatcaatatgacttttccaacaaaatcgcagattattagaatctttggtaccatgatcaatcaaaagctgcaggattttgaggaggaagttaaacccatcgggaacgtagtgaccgaagccacactcgacatgtacaacactgtcgtgcagagatttctccctacgcctactaagatgcactacctatttaaccttagagacataagcaaggtcttccaagggatgctaagggccaacaaagacttccacgacaccaagagcagcatcacacgcctgtggatccatgagtgttttcgggtgttttccgatcgacttgtcgacgccgcagatacagaagcattcatggggattatatccgacaagctcggcagtttttttgatcttaccttccatcatctgtgtccctctaaacggccacctatatttggcgacttcctcaaggagcccaaggtgtatgaggacctgacagatctgacagtgctcaagacggtgatggagactgcactgaatgaatataatttgtccccgagcgtcgtgcctatgcagcttgttctctttagggaagccattgagcatatcactcgcattgtccgggtgatcggacagcctcgcggtaacatgttactggtgggcattggcggttccggaaggcaatctctcgcccgactggcctcgtcaatttgcgattataccacatttcagatcgaggtgacaaaacattataggaagcaggagttccgcgacgacatcaagagattatatagacaggctggcgtagaacttaagaccaccagtttcattttcgtggatacacagatcgctgacgaaagcttccttgaagatatcaacaacattctgtctagtggagaggtccccaatttgtacaagcctgacgagtttgaggagattcagtctcatatcatagaccaggctagggtcgagcaagtgcccgagtcttcggactctttattcgcctatctcattgaaagagtgcagaataacttacacattgttctttgcctgagtccaatgggtgacccattccggaattggataagacagtatcccgcacttgtaaattgtactaccatcaactggttctcagagtggcctcaggaagccttgctggaagtggcggagaagtgtcttatcggcgtggatctgggtactcaagagaacattcatcggaaagtagcccagatctttgtgacaatgcactggagcgtagctcagtattctcagaagatgctcctcgagctcagacgccacaactacgtcacacccaccaaatatctggaactgctcagtggctataaaaagcttctgggggaaaaacgacaggagctgctagcacaagcgaataagctcaggacagggctgttcaagattgatgaaactcgggaaaaggttcaggtgatgtcccttgaactggaggacgcaaagaagaaggttgcagaatttcagaaacagtgcgaagaataccttgtgatcatcgtgcagcagaagagagaggccgacgagcagcagaaggcagtcactgcgaactccgagaaaattgcagtagaagagatcaagtgccaggctctggccgacaatgctcagaaggatcttgaggaagccctcccagcgctggaagaagccatgcgggcactggaatccctcaataaaaaggatataggggagatcaaatcttacgggaggccccctgcacaggtggaaatcgttatgcaagccgtgatgattttgagaggcaatgagccaacctgggctgaagccaagaggcagctcggagaacagaatttcatcaagtcccttattaatttcgacaaggataatatctcagataaagtgctcaagaagatcggtgcgtactgtgctcagccagattttcagccagatattatcggccgtgtgagcttagccgcaaagtccctgtgtatgtgggtgcgcgctatggaactgtatgggcgactgtacagggtggtggagccaaaaaggattaggatgaacgccgctttggctcagctacgggaaaaacaagcagcactcgctgaggcacaggagaaattgcgagaggtcgccgagaagctggaaatgctgaagaagcagtacgacgagaagcttgcgcagaaagaagagctaagaaagaagagcgaggagatggagctgaaacttgaacgagccggtatgctcgtgtcaggactcgctggggagaaggccagatgggaggaaaccgtgcagggattagaagaggatttgggctatctagtgggagactgcctgctggccgctgctttcctttcatatatgggtccttttctgaccaactaccgcgatgagatcgtgaaccagatctggatcggcaaaatttgggagctacaagtgccttgcagtccctccttcgctatagacaacttcctctgtaatccaaccaaagtgagagactggaacattcagggccttccctccgatgcatttagcaccgagaacgggattatcgtcaccaggggcaacaggtgggctcttatgatcgacccccaggcccaggccttgaaatggataaaaaacatggagggagggcaaggactgaagattattgacctgcaaatgagcgattatctcagaatcttagaacacgcaattcatttcggatacccggtgctattacagaatgtccaggagtacctagatcccactcttaatcccatgcttaataagagcgttgcaaggattgggggtagactcttgatgcgcatcggggataaagaagtggagtacaacaccaattttaggttctatatcactacaaagctgtcaaatccccactatagtccggagactagcgctaaaaccaccatcgttaatttcgccgtgaaggagcagggtctggaagctcaactcttagggatcgtagtgcgcaaggagagacccgaactggaagaacagaaggacagcctggtcatcaacattgccgctggaaaaagaaaactaaaagaacttgaagatgagattcttcgacttctgaatgaggcaaccggctcccttctggacgatgttcaactggtcaacaccctacacacttcaaaaatcactgccacagaagtgaccgagcaactggaaacctctgaaactacagagatcaacactgatctggctcgcgaggcgtaccgcccttgcgcacagcgcgcatcaattctcttttttgtactgaatgatatgggatgcattgatcccatgtatcaatttagcctagacgcctatatttccctgttcatcctgtcgatagacaaatcgcaccgctcaaacaaactggaggaccgtatagactatttaaacgactatcacacatatgcggtgtatcgctacacctgtcgaactctattcgaacggcacaagctgttgttttctttccatatgtgtgccaaaatactcgagacttccggaaaactaaacatggatgagtataacttctttttaagaggcggtgttgttctggaccgagaggggcagatggacaatccatgtagttcctggctggctgatgcgtactgggacaacatcacggagctggataagctcaccaatttccacggcctgatgaattccttcgaacagtatccacgcgactggcacctgtggtacaccaacgccgctcccgagaaggctatgctgcccggtgagtgggaaaatgcttgtaatgagatgcagcggatgctaattgttaggtctctcagacaggacagagtagctttctgtgtgacctcattcatcatcacaaacctgggttcgagatttattgagccccctgtactaaacatgaagagcgtgcttgaggactctacacctaggtcccctctggtgtttattttgtcacctggggtggacccgacctccgccttgctccagctcgcagaacatatgggcatggcccaacggttccatgctctgtccctagggcaaggtcaggcgcctatcgccgcaagacttttgcgagagggggttacacagggtcattgggtgttccttgccaattgccacctctcactctcctggatgccgaatcttgataagctcgttgaacaactccaggtggaagatccacacccctcatttcgcctgtggctttcttcaatcccccaccctgatttcccaatctctattctacaggtgtccatcaagatgaccacggagccgccaaaaggactgaaagccaatatgacaaggttgtaccagctgatgagcgaaccccaattttcacggtgttcgaaacctgccaaatataaaaaacttttattctctctgtgtttcttccattcggtgctcttggagaggaagaagtttctccagctaggctggaacattatctacggatttaatgactctgatttcgaggtgtcggaaaacctcctgtccctgtacctcgatgaatatgaggaaacgccatgggatgccctgaaatacttaatcgctggcattaactacggtggccacgtgaccgatgattgggaccgccgtctcctgaccacttatattaatgattatttctgtgatcaaagcctctctacccctttccatcggctgtctgctctggaaacctatttcattcccaaagacgggagcctcgcgagttataaagagtatatttccctacttccaggtatggacccccctgaagcgtttgggcagcacccaaatgctgacgtggccagccagatcaccgaggcccaaaccctgttcgacactctgttaagtctgcagccgcagataacccctacccgtgctggaggccagacccgggaagaaaaggttctggaactggcagccgacgtgaagcagaagataccagaaatgatcgattatgaaggtacacagaagctgctggcactggatcctagccctttgaatgtcgtcctgttacaggaaatccaaaggtacaacactctgatgcaaacaattctattctcccttacagatttggagaaagggatccaggggctgatcgtgatgagcacctctctcgaggagatttttaactgcatctttgatgctcatgtgccccctctctggggtaaggcgtaccccagccaaaaaccactcgccgcatggacgcgggacctcgccatgagagtcgaacagttcgagctgtgggctagccgggcaagaccccctgtgatcttttggctcagtggctttacattccctaccggctttctgaccgcagtcttacagtccagcgctagacagaataacgtcagcgttgattccctgtcttgggagttcattgtcagcacagttgacgactcgaaccttgtgtacccaccgaaggacggcgtatgggtaagaggactgtacctggaaggcgctggctgggatcgcaaaaactcatgcctagtggaagcagaacccatgcagctggtatgcctcatgccaacaatccattttaggccagccgagtctcgcaaaaagtctgccaagggtatgtactcatgtccttgttattattaccctaatcgggctggaagtagtgatcgcgctagttttgtcatcggaatcgatctcaggtcaggggcaatgacacctgatcactggatcaaaagagggactgccttactgatgagtttggactcgtac

SEQ ID NO: 221435 - DNA, 12351 bp, Artificial Sequence
  Description of Artificial Sequence: Synthetic coding sequence
atgggtgccactgggagactggaattgactctggctgccccaccgcaccctgggccagcttttcagaggagtaaagctcgtgagacacagggcgaggaagaaggatcagaaatgcagattgccaaatccgatagcatccaccatatgtctcactcccaagggcagccggaactcccacccctgcccgcaagcgccaacgaggaaccctccggactctatcaaactgtcatgtcgcactcattctacccgccacttatgcagcgaactagctggactctcgctgcaccctttaaggagcagcatcatcatcggggaccttcagattcaatcgcaaataactacagcctaatggcccaggatctaaaactcaaggacctcctcaaggtgtatcagcccgctactataagtgtgccccgagatcggactgggcagggcttacccagctcaggtaacagatcctccagcgagccgatgagaaagaagaccaagttctcttcgcggaacaaggaggattcgacgcggattaaattagccttcaagacctctatttttagccccatgaagaaggaggtgaaaacatctctaacttttcctggtagccggccaatgtcaccagagcagcagctggacgtgatgttgcagcaggagatggagatggaaagtaaggagaaaaagccaagtgaatcagacctggagaggtactattattacttgaccaatggaattagaaaagacatgattgcgcctgaagagggagaggtcatggtgagaatttccaaacttatatcaaacacgttgctcacttctcctttcctggaacccttaatggtcgtcctggtgcaagagaaagaaaacgattactattgttctctgatgaaaagcatcgttgactatattctcatggacccaatggagcgcaagcgtttgttcatcgaatcaatccctaggctctttccccagcgcgttatcagggccccagtgccctggcactctgtgtatcggagcgccaaaaagtggaacgaggagcacctccacacagtaaaccccatgatgctacggctgaaggagctctggttcgccgaattccgtgacctaagattcgtccgcaccgccgagatccttgcagggaaacttcctcttcaacctcaagaattctgggatgtgatccagaagcattgtctcgaggctcatcagacactgctgaataagtggatccctacttgtgcgcagctttttacgagccgtaaagagcactggatacactttgcgccaaagtccaattacgactcctcccgaaacattgaggaatacttcgcctctgtggcctcatttatgagtctccagttgcgggaactcgtgatcaaatcactggaggatctggtgtccttattcatgatacataaggacggaaatgacttcaaagagccctatcaggagatgaagttttttattccccagctgatcatgatcaaattggaggtgagcgagccgattatcgtgttcaatccaagcttcgatgggtgctgggagctgatccgagactctttcctggagatcataaagaattccaacgggatccctaagttgaagtatattccccttaagttcagtttcactgcagcggctgcggacagacagtgtgttaaggctgcagagcctggggaaccatcaatgcacgccgcagccaccgctatggcagagctgaagggctataacttgttgctgggcactgtgaacgcggaggaaaagcttgtaagtgactttctgatccagacgtttaaggtcttccagaagaaccaggtgggaccgtgtaagtacttgaacgtatacaagaagtatgtcgacctgctagataataccgctgagcagaacattgctgcgttcctgaaagaaaatcacgacatcgacgactttgtgaccaagataaacgccattaaaaaaagaagaaacgaaattgcaagtatgaacattacggtgccactggccatgttctgtttggacgcaacagcactcaaccacgatctctgtgagagagcccagaacttgaaggaccatctgatccagttccaggtggacgtcaaccgggatacaaacacaagcatctgtaaccagtattcccatattgccgataaagtttccgaggtgccagcaaataccaaagagcttgtatcattaattgagtttctcaagaaaagctctgctgtcactgtgtttaagctccgcagacagcttcgggatgcatccgaacggctggagttcctgatggattatgccgatctgccctaccaaattgaggatatcttcgacaactctaggaacctgctgctccacaaacgggaccaggccgaaatggatcttattaaacggtgctccgaatttgagctgcggttggaaggctatcatagagaactggagagcttccgtaagagagaggtgatgaccactgaagagatgaagcataatgtggaaaagctgaacgaattgagcaagaatctaaaccgtgcattcgcggagtttgagctgatcaacaaggaggaggagctgctagagaaagagaaatccacctatcctctccttcaagcaatgttaaagaacaaggttccatacgaacagctgtggtcaacagcatacgagttctcaattaaatccgaggagtggatgaacggccctttattcctcctgaacgctgaacagattgccgaagaaatcgggaacatgtggcgcacaacatataaacttataaagactctctcagatgtgcctgctccacgaaggctggcggagaatgtaaaaattaaaattgacaagttcaaacagtatatccccatcctctcgatttcatgcaatcccggtatgaaggataggcattggcagcaaatttctgagatcgtgggatatgaaataaagccaactgagaccacttgcttgtctaatatgcttgagttcggctttggcaagtttgtggaaaagttagagcccataggagcagctgcctccaaggagtattctctagagaaaaacctggaccgaatgaagctggattgggtgaacgtgaccttctcattcgttaaatacagggataccgacactaacatcctgtgcgccatagatgatatccagatgctgctggatgaccatgttatcaaaactcaaacgatgtgcggaagcccattcatcaaacctatcgaggcagagtgtaggaagtgggaagagaagctgattcggatacaagacaatctagacgcgtggctgaaatgtcaggccacatggctctacctggagcctatcttcagcagcgaggacatcatagcccagatgcccgaggagggtcgaaaattcggcatcgttgacagctactggaagtcgctcatgtcacaagctgttaaagacaatcgcattctagtggccgctgaccagcctcggatggccgaaaagctgcaggaagctaacttcttgttggaggacattcaaaaagggctcaacgactatcttgagaagaagagattgttttttccacggtttttctttctgtccaatgacgaactcctcgaaatcttgtctgagactaaagacccactgcgggttcagccacaccttaagaagtgtttcgagggcatcgccaagctggagtttacagacaacctcgagatcgttggcatgatctcttctgagaaggaaactgttcccttcatccagaagatctacccagcaaacgccaagggcatggtcgagaagtggctgcagcaggtcgagcagatgatgttagcctctatgcgggaggtgatcggcctaggtatcgaagcctacgtgaaagtgcctaggaaccattgggtgctccaatggcccggtcaggtggtgatctgcgtcagtagcattttttggacccaggaagtatcacaggccttggccgagaatacattactggacttcctcaagaaatccaacgatcagattgcacagatcgtgcagctggttaggggtaaactgagctctggagcccgtttgactttgggagctctgaccgtgattgacgttcacgcacgggacgttgtggccaaactgagcgaggacagagtgtctgatttgaacgactttcaatggatctcccagttacggtattactgggtggctaaagacgttcaagtgcagatcattacaactgaagcactatatggatacgagtacctgggcaatagtcctcggctagtcattacccctctgaccgatcggtgttaccgcaccctaatgggggcactcaaacttaatttaggcggagcccctgagggcccagcaggaacggggaaaactgaaactactaaggatctggccaaggccctcgccaagcaatgcgttgtctttaattgttctgacggtctggattataaggccatggggaaatttttcaaaggcctggcgcaggcaggcgcatgggcatgcttcgatgaattcaatcgcatcgaagttgaagtattgtcggttgtagcccagcagattctgagcattcaacaagctattattcggaaactaaagacatttattttcgaagggacggagctcagcttgaaccccacatgcgccgtgttcatcaccatgaatccaggctatgctggcagggcagaattacctgataatctcaaagccctgtttcgaaccgttgccatgatggtacctgactatgctttaattggcgaaatctcactctacagcatgggattcctggactctcggtccctggctcagaaaattgtggccacctatcgtctttgctcagaacagctatcctcacagcaccattacgactatggaatgcgcgctgttaaatccgtgctgaccgctgctggtaatttgaaacttaaataccccgaggaaaacgagtccgtccttttgctgagagcattattagatgttaatctcgcaaagttcctcgctcaagatgtccccctattccagggaatcatttctgaccttttccctggcgtggtgttacccaaacccgactatgaggtgtttctgaaagttttgaatgacaatattaaaaaaatgaagctgcaacctgtgccttggttcataggcaagatcattcaaatctacgagatgatgcttgtgcgtcacgggtacatgatcgtgggagacccaatggggggtaagacatctgcatataaggttcttgctgcggcactgggtgacctgcacgctgccaatcaaatggaggagttcgctgtcgagtacaaaattataaaccctaaagctataaccatgggccaactctatggctgctttgatcaggtgtcacacgagtggatggacggagtgctcgctaacgcgtttcgtgagcaagccagcagtctctcggatgatcggaagtggattatttttgatggacccgtggatgccatctggattgagaacatgaacactgtgctggatgacaataagaagctgtgcctgatgagcggtgagatcattcagatgaacagcaaaatgagtctgatcttcgaaccggctgacctagagcaagctagcccagctactgtctctcggtgtggtatgatttacatggagcctcaccaacttggatggaagccgctgaaagacagctatatggacacactgccgagttctttaacgaaagagcacaaggagctagtgaatgacatgtttatgtggctcgtgcagccttgcctcgaattcggcaggctgcactgcaagtttgtggtccaaacctccccaatccatctggctttctctatgatgcggctgtattctagtctcttggatgaaataagggcggtggaagaagaggagatggagttgggggagggtctttccagtcagcaaatctttctgtggctgcagggtctgttcctgttttctttggtgtggacagttgctggaaccattaatgctgactctcgcaagaagttcgacgtgttttttagaaatctgatcatgggtatggatgacaatcatcctcgacctaagtctgtgaaactaaccaagaataatattttcccagagagaggttctatttatgacttctattttatcaagcaggcaagtgggcattgggaaacctggactcagtacattaccaaagaagaggaaaaggtgccagctggggcaaaggttagtgagctcatcattcccaccatggaaaccgctagacagtccttcttcctcaaaacttatctcgaccacgagatccctatgctctttgtggggccaaccggcaccgggaaatctgccatcacaaacaattttttgcttcacctgcccaagaacacctatttgcctaattgcataaacttttccgccaggacctccgcaaatcagacgcaggacattatcatgtcaaagctggatcgtaggagaaaaggcttgtttggcccacccattgggaagaaggccgtagtgtttgtggacgatctgaatatgcccgcaaaggaagtctacggtgcacaaccccctatcgagctcctgaggcagtggatagaccacggctattggtttgataaaaaagatactactcgattggatattgtggacatgctgctggtgacagcaatgggcccacctggaggtggtaggaacgacataaccggcaggtttacgaggcacctcaacatcatttccatcaacgcctttgaggatgatatcctgactaaaatttttagttcgatagtggactggcattttgggaagggtttcgatgtgatgtttttgcgctacgggaagatgctggtgcaggccacgaaaaccatctacagggacgccgttgaaaattttttgcctacgccgagtaagtcccattacgtcttcaatctgcgtgacttctcacgagtgatccagggggttctgctgtgccctcacacccacctccaagatgttgagaagtgtattagactgtggattcacgaggtctacagagtcttttatgacaggctgattgacaaagaagatcgacaagtctttttcaatatggtcaaggaaacgactagcaactgctttaagcaaacgatcgaaaaggtacttatccatttaagtccaaccgggaagattgtagatgacaatattcgctcccttttcttcggcgactactttaagcctgagtctgatcagaaaatatatgacgaaattactgacctgaaacagcttaccgttgttatggaacattacctggaagaattcaacaacatatccaaagcgccaatgtcacttgtgatgttcaggtttgccattgaacatatctcccgaatctgtcgtgtcctgaaacaggacaagggacacttgttactggtcgggattggcggtagtgggaggcagagcgcagctaaactgagcacatttatgaacgcttacgaactctaccagatcgaaatcacaaaaaattatgccggtaatgattggcgcgaggacctgaaaaagatcattctccaggtaggcgtcgcaactaagagtactgtttttctgtttgctgacaaccaaatcaaggacgagagcttcgtcgaagacataaatatgctgttgaatacgggggatgtgcccaacatctttcctgccgacgaaaaggcagatatcgttgagaagatgcagacagcagccaggacccagggcgaaaaagtggaggtaacgccgctttccatgtataatttttttatcgaacgtgtgatcaacaaaatatccttttccctcgccatgtcaccgattggggacgccttccggaacagattgcggatgttcccctcactgatcaattgttgcaccatcgattggtttcagagttggccaactgatgcactcgagcttgtggccaacaagttcctggaggacgtcgagcttgacgacaacataagggttgaggtggtctcaatgtgtaagtactttcaggaatcagttaagaaattgagccttgactattataacaaactccggagacataattacgtgacgcccaccagctatctagaattaattcttacctttaaaacgctcctgaattctaagcgtcaagaagtcgcaatgatgaggaatcggtatttaacaggtttgcagaagttggactttgctgcctcgcaggttgctgttatgcaaagggagctcacagctttacaaccccagctaatcctcacttctgaggaaactgccaaaatgatggtgaagatcgaggctgaaacgcgggaggctgacgggaagaagctcctcgtgcaggccgatgagaaagaggccaatgtggccgcagccatagcccagggcattaagaacgagtgcgaaggcgatttggctgaggcaatgcccgcacttgaagccgctctagccgcacttgatacccttaacccagccgatatttcactggttaagagcatgcagaatcctcccggaccagtgaagctagtgatggagtccatttgcattatgaaagggatgaaacctgagaggaaacctgacccctcgggctccgggaagatgatcgaagattattggggagtgagcaaaaagattctcggagaccttaaattcttggagagcctgaagacatatgataaggataacattcccccacttaccatgaaacgcatccgggaaaggtttattaaccaccctgaattccagcccgcagtaattaagaacgtatccagtgcatgcgaaggactctgtaaatgggtgcgagccatggaggtttacgacagggtggctaaagtcgtggccccaaagcgtgagcgcctgcgggaagctgagggcaaattggccgctcagatgcagaaactgaatcagaaacgcgctgagcttaagctagtagtcgaccgcctgcaagccctcaatgacgatttcgaggagatgaacaccaaaaagaaagatctcgaagagaacatcgagatctgttcccaaaagctggttagagccgagaagctgataagtggcttgggcggagaaaaagacaggtggacagaggccgctaggcagcttgggatcagatatactaatctcaccggggatgttctgcttagttccggcactgtggcttacctcggagcgttcaccgtggactatcgagttcagtgccagaaccagtggctggccgaatgcaaagacaaggttatacctggcttttcagactttagtctgagccacacgctgggggatccaattaagatccgcgcttggcaaattgccggtcttcccgtggatagtttttctatcgataatggaataattgtcagtaattcgcgccgatgggcactgatgatcgatcctcacgggcaggccaataagtggattaaaaatatggaaaaggccaacaaactggccgttataaagttctccgatagtaactacatgagaatgcttgaaaatgcccttcagctcggtaccccagtcctcatcgagaatatcggcgaggagttggatgcttccatcgagcctattctcttgaaggccaccttcaagcagcagggagtcgaatatatgcggttaggagagaatattatcgaatacagcagagacttcaaactctatattacgacaagactccgtaatccacactatctgcccgaagtcgccgtgaaggtttgcctgttgaacttcatgattacacccttagggctgcaggatcagctcttggggatcgttgccgcaaaagagaagcccgaactggaggaaaaaaaaaatcagctgatcgtagagtccgccaaaaacaaaaagcatttaaaagaaatcgaagacaagatcctggaggttttgtctatgtctaagggaaatatactcgaagacgaaacagcgatcaaagtgttaagttcatccaaggtattaagcgaagagatctccgaaaagcagaaggttgccagcatgacggaaacccagattgatgaaaccaggatgggatacaaaccagtggccgtgcatagcgccaccattttcttctgcatctctgacctcgctaatatagagcctatgtatcagtattctctgacatggttcatcaatctgtacatgcactctctgacccattctaccaagtctgaagagttgaatttaagaatcaagtacattatagaccacttcacactctccatttacaacaacgtctgccgcagcctgttcgaaaaggacaaacttttgttctcactcctgttaacaatcgggatcatgaagcagaaaaaggaaatcaccgaggaggtctggtattttctattgactggcggaatcgccctagacaacccataccctaaccccgcacctcagtggctgagtgagaaagcctgggctgagatcgttcgggcttccgccctgcccaagctgcacggcctcatggaacacctggagcagaatctgggtgagtggaaactcatatacgacagtgcatggccacacgaggaacagctgcctgggagttggaagttctctcaggggctggagaaaatggtgatcctgagatgcctgcggccagacaagatggtgcccgctgtgcgagagttcatcgccgagcatatggggaaactatacattgaagcgccaacttttgacctccagggctcatacaatgactcgtcctgttgtgctccactaattttcgttctgtctcccagcgcggaccctatggctgggctcctcaagttcgccgacgaccttggcatgggaggcacaaggacccagacaatatccttgggccaagggcaaggcccaattgcagcaaaaatgattaataacgccatcaaggacggaacgtgggttgtactccagaactgccatttggccgcatcatggatgcccactcttgagaagatctgcgaagaagtcatcgtgcccgagagcaccaacgctagattccggctgtggctgacctcataccctagcgaaaagttcccggtgagcattctgcagaatggcataaaaatgaccaatgagccgcctaagggcctgcgtgccaacctccttcggtcatacttgaacgaccccatctccgatccggttttcttccagtcttgcgctaaggctgtcatgtggcagaagatgctcttcggtctctgtttctttcacgcagtcgtgcaggagagacgcaactttggacccctcggatggaatattccttacgagttcaatgaatccgatctcaggattagtatgtggcagatccagatgtttctgaacgactataaggaagtgcccttcgatgccctcacctatctcacaggagaatgcaactacggaggcagagtgaccgacgataaagatcggagactgctgcttagcctgctctccatgttttactgtaaagagatagaagaggactattacagtctggctccaggagacacctactacatcccaccacacggctcctaccagtcttatatcgactacctccgcaatctccccatcaccgctcacccagaagtgttcggactgcatgaaaatgctgacattactaaagacaaccaggaaacaaaccagctcttcgaaggcgtgctccttactctcccaagacaatctggagggtccgggaaatccccacaggaagtcgtggaagagttggcccaagacattttgagcaaactgccccgagattttgacctggaggaagtgatgaaactttaccccgtcgtctatgaggagtcaatgaacaccgtcctccggcaggagctcatccggttcaatcgtctcacgaaggtggttaggagaagcctgataaatttggggagagcaatcaagggacaggtgttgatgtccagcgagctcgaggaagtgtttaattccatgttggttggcaaggtgcccgctatgtgggccgcaaagtcttaccccagcttgaaacccttgggcggttatgtagctgatctgctggcaagattgacgttcttccaagaatggatagacaagggcccacccgtcgtcttttggatttcagggttttactttacgcagagcttcctgacaggtgtgagccagaattacgcgcgtaaatataccattcccattgatcatattggtttcgagttcgaagtgacaccacaggagactgtgatggagaataatcctgaggacggtgcctatatcaagggcctctttttagagggggcacgatgggatcggaaaactatgcagatcggggagagcctccccaagattctgtacgacccgcttcctattatttggctcaagccaggggagtctgcaatgttcctgcaccaggacatctatgtatgtcccgtctataaaacttcagccaggagagggacactttctaccactgggcatagtactaactatgtgctctcaattgagctgcctaccgacatgccacagaagcactggatcaatcggggagtggcatctctctgtcagctggacaactac

SEQ ID NO: 221436 - DNA, 2262 bp, Artificial Sequence
  Description of Artificial Sequence: Synthetic coding sequence
atgggcgacatggattgttctagccaaaaaatcgccaagagtgattccatccaccacatgtcccattcccaaggccagcctgagctgccaccccttcccgcatcagcaaacgaggagcctagcggattataccagactgtgatgtcgcatagcttttaccctccactaatgcagaggacctcttggacccttgccgcaccattcaaagagcagcatcatcatcggggacctagtgactctatcgctaacaattactccctaatggcgcaggacctgaagctgaaagatctccttaaagtgtaccagccagcgacgattagcgtgcctcgtgatcgcaccgggcaggggctgccaagcagtggcaatcgatcttcttccgaacctatgaggaaaaaaacaaagttctcctctcggaacaaggaagactctaccaggatcaagctcgccttcaagaccagtattttctctcctatgaagaaagaggtgaagacatctctaacatttcccggaagtcgtccgatgtcaccagaacaacagctggacgtgatgcttcaacaagaaatggaaatggaaagcaaagagaaaaaaccgagcgagtcagacctggagaggtattactactacctaacaaacggaatcagaaaggacatgattgctccagaggagggcgaagtgatggtgcgcatctccaaacttatttcaaacaccctgctcaccagtccgttcctagaaccgttaatggtcgtgctggtgcaggagaaggagaacgactattactgctctctaatgaaaagtattgtcgattacattctcatggaccctatggagcgaaagcgcttgtttatcgagtctatcccgagactctttcctcaacgagttataagggcccctgtgccttggcattccgtgtatcggagcgccaagaaatggaacgaagaacatctgcatacagtgaaccctatgatgctgcggcttaaagagctgtggttcgcagaatttcgggacctgagatttgtgagaacagcggaaattctggccggaaagttgccgctccagcctcaagagttctgggatgtcatacagaaacactgtctggaggcccaccaaaccttactcaataagtggatccccacatgtgcccagttatttactagtcgcaaggaacactggatccatttcgcccctaagagtaattacgattcatctcggaatatcgaagaatacttcgcatcggttgcctctttcatgtcactccaactgagagaactggtcataaagagcctcgaggacctggtgtctctattcatgatccacaaggatggaaacgactttaaggagccttaccaggagatgaagtttttcattccccagttaataatgattaagttggaagtttccgagcccattattgtgtttaatccatccttcgacgggtgttgggagttgatccgggactctttcttagaaatcataaaaaatagcaacggtatcccgaaggtcgaatctgtcctgttccctgaactgaaggggtataatctgttactgggtactgtgaatgccgaagagaaactggtgtccgatttcctgattcagactttcaaagtgtttcagaagaatcaggttggcccatgcaaatatttaaacgtgtataaaaagtacgtcgacctgctggacaatactgccgagcagaatatagccgcattcctgaaggaaaaccacgacatcgacgattttgttaccaagatcaatgcaatcaagaagcgccgaaacgagattgctagcatgaacattactgttccacttgccatgttctgcttagatgctactgctttgaaccatgatctgtgcgagcgcgctcagaacctgaaagaccacctgattcagtttcaggtcgacgtgaaccgagacacaaatacatccatatgcaatcagtattcccatatcgccgacaaggtgtctgaggttcccgctaatacaaaggagttagtgtctctgatcgagtttttaaaaaaaagcagtgcagtcaccgtgtttaaactgcggaggcagctgagagacgcttctgaaaggctcgaattccttatggattacgcagacctcccctatgaagacataaagctgaacagcacgctgttcctgtggccagaccagatagaggacatctttgacaactctaggaatttgctgttgcacaagcgcgaccaagctgagatggatctcatcaaaagatatcgagagtcactcggcctgtcgtggaagtag

SEQ ID NO: 221437 - DNA, 5663 bp, Artificial Sequence
  Description of Artificial Sequence: Synthetic coding sequence
atgggcgctactggtagactggagcttacgcttgcagcacctccacaccctggcccagccttccaacgctcaaaggccagagagacccagggggaagaagagggttccgagatgcaaattgcgaagtctgattctatccatcatatgagccatagtcaggggcagccagaacttccaccccttccggcttccgccaatgaggagccttcgggactctatcagacagtgatgagccacagcttctacccaccccttatgcagagaacaagctggaccctggctgctccttttaaggaacagcatcaccaccgtggccctagcgacagcattgccaacaattactcactgatggcgcaggacctgaaactcaaggatctcctgaaggtgtaccagcccgcaacaataagtgtgcccagggacaggacaggtcagggtctaccctcctccggaaatagatcatcctccgagcccatgcgcaagaaaaccaaattttcatcaaggaataaggaagactccactcggataaaacttgcttttaagactagcatcttcagcccaatgaagaaagaagtgaagacctctcttactttccccggatcccggccaatgtctccagagcagcagctggatgttatgcttcaacaagagatggagatggagtcaaaggagaaaaaaccgagcgaatccgatttggagcggtactactattacttaacgaatgggattagaaaagatatgatcgcccctgaagagggggaggtaatggttcgaatctcaaagcttatttccaacacattactgacctcccctttcctcgaaccactcatggtggttttagttcaggagaaggaaaatgactattactgcagcctcatgaagtctattgtcgactacatcctgatggacccgatggaacgcaaacggctgttcattgagtcgatccctagactgttccctcagcgtgttatacgagcccctgttccctggcattccgtatatcgttcggccaagaagtggaatgaggagcatctccacacagtgaatccaatgatgctgaggctgaaggaactatggtttgcggaatttcgcgacctgaggttcgttcgcaccgctgaaatcctggctggaaaattgccgttgcagccccaagaattctgggacgttatccaaaagcactgcttggaagcccaccagaccctgcttaataagtggattcccacttgtgctcagctgttcacttcacgcaaagagcactggattcacttcgcccctaaaagcaattacgattccagccgtaacatcgaggaatactttgccagtgtggcaagctttatgtctctccaattaagggaattggtgattaagtcacttgaggatctggtatctttatttatgattcataaggacggcaacgactttaaagagccatatcaggaaatgaaatttttcatcccccagctcatcatgatcaaactggaggtctcggagccaattattgtgtttaacccctccttcgatggatgctgggaactcattcgagatagttttttggagattatcaaaaactccaacgggatcccaaagctcaaatacattcccttaaagttcagcttcacggctgcagctgccgatcggcagtgtgtgaaggccgctgagccaggcgagccttctatgcacgcggctgccaccgcaatggcagagcttaaaggttacaacctcctgttgggaacagtgaatgcagaggaaaaactggtcagtgacttccttattcagacctttaaagtgtttcagaaaaaccaggtgggaccatgcaagtatctgaacgtatacaagaagtatgtagacctgctagataacaccgccgaacagaatatcgctgctttcctgaaggagaaccacgacatcgacgactttgtgacaaaaattaatgccattaagaagcggagaaatgaaatagccagtatgaatatcaccgtccctctggccatgttttgtttggacgccacagctctgaaccatgacctatgtgaacgtgcccagaacttgaaggaccatctgattcaattccaagtggacgtgaaccgcgacaccaatactagtatttgcaatcagtattcccatatagctgacaaggtttccgaggtgcctgcaaacacgaaggaactcgttagcctcatagagtttcttaagaaatctagcgctgtgacggtcttcaaactcaggcggcagcttcgcgacgctagtgagcgcctcgagtttctgatggactacgccgatctgccttaccagatcgaagacatatttgataattctcggaacttgctgttgcacaagagagaccaggcggagatggatctaattaaacggtgctctgagtttgagctgagactggaagggtaccaccgcgaactagaatcgttccgtaagcgcgaagtaatgactaccgaggaaatgaaacacaacgtggagaagttaaacgagctaagtaaaaatctgaacagggccttcgcagagtttgagttgatcaataaagaggaggagctcttggaaaaggagaagtccacatacccactcctgcaggccatgttaaagaacaaggtgccttatgagcaactgtggtcaaccgcatatgagttttcaatcaagtctgaggagtggatgaatggccctctgtttcttctgaatgcagaacagattgctgaggagattggcaacatgtggcggacgacctataagctgataaagactctgtcagatgtgcccgctccccgacggctcgccgaaaatgttaaaattaagatagacaagtttaaacaatacatacccatcttgtctatctcttgcaaccccggtatgaaggatcgacactggcagcagattagcgagattgtgggatatgagatcaagcccaccgagaccacatgcctgtctaacatgctggaatttggctttggaaaattcgtagaaaaactcgaaccaatcggggctgctgcctcaaaagaatacagtctagaaaagaacttggacagaatgaagctcgactgggttaatgtcacattttcttttgtgaagtaccgagacaccgacaccaatatcctgtgcgccatagacgacattcaaatgctgctggacgaccacgttattaaaacccagacaatgtgcggcagcccattcataaaaccaatcgaagcagagtgcagaaagtgggaagaaaagttgattcggatccaggacaacctcgacgcatggctgaaatgtcaggctacctggctttacttagaacctattttttcttcggaggatatcattgcccagatgcctgaggagggacggaaattcggcatcgtggacagttattggaagagtctgatgtcacaggcagtgaaagacaacagaattctggtggccgcagaccagccaaggatggccgagaagctgcaagaggccaactttttgttagaagacatccagaagggactgaatgattacttagagaagaagcgactgttcttccctcgcttctttttcctgtctaatgacgaactccttgaaatcctttctgagactaaagatcctttgcgcgttcagccccacctaaagaaatgcttcgaaggaatagctaaattggaatttacagacaacctcgaaatcgtgggaatgatctctagtgagaaggagacagttccgttcattcagaagatctatcctgcaaacgcaaagggaatggtggagaaatggttacagcaagtggagcagatgatgctggcatcaatgcgggaagtcatcggtttgggcatcgaagcctacgtaaaagtcccacggaatcattgggttcttcagtggcctgggcaggtggtgatctgcgtgagctccatcttctggacccaggaggtctcacaggccctggccgagaatacactgctggactttctgaagaaaagtaatgaccagatcgcacagattgtgcagctggtgaggggcaagctgtcttccggcgctcgcctgactttgggtgcactcaccgtcattgatgtgcacgcacgcgatgttgtggccaagttgagtgaggacagggttagcgaccttaatgacttccaatggatctcacaactgaggtactactgggtggcaaaggacgtgcaggtacaaattatcacaactgaggcgctctacggctacgaatacctgggcaatagtcctcgactcgttatcacgccactgactgacaggtgctatcgaaccctcatgggggcactcaaacttaatcttgggggagcaccggaagggcctgccggaaccggaaagaccgagaccacaaaggatctggctaaggccctagccaagcagtgtgttgtgtttaactgtagtgacggcctggactacaaagctatgggaaaattctttaaggggcttgcccaggctggggcatgggcttgtttcgatgagtttaacaggattgaggtggaagttctctccgtcgtggcccagcaaattctctccatccaacaagcgatcatccggaagctgaagacttttatattcgaaggaaccgaattgagcctcaaccctacgtgcgcagtcttcattactatgaaccccggttatgccggacgcgcagaactgcctgacaacctaaaagccctcttccgtaccgtggctatgatggtccccgactatgcactgattggggaaatctcattatattcgatggggttcctagattcccggagcctcgcccaaaagatcgtggccacataccgactttgcagcgagcaactgtcctcccagcaccactacgattacggaatgcgggctgtgaaaagtgtccttaccgctgctggaaacctgaagcttaaatacccagaggaaaatgaatcagtactattgctgcgcgctctgctcgatgtcaatttggcaaagttcctggctcaggatgtccctctgttccagggcattatcagtgatctgttccctggagtggtcctgcccaagcccgactacgaagtgtttctcaaggtccttaacgacaacattaagaaaatgaagctgcagcccgtgccatggtttatcggcaagatcatacagatatacgagatgatgctggtgagacatggatacatgattgtaggggaccctatgggcggtaagacatccgcgtacaaagtcctagctgcggcactgggtgatctgcacgccgctaaccagatggaggagttcgctgtggagtacaaaatcattaatcctaaagccattactatgggccagctgtatggttgctttgatcaagtttctcacgaatggatggatggggtcctggctaacgctttccgcgaacaggcttcttccctaagcgatgatcgcaagtggattatctttgacggccctgtggatgcgatttggattgagaatatgaatactgtgctggacgataacaagaaactgtgcttgatgtctggtgaaatcatccagatgaacagcaagatgtcgttgatattcgaacccgcagacttggaacaggcaagtcccgcaacggtttccaggtgtggcatgatctacatggagcctcatcagctggggtggaagccattgaaggatagttatatggacaccttaccttcttcattgacaaaagagcacaaggagctgatgaagagtggacaata

SEQ ID NO: 221438 - DNA, 462 bp, Artificial Sequence
  Description of Artificial Sequence: Synthetic coding sequence
atgcttcacatggggttggcccacgttaagagaatgcctcggagcagccggttgcagtgcaaagaagcacaggctttcttttctttacagtccgggacttatcgcgttctctccaccccactcaagctgggcgtgtgggaagagaagaaacactgggctgccctcctccagcccgtgagtctcggccgtaaatggaaaaagcgcccttgtaacctggatgactacgtatgggggcagctgaaatatatccctttaaagtttagtttcacggccgcagcggctgaccggcagtgcgtaaaggccgctgagcccggagagccctccatgcatgctgccgcaacagcaatggcagggactcgcgcaggcaccactttcgacgagctgcagtgtcaggaagatatggtctgtaccaggtttgagaataaagcatacgttaacaccaatgattttactaggcaatag

SEQ ID NO: 221439 - DNA, 13875 bp, Artificial Sequence
  Description of Artificial Sequence: Synthetic coding sequence
atgttcaggattgggcgacgacagctgtggaagcattctgttacccgggtcttgacccaaagattaaagggtgagaaggaagccaagagagcactgctcgacgcacgccacaattatctcttcgccatcgtggcatcttgcttagacctcaataagaccgaggtggaagacgctatcctcgaggggaatcagatcgagagaatcgaccagctgttcgccgtgggcggtctgcgacacctgatgttctactaccaggacgtggaagaggctgagacagggcagctgggatccctaggcggagtgaacctggtgagtggaaagatcaagaaaccaaaggtattcgttactgagggcaatgatgtggccttgacaggggtgtgtgttttctttatccgaacagacccctccaaggccatcaccccagacaacattcatcaggaagtgagcttcaacatgcttgatgctgcggacggtggccttttgaactccgtacggaggctgctgagcgacatctttataccagctctcagagccaccagccatggctggggagaactggaagggctccaagacgcagctaacatccgccaggagtttctctcctctttggagggatttgtcaatgtgttatctggagctcaggaatcgctgaaggaaaaggtgaatctcagaaaatgtgacattttggagctcaagaccttgaaagagcccacggattatttgactctcgccaacaatccagagactttgggaaagatcgaggattgtatgaaagtttggataaaacagacagagcaggtcctcgccgagaataatcagctgctcaaagaggctgatgacgtcggtcccagagcggaattagagcactggaagaagcggttgagtaagttcaattatctgctggagcaactcaaatcacccgatgttaaagcggtattggctgtgttggccgctgccaagtctaagctgctgaaaacatggcgcgaaatggacatcagaatcactgatgctactaatgaagcgaaggacaacgtcaagtacttgtataccctcgagaaatgctgtgatcccctatattcctctgaccccttgagcatgatggatgccatccccacactcattaatgccataaagatgatctattcaatttcacactactataatacgagcgaaaagatcaccagcctcttcgtcaaggtaaccaatcaaatcatctccgcctgcaaagcttatataactaataatgggaccgcctctatttggaaccaaccgcaggatgtggtggaagagaagatcctctccgcaatcaagctcaagcaggaatatcagctgtgttttcacaaaacaaagcagaaactgaagcagaacccaaacgcgaagcagtttgacttttcagaaatgtacatatttggcaagttcgagacttttcaccggaggttggcaaagattatcgatattttcaccaccctcaaaacttatagtgtgctgcaggattcgaccattgagggactcgaagacatggccaccaaatatcaggggatcgtcgccaccattaagaagaaggagtacaactttttggaccagaggaagatggacttcgatcaggattacgaggagttctgtaagcaaacaaatgaccttcataatgaactaaggaagttcatggatgttacctttgctaaaatccagaatacaaaccaggctcttcgcatgctaaaaaaattcgagcgtctcaacatccccaatctggggattgacgataaatatcaactcatcctagagaattacggagccgacatcgacatgatcagcaagctctacacaaaacaaaagtatgacccaccactggcgcgaaatcagccgcctattgctggaaaaattctctgggcgcgacagctgttccataggatccagcagcccatgcagttgttccaacagcaccccgctgttttatcgacggctgaggccaaacctataatcagatcatataaccggatggccaaagtgctcttggaattcgaagttctgttccatcgggcatggctgcgacagatcgaggaaattcatgtggggctggaggcctctctcctagtgaaggcccctggtacaggagaattgttcgttaactttgatccacagatcctgattctctttcgcgaaacagaatgtatggcccagatgggtctagaggtgagtcccttggcgacttctctgttccagaaaagagataggtacaagagaaactttagtaacatgaagatgatgctggccgagtaccagcgcgtgaaaagtaaaattccggctgctatcgaacaactgatcgtgccgcatctcgccaaagtggatgaggcgcttcagcctgggttggccgcactgacatggaccagcttgaacatcgaggcctatctggagaatacatttgctaagattaaggacctcgaattactgctcgacagggtcaacgatcttatagagttcaggatcgacgccatactagaggagatgagttccactccactgtgccagctaccacaggaggagcccctaacatgcgaggagtttttgcagatgacaaaggacctttgcgttaacggagctcaaatcctccatttcaagtccagccttgttgaggaggcagtcaatgagttggtaaatatgctgctagacgtggaagtgctgtccgaagaagaaagcgaaaaaatcagtaacgagaacagtgtaaattataagaatgagtcgtctgccaaaagagaagagggcaatttcgacacactaacatcttccatcaatgcccgagcaaatgccctgctacttactactgtgacccgaaagaagaaggaaaccgaaatgcttggggaggaggccagggaattgctgagtcattttaaccaccaaaatatggatgctctcctgaaggtgacacgcaacacccttgaagcgattcgtaaacgaattcattcaagccacacgattaacttcagggattccaatagtgcgagcaatatgaaacagaacagcctgcctatttttcgcgcttctgtaacactggccatacccaacatcgtgatggcaccagcccttgaagacgtgcaacagacgcttaacaaagccgtggaatgtatcatcagcgtacctaagggtgtccgccagtggtcatctgagctgcttagtaaaaaaaaaattcaggagcgaaagatggccgcattacaatcgaatgaggactctgactccgatgtcgagatgggggaaaatgagctgcaagacaccttagagattgccagcgtaaacttacccattccagtgcaaacgaagaattactacaagaacgtgagcgaaaataaggagattgtgaagctagtgtctgtgctctccacaattatcaatagcacaaagaaagaagtcattacctctatggactgctttaaacgttataaccacatctggcagaagggtaaggaagaagcaataaaaacgttcataacgcaaagccctctgctgtccgaatttgaatctcagatcttatacttccagaacttggagcaggagataaacgctgaacccgagtatgtctgcgtaggctccatagccctttacaccgccgacttaaagtttgccttaaccgcagagacgaaggcatggatggtcgtgatcggcaggcactgcaacaagaagtatagatcagaaatggagaacatcttcatgttgatcgaggagtttaataagaagttgaaccggccaatcaaagacttagacgatatccggatcgccatggcggcactgaaagagattcgggaggaacagattagcatcgatttccaggtggggcctatcgaggaaagctacgccctgttgaataggtacggcctgttaattgccagggaggagatcgataaagtcgatacacttcactacgcttgggagaagttgttagctagagctggagaggttcagaataaacttgtaagtttgcagccgtccttcaagaaggagttaatcagcgccgtcgaagttttccttcaggactgccaccagttctatttggactatgatcttaacggtcccatggctagcggtctgaagccccaagaagcttccgacagactgatcatgttccagaatcagtttgataacatttatcggaagtacatcacctatacaggcggtgaagaactgttcggcctgcctgcaacccaatatcctcagctcctggagattaaaaagcagcttaatctcctccagaagatctacactctttataactctgtcattgagactgtgaattcctattatgacatcctgtggtcagaagtcaacattgagaaaattaataatgagttgctggaatttcagaacaggtgtcggaagcttccgagggcactcaaggattggcaagcttttctagatctaaaaaaaattattgatgatttctccgaatgttgtccgctcctggaatacatggcatcaaaggcaatgatggagaggcactgggagcggatcacaacgctgaccggacattctttggatgtcggaaacgagtcctttaagttaagaaacatcatggaggctccacttctgaagtacaaggaggaaattgaggacatttgcatatcagccgtcaaagagcgcgacatcgaacaaaaactaaagcaggtaattaatgaatgggataataaaacctttacgttcggatctttcaaaaccaggggggagctgcttctgcggggagactccacatccgagatcatagcaaatatggaggacagtctcatgctcctcggatcactcctctctaaccggtacaatatgcccttcaaggcgcagatacagaagtgggtgcagtacctgtccaactccactgacatcattgagtcttggatgactgtgcaaaacctgtggatatatctagaggcggtgtttgtagggggagatattgctaagcagctccccaaagaggcgaagcgcttctcaaatattgacaagtcttgggtaaagataatgactcgcgcacatgaagttccatccgttgtgcaatgttgcgttggagatgaaacccttggccaactgcttccccacctacttgatcagctggagatttgtcagaaatcactcactggttacctcgaaaagaagaggttatgcttccccaggttctttttcgtgagtgatcctgcgctgctagaaatcctgggtcaggcgtccgacagccatacgattcaagcccatctgctgaatgtgttcgacaatataaaatctgttaaatttcacgaaaagatttatgatcggatcctctcgatctcatctcaggagggagaaaccatcgaattggacaaaccggttatggcggagggcaatgtggaagtgtggttgaactcactcttagaagagagtcagagttccctgcacctggttatacggcaggcggcagcaaacatccaagagacaggattccaactgaccgagttcctctccagtttccccgctcaggtgggccttctgggcatccagatgatctggacgcgggatagtgaagaggcactgcgaaacgcaaagttcgataaaaagattatgcagaaaaccaaccaggccttcctggagctgttgaacactctgatcgatgtgaccacccgggacctctccagtacagagcgggtaaagtatgaaacactgatcactatacacgtgcatcagcgagatattttcgatgacctgtgccacatgcacatcaagtctcctatggactttgaatggctgaagcaatgtagattttacttcaacgaagattctgataaaatgatgattcatattaccgatgttgccttcatttaccagaatgaattcctaggctgcacagatagattggttatcaccccattgacagacagatgctacataactctcgcccaggcactgggaatgagcatgggcggtgctccggcagggccagccggaactggcaagactgagacaactaaggatatgggcaggtgccttggaaagtacgttgtggtttttaattgttcagatcagatggactttcgaggattagggaggatcttcaagggccttgcccagtccggctcttgggggtgttttgatgagtttaatagaatcgaccttccggtgttgtctgtggcagctcagcaaatctcgattatcctgacctgcaaaaaagaacacaaaaaatcattcatcttcaccgatggcgataatgtcaccatgaacccggagttcggactgttccttacaatgaatcccggatacgccggtcggcaagagcttcctgagaatctgaagattaactttcgctccgtggccatgatggtgcctgacaggcagatcataattagggtgaaattggcttcatgtggctttatcgacaacgtcgtccttgctcgcaagttcttcaccctctataagctgtgtgaggagcaactcagcaagcaggtccactacgattttggcctgcgcaatatcctatctgtgctacgtactttgggtgcagccaagcgcgcaaaccctatggacacggaatctactatcgtaatgcgcgttctccgcgatatgaacctctcaaaattaattgatgaggacgagccattgttcctgagcctaattgaagacctgttcccaaacatactcttggacaaggcagggtatcccgagttagaggctgctatctcgcgacaggtggaagaggctgggcttatcaatcatccgccttggaaactcaaggtcatccagctgtttgaaactcagagagtgcggcatggcatgatgacgctgggcccatcaggggctggcaaaaccacgtgtatccatacgctgatgcgggcaatgactgattgcggtaaaccccatagggaaatgaggatgaacccaaaagccattacagctccacagatgtttggtcgactcgatgtagccacaaatgattggaccgacggcatcttcagcacactttggcggaaaaccctccgtgcaaagaagggggagcatatctggatcatcctagatggcccagtagatgccatctggatcgaaaacctgaactccgtcctcgatgataataaaacactgacactggctaacggtgaccgcattccgatggccccaaattgcaaaataatatttgagccacacaacatagacaacgctagccccgcaactgtgagccgaaacggaatggtgtttatgtcatcctccatactggattggtctccaattctggagggctttcttaaaaaacggagccctcaagaggctgaaattctccgacagctttacactgaatcatttcccgatctatatcggttttgtatccaaaacctggagtataagatggaggtgctcgaagcttttgtgatcacccaatccatcaacatgttgcagggacttattcctctaaaggagcagggaggggaggtttctcaagctcatctgggtcgactcttcgtatttgcactcctatggtcggcaggcgcagcgctagaactggatgggcgacgccgactggagctttggctgagaagcagacccacgggaaccttggaacttcctcccccagccggacctggcgatacagcatttgactattacgtagcgcctgacgggacgtggacccactggaatactaggacccaggagtatttgtaccccagtgacaccacccctgaatatggatctatattagtccccaacgtggacaatgtgagaacagacttcctgatccagacgattgccaagcagggcaaagctgttctcttgatcggagagcaggggactgccaaaacagtgatcattaaagggtttatgtctaaatacgatcctgagtgccacatgatcaagtctctgaatttctcaagcgcaacaacccccctgatgttccagcggacaattgaatcctacgtggacaagagaatgggcacaacatatggccctccagcagggaaaaaaatgacagtgttcatcgatgatgtcaacatgcccataatcaacgaatggggggatcaggtaacaaacgagatcgtgaggcaacttatggagcagaatggattctacaatcttgagaagccaggcgagttcacctcgatagtcgacattcagttcttggccgcaatgatccatccaggaggcggacgcaacgatattccacagaggttaaagcgccagttttctatattcaattgcacactaccatctgaagcttccgtcgacaagatcttcggggtaatcggcgtgggacactactgcacccagagaggcttcagcgaagaagtcagggacagcgtgactaagctggtgccattaacccggaggctgtggcagatgacaaaaataaagatgctgcccaccccggctaaattccactacgtgtttaatctgagagacctcagtcgtgtgtggcagggaatgttgaatactacctccgaggtgataaaggaacctaatgacctgctgaaattatggaagcatgaatgcaagagggtcatcgccgaccgcttcactgtttcgagtgacgtgacctggttcgataaggcccttgtttctttggtcgaagaggaattcggggaggagaagaaactgctggtggactgtggcatagacacctactttgtcgacttcctccgtgacgcccctgaagccgcaggggagacttcagaggaggcggatgccgagactcctaagatctacgaaccaattgaaagtttctctcacctgaaggaaagactgaacatgttcctgcagctctacaacgagtctatacgaggggctggcatggacatggtgttctttgccgatgccatggtacacctggtcaagatcagcagggttattagaacacctcagggcaacgccctcctcgttggcgtcggcggtagtgggaaacaatctttgacccgcctcgccagctttatcgcaggatacgtgtctttccagatcacactgacacgcagctacaatacaagcaatcttatggaagacctcaaggttctctaccgaacagcaggtcaacaggggaagggaattacttttatcttcacagataacgagatcaaagacgagtcatttcttgaatatatgaacaatgtcctctccagcggagaggtgtccaacttgtttgctagagatgaaatagacgaaattaacagcgaccttgcctctgtgatgaagaaggagttccccagatgcctacctaccaatgaaaacttgcacgactactttatgagtagggtgcggcaaaatctccacattgtgctttgtttctctccagtgggcgaaaaatttcgcaatagggcattgaagtttcccgcactgatctccgggtgcacaatcgattggttctctcgatggcctaaagatgcgctggtagccgtatccgagcatttcctgacatcttatgacatcgactgtagcctggaaatcaaaaaggaggtcgtgcagtgcatggggtcatttcaggacggcgtggcagagaaatgtgtggactatttccagcgctttcggagatccactcacgtcacgccaaaatcatatctatcgtttatccaaggctataagttcatatatggtgagaaacatgtggaagtgaggacactggcgaatcgaatgaacacgggattggaaaaacttaaggaggcctctgaatccgtcgctgccctcagcaaggagttagaggccaaggagaaagagctgcaagtcgccaatgacaaagctgacatggtgctgaaggaggtgacgatgaaggcacaagccgcagagaaagtcaaagcagaggtccagaaagttaaagatcgagcccaggctatagtggattccatctctaaggacaaggctatagctgaggagaaactggaagcagccaagccagccttagaagaggccgaagcggcactgcagacaatcagacccagcgacatcgcaaccgtgaggacgctgggcaggcctccccatctcataatgcgcatcatggactgcgtcttgttgcttttccaacggaaggtttccgcagtcaagattgatttggagaagagttgtacgatgccatcgtggcaggagtccctgaagcttatgactgctggaaacttcttgcagaatctacagcagttcccgaaggataccatcaatgaggaggtcatcgagttcttgtcaccttacttcgagatgccggactacaatattgaaaccgctaagagggtgtgcggcaacgtggctggcttatgctcttggactaaagcgatggctagcttcttctcaatcaataaggaagttcttccactgaaggccaatttagttgtccaggaaaaccggcaccttttagctatgcaggacctgcaaaaggcacaggcagaattggatgataagcaagcggagctagatgtggtacaggccgaatacgagcaagcaatgacggaaaaacagacacttcttgaggatgccgagcgatgtaggcataagatgcagaccgcttccaccctaatctccggattggcgggagaaaaagagcgatggaccgaacagtctcaggagtttgccgcacagacaaaaagactcgttggggatgtactgctggccaccgcctttctgagttactccggcccattcaatcaggagtttagggatcttctgctaaacgactggaggaaggagatgaaagcgagaaagattccattcggtaagaatttgaacctgtccgagatgctcatcgacgctcccaccatcagcgaatggaatctacagggcctgcctaacgacgacttatcaatccaaaatggaattatcgtaaccaaggccagtcggtaccctctcctgattgatccacagactcaaggaaagatctggataaagaacaaagagagtcgaaacgagctgcagataacatccttaaaccataaatatttccggaatcacctcgaagactccttgagcctaggcagacccctgcttattgaggatgtcggtgaggagctggaccctgctctagacaatgtcctggaaaggaatttcatcaagacggggagcacctttaaagttaaagtgggtgataaggaggtcgatgttcttgacggatttcgtctatacatcacaaccaaactgccgaatccagcttacacgccagaaatctcagcccgaacctcgattatagacttcaccgtgacaatgaaagggctggaggaccagctgctgggtcgagttatcctgacggaaaaacaggagctcgagaaggagcgcactcatttgatggaagatgtgactgccaataagcgcagaatgaaagagctagaggataatctgctgtacaggctgacatctacccaagggtccctggtggaggatgagagcctgatagtggtgctctctaatactaagcgaactgcagaggaggtcactcagaagttggagataagcgccgagactgaagtgcagattaacagtgctcgagaggagtaccgccctgtcgctacccgtggcagtatcttgtattttttgataactgagatgcggctggtgaacgagatgtatcagacatcacttagacagtttctgggcttgttcgacctgtctctcgcccgttccgtaaagtccccaattactagtaagcgaatcgccaatattatcgaacacatgacttacgaggtctacaaatacgcagcaagaggcctgtacgaagagcataagttcctgttcaccttgctgctgacccttaaaatcgacatccagcgcaatcgtgtaaaacatgaagaattccttactcttatcaagggaggggcatctctggatcttaaagcatgtcccccaaaaccgtcgaagtggatcctggatattacatggcttaacttggtggaactgtcaaagctcaggcagttttcggacgttttggaccagatctcacggaatgaaaaaatgtggaaaatttggtttgacaaggagaacccggaggaggaaccgctccccaacgcatacgacaagtccctcgactgcttcaggagactgcttctcattcgcagttggtgccccgatcgaaccatcgcccaggccagaaagtacatcgtcgatagcatgggcgaaaagtacgccgaaggagtgattctggatctggagaaaacctgggaagagagcgatccaagaactccgcttatatgcctcctctccatgggaagtgatccgacggacagcatcattgcattgggtaagaggttaaaaatcgagactagatatgtgtccatgggccagggccaagaggtgcatgcacggaaactgcttcagcagaccatggctaacgggggatgggctttattgcagaattgccacctcggcctggatttcatggacgaactaatggatatcataattgagacggagctggtacatgacgccttcaggctgtggatgacaactgaagcacataagcagttccccatcactcttctccagatgagtataaagtttgccaatgatccaccccagggactccgggcagggctgaaacggacttactctggagtgtcccaggatctgctggacgtcagtagtgggtctcaatggaaacctatgttgtatgctgttgcttttctgcactctactgtgcaggagcggaggaagttcggggctctgggatggaatattccttatgagtttaaccaggccgacttcaatgccacagtgcaatttattcagaatcacctagatgatatggacgttaagaaaggagtgagttggactacaatccggtacatgattggagaaatccaatacggaggtcgcgtgaccgatgattacgacaagagacttctgaatacctttgctaaggtttggtttagcgaaaatatgttcggtcctgatttctctttttaccaggggtataatatcccaaaatgttctacagtggacaactatcttcagtacatccagagtctacctgcttatgattcccctgaggtgtttggcctccatccaaatgcagacattacgtaccagtccaagctggctaaagacgtgctggacaccatcctgggcatccagcccaaagacacttcgggagggggtgatgagacccgcgaggcggtggtggccaggttagccgacgacatgttagagaagctccctccagactacgtgcccttcgaagtgaaagagcgcttacaaaagatggggccatttcagccaatgaacattttcctgcgacaggagatagaccggatgcagcgcgtcctgtcgctggtccggagcaccctgacagagctgaaactcgccattgatggcacaattattatgagtgaaaatctgagagacgctctggattgtatgttcgatgccagaattccagcttggtggaagaaggcatcttggatcagttcaactctggggttctggttcactgaactcatcgaacgaaattcccagttcacatcatgggtgtttaatgggcgaccccactgtttctggatgaccggcttctttaacccgcaaggttttctcacagcaatgcgtcaagagatcacacgcgcaaataagggctgggcgttggacaatatggtgctctgcaatgaggtcactaaatggatgaaggacgatattagtgcacccccaacagagggtgtctatgtatacggtctgtacttagagggtgccggttgggataagaggaacatgaagctcatagaaagtaaacccaaagtgctgtttgagctaatgccagtgattaggatctacgcagaaaacaataccttgcgcgacccccgtttctacagttgccccatatacaagaagcccgtgcggaccgacctcaactacattgccgcagtagacctgagaacggcccaaacacctgagcattgggtgctgaggggagtggcgctattgtgtgacgtcaagtaa

SEQ ID NO: 221440 - DNA, 12477 bp, Artificial Sequence
  Description of Artificial Sequence: Synthetic coding sequence
atgacctttcgagccacagactccgagttcgatctcactaacatagaggaatatgccgaaaattccgcactaagcagattgaacaatatcaaggccaagcagcgtgtgtcctatgtcacatcaaccgagaacgaatcggatacacaaattctgactttcaggcacatcactaaagcacaggaaaagactaggaagcggcagcagcctataaagttggaacctctccccgtgttaaaggtatatcaggaccataaacagccagagtatattcacgaacaaaacaggtttcagcttatgaccgcgggaatcattaaacgccctgtgtccattgccaagaagagctttgctacttcctctactcagtttctggagcaccaggatgctgtcaagaagatgcagatccatcggccatatgtggaggtattttccccaagtccgccaaagctgccccataccggtattggtaaaaggggcctgttcggcacaagaagctcggcgtacccgaagtacacattccacgatcgcgaagaggtggtgaaggccaatatacgcgacccacttcaaatcataaaaataataagagaaaacgagcatttaggctttctttatatgattcctgccgtgccacggtcttctatagaatacgatacatacaatttgaaagtggtctcctatgaaaacatcaacaagaatgattattacaccatctctcagagggccgtcacccatatttacaatgaggatatcgagttcatcgagattgacagatgggaacaggaatacttatatcatcgggaacttactaaaatccctatctttagtctgtttcgaaaatggaaggccttctctgtctggcgaaagaacgttcggtcaaagaaaattactggctgccagaagagtttacaaaaaaatctcttcatagtcaacccacacctgaggcccgctcttcttaaaattaatgagctttgttaccacttgagctttatgggactctgctatattgaaaagtgtcatacctacactctccaggaatttaaggcagcccaggtgatcaggttggccgaagtaactgaacgcctgggcgaatttcgcaacgaggccaagtacgtggtgcggagggcttgccgctttgcactccgggctgctggattcgtccctgatgactgtgcatttggacccttcgaggactatcataaggtgcagagttccggtagcttcattaatacaccacatgagttgccgacttatggcgattccgaaaagatgacctacacagagcaagccagtaagcggcactactgcatgcgcctgacatgctttatccgactgaacgactatctgatcgagaacacgatgcatatcttaacagtaaacgctgtgaacagcctactcaaccaccttaccgacaaactgaaaagaaccccatccgccgatgtgattcagaaatggatcacagaggagaaacccgaggtgcctgataaaaaaggcactctgatggtcgagaaacaggaggaagacgagtcactaatcccaatgttcctgaccgaactgatgctcactgttcagtcactcctgtttgagccttctctagaagatttcctggatggtatccttggggcagtaaaccactgtcaaaatactgttctctcagtgccaaacctggtgccggacagttatttcgacgcatttaccagcccatatatcaataataagcttgagggaaagacctgcggcaccggtcccagtctcgctgcagtgttcgaggacgacaaaaattttcacaccataatctcccagattaaggagacaatccaggccgcttttgagtcagccaggatctatgccgcaacatttgagaaattccagatcttttttaaggagaatgagagcctggatctccaggctctaaagttgcaggagcctgacataaatttttttagtgagcagcttgaaaagtaccacaaacaacacaaagacgcggtcgctctcaggccaactagaaacgtgggactcctgctgatcgacaccaggctcctgagggaaaaactgattccaagcccactgcgatgtctagaggtgctaaattttatgctgcctcggcagtctaagaaaaaggtggatgctattatttttgaagcacaggatgccgagtacaaactggaatttgtgcccaccaccactaccgagtacgtgcattctcttctcttcttggatgaaattcaagagaggattgaatccctggaagacgaaggtaacatcgtgacccagatgtataagctgatggagcaatatcaggtacccaccccaccggaagacttcgccgtcttcgccaccatgaagccgagcatcgtggctgtgcggaatgctatagataagagcgtcggcgatcgcgaaagtagtattaagcagttttgtgtgcatctggggtctgacctggaggagcttaacaacgaagtgaacgaagtgaaactccaagcccaggatccccaaatactggacatcagcgcggatcaggataaaattcgcttaattctgaataacctgcagagcgtgctcgccgacctccaaaaacgcgcattccagtacaaaagctatcagaagaacttcaaggttgaggtgagcaagttcgaggcgctagaggaggtatccgccgagctcaaactcaaacagctgttatgggattcctttagcgagtgggataaactgcaacaggaatggctgaagtctaagtttgattgtcttgatcccgaagtgctgaacggacaggtctctaagtacgcgaaattcgtgacccaattggagaaggggctgccgcctaacagtgtcgtgccacagttaaaatacaaggtcgagaagatgaaggagaagctgccagtaatcattgacctacgaaatccaactctgaaggctagacattgggctgccattgaacagacggtcgacgccacattggtcgacgccgagatccctctgacactggaaaggttgtcccagctgcacgtgttcgatttcgggcaagaaatccaggacatctcgggccaggccagtggagaggccgcattggaggctattcttaaaaaggtggaggactcatggaagaccacggagtttgtgattctaccgcaccgcgatagcaaggacgtgttcatcctcggcggtactgacgatatccaagtgctgctggatgactccacgatcaatgtggctaccctggctagctccaggtaccttggacccctgaaaacacgggtcgacgaatggcaaaagcagctggccttatttaatcagactctggaagagtggttaacatgccagcgcaattggttatacctggagagcatatttaacgcacctgacatccagagacagctgcctgctgaagctaaaatgtttcttcaagtggataagtcttggaaagaaattatgagaaaggtgaatagactgcccaacgctctcagggctgctacccagccaggtctgctcgagacctttcaaaacaataacgccttgttggaccagatccagaagtgtctcgaggcctacctggagagcaagcgggtcatctttcctcggttctacttcctaagcaacgatgaactgctggagatcctggcccaaacacgcaacccacaggcagttcagcctcacttgcgaaagtgcttcgattcaatctccaagctggagttcgctttgatgcctccggctgagggaaaaattccaggaatcgatggagaaccagagaaagtatatactaatgacatcctggcgatgcttagtcctgagggcgaacgtgtttcactcgggaaggggttgaaggctcggggtaatgtcgaagagtggttagggaaggttgaagaagccatgttcacatcactcaggaggttgtgcaaggctgctattgccgactaccaaggcaagctcagaaccgactgggtggttgccggtcaccctagccaagtgattctcactgtttcccagataatgtggtgtagggatttaacagagtgtctggagacagagcatagtaatcatatccaagctctaaaaaatttcgaaaaagtgaactttgagaggctcaacgctcttgcagccattgttcaggggtccctgcctaaacttcataggaacattctgactgccctgatcactattgacgtacatgcccgagatatcgtaaccgagttggtacagagcaaggtggagaccgttgaatccttcgactggcagaggcaactgcggtactactgggatatagatctcgataattgcgttgccagaatggcactgagccagtacacatatgggtacgagtaccttggcgcatgcccccgtctggtgatcacccccctgacggatcggtgttacctttgtttgatgggcgcactccagctggatcttggcggtgcgccagcaggacctgccggtactgggaaaacggaaacgactaaagacctggccaaagctctcgccattcagtgtgtggtgtttaattgctctgatggactagattataaaatgatgggacgattcttttcaggtttggcgcagtccggcgcttggtgctgcttcgatgaatttaatcggatcgatatcgaggtgttaagtgtaatcgcgcagcagcttattaccattaggaacgccaaggctgctaaactgagcagatttatgtttgagggacgcgagatcaagttggttatgacatgtgcagcctttatcacaatgaatcctggttatgcgggtaggacagagctacctgataacctcaaagccctattcaggccattcgcaatgatggtgccaaactacgcccttatcgctgaagtcatactgtacagcgaggggttcgaatcctccaagattctcgcccgaaagatgactcagatgtataaactttgctctgagcagctaagccagcaagaccactatgatttcggcatgcgcgcagtgaaatccgttctggtgatggccggttctttgaaacgcgagaatccagacctcaatgaagatgtggtcctgattagggctctgcaggatagtaacctgcctaagttcttgactgatgacgctctgctgtttagcggcatcatttctgatttattcccgggagtacagattcccgagcacgactacggcatcctgcaaagcaccatagtcgacgtcatgaatcgacagaacctgcagcccgaaatgtgtatggttaggaaggttattcagttctatgagaccatgctcgtccgccatggcgtaatgctggttggcccaaccggcggaggaaaaactacggtttaccggatcttagccgagaccttgggcaatctgcagaagttgggtatcgagaacagtttctatcaggccgtgaagacgtacgtgttaaatcctaagtcaattaccatgggtgaactctacggcgaagtaaataacctcaccctcgaatggaaagatggtctcatggcgctgtccgtgagggccgcagtgaatgatacatccgaggatcacaagtggatcattagcgatggcccagtggacgccctgtggattgaaaatatgaatactgtactcgacgataacaaaatgctgtgcctcgccaactcagaaaggatcaagctgacacctcagattcatatgctgttcgaggtgcaggatctcagggtcgctagtccagccacagtgagcaggtgcgggatggtatttgtggacccagaggagctgaaatggatgccttacgtgaaaacatggatgaaggggatcagcaagaaactgacagaagagacccaggagtacatcctcaatctttttcagaggtatgtggacgaaggccttcacttcattaacaaaaaatgctctcaggcgataccacaggtagacatttctaaagtgacgacgctgtgttgcctactagagtccctgattctggggaaggacggggtcaatctcgccatggagcaaacaaagctaaacacaattctctgtcagacattcgtgttctgttatctgtggtccctggggggaaacctgactgagaactattacgattccttcgacacgtttatcaggacccagttcgacgataatccagacgcgcgactaccaaatagtggagacctgtggagcatccatatggactttgacaccaagaggctggacccatgggagcgcatcatccctactttcaagtataatcgcgacgtgccattctttgagatgctggtccctaccacggacaccgttaggtacggttacttaatggaaaagctactggccgtcaaacattctgtgctttttaccggcataactggggtgggcaaatctgttatcgccaaggggctgctcaataaaattcaggagagtgctggctacgtccctgtctacttgaatttcagcgcccagactagtagcgcccgtacgcaggagatcatcgagagcaaacttgagaggaaaagaaagaacattctgggggctccaggaaacaaaaggatcgtgatcttcgtcgacgacctcaacatgccccgactggatcgctacggcagtcagcctcccatcgagctactccgccagtaccaggacttcggagggttttatgaccggaataagttgttttggaaggagattcaggacgtcacaataatctccgcctgcgctcccccaggcggaggcaggaacccagtgacccctcgcttcatccggcacttctctatgctctgcctacccatgccatcagaacactccctgaagcagatttttcaggctatcttgaatgggttcttatcagacttccctcccgcagttaaacagacagcaagctccatcgtggaagcctcagttgagatttacaacaaaatgagcgtggatctgctgcctacaccagctaagagccattacgtgtttaacttaagggatctgtctaaatgtgtgcagggcatactgcagtgtgatcccggaacgatcagggaggagatccagatattccgcctgttttgtcatgagtgccaaagggtatttcatgatcggctcattaataacgaagacaaacactatttccacgtgatcctgacagagatggccaacaagcattttggcattgccatcgatctggagtacttcttgaacaaaccaatcatttttggtgattttattaagttcggagcagacaaggcagataggatctatgatgacatgccggatattgagaagaccgccaacgtcctacaggactatttggatgattataacttgacaaaccctaaggaggtgaagctggtgttctttcaggacgcgatagagcatgtgtccagaattgcccgaatgattcgacaggagagaggtaatgctctgctggttggcgtcggcggaactggtaaacagtccttaacacgtctggccgctcacatctgtggttacaaatgcctgcagattgaactttccagaggatacaactatgactctttccacgaggatctgagaaagctttataaaatggccggagttgaggacaaaaacatggtgtttctgttcaccgacactcagatagtggtggaggaatttctggaggacatcaataacatcctcaactcaggcgaagtaccgaatctgtttgaaaaggacgaactggaacaggtgcttgccgctacaaggccacgcgcaaaagaggttggtatttcggagggaaatcgtgatgaggtctttcagtattttattagcaaggtccggcagaaactgcatatcgtcttatgtatgtctccagttggggaggcgtttcgatctcgctgtaggatgttccctagccttgttaattgctgcacaatagactggttcgtgcagtggcctagggaagcgctgctcagcgtctcaaaaactttcttttcccaggtggacgccggtaacgaagagctcaaagagaagctgcctttaatgtgcgtgaacgtgcacctcagcgttagcagcatggctgagagatattacaatgagctcagaagaaggtactataccactccaacctcataccttgagctcatcaacctgtatttgagcatgctgtccgagaaacgtaagcaaataatcagtgcaagagaccgcgtgaagaacggtctgacaaaactgcttgagactaatatcctcgtcgacaagatgaaactagacttgtctgcacttgagcccgttctactggccaagagtgaagacgtggaggcactgatggaaaagctggccgtcgatcaggaaagcgctgatcaagtgcgcaacaccgtgcaagaggacgaggctaccgcgaaagtgaaggctgaggaaacacaagcaatcgctgacgacgctcagagagacctagacgaagccctgcctgcgctcgatgcggctaacaaggcattagactctctagataaggcagacatcagcgaaatccgggtgttcacaaagcctccagatttggtgatgacagttatggaggccatcagtatcttgctgaatgcaaaaccagattggccttctgccaaacagctgttgggtgactccaactttctgaaaaggctactggagtacgacaaagaaaacattaagccacagattctcgccaagctgcagaaatatatcaataaccctgatttcgtgcctgaaaaggtggagaaggtgtccaaggcatgtaaaagtatgtgtatgtgggtgagggcgatggatctttattccagagtagtcaaggtggtcgagccaaaacggcaaaagctgcgggcagcccaggctgaattggacattaccatggccacacttcgcgaaaagcaggccctactgcggcaggtcgaagaccagatacaggcccttcaagatgagtacgataaaggagtcaatgaaaaagagagtctagctaagactatggcacttactaaggcccgactggtgagagccggaaagttaacagcggctctggaggacgagcaagttcgctgggaggagtcgatccaaaaatttgaagaagagattagcaacattacaggaaatgtatttatcgctgccgcttgtgtggcttactacggggctttcacagcccaatatagacaatccctcatcgagtgctggatccaagattgccagagtctggaaatccccatcgacccttcgtttagcctgattaatatcctgggagacccctacgagattcgacagtggaacaccgacgggctacctcgcgatcttatctccacagaaaacggcatcctggtgactcagggcagacggtggccgttaatgatagaccctcaggaccaagctaacagatggatccgaaacaaggaatcaaaaagtgggctaaagattatcaaactgaccgactcaaatttcttacgcatcctcgaaaattcaatccgacttggtttgcctgtgctacttgaagaattgaaagaaacattagaccctgccttagagcccatccttctaaaacagattttcatttctgggggtcgtctactcattagactgggggactcagatatcgactacgacaaaaattttcgattttacatgacaaccaaaatgcccaacccccactacctgcctgaggtctgcatcaaggtgactataatcaactttactgtgactaagtctggactggaagatcagctgctgagcgatgtggtgagactggagaagcccagactggaagagcagagaatcaaacttattgtgcggatcaataccgataagaaccagttaaaaaccatagaggagaagatcctgaggatgctttttacatccgaggggaatatcttggacaacgaagagctgatcgatacattgcaggactctaagattacatctggcgcaattaaaaccaggttggaagaggcagaaagcactgagcagatgatcaacgtggcacgcgaaaaatatcgacctgtcgccacccagggatctgtgatgtacttcgtgattgctagccttagcgaaattgaccctatgtaccagtattctttgaaatactttaaacagctcttcaacactaccattgagacaagtgtaaagactgagaatcttcagcagcggctagatgttcttctggagcaaacactcttgacagcctacgtcaacgtttctcgtgggttattcgagcagcataagttgatttattcttttatgctttgtgtggaaatgatgcgtcaacagggtactctgagcgacgccgagtggaacttctttctgagagggtcggccggactcgagaaagagaggccacccaagcctgaagccccatggctgcctacagcaacctggtttgcctgctgtgacctcgaggagagtttccccgtcttccacggactgacacagaacattcttagtcaccctatttctatccgcctcggcagtttcgagacgtacattaatccacagaaatgggaagggtacagcaagatgaagcacgaggacaaacacatgcggcaagagaaagaagcggcacaccaggatccatggtccgcaggcctttcttcctttcacaaactgatcctgattaaatgctgcaaagaagaaaaagtggtgttcgctcttacggactttgtgatcgaaaacctgggcaagcagtttatcgaaacacctcctgttgaccttcctaccctgtaccaagatatgagctgtaacacaccgttggtattcatcttgtccaccggaagcgaccccatgggcgcatttcagagatttgccagagaaagcggctacagtgaacgcgtgcaatcaatttcacttgggcagggccagggcccaatcgctgagaagatggtgaaagatgcgatgaaaagtggaaactgggtttttctgcagaattgtcatttggcggtttcatggatgttagccatggaggaactaatcaaaacatttaccgatccggattcagccatcaaggatacattcaggttgtttctttcctcaatgccctctaatacattcccggtgaccgtcctgcaaaacagcgtgaaagtgactaacgaaccacccaaggggctgcgcgctaacatcaggagagcctttacggaaatgactcctagttttttcgaagagaacatccttggcaaaaagtggcggcagatcatcttcgggatttgcttcttccatgctattattcaggagcgcaaaaaattcggacccttaggttggaacatctgctatgagttcaatgactcggatcgggaatgcgccctcctgaacttgaagctgtactgtaaggaaggcaagatcccatgggacgctttgatttacatcaccggggaaattacttatgggggacgcgtgaccgatagctgggatcagaggtgcctgagaaccatactgaagcggttcttttcaccagagacactggaggaggattataagtattcagagagtggtatttattttgcaccgatggccgactcactgcaggaatttaaagattacattgaaaaccttccactcattgatgacccagaaatttttggcatgcacgagaatgccaacctagtgtttcagtacaaagagacctccactcttatcaacacaatcctcgaagtccagcctaggtcgagcacgggaggcgaagggaagtccaatgacgagattgtacaggagctggtggcctctgtacagacccgggtgcccgagaaactggagatggagggggcatctgaatccctcttcgtgaaagacttgcagggcaggctgaactcactcacaaccgtcttaggccaggaggtagaccggtttaataacctattaaaactaattcatacatctctggagacactgaacaaggcaatcgccggtttcgtcgtcatgagcgaggaaatggaaaaggtctacaactctttcctaaacaatcaggtacccgctctgtggagcaacacagcatacccttcactcaaacctctgggatcctgggtcaaggatcttatcctgcggacttctttcgtggatttgtggttgaaacggggtcagcctaagtcatactggatatccggctttttcttcccacagggcttcctgaccggaacccttcaaaatcatgccaggaaatataacctcccaatcgatgagctgtccttcaagtacagtgtgatcccaacctatcgagaccaggcggctgtgatagaggccgctaaaacggtccagtttgggcaggaactgccaatggacatggagttgcccagccccgaagatggggtgctagttcatgggatgttcatggatgcatcaagatgggacgataaagaaatggtaatagaggacgccctcccgggtcagatgaaccctgtactgccggtagtgcattttgaaccacagcaaaactataaaccgagccctaccctatatcattgtccactatacaaaactggtgcccgagctggtaccctatctacaacaggccattctaccaacttcgtggtcaccgtcctactcccctctaaacgatctaaggattactggatagcaaaggggtccgcacttttgtgtcagctgagcgagtac

SEQ ID NO: 221441 - DNA, 12477 bp, Artificial Sequence
  Description of Artificial Sequence: Synthetic coding sequence
atgactttcagagccacagacagcgagttcgatcttaccaatatcgaagagtatgcagagaactctgctttgtcacggctgaacaacatcaaggccaagcagagagtctcctatgtcacatccactgagaacgagtctgacacacaaatcttaacattccggcacatcaccaaggctcaagagaagaccagaaagagacagcagccaatcaagctcgagcctttaccggtgctgaaggtgtatcaggaccataagcagcctgaatatatccacgaacagaaccgctttcagttgatgaccgccggaattattaaacgccctgtttcgattgctaagaaatcatttgccaccagctcgacccagttccttgagcaccaagacgctgtcaagaagatgcagattcatcgtccctacgttgaggtgttttcaccatctccccctaagctgccccataccgggattggaaagaggggtctgttcggtacccgcagttcggcgtatccgaagtataccttccacgatagagaggaggtggtgaaagcaaacattagagaccctcttcagatcattaagatcatcagagaaaacgaacacctcggattcctgtatatgatacctgctgttcccaggagcagcatcgagtacgacacctataacctcaaggtcgtctcttatgaaaatataaataagaatgactattacaccataagccaaagagccgtaacccacatctataatgaagatatcgagttcatcgagatcgacaggtgggaacaggagtatctctaccaccgcgaactaaccaaaatcccaatcttttccctgtttaggaaatggaaggctttctctgtgtggcgcaagaatgtgcgtagcaagaagatcactggatgccaaaagtctttgcagaagaatctcttcatcgtcaatccgcatctgcgacctgctctgttaaaaatcaacgagctgtgttatcacttgagtttcatgggcctgtgctacatcgagaaatgtcacacatacaccctccaagaattcaaagccgctcaggtgatccgattggcggaagtgactgagcgtctcggggagttcagaaatgaagccaaatacgttgttagacgagcctgccgttttgcgcttagggccgctggtttcgtgcccgatgactgcgcttttggaccctttgaggattaccataaggtacagtccagtggcagcttcattaacactccacacgagttaccaacctacggggacagtgagaaaatgacgtacacagagcaggcttcaaaacgccactactgtatgcgtctcacttgttttatccgattgaacgactatctgattgagaacacgatgcacattctgacagtcaatgcggtaaattctcttctcaatcacttgacggataaacttaagcgaaccccatctgccgacgttattcaaaaatggattactgaagaaaagccggaggtcccggataagaagggcacgctgatggttgagaagcaggaagaagatgaatctcttatacccatgtttttaactgaactaatgttaaccgtgcagtcgctgctcttcgagcctagcctggaggattttctagatggaattttgggagccgtgaaccattgtcagaatactgtgctgtccgttcctaacctagtcccggatagttacttcgacgcattcacgtctccctacattaataataagctggaaggaaagacctgtggaaccgggccaagcctagccgctgttttcgaagatgataagaacttccatacaataatcagtcagatcaaggaaaccattcaggctgcatttgagagcgcccgaatctatgccgctaccttcgagaagttccaaatctttttcaaagagaacgagtctttggatctgcaggcccttaaacttcaagaaccagacatcaatttcttctcggaacagctggagaaatatcataagcaacacaaggatgcagttgctctgaggccgactcggaatgtcggcctgctgctcatcgatactagactcctgagggaaaaactcatcccttcgccgctgagatgtcttgaggtgcttaattttatgctgccaagacagtccaaaaagaaggtagatgccattatctttgaggcccaagacgcagagtataaacttgagtttgtccctaccacgaccaccgagtacgtacattctctgctctttctggatgaaatccaggagcggattgagtcactggaagacgaggggaatattgtgacgcagatgtataaattgatggagcagtatcaagttccaactcctcctgaggacttcgcagtattcgccactatgaagcccagcatcgttgctgtgcgtaatgcaattgataagtctgtgggagatagagagtcctctataaaacaattctgtgtccacttgggatctgacctcgaagagcttaacaacgaagttaatgaagtaaagttacaagcacaggacccacaaattctagacatttccgctgaccaggataagatccggctcatcctgaataacctacaatccgtgttggctgacttgcaaaaacgggcattccagtataaatcctatcagaagaatttcaaggtggaagtttcaaagtttgaggcattagaggaggtcagcgcagaactaaaactcaagcaactcctatgggattccttctctgagtgggacaaactgcaacaagagtggttgaaatcaaagtttgactgcctggacccggaggtactgaacggccaggtgtctaagtacgcgaagttcgttacccagctcgagaagggcctccccccaaacagcgtggtcccgcagctgaaatataaggtagagaaaatgaaggagaagctgccagtcatcatcgacttgcggaatcccactctaaaggctcgccactgggccgctattgagcagaccgttgatgcgactctggtagacgcagagatccccctgacactcgagcggctgagccagctgcatgtgtttgatttcggacaggagattcaggatatctctggccaggccagtggcgaagctgcgctagaggcgatcctgaagaaggttgaggacagttggaagacgactgaatttgtgattctgcctcaccgtgatagtaaagacgtattcattctggggggaaccgacgacatccaggtgctattggatgatagcaccataaatgtcgccaccctggcaagctcaagatacctcggcccattaaagacccgagtggatgagtggcagaagcaactcgctctattcaaccagaccctggaggagtggctgacttgccagagaaactggctgtacctggaatcaatattcaacgcacctgacatccaacgacagcttccggcagaagctaagatgtttctgcaggttgacaagtcttggaaggagatcatgaggaaggtcaaccggctgcccaatgctctccgggcagctacacaaccagggctgcttgaaactttccagaacaataacgctttactggatcaaatccaaaaatgcctcgaagcatatctggagtccaagagggtgatctttcccagattttacttcctttcgaacgacgagctacttgagattctcgcccaaacccgcaatccccaggccgtacagccacacttgagaaagtgtttcgacagcatctccaagctggagttcgctttaatgcccccagccgaaggtaaaatcccaggcatcgatggcgagcctgaaaaagtgtacacaaatgacatccttgccatgctctccccggagggagagcgtgtgtcgctgggaaagggtctgaaagcacggggtaacgtcgaggagtggctcgggaaagtggaggaagccatgttcactagcctgcggcgtctctgcaaggcagctatcgctgactaccagggtaaactgaggacagactgggtagttgctggccatccttcccaggtcattctgactgttagccagataatgtggtgtagagatcttacagagtgcctggagactgaacacagcaatcacattcaggccctaaaaaacttcgagaaagtgaactttgagaggctgaatgcattggccgcaatcgttcagggtagcctgcctaaattgcaccgcaacattcttacggccctgatcaccatcgacgtgcacgccagagacatagtgacagagttagttcagtctaaggtggaaaccgttgaaagtttcgattggcagcgtcaactcaggtattactgggacattgaccttgataattgtgtggctcggatggccctctcacaatacacttacgggtacgaatatttgggggcttgtccgagactggtgattacacctctcacagaccgatgctacctgtgcctaatgggcgcactgcagctcgacctggggggagccccagccggacccgctggcacaggcaaaactgagaccactaaagacctggccaaggcgcttgctatacagtgcgttgtgtttaattgctctgatggactcgactataagatgatgggacgatttttctctggcttagctcagtctggcgcttggtgctgttttgatgaattcaacagaattgacatcgaggtccttagcgtcatcgcccaacagctaatcacaatccgtaacgcaaaggccgcaaaactgagcagattcatgttcgagggtcgcgagatcaagctcgtgatgacttgtgcagcgttcataacaatgaaccccggatacgccggacgcaccgaactgcccgataacctaaaagctctcttcaggccctttgccatgatggtgccaaattatgctctgatcgcagaagtgatactgtacagcgaaggctttgagagctcgaaaatactggcgagaaagatgactcaaatgtacaagctgtgctccgaacagcttagtcagcaggaccactatgatttcggtatgcgcgcagtgaagtccgtgctggtgatggccggatctctcaagagggagaatcccgacttaaatgaagatgtcgttctgatcagggcactgcaagattctaacttacctaagttcctgaccgacgacgccctcttattttccgggatcatcagtgatctttttcccggtgtccagatcccagagcacgactacggtattttgcaatctactattgtggacgtgatgaaccgccaaaatcttcagccagagatgtgtatggtacgtaaagtcatacaattctatgaaaccatgctggtgagacatggtgttatgctggtcggcccaactggcggtggtaagaccaccgtgtacagaattttggcagagacactaggcaatcttcagaaactgggaatcgagaattccttctatcaagccgtgaagacttacgtcctaaacccgaagtcaatcaccatgggcgaactgtacggcgaagtaaacaatctgaccctggaatggaaagacggactaatggccctgtctgtgagagctgctgtcaatgacacatctgaggatcataagtggataattagtgatggccctgtagatgccctctggattgaaaacatgaacaccgttctcgacgacaataaaatgctgtgcctagccaattccgaaagaataaaactcacaccacagattcatatgctttttgaagtgcaagaccttcgcgtcgcctccccagccaccgtgagccgatgtggtatggtctttgtcgatcctgaagaactgaagtggatgccgtacgtgaagacttggatgaagggcatctcgaagaaattaaccgaagagacccaggaatatattcttaatctgttccagcgatacgtggacgaaggacttcactttatcaacaaaaaatgttcacaagcgatcccacaggtggatatctccaaggttaccacactgtgctgtttgcttgagagcctcattctgggaaaagacggcgtcaacctggctatggagcagaccaaactgaatacaatactgtgtcaaacattcgtgttctgctacttatggagtctggggggtaatctgaccgagaactactatgacagctttgatacattcattcggacacaattcgacgataaccccgacgcccgactgcccaactcaggggacctgtggtcgattcacatggactttgacacgaagcgactggacccttgggaacggatcatcccaacctttaagtacaatcgtgacgtgcctttcttcgagatgctggttcccacaaccgataccgttcgctatggttatctcatggagaaactgctggccgttaaacactcggtgttgtttactgggattacgggggtgggaaagtctgtcatcgccaaaggactcctgaataaaattcaggagtctgccggatatgtccctgtatatctgaatttctcggcacagactagcagcgccaggacacaagaaattattgagtccaaactagaacggaaaagaaaaaacatcctcggagccccaggaaataaaaggatagtgatattcgtagacgatctgaatatgccccgtctcgataggtacgggagccagcctcctatcgaactactgcggcagtaccaggactttggtggcttttacgacaggaacaaactgttttggaaagaaatccaggatgtcaccatcatcagtgcctgtgccccacccggtggaggccgaaaccctgtgactccgagatttatcaggcacttctcaatgctgtgccttcctatgcccagcgagcactccctgaaacagatcttccaggcaatcctgaacgggttcttgtctgatttcccacctgcagtgaaacagaccgcctctagtattgtggaagcttccgtcgagatttacaacaagatgtctgttgatctcctccctaccccagccaagtcccattatgtgttcaatctccgagatctgtctaagtgtgtgcagggcatcctccaatgtgatccaggtaccatcagggaggaaatacagatctttaggctgttctgccacgaatgccaaagggtgttccacgacagactgattaataatgaagataagcactattttcatgttattctcacagagatggccaataagcacttcgggattgccattgatcttgagtattttctgaataaaccaattatattcggggacttcatcaagtttggcgcagacaaagccgaccgcatctacgacgatatgcccgacattgaaaaaaccgccaatgtgctacaagactacctcgacgactacaatctgaccaaccccaaggaggtgaagctcgtattttttcaagatgctatcgagcacgtgtctaggatagcacggatgattcggcaagaaaggggcaacgcactgctggtgggcgtgggaggcaccggcaagcaatccttaacccgtttggctgctcacatctgcggctacaagtgcctgcaaatcgaacttagtcgcggatacaactacgactcctttcatgaggacctacgcaagctgtataagatggcaggggtcgaggataagaatatggtatttctcttcactgacactcagatcgttgtggaagagtttctggaagatataaacaacatactgaactcaggagaagtacccaatttattcgagaaggacgaattggagcaggtgctggctgcgacacgcccacgcgctaaggaggtggggattagcgagggcaaccgcgatgaagtatttcaatactttatcagcaaagtgcgccagaagttgcatatcgtgttatgtatgagtcccgtgggcgaagcctttcgaagcaggtgcaggatgttcccctccctggtgaattgctgtactatcgattggtttgtacagtggccacgcgaagctcttctctctgtgagtaagacctttttcagccaggtggacgcgggaaatgaggaattgaaggagaaactaccgctgatgtgtgtgaatgtgcacctgtctgtgtcttccatggctgaacgatattacaatgaactgcggaggagatattacacaactcccacgagctaccttgaattgattaatctgtacctgagtatgctgagcgagaagagaaagcagatcattagtgcgagagaccgggtgaagaacggacttacaaagttactcgaaaccaacattctggtagacaaaatgaagctcgacctgtccgccctggagcccgtattgctcgcaaaaagtgaagacgtggaggctttgatggaaaagctggcagttgaccaggaaagtgccgatcaggtgcgaaataccgtgcaggaagatgaagcgacagccaaggtgaaggctgaggaaacgcaggctatagctgacgatgcccagagagatttagacgaggccctgccagctctcgatgcagcaaacaaagcactggactcccttgacaaggctgacatctcagagatccgagtctttacaaaacctcctgatctcgtaatgactgtcatggaagctatatctattctcttaaacgctaaaccagattggcccagcgcaaagcagctgctgggtgactccaactttttgaaacgcctgctcgagtacgataaagaaaacattaaaccacagatcctggccaagctgcaaaagtacatcaacaaccctgacttcgtgcccgaaaaagtggaaaaggtttccaaagcgtgcaagtccatgtgtatgtgggttagggcaatggacttatactctcgggttgtcaaagtggttgagcccaaaaggcagaaactcagggctgctcaagctgagctcgatatcaccatggccaccctccgggaaaaacaggcactgttgagacaggtcgaggaccagattcaggccctgcaggacgaatatgataagggggtgaatgaaaaggagtctcttgcaaaaacaatggctctcacaaaggcaagacttgtcagagccggtaagttaacagctgctttagaggatgagcaggtgcggtgggaagagtccatacagaagttcgaggaagagatttcgaacattacaggtaacgtattcatcgctgcagcctgcgtcgcctactacggagcttttaccgctcagtataggcagagtcttatagagtgttggatacaggattgccaatcgttggagatacctatcgaccccagtttctcattaattaacattctgggtgacccctacgagatccgccagtggaatactgatggcctgcctcgcgatctgatctctaccgagaatggcatactcgtgacccagggacgcagatggcccctgatgatagatcctcaggaccaggccaaccgttggatccgaaacaaggaaagcaagtccggtcttaaaattattaagctgacggatagtaactttcttcgtattctagaaaactctatccgactaggcctccctgttttgctggaagagctgaaggaaaccctggaccccgcattggaacctatactcctcaagcagatatttatcagcggcggacgattgttaatcagactgggcgacagcgatatcgactatgacaaaaactttaggttctacatgacaactaagatgcctaatccccactaccttcccgaagtgtgcatcaaagttactattatcaacttcaccgtgacaaaatcagggctcgaggaccagctattgtctgacgtggtgcggctcgaaaagcctaggctggaagaacagaggatcaaattaatcgtccggattaatactgataagaatcagttgaaaacgattgaagagaagattttgcggatgttgtttacgtctgagggcaatatcctcgacaatgaagaattaatcgacaccctccaggacagcaaaattactagtggggctatcaaaacccggctcgaagaagcggagagtacagaacagatgataaacgtcgcacgtgaaaagtaccggcctgtcgccacgcagggcagtgtgatgtactttgtgatcgcatcactctccgagatcgacccgatgtaccagtacagcttgaagtatttcaagcagctgttcaataccacgatcgaaacctcggtcaaaactgaaaatctgcaacagcggctggacgtccttctcgagcagacattattgactgcctacgttaatgtctctcgcggtttattcgagcagcataagctgatctacagctttatgctttgcgtagagatgatgaggcaacagggcactctctctgacgccgagtggaactttttcctgcggggatccgcaggcctcgagaaggaacggcctcctaagccagaagccccttggctgccaaccgcaacttggttcgcttgttgcgatctggaggaaagtttccctgtgttccacgggctgactcaaaacatcctgagccatcccatctccatccgccttgggagttttgaaacgtatatcaacccacagaaatgggaggggtatagcaagatgaagcacgaggacaaacacatgcggcaggagaaggaggccgctcaccaggatccatggtccgccggtttgtcctcgttccataaactcatcttgataaagtgctgtaaagaggaaaaagtggtgtttgcactaaccgattttgtgatcgaaaatctcgggaaacaatttattgagacaccgccagttgacctgcccacactgtaccaggacatgagttgtaacactcctttagttttcatcttgtcaacgggctctgatcccatgggtgcgttccagaggttcgcgagggaatccgggtatagcgagagagtgcagagcattagcctaggtcaaggacaggggccaattgccgagaaaatggttaaagacgccatgaagtctggtaactgggtctttctgcagaactgtcacctagcagtgagctggatgctagctatggaggaactgattaagaccttcacagatcctgattcggcgatcaaggacacctttagactgttcctttcctccatgccctccaacacgtttccagtgaccgttctacagaattctgtgaaggtcaccaacgaacctcccaaggggctgcgggcaaacatccgccgagctttcaccgaaatgacacccagcttctttgaggaaaatatattggggaagaagtggcggcagattatttttgggatttgcttcttccatgcgatcatccaggagaggaagaaatttggcccattgggctggaatatctgctatgaattcaatgactctgatcgcgagtgcgccctgctaaacctcaaactgtactgtaaagaaggaaagataccttgggacgctctcatctacataactggcgagattacttacggtgggcgtgttactgacagctgggaccagaggtgcctgcgcactatactgaagcgtttcttctcccctgagacacttgaggaggattacaagtacagcgagtcgggcatttacttcgctcccatggccgacagtctgcaggaatttaaagattatattgagaatctaccactcattgatgacccggagatttttgggatgcacgagaatgcgaacttagttttccaatataaggagacgtcaactctgataaacacgattcttgaagtacaaccacggagctcaacagggggtgaagggaagagcaacgacgagattgtacaagaacttgtggcatccgtgcagactagggtgcctgagaagttagagatggagggtgccagtgagtctctattcgtgaaagacctccagggcagactgaactcattgaccacagtgctcggccaggaggtagatcggttcaataacctgctcaagttgatccacaccagcctcgaaactttgaataaggccatcgctggcttcgtagtgatgtcagaagagatggaaaaggtgtataatagcttcctgaataaccaggttcccgctctgtggtcaaacacagcctaccccagcctgaagccgctgggatcgtgggtgaaggacttaattttaaggactagctttgtggacctgtggttaaaacggggacagcccaagtcctattggataagcggctttttttttccgcagggttttctaactgggactcttcagaaccacgctcggaaatataacctcccaattgacgagctcagtttcaagtattccgtcatccccacgtacagagatcaggctgctgtaatcgaagcagcgaagaccgtgcagtttggccaggagctaccaatggatatggaacttccaagcccggaggatggagtgctcgtgcatggcatgttcatggacgcaagcaggtgggatgataaggagatggtcatcgaggacgctcttccagggcagatgaatccggtcctgcctgtggtgcactttgagccgcagcagaactataagccttcccccacactctatcattgtcccctgtacaaaaccggagccagagcgggaaccctgtctaccaccggccacagtaccaacttcgtggtgactgtcctgctgccatctaagaggtctaaggattattggatagcgaagggctccgcactgctttgccagttgagcgagtaa

SEQ ID NO: 221442 - DNA, 7592 bp, Artificial Sequence
  Description of Artificial Sequence: Synthetic coding sequence
atgacctttagggcaaccgactccgagttcgatctgaccaacatcgaggaatacgcagagaattctgcccttagccggctcaacaacatcaaagccaagcagagagtgagctacgtgacgtctaccgagaacgagtccgacacccaaatacttacatttaggcatatcactaaggcccaggaaaagactaggaagcgacagcaacccatcaaactggagcccctgcccgtgttgaaagtgtatcaggaccataagcaaccagagtatatccatgagcagaatcgatttcagctgatgacagcgggaataatcaaaaggcctgtgagcattgccaagaaaagcttcgcgacgtcaagcacacaattcttggagcatcaggatgctgtaaaaaaaatgcaaatccatcgcccttatgtggaggtgttcagcccctccccaccaaagttgccccatacagggatcggaaaaagagggctcttcggtaccaggtcaagtgcttatcccaagtacaccttccacgatcgggaggaagtggtcaaggccaacatccgggatcctctacagatcattaagattataagagagaacgagcatcttggctttctctatatgatccccgcagtgccaaggtcttccatcgaatacgatacctataacctgaaggtggtcagctatgaaaacataaacaagaatgattattacacaatcagccagagggctgtgacccatatatataacgaagacatagagttcattgaaatcgacagatgggaacaggagtacctataccatagagaactgacaaagatccccatcttcagtttatttcgcaaatggaaggctttcagtgtctggaggaaaaacgtgaggtccaagaagatcaccggatgccagaagtccctccagaagaacctttttatcgtgaacccacaccttcggccagcacttttgaaaatcaacgaattgtgttatcacctatcgttcatgggcctttgctatatcgaaaagtgccacacctacacgctacaggaattcaaggccgctcaggtcatccggctcgctgaagttacagagcggcttggtgaattccgcaacgaggccaaatatgtggttaggagagcatgtagattcgctcttagggcagctggattcgtgccagacgattgtgcgttcggccctttcgaggactaccataaggttcagagcagcggcagctttatcaacaccccacatgaattgccaacctatggtgacagcgaaaagatgacatatactgaacaggcgtctaagcgacattactgcatgaggcttacatgtttcatccggctcaacgattatctgattgagaatactatgcacattctgaccgtgaacgcggtgaactccctgctcaatcatttgaccgacaagttaaagcggacaccctcagccgatgtgatacaaaaatggattactgaagagaaaccagaagtccccgataaaaaaggcacactcatggtcgaaaaacaggaggaggacgagtcacttattcctatgtttttaacagagctgatgttgaccgtacagagtctgttattcgaaccatccttggaggactttttggacgggatcctgggggctgtgaatcactgccaaaacacggttctgtccgtcccaaatctggttcctgatagctatttcgacgcattcacatccccatatattaataataagttggagggcaaaacgtgcgggaccggcccttccttggccgcagtttttgaagatgacaagaattttcacaccattatttcccaaataaaagaaactatacaggctgctttcgagtctgctcgaatctatgccgctacgtttgagaagtttcagatttttttcaaagagaacgagtctctcgatctgcaggccctgaagttgcaggagcctgatatcaactttttctccgaacagttagaaaagtaccacaagcaacacaaagacgctgtggccctgagacccacccgtaacgtgggtcttctcctcatagacaccagattgctccgcgaaaaactgatcccttccccactccgatgcttggaggtgctgaactttatgttgccacgacagtccaagaaaaaagtggacgccattatttttgaagctcaagacgccgaatataagttggagttcgtgcccacgacaacaaccgagtacgtgcacagcctgttgtttctggacgaaattcaggaaagaattgagtcgctggaagacgagggaaatatcgtcactcaaatgtataagctgatggaacagtaccaggtccctacacctccggaggattttgcagtctttgctacaatgaagccctctatcgtggcagtgcggaacgctattgataaaagcgtgggagaccgggagagttctatcaaacagttctgtgtacacctgggctcagatttggaggagcttaataatgaagtcaacgaggtcaaactgcaggcccaggatcctcagattctggatattagtgcggaccaggacaagatcaggctgattttaaacaatctgcagtctgtgctggccgacttacaaaaaagagcattccagtacaaaagctatcagaaaaacttcaaagtggaggtgagcaagttcgaggcgctggaagaagtgtctgctgagctgaagctgaaacaactactctgggactctttttccgagtgggacaaactgcaacaagaatggttgaaatctaagtttgactgcctagaccctgaggtcctcaatggccaggtgtcaaagtacgccaagtttgtgacacagctcgagaagggcttgccccctaactcagtggtgccacagctcaaatacaaagtcgagaaaatgaaagaaaagctgccagtgattatcgacttacgcaatcccactttgaaggcgcgacactgggcagccatcgaacaaacagttgatgcgacactggtggacgctgaaataccattgacactcgagcgactaagccagttacatgtctttgacttcggccaggaaatacaggacatttcagggcaggctagtggcgaagctgccctggaggccatcctgaagaaagttgaggatagttggaaaactactgaatttgtcatcctgcctcaccgggattccaaggacgtgtttatcctcggtggcacggacgatatccaggtgctgctggacgactcaactatcaacgtagcaacattagcctctagtagatatctcgggccactgaaaacccgagtagatgaatggcagaaacaattagctttgtttaatcaaactcttgaggagtggctgacatgccaacggaattggctgtacctggagtcgatctttaatgctcccgacattcagagacaactgccggctgaagcgaagatgtttctgcaggtcgacaagagctggaaagagatcatgaggaaagttaatcgcctgccaaacgccctgagagctgccacccagccagggcttctagagactttccagaacaataatgctctgctggatcaaattcagaaatgcttagaggcttatttagagagcaaacgcgtgattttccctagattttacttccttagcaacgacgagctccttgaaattctggcccaaactcgtaatcctcaggctgtacagcctcatctgcggaagtgcttcgattcgatatcaaaattggaatttgccttaatgcccccagccgagggcaagatccccggaatcgacggagaaccagagaaagtgtacactaatgacatcctcgctatgctgtccccagaaggcgagagagtgtctctggggaaaggcttgaaagcccgaggcaacgtggaagaatggcttggcaaagtcgaggaagctatgttcacatccctgcggaggctgtgcaaagccgcaatcgccgactatcaaggcaaactccggaccgattgggtggtcgcgggacacccaagccaagtgatcctcaccgtctcgcagatcatgtggtgcagagatttaacagagtgcctggagaccgagcacagcaatcatattcaggcccttaagaattttgagaaggtgaattttgagaggctgaacgccctggccgctattgtgcagggttccttaccgaagctgcaccgcaacatcttgacagccttaattacgattgatgtccatgctcgggatatcgtgacggagctcgtgcagagcaaggtggaaactgttgaaagcttcgactggcaacgccaactgaggtattactgggatattgacctcgacaattgtgtcgcaagaatggctctttctcagtatacgtatggatacgaatacctgggtgcttgcccacgtcttgtaattactcctctcacagataggtgctacttatgcctaatgggggcactgcaactcgatctgggaggcgctccagctggtcccgcaggaacaggaaaaacagagaccacaaaggacttagcaaaagctctggctatccagtgcgttgtgttcaactgcagcgacgggctggattataaaatgatgggcaggttctttagcgggcttgcccagtcgggcgcatggtgttgcttcgatgagttcaatcgcattgatatcgaagtgctgagcgtaatagctcaacagttaatcacgattaggaatgctaaggctgccaagctatctaggttcatgtttgagggaagggagattaaactcgtgatgacgtgtgctgccttcatcacgatgaatccagggtacgccggaaggactgagctcccagataacctgaaagctttattcagaccatttgccatgatggtgcccaactacgcactgatcgccgaagtgatcctttacagcgagggtttcgaatccagcaaaatcttggcaagaaagatgacgcagatgtacaagttgtgttctgaacaactctcccagcaggaccactatgatttcggcatgagagccgtgaaatctgtccttgtcatggccggatctctgaaaagagagaacccagatctaaacgaggatgtggttcttatcagggcactgcaggatagcaatcttcctaagttccttacggatgacgcgcttctgtttagcggcattatttcggacctgtttccgggtgtacagattccagagcatgactacgggatcctgcagtcgaccatagtggatgtgatgaaccgccagaacctacaacccgaaatgtgcatggtgagaaaagtgatacagttttacgaaacgatgctggtccgacacggcgtaatgctggtcggccctacaggcggaggaaaaacaactgtttaccggatcttagctgagactttaggaaacctacaaaagctgggaatcgagaatagtttctatcaggcagtgaaaacgtacgtgctcaaccctaaatcgattacaatgggcgagctgtatggagaggtgaacaatctcacactcgaatggaaagacgggctgatggcgcttagcgtgagagccgctgtgaacgatactagtgaagatcacaagtggatcatcagtgacggaccagtagacgccttgtggatcgagaatatgaacacagtactggacgataataaaatgctgtgcctggcgaacagtgagcggataaagctgacacctcagatacatatgctattcgaagttcaagacctgagggtggctagtcctgcaaccgtgagcagatgtggcatggtatttgtggaccccgaagagttaaaatggatgccctatgtcaagacgtggatgaaaggcatatcgaaaaaattgaccgaagaaacacaagaatacatcctaaatctgttccagcgttatgtcgacgagggtttacatttcattaacaagaagtgctcacaggccattcctcaggtggatatcagcaaagtgacaaccttgtgttgcctgctcgagtctctgatcctcggaaaagatggggttaacttagccatggaacagaccaagctgaacacaattctgtgtcagacctttgtgttctgttacttgtggagtctggggggtaacctgaccgaaaactactatgacagcttcgacactttcatccgcacacagttcgatgacaatccagacgctcgcttgcctaattctggtgacctctggtcgattcacatggatttcgatacgaagaggttggacccgtgggaacgaatcatacctacttttaaatataaccgagatgtccctttcttcgagatgttggtacctaccacagataccgtgcgatatggctatctgatggagaagctcttggccgtcaaacattcagtgctgttcactgggattacgggagttggaaagagcgtcatagccaagggactcctcaacaagattcaggagtccgccggatacgtgcccgtctatctcaacttctctgcacaaactagtagtgctcgtacacaggaaattatcgagtcgaagttagaacgaaaaaggaaaaatattctgggagcgcctggcaacaaacgcatcgtgatatttgtggacgacctgaatatgccaagactggaccgctacggctctcagccaccaatcgagctgttacgtcagtatcaagattttggagggttttatgacagaaataagctgttctggaaagaaatccaggacgtaaccatcatttcagcctgcgcgccacccggagggggtcgcaatcctgtgactccaagattcatcagacatttctctatgctctgcctcccaatgccttctgagcacagcctcaaacagattttccaggcgatactgaacgggtttcttagtgacttccccccagccgttaaacagacagcgagcagcatcgtggaggcttcagtggaaatatataacaagatgtcagttgacctgttgccaacacccgctaagtctcactacgtcttcaatctgagagacctctctaaatgcgttcaagacaaacactttggcatagccattgacctcgagtactttcttaacaagccaataatctttggtgatttcattaagtttggagccgataaagccgaccgcatttatgatgatatgcccgatattgaaaagacggccaacgttttgcaggactatctggatgactataatttaacaaatccaaaggaggtgaagctggttttcttccaggatgcaattgaacacgttagccgcattgcacgcatgatccgccaagagagaggtaatgccctcctcgtcggcgttgggggaacaggcaaacaatctcttactagactcgcagcccacatttgtggatataagtgtctgcagatcgagctgtcaagagggtataattatgactctttccatgaggatttacgaaaactgtataaaatggccggagttgaggataagaacatggtgttcctctttacagacactcaaatagtagtggaagagttcctggaggacattaacaacatcctcaactcaggggaagtaccaaacctgttcgaaaaagatgaacttgagcaagttttggccgcaacgagaccgcgtgcaaaggaagtgggtatctcagaggggaatcgggatgaggtggggtgtgcccgagttgttatgtggctctaccacaagaacgtctctagccccttcattta

SEQ ID NO: 221443 - DNA, 14088 bp, Artificial Sequence
  Description of Artificial Sequence: Synthetic coding sequence
ggggctgaggcccctccatccactgaggaagctgcacctccacggtccgaggaggaagaggctccgcgaccgccaacagtggaggcgcctgccgaagacggcttcagtccctctgcagaggatgctgtgagcagcgttgtggactatcgggacctgatcccttccgaggagggcatcgtcttgccagatgatcatgaggctgatctgaatagagtccgccagcggcttgcgccaaggcccgtccagtctgtcatcagtgaagtgctgagtctcccaagctcacgaaggtcatccaggtatcggagaagcatgtccgggttacccaacctccaagagaccctgaaagaacgtcaggccaggtttcgcgaagcgagagagtctaggcgcctcaaaattgacccctcctacaagtacatatttgagatcttagctgaaaaccttggtctggatattgtgacagtggaagaactcatccttgactgtcccagtttggaggcgtttaccaactttttcgccaaggacgggtgcaaaaccctaaagttcctctaccaggagggggatgtaccaggcattgagtgcggccgaacgatagctggtgccactaaaggggcaaagatgatgaagttgtacatcgacaatgccgctccagataaactcaagggactgtgcatcttcttcgtgcgttgccgaaatgacgttgccattaacgtgaagaccatccaggaagaagctctttttacggtccttgacgcatctaaaggtctactcaatggcatccgtgatatgttggctaacattttcctccccgcagtgctggccactaataattggggagccttaaatcagtccaaacagggggagtcagagaagcacatattcaccgagaccatcaacaggtacctgtccttcctggacggcgcacggatttctattgaggggaccgttaaattgaagacaatcgataacgtcaacttttcaaagctgcacacattcgaagaggttactgcggctgcttctaatagcgaaactgtgcatcagttagaggaggtgcttatggtttggtacaagcagatcgagcaagtgctcatcgagtcagaacagatgaggaaagaggcaggcgattccggtcccctgacggaactcgaacactggaagcgaatgtcagccaagttcaactacatcatagaacaaatcaaagggccttcctgcaaagctgtcattaacgtgctcaacgttgcccattcgaagctccttaagaactggagggatctagatgctcggatcacagataccgcaaacgagagcaaggacaacgtgcgttacctttacactcttgaaaaagtctgtcagcctctgtataaccacgatctggtgtctatggctcatggcatccagaatctgataaacgccatccgcatgatccacggagttagcagatattataacaccagcgagagaatgaccagtctgttcataaaagtcacgaatcaaatggtcacggcttgtaaagcgtacatcaccgacgggggactaaaccatgtgtgggatcaggagacaccagtggtgcttaaaaagatccaggattgtatctttctgtttaaagaatatcaggcttctttccataagacgcgcaagcttatcagcgagagctccggagagaaatcgtttgaggtgtcagagatgtacatcttcgggaaattcgaggccttctgcaagagacttgagaagataaccgagatgatcaccgtggttcaaacgtattctaccttatcaaactccactattgaaggaatcgatatcatggccattaaatttcgtaacatatatcagggcgtgaagaaaaagcagtacgacatccttgatccacgcagaactgagttcgatacagatttcctggactttatgacgaagattaacggcttggaagtacagattcaggcatttatgaattcctcattcggaaagatactgagctcccagcaggcccttcagttactgcagaggttccagaaattgaacatcccgtgtctgggactcgaaatcaaccacactatcgagcggatcctgcagtattacgttgctgagttggacgccacgaaaaagctgtaccactcccagaaagacgatcccccactggcacgaaacatgccacctattgccggaaagattctgtgggtgcgccagctttaccggaggatatccgagccaatcaattatttcttcaaaaactctgacattcttagtagtcctgatggcaaggccgttatccgccagtataacaagatcagctacgtgctggtcgagtttgaggttgtctatcatactgcctggatcagagagattagccagctgcactacgcactccaggcaaccctatttgtacgccaccccgagacaggcaaattactggtgaatttcgaccctaagattctggaagtcgtacgcgagacgaaatgtatgataaagatgaaactggatgtcccagaacaggccaagaggctgctcaaactagaaagcaagctgaaagccgataagctctacctgcaagggttgttacagtattatgatgaattgtgccaggaggtcccgtctgtgtttgtgaatttaatgactccaaagatgaaaaaggtcgaatctgtgttaagacaggggttgactgtactgacctggtcatctctaacactcgagtctttcttccaggaggtcgagctggtgttagacatgtttaatcagctgttgaagaaaattagtgacctgtgtgaaatgcatatagatacggtgcttaaagagattgccaagaccgtcttgataagcctgcccgaatctggcgcaacaaaagtcgaagacatgctgaccctgaatgaaacttacacaaaagaatgggctgacatactcaaccacaagtccaaacatgtggaagaagctgtcagggagctaattagtatttttgaacagatctatgaggtgaaatacaccggcaaagttgggaaacagtctgagcagaggaagcacgtagtctttggcagcgagactggcgaaggagagaacaacgattatgaggcaaacatagttaacgagtttgatacccatgacaaggaggacgaatttaaaaaggagtgtaaagaggtgtttgcttttttcagccaccagctcctcgactctcttcagaaggcgactcgcctctctctggataccatgaaacgaagaattttcgtcgcttccctttacggcagaaagcagagcgaggatatcatctcctttatcaagagcgaagttcatttagctatccccaatgtggtgatgataccctcactggacgacatccagcaggcgatcaaccgaatgatccagctcacattggaagtatctagaggggtcgctcactggggccagcagcagattcgacccataaaatcagtgatcccatcccccactactactgacgtcacacatcagaacacaggaaaacttctcaagaaggaagagaggagcttcgaggaagctatacccgcacgaaagttgaagaatttctaccccggtgtggccgagcacaaggacatcagtaagttggtgctcctcctgagcagttctgtcaactcactgagaaaagcagctcacgaggcactgcaagactttcagaagtacaaaactctgtggaccgaggatagggatgtgaaagttaaggaattcctggcaaacaacccatctcttactgagatccgcagtgagatccttcactacgcaacttttgagcaagaaatcgacgagttgaagcccataatcgtcgtcggggcacttgagttacatacagagccgatgaagctggccctctctattgaagctaaggcttggaaaatgctgctgtgtagatatctgaacgaggaatacaaaaaaaagatgagctacatgatagcattcataaacgagtacctgaaaaagctaagcaggcctatcagggaccttgacgatgttcggtttgccatggaggcactgtcctgcattagagacaatgagatccagatggacatgaccctggggccaatcgaagaggcgtacgccatcctgaaccgcttcgaagttgaggtgaccaaagaagaaagtgaggccgtggataccttgcggtattccttcaataaactccagagtaaggccgtgtccgtacaggaggacttggtgcaggtgcaacccaagttcaaaagcaatctgctcgagtcagtggaagttttcagggaggacgtgatcaatttcgctgaagcatacgagctagagggccctatggttcctaacattcctccacaggaggcctctaacaggttgcagatcttccaggcatcctttgatgacctgtggcggaagttcgtgacatattcatccggcgaacaactgtttggacttcctgtgacggattatgaggtgctgcacaagacaaggaaagaacttaacttgctccagaaattgtacggcttatatgataccgtgatgagctctatcagtggatactacgagatattatggggcgacgtggacatcgagaagatcaatgccgagcttctcgagtttcagaaccggtgcagaaagttaccaaaaggcctaaaggattggcaggctttccttgacctgaaaaaacggatcgatgatttcagcgagtcctgcccactactagagatgatgacgaataaggcaatgaaacagagacattgggacagaatctcagagctgaccggaaccccattcgacgtggaaagcgacagcttctgccttagaaatatcatggaggcccctttgctgaaacacaaggacgatattgaggatatatgcatctccgccatcaaggagaaagacatcgaagcaaaacttacccaagttattgagaattggacaaatcagaatctgtctttcgcagctttcaagggaaaaggagagctactgcttaagggcaccgaatcaggcgaaattatcaccctgatggaggatagcttgatggtcttgggcagtttgctgtccaaccggtacaacgccccttttaaaaagaatattcagaactgggtgtataagctgtccaccagcagtgatatcatcgaggaatggctggtggtccaaaacctgtgggtctatctggaggccgttttcgtcgggggtgacatcgctaagcagcttccccaggaggccaaacgattccaaaatatcgataaaagctggattaagatcatgcagagggcgcacgagaatcctaacgtcatcaattgttgcgtcggggatgaaacgatggggcagctgctaccacacctgcacgagcagctggaagtgtgtcagaaatcccttacgggatatctcgagaagaagaggcttctgttccccaggttcttcttcgtatccgatccggtgttgctcgagatcctaggccaagcctccgatagtcacacgatccagccacatctccccgctgtgagtgacaacattaatgaagtaaccttccacgccaaagattatgacagaataatggcagtcatatctagggagggcgagaaaatcgtactcgataacagcgtgatggcaaaaggcccagtggaaatttggctgctcgacctgcttaaaatgcagatgagttccctacataatatcatccggtccgccttttaccagatctctgattccgggttccagctactacccttcctatctcacttcccggcacaggtgggactgttaggtattcagatgctgtggactcacgattcagaggaagccctcagaaatgctaaagacgataggaagattatgcaggtgaccaaccaaaaatttctcgatatcctgaataccttgatcagtcaaacaacccatgatctctctaaattcgaccgtgtcaaattcgaaacactgatcaccattcatgtccatcagcgggacatttttgacgatctagtgaagatgcacattaagagccccactgactttgagtggctgaaacaaagccgtttttattttaaagaggacctggatcagaccgtggtatctattactgatgttgacttcatttatcagaacgagtttcttgggtgcaccgatcggctggtgatcacaccactgactgatagatgttatatcacgctggcccaggcgctcggaatgaacatgggaggcgctcccgcaggcccagccggtactggaaagacagaaactacaaaggatatgggtcgttgtctgggcaagtacgtcgtggtgttcaattgcagcgatcagatggattttagggggttggggcgaattttcaagggtctggctcagtcaggctcttggggctgtttcgacgagtttaaccggatcgagttgcccgtgctcagcgtcgccgcacagcaaatttatatcgttctgaccgctaggaaagagaggaaaaaacaattcatcttctccgacggggactgcgtcgatctcaatcctgagttcgggatctttctgacaatgaacccagggtacgccggtcggcaagagctgccagagaacctcaagatccagtttagaacagtggctatgatggtgcccgaccgtcaaatcattatgagggtgaagctagcctcctgcgggtttttagagaacgtgatcttagcgcagaaattttacgtgctctataagctgtgcgaggaacagttgacaaagcaggtgcattacgacttcggactgcggaatattctgtctgtgcttcggaccctcggtagtcagaagagagccagaccagaagacagcgaattgtcgattgtgatgcggggtctccgggacatgaacctttcaaaattggtcgatgaagatgagcccctgtttttgagcctgatcaatgatctgttcccgggactccaactggattcgaacacatacgctgaacttcaaaacgctgtggctcatcaggttcagatcgagggtcttattaatcacccaccatggaacttaaagctggtacagctgtatgagactagtcttgtgcggcacggccttatgactttgggtccgtcaggatccggcaagaccactgtgatcaccattctgatgaaagctcagactgaatgcggcagaccccacagagagatgcggatgaacccaaaagccatcactgctccccagatgtttggcagacttgatactgctaccaacgactggaccgacggaatattcagtaccctctggaggaaaaccctgaaagctaagaagggcgagaacatttttttaatacttgacggtccagtagacgccatatggattgaaaacttgaatagtgtgctcgatgacaataagactctgaccctagccaacggcgacagaatccctatggctccttcttgtaagctgcttttcgaggtccacaacatcgagaatgcatcaccagctacggttagcagaatgggtatggtctatatctcatctagtgctttgtcttggaggccaattctgcaggcatggctcaaaaagaggactgcgcaggaggccgctgtcttcctcactctctatgaaaaagtgttcgaggacacttacacttacatgaaacttaacttgaacccaaagatgcagctgctcgaatgcaattacatcgtgcagagtttaaacctccttgagggcttaattccttcaaaagaggaaggcggagtgagctgtgtagagcatctccacaagttatttgtcttcgggctcatgtggagcctgggggctctcctcgaactcgagtctagagagaaactggaagcgtttctgagacagcatgaatctaaactggatctccccgaaatcccaaaggggtccaaccagaccatgtacgaattttatgtcactgattacggagattgggaacactggaacaagaaactacaaccctattattatcccactgacagtatcccagagtacagtagtatcttagtgccaaatgtggataatattcggacaaattttcttatcgatacgatcgcaaaacagcataaagcagtgctgttgaccggagagcaggggaccgcaaagacagtcatggtgaaagcctatctaaagaagtatgaccctgaagttcaactgtcaaagtcactgaatttttccagcgccacagagcctatgatgttccaacggacgatcgagagctatgttgataagaggatcggatccacttatggaccacccggtggcaggaagatgaccgtgtttatcgacgacattaatatgccagtgataaacgaatggggtgatcagatcaccaatgagattgtacgccagatgatggaaatggagggcatgtacagcctggataaaccgggagactttactaccatcgtggacgtgcagctcatcgctgctatgatccatcccggaggcggacggaatgacatcccacagcgactgaagagacagttcactgtatttaactgtaccctcccttctaacgcctcaatcgataaaatttttggtatcatcggatgcggctacttcgacccctgtcgaagctttaagccccagatatgtgaaatgattgttaacctggtttctgtggggcgtgtcctgtggcaatggaccaaggtaaagatgctgccaacaccaagtaagtttcactatatattcaatctcagggatctgtctagaatttggcagggtatgctcaccatcaaggccgaagaatgcgcttctatccccaccctcctcagtctcttcaagcacgaatgttctcgggttatagccgaccggttcataacacctgaagacgagcagtggtttaacgctcatctgaccagagctgtggaggagaatatcgggtccgacgcagcgagctgcatcctgcccgagccttatttcgtagacttcctgcgagaaatgccagaacccaccggggatgagcccgaggattctgtcttcgaggttccaaagatctacgagctcatgccctccttcgacttcctggcagagaagctccaattttaccaaagacagttcaacgaaatcatacgaggaacctccctggatctggtgttctttaaagatgccatgacacatttgatcaagattagtcgtatcatacgtacttcttgcggtaatgcactcctggtgggtgtgggcggatcgggcaaacagtctctgtccagattggcttcttttatcgcagggtaccagatcttccagatcaccctgactaggtcctacaacgtgacaaacctgacagacgacctcaaagcactgtataaagtggccggagccgatggtaagggcattactttcattttcactgacagcgagatcaaggatgaggcgtttttggagtatctgaataaccttctgagctctggtgaaatttctaacctgtttgcgcgagacgaaatggatgaaataactcaaggactgatctccgtgatgaagagggagctgccgcgacatccgcctacatttgacaacctttatgaatacttcatcagcagatccagaaaaaatttgcacgtcgtgctttgtttttcccctgttggcgaaaaatttcgcgctagatccctgaaatttcccggactcatctcaggatgtaccatggactggttttcccggtggccacgcgaagcattaattgctgtcgcgtcttatttcctgtctgattataacatcgtctgctcttccgaaattaagcgccaagtggtagagacaatgggactcttccacgacatggtgtccgagtcttgcgagagttacttccagaggtataggcgccgagctcacgtgacacccaagtcttatttgtcatttatcaatgggtacaaaaacatctatgcagagaaggtgaaatttatcaatgagcaggccgagcgtatgaatattggccttgacaaactgatggaggcctcagaatccgtggccaagctgtcccaggacctggcagtgaaggagaaggagctcgccgtcgcctccatcaaagctgatgaggtcctggccgaggttaccgtgagcgctcaggcgtcagcgaaaattaaaaatgaggtgcaggaggttaaggataaggcacaaaaaatcgtcgacgagatcgactctgagaaggtgaaagcggagagcaaactggaggccgcaaagccggctctcgaggaggcagaggcagccctaaacacaataaaacccaacgatatcgctactgtgaggaagctcgccaagcccccacacctgataatgcggatcatggattgcgtcctgctgctgttccagaaaaagatcgacccggtgaccatggaccctgaaaagagctgttgtaagccctcctggggtgaatcccttaagctcatgagtgccactggcttcctgtggtcgttgcagcagtttccaaaggatactattaatgaggagactgtcgaactccttcagccatactttaatatggatgactatacgttcgagtctgcaaaaaaggtgtgcggtaatgtagccggacttctctcctggacattggctatggccatcttctacggaattaatcgcgaagtgctcccattgaaagcgaacctggcaaaacaagagggcaggctcgctgtggccaatgccgagctaggcaaggcgcaagcattactggatgagaaacaggctgagcttgataaggtacaagccaagtttgatgcagctatgaacgagaagatggatttattgaacgacgctgacacatgtcggaaaaagatgcaggccgcttctaccctaatcgatggcctgagcggggaaaagatccgctggacacagcagagcaaggagtttaaggcccagatcaataggcttgttggcgacatccttctgtgtaccggcttcctcagctatctgggaccatttaaccaaatcttcaggaactatctattgaaggaccagtgggaaatggaattgcgcgcaagaaagattcccttcactgagaacctgaatcttatctctatgctggtcgatccccctaccatcggagaatggggcctccagggtctgcccggagatgacctgagcattcagaacgggattatagtcacaaaggctacaagataccccttgctgatagatccgcaaactcagggcaagacgtggataaagtcaaaggagaaggagaacgaccttcaggtcacttccttgaatcataaatactttcggacacaccttgaagactcgttgagcctcgggcgacctctgctgatcgaggacatccacgaggagcttgatcctgcactggacaacgtactggaaaagaattttataaagtcaggaactacattcaaggtcaaggttggcgacaaagagtgcgacattatggacacttttaaactgtacatcacaactaaactcccaaacccggctttcaccccggagataaatgccaaaacaagcgtgattgactttacagttaccatgaagggtttggagaaccaactcctcaggcgcgtgatcttgaccgagaagcaggagctggaggccgagcgcgtgaaactgcttgaggacgtaaccttcaataagcggaaaatgaaagagcttgaggacaacctcctgtataaacttagcgccacaaagggctcgttggtggacgatgaatcactgataggcgtgctgcgaacaactaaacagaccgccgctgaggtgagcgagaaactacatgtggcagccgaaacagaaatcaagattaacgctgcgcaggaggagtttcgcccagccgcaacacggggatcaatcctgtacttcctgatcaccgagatgtctatggtcaatattatgtaccaaacttctctcgctcaattcctaaagttatttgatcagagtatggcccgttcagagaagtcccccctccctcagaaaaggatcacgaacatcattgaatatctgacctatgaggtattcacctacagcgtgagggggctgtacgaaaatcacaaatttctcttcgtactcctcatgacactgaagatcgacttacaacggggtactgtcaagcacagggaattccaggcacttatcaagggaggcgctgccctggacctgaaagcttgtcccccaaagccctacaggtggatccttgatatgacgtggcttaatctggtagagctgtcaaagttgccccaattcgctgaaattatgaaccagatctctcgtaacgagaagggttggaaatcctggtttgataaggacgcccctgaagaggagatcatcccggatggctacaacgactccttagatacctgccataaactactgctgatacgatcatggtgcccagatcgtaccgtcttccaggcacgaaagtatattgccgatagtctggaggagaaatacacagagcccgtcatcctgaacctagaaaagacttgggaggagagcgatacacggaccccactgatatgctttctctctatgggaagcgacccaacaaatcagatcgacgcacttgctaaaaagctgaagctcgaatgtcgaacgatcagcatgggacagggacaggaggtccacgccaggaagttaatccagatgtcaatgcagcagggtggctgggtgctgctgcagaactgccatctgggtttggagtttatggaggaattattggagaccttgatcacaaccgaggcatccgatgacagcttccgcgtctggataacaactgaaccacacgacaggttcccgatcactttgctccagacatctctgaaatttacaaatgaacctcctcagggtgtgcgggctgggctaaagagaacctttgctggaataaatcaagatcttctggacatttctaatctccccatgtggaagccgatgctttataccgtagcctttcttcacagtacagtgcaggaacgacgcaagttcggcccactgggctggaacattccctacgagttcaattccgctgactttagtgcatctgttcagtttattcagaatcacctggacgagtgcgacatcaagaagggcgtaagctggaatacagtgagatatatgattggagaagtccaatatggcggacgtgtgaccgatgattttgacaagcggctgctcaactgctttgccagagtgtggtttagcgagaaaatgttcgaaccaagcttctgcttttatactggttataagattccgctgtgcaaaacattagatcagtacttcgagtacatccagagcctaccttccctcgacaaccccgaagtatttggactgcacccaaacgcagatataacttaccagagcaacacggcctcagctgtgctcgaaacgatcacaaacatacagccaaaggagtctgggggaggcgtgggcgagacacgtgaagcgatagtgtacaggctgagcgaagatatgctaagcaaattgcctcccgactacatcccacatgaagttaaaagccgtctgattaagatgggccatctgaatagtatgaatatctttctcaggcaggaaatcgatcggatgcaacgagtaatctccatcctgcgttcgagcctgtctgatttgaaactggccatcgaggggacaattatcatgagcgaaaacctcagagatgcactggataacatgtacgatgcccgaatcccccagctgtggaagcgcgtgagctgggatagttctaccctcgggttctggtttacggagctgctggagaggaatgcccagttctctacttggatcttcgaaggcaggcctaatgtgttttggatgacaggcttcttcaaccctcaagggttcctgaccgccatgagacaggaggtgacgagagcacacaaaggttgggcactcgatactgtgaccatccacaacgaggtcctgagacagacaaaagaggagatcacatccccacctggcgagggtgtgtacatctacggtctctacatggatggagctgcatgggaccggcgaaacggcaaactgatggaatcaacccccaaagtcttattcacccaactgcctgtgcttcatatcttcgctattaattctacggctccaaaagatcccaagctgtacgtttgtccaatttacaagaagcccagaagaactgacctgacgttcattactgtggtgtaccttcgtacagtgctcagcccagaccactggattttacgcggtgttgccctactgtgtgacataaagtag

SEQ ID NO: 221444 - DNA, 13473 bp, Artificial Sequence
  Description of Artificial Sequence: Synthetic coding sequence
atgatgaagttgtacattgacaacgctgccccagataaactcaagggtctttgtatcttcttcgtgcgttgccggaatgacgtggccataaatgtgaagacaattcaagaggaagcgctttttacggttctagacgccagtaaaggccttctgaatggaatccgggatatgttagcaaacatttttctgcctgcagtcctggcaacaaataattggggcgctttgaaccaatccaaacagggcgagagcgagaagcatatctttacggagactatcaatcgatacctgtcattcctggatggggcacgaatcagcatcgagggaaccgtgaaactgaagaccatcgataatgtaaatttttcaaagctgcacaccttcgaggaagtcactgccgcagcttccaatagtgaaacagtccatcaacttgaagaggtattaatggtgtggtataaacaaatagagcaggttcttatcgaatccgagcaaatgagaaaggaagcaggcgactctgggccactcaccgaattggagcactggaagagaatgagcgccaagttcaactatataatcgaacagattaaaggcccatcatgcaaagctgttataaatgtcttgaacgtggcccattctaaactactgaagaattggcgcgacctcgatgctcggatcaccgacaccgccaacgagtcgaaagacaatgttaggtacctgtatactctggagaaggtctgtcagccactgtacaaccacgatctggttagtatggcccatggtattcagaacctgattaatgcaattcgcatgattcacggcgttagcagatactacaatacttccgagcgcatgaccagcctttttattaaagtgactaaccagatggtcaccgcctgcaaggcatacatcactgatgggggtctaaatcacgtgtgggaccaagaaacacctgtggtgctgaaaaaaattcaggattgtatttttctctttaaagaataccaggcaagtttccataagacccggaagctgattagcgagtctagtggggaaaagtcgttcgaagtgtccgaaatgtatatcttcgggaagttcgaggccttttgtaaaagactggagaagataactgagatgatcacagtcgtgcaaacctacagtaccctatctaattctaccattgagggcattgacataatggcaatcaaatttcgcaacatctaccagggagtgaagaaaaaacagtacgatattctcgatcccaggcgcactgagttcgatacagactttctcgatttcatgacaaagatcaatggcttggaggttcagattcaggcatttatgaacagttctttcgggaaaattctcagctctcagcaggcgctccagttgcttcagcgattccagaagcttaacataccctgcctcggattagagataaaccacacaatcgagcgtattctgcaatattatgtagcggagctagatgccacaaaaaagctataccactctcagaaagatgatccacctctcgcacgcaatatgccccctatagccggtaagatcctttgggtgcgacaactgtaccggaggatttctgagcctatcaattactttttcaaaaatagcgatattcttagctcgcccgacggtaaggctgtgatcaggcagtacaataagatcagttatgtattggtagaatttgaggtggtctaccacacagcctggatccgtgaaatctctcagctacactacgccttacaagcaacgctgtttgttcgacaccctgaaaccgggaaactgctcgtaaattttgacccaaagatcctagaggtagtgcgagagaccaagtgcatgatcaaaatgaagctggacgtcccagaacaggcgaagaggctcttaaaattggagagcaagttgaaagccgataagctgtacctccagggtttactccagtactacgacgaactctgccaggaggtcccgtctgtgttcgtgaatttgatgacgcctaaaatgaaaaaagtggagtcagtgctgcgtcaggggctgacggtactgacttggtcttctctgaccctggagtcctttttccaggaggttgaattggtcttggacatgttcaaccagttgctgaaaaagatttccgacctctgcgagatgcacatcgacactgtgttgaaagaaattgccaagaccgtcctgatttcactccctgaatccggagcaactaaggtcgaagatatgttaacactgaacgagacctacaccaaagagtgggccgatatcctcaatcacaaatctaagcacgtggaagaggctgttagggaattgatttccatttttgagcaaatttacgaggtgaaatatacagggaaagtcggcaaacagagcgagcaaaggaagcatgtggtcttcggctcagagacaggagagggggaaaacaacgactacgaagccaacatcgtgaatgaattcgatacacacgacaaggaagatgagtttaagaaggagtgtaaggaggtgtttgccttcttttcccatcaacttttggactctcttcagaaggccacgcggcttagtttggataccatgaaaaggagaatcttcgttgcctcgctatacgggcgtaaacagtctgaggacatcatatccttcattaaaagtgaggttcacctggccatcccaaacgtagtcatgataccctctctggatgacatacaacaggctattaaccggatgattcagctgacactggaagtgagcaggggcgtggcacattggggccagcaacagattcgccctattaaaagcgtgatcccatccccaactaccaccgatgtcacccaccagaatacaggcaagctgttaaagaaggaggagcggtcattcgaagaggcaattcctgctagaaagcttaaaaatttctatccaggagtagctgagcacaaggatatctctaagctggtgctgctgctgtcttcttcagtcaatagcttgcgcaaagccgctcatgaagccctgcaagacttccaaaagtacaaaactctttggacagaggacagagatgtcaaagtgaaggaattcttggcgaataatccctccctcactgaaatccggagcgagatccttcactacgccactttcgagcaggaaatagatgagctcaagcctatcatagttgtgggtgccctggagctacataccgaaccaatgaaattagcattgtcaatcgaggctaaagcttggaaaatgttactgtgcaggtacctcaacgaggaatacaagaaaaagatgtcctacatgatcgccttcatcaacgaatatttaaagaagctcagtaggcctattcgggatctggatgacgtgagatttgcaatggaagccttatcatgcatacgagacaacgagattcaaatggacatgactttgggccctattgaggaggcctacgccatcttgaatcggttcgaggtggaggttacaaaggaggaaagcgaggctgttgacaccctgcgctactcatttaataagctgcaatctaaggccgtgtccgttcaggaagacttggtgcaggtccaaccaaagttcaaatctaacctgctggagtctgtagaggtctttagggaagacgtcatcaactttgccgaggcttacgagctggaaggtcccatggtgcctaacatcccccctcaagaggctagcaatcggcttcaaatcttccaggcatccttcgacgatctttggaggaagtttgtgacctattccagcggcgaacagttgttcggcttacctgtgactgactatgaggtcctgcataaaacccggaaagaacttaatctgttgcagaagctttacggcctttacgataccgtaatgtcctccatcagtgggtattacgaaattctgtggggcgacgtggacatagagaaaatcaatgctgagttgctagagtttcagaatagatgccgtaagctgcccaagggccttaaggactggcaggcgtttttagacttgaagaagagaatcgacgatttctccgaatcctgcccacttctggagatgatgacgaacaaagcgatgaagcagcgccactgggatcgcatatctgagctcaccggtactccattcgacgtcgaatcggacagcttctgcctccgaaacattatggaagctcccttactcaagcataaggatgatatcgaggacatctgcattagcgctataaaagagaaggacatcgaagccaaactaacacaggtgatcgaaaactggaccaaccaaaatctcagtttcgccgcttttaagggtaaaggggagttgttactcaaaggcactgagtcaggagaaatcatcactctgatggaggattcactcatggtcttggggtccttgctctctaacagatacaacgcgccttttaagaagaacatccagaactgggtgtataaactgagtacttcttctgatatcatcgaagagtggctcgttgtgcagaatctatgggtatatttagaggccgtgttcgtggggggagatatcgctaaacagttaccccaagaagctaagaggttccagaacattgataaaagctggattaaaataatgcagcgggcacatgaaaatccaaatgtcatcaattgctgcgtgggggacgaaactatgggccaactcctaccccacctgcacgagcagttagaagtgtgccaaaagagtctgactggttacttggaaaaaaagagacttctctttccacggtttttcttcgttagcgatccagtcctcctcgaaattctaggccaggcttctgactctcacacaatccagccgcacctcccggcagtaagcgataacattaatgaggtgaccttccatgcaaaagactatgatcgtatcatggctgttatttccagggaaggcgagaagattgtcctggacaattcagttatggccaaagggcctgtcgagatctggctattagatctcctgaagatgcagatgtcgtcccttcataatatcattaggtctgcattttaccagatctccgattctggctttcagctgctccccttcttaagccacttcccagcacaggtcggattgcttggaatccagatgctgtggacacatgattccgaggaagccctgcgcaatgctaaagatgatcggaaaattatgcaagtgaccaaccagaaatttctggatatattgaacaccctgatttcacaaacaacacatgatttaagtaaatttgatcgggttaaatttgaaacccttatcacaattcacgtgcatcaacgggatatcttcgatgacctcgtcaagatgcatatcaagagccctactgatttcgagtggctcaaacagagtcgcttttacttcaaggaagatctggatcagaccgtcgtgtctattaccgatgtcgacttcatatatcagaatgagtttctgggctgtacagacaggctggtcattactccccttactgacaggtgttacattaccctggcgcaggcgcttggaatgaacatgggaggtgcaccagccggacccgcaggcacaggaaaaactgagaccaccaaagatatgggcagatgcctgggcaagtacgtagtggtattcaattgttctgaccagatggattttaggggactgggccgaatctttaaaggtctcgctcagtctggttcctggggatgttttgatgagtttaatagaatagagcttcccgttctgtcagtcgcagcacagcagatttacatcgtgttgaccgccaggaaggagagaaaaaagcagttcatcttttcagacggtgattgtgtggacttgaacccggagttcggaatattcctcactatgaaccctgggtatgctggtcgacaggaactgccagagaatctgaagatccagtttcggactgtggcaatgatggtacccgacaggcagattatcatgcgagtgaaactggctagttgtggctttctcgagaatgttatcctcgcacagaagttctatgtgctgtataagctgtgcgaggagcagttaaccaagcaggtccattacgactttggtttgcggaacatactgagcgttctgcgcaccctggggtcacagaagcgcgcacggcctgaagattccgaactgtctatcgtaatgcggggactgcgcgacatgaatctctccaaactggtcgacgaagacgagccactttttctgtctctcatcaacgacctgttccctgggcttcaactagattcaaacacctatgccgagctgcagaacgccgttgcacaccaggtgcagatagaggggctcattaatcatccaccatggaacctcaagcttgttcaactctacgaaacctctctggttcgtcacggactcatgaccctaggtcccagtggctctggcaaaaccaccgttattaccatactcatgaaggcacaaaccgagtgcggaagaccccaccgcgagatgagaatgaacccgaaagccatcaccgcaccccagatgttcggacgcttagacacagcaactaatgactggacagatggaatctttagcaccctttggcgaaaaacccttaaggccaaaaaaggggagaacatcttccttatcttagacggacccgtcgatgccatctggatagaaaatctgaatagcgtgctggacgacaacaaaactttgaccttggcgaacggggatagaatcccaatggccccaagttgtaagttgctattcgaggttcacaacattgagaatgccagtcccgcaacagtgtcccggatgggcatggtgtatataagcagttccgccctaagctggcgccctatactgcaggcctggttgaaaaagcggacagctcaggaggccgctgtgtttctgaccctgtacgagaaagtgtttgaagatacatatacctacatgaagctgaatcttaatcctaagatgcaacttttggagtgcaattatattgtgcagagtctgaatcttcttgagggactgatcccctccaaagaagaaggtggcgtgagctgcgtggagcatttgcacaaactgtttgttttcgggctcatgtggtccctaggggctctgctcgagctagagtcgagagagaaattggaggcctttctgcgccagcatgaatccaaacttgacctgcctgaaatcccaaaaggatctaaccaaaccatgtatgaattttatgtgaccgactacggcgattgggagcattggaataaaaaattacagccttattactatcctacagactccatcccagaatattcgagtatcctggtgcctaacgttgataacatcagaactaactttctcatcgatacgatagccaagcagcacaaggccgtcctgctcaccggggaacagggcaccgccaaaactgtcatggtgaaggcttatttgaagaagtacgatcctgaggtgcagctcagcaagagcctgaacttttcttctgcgacagagccaatgatgttccaacgtaccattgagtcctacgtcgacaagaggataggctctacttacggaccaccaggcggacgaaaaatgacagtatttatagatgatattaacatgccagtgatcaacgaatggggggaccagattacaaacgagatcgttagacagatgatggaaatggaaggaatgtattcactggataaacctggcgactttaccacaattgtcgacgtgcagctgatagccgcaatgatccatccgggtggaggtagaaatgatattccgcaacgcctgaaaagacagttcacggtctttaactgcaccctgccaagcaatgcaagcattgacaagatcttcgggatcatcgggtgtggatatttcgacccatgccgtagctttaagccccaaatctgtgagatgatcgttaacctcgtaagtgtcggtcgtgtgctgtggcagtggaccaaggtcaagatgctgccgacccccagcaagttccattacatcttcaacctgagagatctgagccgcatctggcagggcatgcttacgattaaagctgaggagtgtgctagtatccctaccttactgtcgcttttcaagcatgaatgctcccgcgtcattgcggaccgattcattaccccagaggacgaacagtggtttaatgcacaccttacccgggctgttgaagaaaacatcgggagcgacgcagcatcctgtatcctgccggaaccgtacttcgttgatttcttgagggagatgcccgagcctaccggtgacgagccagaggactcagttttcgaggtgccaaaaatatacgagttgatgccctcatttgatttccttgccgagaagctgcaattctatcagagacagttcaacgaaattattagaggcacaagtctggatttagtcttcttcaaggacgcaatgactcatctaataaagatatctcggatcatccgaacctcatgtggcaatgccctccttgtgggcgtgggcggatccggtaagcaatctctcagtagattggcctctttcattgccggttaccagatctttcagattacactgaccagatcctacaacgtcacgaaccttacagatgatctaaaggccctctacaaggtcgcaggcgctgatggcaagggcatcacattcatcttcactgattctgagatcaaggacgaggcctttctcgagtatctcaataatctcttgtcatccggcgagattagcaaccttttcgctcgagacgaaatggacgaaattactcaaggactgatctcagtgatgaagcgggaattaccacggcacccccctaccttcgataatctctatgaatattttatcagtcgcagtagaaaaaacttgcacgtggtgctctgcttcagtcccgtcggagagaagttcagagctagatccctcaaatttcctggcttgatttccggatgtaccatggattggttttcaagatggcctcgggaggccctgatcgctgtggctagctattttctttcagattataatatcgtctgttcttcggagatcaaaaggcaagtggtggaaacaatgggcctgtttcacgacatggtgtctgagtcgtgcgagtcatactttcaacgctacaggaggcgtgcgcacgtaacccctaaaagttacctgagtttcattaacggatataagaacatttacgccgagaaagtgaaattcattaatgagcaggcagagcgcatgaacataggtctggataaactgatggaggcttcagaatctgtcgcgaagctatcccaggatctggcggtcaaagagaaagagctggccgtcgctagcattaaggcggatgaagtcctagctgaagttacggtgagtgctcaggccagcgccaaaataaaaaacgaagtccaagaagtcaaagacaaggctcagaaaattgtagacgagattgatagtgagaaggtcaaggcagagtctaagctagaagccgctaaaccggctctcgaggaggccgaggccgcactcaacacaatcaagcccaatgacatagcgaccgtgagaaagctcgccaaacccccacacctgatcatgagaataatggactgtgtgctccttctgttccagaagaagatcgaccccgttacaatggatcccgaaaaatcgtgttgtaagcccagttggggcgagagtttgaagctgatgtccgccacgggctttctgtggtccttgcagcagttcccaaaggatacgatcaacgaggagactgtggagctgcttcagccgtatttcaacatggacgactatacctttgagtcagccaagaaagtatgcggtaacgtggctggtctcctgtcctggacgttagcgatggcaattttttacgggattaaccgggaggtgctgcccctcaaagcaaacctcgccaaacaagagggcaggctcgcggttgctaatgcggaacttggcaaggcacaggctctgcttgacgaaaagcaagcagaacttgataaggtccaggctaaatttgacgccgctatgaacgaaaaaatggatctgcttaatgatgcagacacttgcaggaagaaaatgcaggctgccagcactctgatcgatggtctgagcggcgagaagatccggtggacacagcagagcaaagagtttaaggcccagattaatcggctagtgggggatatccttctttgtactgggttcctgagctacctcggtcctttcaatcagatctttcggaattacctgctcaaggatcaatgggagatggaactccgggcaagaaaaattccattcaccgaaaatctgaaccttattagcatgctcgttgatccacctactatcggcgagtggggactccaaggattgcccggtgatgacctgtccattcagaatggaattatcgttactaaggcaacacgatatcccctcctgatcgaccctcagacacaggggaaaacttggattaaatcaaaagaaaaggaaaatgatctgcaggttaccagtctcaaccacaagtacttcagaactcacctggaagactccctcagtctcgggaggcccttgcttatcgaggatattcacgaagagttagaccccgctctcgacaatgtccttgagaagaactttataaaatcgggcaccacatttaaagtgaaagtaggcgacaaggagtgcgacataatggacacattcaagctgtatataaccacaaagctgcccaaccccgcattcacccctgagatcaacgccaagacgtccgtgatcgactttaccgtaactatgaaggggctggagaatcaactgcttcgcagagtcatcctgactgagaagcaagagttggaggccgaacgagtgaaactactggaggacgtgacattcaacaagaggaagatgaaggagctggaggacaacctcctctacaagctgtcagctactaaaggcagtcttgtcgacgacgaatcactgataggcgttttacggactactaagcagactgccgcagaggtgtctgagaagcttcatgtggccgctgaaacagagattaagataaatgccgcacaagaggagttccgtcccgcagcgactagggggagcattctttactttctgatcacggaaatgagcatggttaatatcatgtaccagacaagtcttgctcagtttctcaaactattcgaccagtcaatggccagatcagagaagtctccattgccccagaagagaattaccaacatcatcgagtacctaacctacgaggtttttacttatagtgtcaggggtctctatgagaaccacaaatttctgttcgtgctgctgatgactctcaaaatagatctccagcgcggtacggtcaaacatagggagttccaggccctgatcaagggcggagccgcactggacttaaaagcgtgccctcctaagccttatcgatggattttagatatgacctggctgaatctggtggaactgtctaagttgccccagttcgcagagatcatgaaccagatcagtcggaatgagaaggggtggaagtcttggtttgacaaagatgctccagaggaagagattatacccgatgggtacaatgactccctggatacttgccacaagttacttctgatccgatcttggtgccctgacaggacagtgttccaggccagaaagtacattgccgattcattggaggagaaatacaccgagcctgtaatcctgaatttagagaaaacctgggaggaatctgatactcgtactccccttatctgttttctcagcatggggtccgacccgaccaaccagatcgacgctcttgcaaagaagctgaaactggaatgtagaaccatttctatgggccagggccaagaagtccacgccagaaagctgatccagatgtcaatgcaacaaggcggttgggttctattacagaactgccacctaggtctggaattcatggaggagcttttagagaccctaataacaaccgaagcatctgatgacagttttcgtgtttggataacaaccgaaccccacgatcggtttccgattaccctcctgcagacctctctgaagttcaccaacgaacctccacagggggttcgcgctggcctcaagcgcacctttgccggaattaatcaagatctccttgacattagtaatctccccatgtggaagcccatgctatacaccgtcgcattcctccacagtactgtccaggagagacgaaagtttggcccactcggctggaatatcccgtatgagttcaatagcgcggacttttctgcatcagtgcagtttattcaaaaccatctggacgagtgtgacataaagaaaggagtctcgtggaatactgtgagatacatgataggggaagtgcaatatggcggacgcgtcacggacgattttgacaagagactactcaattgttttgcgagagtgtggttcagtgagaaaatgtttgaaccatcattctgcttctacaccggctataagattcctctgtgcaaaacgcttgatcagtactttgaatacattcagtccttgccctcactggacaaccctgaggttttcggcctgcacccaaatgccgatatcacttaccaatccaacacagccagtgctgtcctcgaaaccataactaatattcaacctaaggagtccgggggtggcgtgggcgaaacgagagaggccattgtgtaccggctttccgaagatatgctctctaagctgcctcccgattacattccacacgaggtcaagagcagactaattaagatggggcatttgaattcaatgaatatttttcttcgacaagaaatcgaccgtatgcaaagagtgatttcaattctcaggagtagcctgtccgacctgaaactggccatcgaaggaactatcatcatgagcgaaaatttaagggatgcactcgacaacatgtacgacgccagaattccacagttgtggaaacgcgtttcctgggattcctcaacgttgggattctggtttacagaactcctggagcggaatgcacagttctccacctggatctttgaagggcgacctaacgtattttggatgaccggattctttaatccacagggcttcctcactgccatgcggcaggaggtgacacgcgctcacaaaggatgggccctggacactgtaacaatccacaacgaagtgcttagacagactaaggaagagattacctccccacctggagaaggcgtatacatttacggattgtacatggacggagcagcatgggatcgtagaaacgggaagcttatggagagcacccccaaggttttatttacacaattgccagtcctccatattttcgctatcaatagtacagcgcctaaggaccccaaactttatgtatgtcccatctacaaaaagcctcgaaggaccgatcttacattcatcaccgtggtttacctgagaaccgtcctgagccctgatcactggatcttacgcggagttgccctcctgtgtgatatcaagtat

SEQ ID NO: 221445 - DNA, 13365 bp, Artificial Sequence
  Description of Artificial Sequence: Synthetic coding sequence
atgatgaaactctacatcgacaacgcagcaccggacaaactaaaggggctgtgcatcttcttcgtgcgctgtagaaatgatgttgccataaatgtaaaaacaattcaggaagaggcattatttaccgtactggacgcctcaaaaggactcctcaatggcatacgggacatgctggctaacattttcctgccagccgtattggctactaataattggggagctttgaaccagtccaagcagggcgaatctgagaaacacatctttaccgaaacgatcaaccgatacctgagcttcctggacggggctaggatcagtatcgaaggaaccgtgaagctgaagaccatcgacaacgtcaatttttccaagctgcataccttcgaggaggtcacagcggcagctagcaatagtgagacagtgcaccagcttgaggaggtccttatggtttggtataaacaaatagaacaagtcttgatcgagagtgaacagatgagaaaagaggctggtgacagtggacctctgacggagctagagcactggaaacgaatgagtgctaaattcaattatattattgagcagattaaagggccatcctgcaaagccgtgattaacgtgcttaatgtggcccactctaaattgcttaaaaactggcgggatctcgacgccagaatcactgacacagcaaacgaatcaaaagacaacgttcggtatttatataccctcgagaaggtctgccagcccctatacaaccacgatttagtgtccatggcgcatggtattcagaaccttattaacgccatccgtatgatccacggggtgagcagatactataatacgtctgagcggatgacaagtctgtttatcaaagtgaccaaccagatggtgacagcttgcaaggcttatattaccgatggaggcctaaatcacgtgtgggaccaggaaacaccagtggtactgaaaaaaatccaagattgcatctttttattcaaggaatatcaagccagcttccacaagacgaggaagctgatatccgagtcaagcggcgaaaagagctttgaggtgagcgaaatgtatatatttggtaagtttgaggctttctgtaagaggttggaaaagattaccgagatgatcaccgtggtccagacatattcgacattgtctaacagcaccatcgaaggaatagatatcatggctatcaagtttagaaatatttaccaaggtgtcaagaagaaacagtatgatatcctggatccgcgtcgaacagaattcgacaccgacttccttgactttatgaccaaaatcaatgggttggaggtgcagatccaggcctttatgaattcttccttcgggaaaatcctgtcatctcagcaggcactgcaattgctgcagaggttccaaaagctcaatattccgtgtctgggcttggaaattaatcatacaatagagcgcattctgcagtattatgtggccgaattggacgctacgaagaaattataccactcccagaaggacgacccccctctcgccagaaacatgccaccaatagctggaaagattctgtgggttcgccagctgtaccgcagaatttcagaacccattaactacttcttcaaaaacagcgacattctgagttcacccgacggaaaagcagtgatccggcagtacaataaaatctcttatgtgctagtagaatttgaagtggtgtatcataccgcctggatcagagagatatcccagttgcattatgccctgcaggccactctatttgtgcgtcaccccgagaccggaaaactgctggtaaacttcgaccccaaaatactagaggtcgttagagaaaccaaatgtatgatcaaaatgaaactcgacgtccctgagcaggccaagcggcttttaaagctggagagtaaactgaaggccgacaagctctacctacaaggactcttacaatactatgacgagctgtgtcaggaggtgcctagcgtgtttgtgaatttgatgacgcccaagatgaaaaaggttgaaagtgttctacgacaggggctaacagtcctgacctggtccagcttaaccctggagtctttcttccaggaagtggagcttgtccttgacatgtttaatcagctcctcaaaaagatctctgacctgtgtgagatgcacatcgacacggtgctcaaagaaatagccaaaactgtcttaataagcttgccggagagcggagccacgaaagtggaggacatgctcacacttaacgagacctataccaaagaatgggcagatattctgaatcacaaaagcaagcatgtggaggaggcagtgagagagttaatttcgatctttgagcaaatctacgaagttaagtatacaggaaaagtcggcaaacaaagcgaacagagaaaacatgtggtgttcggatccgaaacaggtgagggtgaaaataatgattatgaggcaaatatcgtgaatgaattcgatactcatgacaaggaagatgagtttaagaaggaatgtaaagaagtgtttgcctttttcagccaccagctccttgactccttgcagaaggcaacaagattatccctagacaccatgaaacgcaggattttcgtggcgtctctgtatgggaggaagcagtcagaagacatcatcagtttcataaaatccgaagtgcacctcgctatccctaacgtggtgatgataccttccctggacgacatccaacaagcgataaacaggatgatacagctgaccttggaagtttcccggggtgtggcccactggggtcagcagcaaatacgtccaattaaaagtgtcatcccatctcctacgacgaccgatgtcacacatcagaacaccgggaagctgctgaagaaggaggagcgttcgtttgaggaagccatacccgcaagaaagctgaagaacttctacccaggagtcgcagagcacaaggatatctccaagctggtcttgctgctctccagcagtgttaactctctcagaaaggccgctcacgaggcccttcaggatttccagaagtataagactctgtggaccgaagaccgcgacgttaaagtgaaggagtttctcgcgaacaatcccagtctcactgaaataagaagcgaaatactgcattacgcaacgtttgagcaggagattgacgaacttaagccaattattgtcgtaggcgcacttgaactgcacaccgagcccatgaaactggctctctcaattgaagccaaggcgtggaaaatgctcctgtgtaggtacctgaatgaagaatacaaaaagaaaatgagctacatgatcgcttttatcaacgaatacctaaaaaaactgtccagacctataagggacctagatgacgtccgctttgcgatggaggccctctcatgtatacgcgataacgaaatccagatggacatgactctcggaccgatagaggaggcttacgcaattctcaacagatttgaagtagaggtcactaaagaagaatctgaggcagttgataccctgcgatatagcttcaataaactacagtccaaggcggtgtctgtccaggaggacctagtccaggtgcaacccaaattcaaatctaatttgttagagtctgtggaagtttttcgcgaggatgtcatcaacttcgccgaagcgtacgagctcgagggaccgatggtgcctaacattcctccccaggaggcaagcaatcgtctccagatctttcaggcgtcctttgatgacctgtggagaaagttcgtgacctacagtagtggcgaacagctgtttggtctgcccgtgacggactacgaggttctgcacaagactcggaaggaactgaatctgctgcagaagctttatgggctctatgacaccgtgatgtcttcaatttcagggtactatgaaatcctgtggggcgacgttgacatcgagaaaataaacgccgaactgttggaatttcagaaccggtgtaggaaactcccaaagggcctgaaggattggcaggcgtttctcgatctcaagaaacgtattgacgacttcagtgagtcgtgtcccttactggagatgatgaccaataaggcgatgaaacagaggcactgggatagaatcagcgagctgacaggaacaccgtttgacgtggagagtgacagcttctgtttgcgaaatatcatggaggctcctttactcaagcataaggatgacatcgaagacatttgcatctccgctattaaagaaaaggacatcgaagccaaactcacacaagtgatcgaaaactggacaaatcagaatctgtcattcgcagccttcaaaggcaagggagaacttctcttgaaggggactgagagcggtgagatcattacgctgatggaggattcactgatggtgctgggatcccttctgagcaaccgctacaatgcaccgttcaaaaagaacatccagaactgggtttataaactctctacctccagcgacattattgaggaatggctcgtggtacaaaatctgtgggtctacctcgaggcggtgtttgtgggaggtgacattgctaagcagttgccccaagaagctaaaaggtttcagaacatcgacaagagttggatcaaaattatgcagcgggctcacgagaaccctaacgttattaattgttgcgttggtgatgaaacaatggggcagctcctgccccaccttcacgagcagctggaggtgtgtcagaagtctttgaccggctacttagaaaagaagcggctcctgtttccacgattcttttttgtgtccgatccagtcttgctggaaatcctcggccaggcctctgactcgcacacgatccagccacacctacctgcagttagcgacaatatcaacgaagtgacatttcacgctaaggactacgataggattatggccgtcatttcaagggaaggtgaaaaaatcgtcctagataatagcgtgatggcaaagggaccagtcgagatatggctcctggaccttctgaaaatgcaaatgtcatcgcttcacaatattattcggagcgccttctatcagatttcagacagtggttttcagctgcttccattcctctcccactttcccgctcaggtgggattgttgggaatccagatgctttggacgcacgactcagaggaagccttgcgaaatgccaaagatgaccgcaagataatgcaagtgacaaatcagaaattccttgatatcctgaacacgctgatatcgcagaccacgcacgatctgtccaagtttgacagagtgaagttcgagacacttattaccatccacgtgcaccagagggatatctttgacgatctggttaaaatgcacatcaagagcccaacagacttcgagtggctcaaacaaagccgcttttattttaaggaggacctggaccagaccgttgtctccattaccgatgtggactttatatatcagaatgagtttctcggttgcactgatcgactggtcatcacccctctcactgataggtgttatatcacgctcgctcaggctctgggcatgaacatggggggagccccagctggacccgcaggcactgggaaaacagagaccactaaagacatgggcagatgcttggggaaatatgtcgttgtttttaactgcagcgaccagatggactttcggggactggggaggatctttaagggcctggcgcagtctggatcctggggctgttttgacgaatttaaccggattgaactgccagttttgagtgtagctgctcaacaaatctacatcgtgctcaccgcacggaaagagagaaagaaacagtttatctttagcgatggcgattgtgtggacctcaacccagagttcggaattttcctcactatgaaccctggatatgcaggccgtcaggagttgccagagaatctcaagatccaattcaggactgttgccatgatggttcctgataggcaggtgcattatgacttcggcttgagaaacatccttagtgttctccgtacattaggaagtcagaaacgtgctaggcccgaggattcagaactctctatcgtgatgcgcggactgcgagacatgaacctttcgaaactagttgatgaggacgagccgctgttcctctctctgattaacgacctgtttcctggcctccagcttgatagtaacacatacgccgagctgcagaacgctgtggctcaccaggtccagatcgaaggtctgattaatcatccaccctggaacttgaaattagttcagctgtacgagaccagccttgtcagacatggccttatgactttggggccttccggttcaggtaaaacgacggtgattacgattctcatgaaggcacagacagaatgtgggaggcctcatagggagatgagaatgaacccaaaggctattaccgctccacagatgttcggacggcttgacaccgctactaatgactggaccgacggcattttctccactctctggcggaaaactcttaaagccaaaaagggggaaaacatctttctcattctagacggacccgtcgacgctatttggatcgaaaacctgaattctgtgttggacgacaacaaaaccctcaccctggcgaatggggataggattcccatggctccttcctgcaaattactgttcgaggttcacaacattgagaatgcaagcccggctacggtttctcggatggggatggtttacataagcagctccgctctgtcctggagacccatactgcaggcctggcttaagaagcgcaccgctcaagaggccgcagtgttcctcacgctgtacgagaaagtgtttgaggatacgtacacatatatgaagctcaatctgaacccaaagatgcagcttctcgaatgtaactatattgtgcagtccctcaatctgctagagggcctgattccttctaaggaggaaggcggagtgagttgcgtggagcatcttcacaagctttttgtcttcggcctcatgtggtccttgggcgctttattggaactcgagagccgtgagaagctggaggcctttctgcgccagcatgaatctaaactcgatcttccggagatacctaaggggtcgaaccagacgatgtacgaattctacgttaccgattacggcgactgggagcattggaacaagaaactgcagccgtactactatccaaccgactccataccagaatactcaagcatcctggtacccaatgtagacaatatcaggactaactttctgatagatactattgccaagcagcacaaggcagtgctacttacaggcgagcagggcactgccaagactgtgatggtgaaggcctatttgaagaagtacgatcccgaagtgcagctgagcaagtcattgaacttttcctccgctaccgaacctatgatgtttcagagaactatcgaaagctacgtcgataaaaggatcggctctacctacgggcctcctggaggcagaaagatgacggtgttcattgatgatatcaacatgccagtgatcaacgagtggggagatcagattacaaatgaaattgtcaggcagatgatggaaatggaagggatgtactcccttgataagccaggtgacttcactaccatagtcgatgtacagctcattgccgctatgattcaccctggcggaggtcgcaacgacattccccagcggttgaagagacaattcactgtgttcaactgcactctgccctccaacgctagtatagataagatatttggcattatcggctgtggttactttgacccctgtcgcagcttcaagccgcagatctgtgaaatgattgtgaatctcgtctcagtcggccgtgttttgtggcagtggaccaaggtgaagatgctgccaactccctcaaagttccattatatttttaatttgagggacctctctaggatttggcaggggatgctcaccatcaaagcggaggagtgtgcatctattcccacactgctatccctatttaagcatgagtgctcccgcgtgatagccgacaggttcatcacccctgaggacgagcagtggttcaatgcccaccttacccgagccgtggaagaaaatattggatctgatgccgcatcttgcatacttcccgaaccttattttgttgatttcctaagggagatgccggagcccacaggtgatgagcccgaggacagcgtgttcgaggtccccaaaatctatgagctgatgcccagcttcgatttcctggcagaaaagctgcaattttaccaacgccaattcaacgagatcatcagagggacttccctggatctcgtgttcttcaaagacgcgatgacacacttgatcaagatttcccggatcattaggacgtcttgtggcaatgccttattagtgggagtcgggggaagcgggaaacagtctttaagtcgcttggcttcatttatcgccggatatcaaattttccaaatcacattaactcgttcgtataatgttaccaatttgaccgacgacctgaaagcactttacaaggtagccggtgcagacggcaaaggcattacattcatctttaccgatagtgagatcaaagatgaagcattcttagagtacttgaacaacctactgagctcaggggaaataagcaatctgttcgccagagacgaaatggacgaaattacccaggggctaatatcggttatgaaaagagagctgccacgccacccaccgacttttgacaatttgtatgagtacttcatttctcgcagtagaaagaatctccatgttgtcctgtgctttagccctgtgggggagaagtttagagctcggtccctcaaatttcccggactgataagcggatgcaccatggactggttctctaggtggcctagagaggcgcttatcgcggtcgcgtcgtactttctgagtgactacaacattgtttgcagtagtgaaatcaaaagacaagtggttgagactatgggattgttccatgacatggtctctgagtcttgtgagtcttacttccagcggtatcgcagacgtgctcacgtgacacccaagagctacctctcattcatcaacggctataaaaacatctatgccgaaaaagttaagtttataaatgaacaggccgagaggatgaacatcggactcgataaactcatggaagccagtgaaagcgtggctaagctgtcccaggatcttgccgtgaaggaaaaagaactcgccgtggccagcatcaaggcagatgaagtcctggccgaagtcacagtctctgcacaggcctccgcaaagattaagaatgaggtgcaggaggtgaaggacaaggctcagaaaatagtagatgagatcgactctgaaaaagtgaaagccgagagtaaactggaggcagccaagcccgcacttgaggaggccgaggccgcattgaacacgattaaacccaatgacattgcaacagttcgcaaactggccaagccaccgcacttgatcatgaggataatggactgcgtactactgttgttccagaagaagatcgacccagtgactatggaccctgagaagtcttgctgcaaaccttcctggggcgagagtcttaagctcatgtccgccaccggattcctctggtccctccaacaatttcccaaggacacaattaacgaagaaaccgttgagcttctgcagccttacttcaacatggacgactatacctttgagtccgccaagaaggtttgtgggaacgtcgccggactcctcagctggacacttgcaatggcaattttttacggcatcaacagagaggtgttacctttgaaagctaatctggcaaagcaggagggacggctagctgtggcgaatgctgaactggggaaagcacaagccctgctggatgagaagcaagcagaactggataaggttcaggctaaatttgatgccgctatgaacgagaaaatggaccttttgaacgatgctgacacctgtcgaaaaaaaatgcaggcggcatcgacacttattgacgggctgtctggggaaaagatccgttggacccaacaatcaaaggagttcaaagcccagatcaaccggctcgtgggcgacatcctgctgtgtaccgggttcttgtcttacctgggtcccttcaaccagatcttcaggaactatctgctgaaggaccaatgggaaatggagctccgtgcaagaaaaataccatttaccgagaatttaaatttgataagcatgctggtcgatccaccaacaatcggggagtggggactgcagggcctgccaggtgatgacctgagcatccagaatgggatcatcgttacaaaggctactaggtaccctctcctgatcgacccccaaacacagggcaagacctggataaaatcaaaagaaaaggaaaacgatcttcaggtgacttcactgaaccacaaatacttccggacccacctggaggatagtctaagcttgggacgacccttgcttatagaggacattcacgaagagttagaccccgctttagataatgtcctagaaaagaactttatcaaaagcggtacgacatttaaggtgaaagttggcgataaagaatgtgatattatggacacctttaagttatacatcacgaccaaactgcccaatcccgcattcactcccgagattaatgctaagacctcagtgatcgactttaccgtaaccatgaaagggctcgaaaatcagttactgagaagagtaatcttaacggaaaagcaagagttagaggccgagcgagtcaagctgctggaggacgtcacctttaacaaacggaagatgaaagaacttgaagacaacctactgtataaactgagcgcaaccaaaggctcgctggtggatgatgaatctctcattggggtcctgaggactacaaagcagacagcagctgaagtgtctgagaagctgcatgttgctgctgagacagagatcaaaattaacgctgcccaagaagaatttagacctgccgcaacacgcggaagcatcctgtacttcctgatcactgaaatgtcaatggtgaacataatgtatcagacatcccttgcccagttcctgaagctctttgaccaatcaatggccagatccgagaagagtccgctgccccagaagcggatcaccaacatcattgaatatctgacatacgaggtctttacctatagcgtccggggactttatgagaatcacaaattcctatttgtccttctgatgacgctcaaaattgatctgcaaagaggcactgtaaagcaccgggaatttcaagcattaattaagggaggcgctgccctcgacttaaaagcctgcccaccaaagccttaccgatggatcctggacatgacctggctgaacctggtcgagctcagcaaacttcctcaatttgcagagatcatgaaccagatctctagaaacgagaagggttggaaaagttggttcgacaaagatgctccggaggaggaaatcatccctgatggctacaacgacagcctggatacctgccacaagttgttgcttataaggtcttggtgtccagatagaacagtctttcaagccaggaagtatatagctgacagcttggaggagaagtacactgagcccgtcattctgaatctcgagaagacctgggaagaatcggacacccgcacaccattgatatgtttcctcagtatggggagcgaccccacaaaccaaatcgacgccctcgccaagaaactgaagctggaatgccgtactatcagcatgggccagggccaggaggtccatgccagaaagttgatccagatgagcatgcagcagggtggatgggtgctactccagaattgtcatttgggactagaattcatggaggagttgctcgagacactcattacgactgaggcatccgacgactcctttcgggtttggattactaccgaacctcacgacagatttcccatcaccctattgcagacctccctgaagttcaccaatgagccacctcagggtgttagagctggactgaagcgcacatttgctggaatcaaccaagatctgctagatatcagcaatctccctatgtggaagccaatgttgtacactgtggccttcctgcatagcactgttcaggagcggcgtaagttcggaccgttaggctggaacataccttacgagttcaacagcgctgacttctcagcctcagtccagtttattcagaatcacctggatgagtgtgacattaaaaagggcgtttcatggaacaccgtgcgctacatgatcggtgaggtacaatacggcggaagggtgactgacgatttcgataagagactactgaactgttttgctagggtgtggttcagcgaaaagatgttcgagccctctttctgcttctacaccggttataagatccctctgtgcaagacactggaccagtactttgaatatatccagtctctgccgtctttggacaatcctgaggttttcggattgcacccaaatgctgatataacataccagtccaacactgcctcagcggtgctggagaccatcaccaatattcaacccaaagagtcaggagggggagtcggagaaacgagagaagctatcgtgtaccgcttgtccgaagatatgctatcaaaactgcctccagattatatcccacatgaggtcaagtcacggctcattaaaatgggacacctgaattccatgaacattttcttacgccaggaaatagataggatgcaaagggtgattagcatcctacgcagtagcttgtcagacctgaaactcgccatagaaggcaccattattatgtcggaaaatctcagagatgcactggataatatgtatgacgccagaattccacagttgtggaagagggtgtcttgggactccagcacgctcggcttttggtttacagaactgcttgagcggaacgcacaattctcaacttggatcttcgagggccgtccaaacgtcttttggatgacgggctttttcaacccacagggcttccttaccgctatgcgccaggaagtcacccgagcacacaagggctgggctctcgacaccgtgacaatccacaatgaagttctcagacagacaaaggaagagatcacgagtcctccaggagagggagtgtacatttacggcctgtatatggacggcgcagcatgggaccggagaaatggcaagttgatggagagcactcctaaagtcctgttcactcaattgccggtgctccacatcttcgctatcaattctaccgctcctaaagacccgaagctatacgtatgtcccatctacaaaaagcctagaaggacagatctgactttcataaccgttgtgtacctcagaacagtactgtctcccgatcactggatcctgcgtggggtggccttgttatgcgatatcaaataa

SEQ ID NO: 221446 - DNA, 12567 bp, Artificial Sequence
  Description of Artificial Sequence: Synthetic coding sequence
atggagaaagatgccgaagatggcgcaccaagtgagggggctgaggcgccaccatcgaccgaagaagctgctccgccaaggtctgaagaggaagaggcccctagacctcccacagtagaggcccctgcggaggacggattctcaccctcagctgaggatgcagtaagttccgttgtggactatcgcgacttgatcccctcagaggagggaatcgtgctgccggacgaccacgaggcggacttaaatagggtaaggcagaggctggccccacgtcctgtgcagtccgtgatctctgaggtcctcagcctgccaagctcccggagatcttctaggtatcgaagaagtatgtctgggttgccgaacctccaggagaccctgaaggagcgtcaggctcgcttccgtgaggccagagaatctcggcgactgaagatcgacccatcctataaatacatatttgaaattctggccgagaatttgggactcgacattgtcacagtggaggaattaattctcgattgccctagcctggaagcctttacaaatttctttgcaaaggacgggtgcaagaccttaaagtttctctaccaggagggtgatgtcccaggaattgaatgtggcagaactattgctggggcaacaaaaggcgcaaagatgatgaaactctatatcgacaacgcagcccctgacaaacttaagggcctgtgtatctttttcgtcagatgtcggaacgacgttgccattaacgtgaaaacaatccaagaggaggccctgttcaccgtgcttgatgctagcaaagggctcctgaatggtattagggatatgttagccaatatattcctgcccgctgtattggcgactaacaattggggtgctcttaaccagagtaagcaaggagaatccgagaaacacatcttcactgagacgatcaacaggtaccttagttttctagacggcgctaggattagcatagaaggcacagttaagctgaaaacaattgataacgtgaacttcagcaaactccataccttcgaagaggtcaccgccgcagcatccaacagtgaaaccgtgcatcaacttgaggaggttctcatggtgtggtacaagcagattgaacaggtgctaattgagagcgaacagatgcggaaggaggccggtgattctggtcccttgaccgagctggagcattggaaacggatgtcggctaaattcaattacatcatcgaacagatcaaagggccatcctgcaaagccgtcataaacgtgttgaatgtggcacatagcaagctcctcaagaattggcgtgatttggacgcacgcattacagatactgccaacgagtctaaggacaacgtcagatatttgtacactttagagaaggtctgtcagcctctttataaccatgatctcgtgagcatggcccatggcatccagaatctgatcaatgctatacgtatgattcacggggtgagtcgatactacaatacatctgagagaatgacctcactgttcatcaaggtgacaaaccagatggtaactgcctgcaaggcctatatcactgatggaggccttaatcatgtgtgggaccaagagaccccagtagtcctcaagaagatccaggattgcatcttcttgttcaaagaataccaggcctcgttccacaaaactcgaaagctcatttccgagagcagcggcgaaaagagctttgaagtttcggagatgtatatttttggcaaatttgaggcattctgcaagcggctcgaaaaaattaccgaaatgatcacagttgtgcaaacatattcaacactgagtaactccacgatcgagggaatcgacataatggctattaagttccggaacatctatcaaggcgtgaaaaagaaacagtacgacatcctcgatccgaggcgcactgaatttgacactgatttcctggactttatgacaaagatcaacggactggaggtccaaatccaagccttcatgaatagtagtttcggaaagattctgtcctcccaacaggcgctccagctgctgcagcgcttccaaaagctcaacattccctgcctggggctcgaaattaatcacaccatagagagaatacttcaatattatgtcgccgaactcgacgctaccaaaaagctttatcactcacagaaggatgatccccctttagcacgcaacatgccacccattgccggaaaaatcttatgggtcaggcagctctacaggaggatctccgagcccataaattacttctttaagaatagtgatatattgtcctcccccgacggcaaggcagtaattcgccagtacaataagatttcttacgtgctcgttgaatttgaggtcgtgtatcacaccgcctggatccgagagatcagccaactccactacgcccttcaggccactttgtttgttaggcaccctgaaacagggaaactccttgtcaatttcgatccaaagattctcgaagttgtgagggagactaagtgcatgattaaaatgaagctggatgtcccggagcaggctaaaaggctattgaaactggagagcaaacttaaggcagacaagttatatctgcagggtttgctccagtactatgatgaactatgtcaggaggtcccaagcgtctttgtaaacctaatgacaccaaaaatgaagaaggtagaatctgttctcagacagggtcttactgtcctgacttggagcagccttacactcgaatccttctttcaggaggttgagctggtgcttgacatgtttaaccagctcctcaagaagatttctgacttgtgtgaaatgcacatcgacacggttcttaaagaaatcgctaaaactgttctgatttccctgccggagtccggcgcaaccaaggtggaagatatgctgacgctgaatgagacttacacgaaggaatgggccgatatactgaaccataagtccaagcatgtggaggaggccgttagggagctaatctctatctttgagcagatatacgaggttaaatacaccggaaaggttggtaaacagtccgaacagcgtaaacatgtggtctttggctcggagactggcgagggagagaacaatgattacgaagccaatatcgttaacgagttcgacacccacgacaaagaagacgagtttaagaaggagtgtaaagaggtgtttgcttttttttcacaccagcttctcgacagtctgcagaaggccactcgtttgtctctggatacgatgaagcgcaggatttttgtagcatcattatacggtcggaaacagtcagaggatatcatttccttcataaagtctgaggtccatctcgctatacccaacgttgtcatgataccatcgctggatgatatccagcaagccattaataggatgattcagttaactctcgaggtctcaagaggtgtcgcccactggggccagcagcaaattaggcccatcaaaagcgtgatcccttctccaacaacaacagatgtcacacatcaaaatactggaaagcttctcaaaaaggaagagcgcagtttcgaggaagctatccctgctcgtaaactcaaaaatttttatcctggcgtagcagagcacaaggatatttcaaagcttgtgttacttctgagcagcagtgtcaattccctccgaaaagcagcccatgaagctttgcaggattttcagaaatacaaaactctatggacagaagatcgagacgttaaagtgaaggaatttctggccaataacccttctctgaccgaaatacgctcagagattttgcactacgcgacctttgaacaggaaatcgatgaactgaagccaatcatagtcgtgggcgctctcgaactccatactgagcccatgaagctggctctttctattgaagccaaagcttggaagatgctactttgtcgctacctcaacgaagagtacaagaagaagatgtcctacatgattgcttttatcaacgagtacctcaaaaaattatcgcgaccaattagagacctcgacgacgtgcgattcgcaatggaggcactgtcttgtataagggataacgaaatacagatggatatgacactcgggcctattgaggaagcatacgcaatccttaatcgcttcgaagtcgaggtcaccaaagaggaatccgaggctgtagacactctgcgctacagttttaacaaattgcaatcaaaagccgtgtccgtgcaggaggacttggttcaagtgcagcccaaatttaagtcaaatttgctggaaagcgtggaagtgtttagggaggacgttataaactttgctgaagcctatgagctcgagggtccaatggttccaaacattcccccacaggaggcttcaaaccgcctgcagatcttccaagcaagcttcgacgatctctggaggaaattcgtgacgtatagttctggcgagcaactattcgggctgcctgtcaccgactatgaggtgcttcataaaacacggaaagaacttaatttgttacagaagctgtatggactttacgatacagtgatgagttccatatccggatattacgagattttgtggggggatgtggacatagaaaaaattaacgccgagctgttggagttccaaaacagatgccgcaagttgcccaaaggactgaaggactggcaggcgtttttggacctgaaaaagaggatcgacgacttcagcgaatcctgtcctctgttggaaatgatgaccaataaggctatgaagcagagacactgggaccggatctccgagttaacaggcaccccgttcgatgtggagtccgactcgttctgcctgaggaatatcatggaggcaccgctgctgaaacacaaagacgacatcgaggatatttgtatctccgcgataaaggaaaaggatattgaagcgaagctaacccaggtaatcgaaaattggacaaaccagaatctgtccttcgccgcttttaaagggaaaggggagcttctcctgaaggggactgagtctggagaaattattacccttatggaagactcgctaatggtgctggggtcattactatcaaaccggtacaatgccccattcaagaaaaacatacagaactgggtgtacaaattgtctacctcatcagacatcatagaggaatggttggtggttcagaacctttgggtctacctagaagccgtattcgttggcggtgatatcgccaaacagctcccgcaggaggcaaagcggtttcaaaatatcgataagtcatggatcaagatcatgcaacgcgcacacgaaaacccgaatgtgataaattgctgtgtgggcgacgaaaccatgggtcagctgttaccccacctgcatgagcagttggaggtatgtcagaagtcattgacaggctatctggaaaaaaaacgcctgctgtttccacgttttttcttcgtgagcgatcccgtactgcttgagatactaggccaagcatcagacagccacaccatacagccacatcttcccgctgttagtgacaatataaacgaggtgaccttccacgctaaagactacgataggatcatggccgttatttcacgagaaggggagaaaattgtgctggataacagcgtgatggctaagggacccgtagaaatctggctcctggacctgctgaagatgcaaatgagttcattacacaatattattagatccgccttttaccagatcagcgatagcggttttcagcttctgccgttcctgtctcattttccagctcaggtgggcctcctaggaattcaaatgttatggacacacgatagcgaagaagccctgcgcaatgctaaggatgaccgaaaaattatgcaagtcacgaatcagaagttcctggatattcttaacaccttaatttctcagaccacccacgacctctccaaattcgacagggtgaaatttgagaccctgataaccattcacgttcatcagcgggatatcttcgatgatctcgtcaagatgcacattaagtcacccacagactttgaatggctgaagcaaagccggttttacttcaaggaggatctggaccagaccgtcgttagcatcactgatgtggacttcatataccaaaatgaatttttggggtgcactgatcgccttgtcataacacctttgaccgaccgctgttatatcacactagcgcaggccctcggtatgaatatggggggtgccccagctggacccgctgggactgggaaaacggagactacgaaagatatgggcagatgcctgggaaaatacgtcgtcgtgttcaactgctcggatcagatggattttcggggtcttgggcgtatttttaagggactggcccagtctgggtcatggggatgtttcgatgagttcaatcgtatcgaacttcctgtgctgtccgtggccgctcagcagatctacattgtcctgacggctcggaaagagcgtaagaaacaattcattttctccgacggggactgtgtggacctgaatcccgagtttggcatcttcctaacgatgaaccccggatacgcaggcaggcaggaactgcctgagaatttaaagatacagttccgcacagtcgccatgatggtgccagataggcaaatcatcatgcgggttaaactagcttcctgcggatttctcgagaacgtgattcttgcacagaagttctatgtattgtacaaattgtgcgaggagcagctcactaagcaggtacattacgactttgggctgagaaacattctctcggtgttgcggactctcggttctcagaagcgggcacgccctgaagattctgagttgtcgatcgtcatgagaggcctcagggacatgaacctgagtaaacttgtggatgaagatgaacccttgtttctatccctgattaatgatctgttcccagggcttcagctcgacagcaatacctatgccgagctgcagaatgctgttgcgcatcaggtgcagattgagggcctaatcaatcaccccccttggaacctgaagttagtccaactttatgagaccagcttggtacggcatggcctgatgactttgggaccgtctggaagcggcaagaccacagtgatcacaatcctgatgaaagcccagacggagtgcggcaggccacatagagagatgcggatgaatcctaaagccattactgcaccacaaatgttcggtcgacttgacaccgcaactaatgactggacagatgggatcttcagcacactgtggaggaagaccctgaaagcaaagaaaggggagaatatattcctgattctggatgggccagtagatgccatctggatcgaaaacctcaattctgtccttgacgataacaaaaccttgacattggctaatggggaccggatcccaatggcaccatcttgcaaacttttatttgaggtacataacatagagaatgccagcccagccactgtcagcaggatgggaatggtctacatctcgagctccgcattatcatggagaccaatcctgcaggcctggctcaagaaacgcacagcccaggaggctgcagtgtttttaaccttgtacgaaaaggtgttcgaagacacttatacttacatgaagctgaacctcaacccgaaaatgcaactcctcgagtgcaactacattgtgcagagcctgaatctgctggagggcctgattccgagcaaggaggagggcggtgtatcatgtgtcgaacacctccataagctcttcgtgttcggcttgatgtggagcctcggcgctctgctcgaactggagagtcgcgagaaacttgaggcctttcttcggcagcacgagtcaaagctggatctgcctgagatcccaaaagggtcaaatcagactatgtacgaattttatgtgaccgactacggtgattgggagcactggaacaagaaacttcaaccgtattattaccctaccgattccatcccagaatacagcagcattctcgttcctaacgtcgacaatattcgaaccaattttctgatagacacaatagccaaacaacacaaggctgttctgctgacaggcgagcaaggcactgccaaaactgtgatggttaaagcttacttgaagaagtacgaccccgaggttcagcttagcaagtccctgaacttcagcagtgcaacagagcctatgatgttccagcgaacaattgagtcttatgttgacaaaagaattgggagtacctatggtcctcccggagggcgtaaaatgactgtgtttatcgatgacataaatatgcctgtcattaacgaatggggcgaccagattactaatgagatcgtgaggcagatgatggaaatggagggaatgtattctctcgacaagccgggagatttcaccacaattgtggatgtgcagctgattgcggctatgatacatcctggtgggggaaggaacgatatccctcagaggctcaagcgtcaatttactgtgttcaactgtacactcccttcaaacgcgagtattgataaaatctttggcattattggctgcgggtacttcgacccatgcaggagcttcaaaccccaaatctgtgaaatgattgttaatttggtgtcagtggggagggtgctgtggcaatggacaaaggtgaaaatgctgcctacaccgtcgaagttccactacatatttaaccttcgggaccttagtcgcatttggcagggaatgctgacaattaaggccgaggagtgtgcctcgatcccaaccctgctgagtttgtttaaacacgagtgttctcgcgtgatcgctgatcggttcattactcccgaagacgagcagtggttcaatgcgcacttaactcgcgctgtggaagagaatattgggtctgatgctgctagctgcattttgcctgagccttatttcgtcgactttcttagagaaatgcctgagccaacaggggacgagcccgaagattcagtttttgaggtcccaaagatatatgagctaatgcctagctttgacttcctagcggagaagctccagttctatcagagacagttcaacgagatcatcagaggcaccagtttggacttggtgttttttaaggacgcaatgacacacttgattaaaataagtagaattattcgtacttcttgtggcaatgcgttactggtgggtgtggggggatcggggaaacagtctttaagtagactcgccagctttatcgccggatatcagatattccagatcacactgactcgctcttacaacgtaacaaacctcactgatgacctaaaggccctttacaaggtagcaggcgcagacggtaagggtattacattcatttttactgactcagagattaaggatgaggcattcctcgagtatcttaacaacctgttgtcaagtggcgagatctccaacttgttcgcacgcgatgaaatggatgaaatcactcagggactcatctcagtgatgaaacgcgagcttcctcgacatccccctacatttgataacctctatgagtattttatttcacgcagcagaaagaatctccacgttgtcctttgttttagccccgtgggtgagaaatttagagcacgcagcctcaaattccccggtctcatttccgggtgcactatggattggttttctaggtggcctcgcgaggctctgatcgcggtggcatcttatttcctaagcgactacaacatcgtgtgttcctcagaaattaaacgacaagtagtagaaacaatgggtctatttcacgacatggttagcgagtcttgtgagtcatactttcagcgatacagaaggagggcccatgtgacccctaagagctacctcagctttatcaacggctacaaaaacatatatgccgagaaggttaaatttatcaatgaacaggcggagcgcatgaatatcgggctggataagttgatggaggcaagcgaatccgtagctaagctctcacaagatctcgccgtcaaggaaaaagaattagcggtggcgtcaatcaaagccgacgaagtgctggcagaggtcactgtctccgcacaggcctcggccaaaataaaaaacgaggtgcaagaggtgaaggataaagcacagaaaatcgttgatgaaatcgattccgagaaagtgaaggccgaatctaagctcgaagcggcaaaaccagctctagaggaggccgaggccgctctcaacactattaaacccaacgatatcgcgacagtaagaaagttagccaaacctccccatctgattatgcgcataatggactgcgtgctgcttctgtttcagaagaaaattgaccctgtcaccatggatccggagaagtcctgctgtaaacctagttggggagagtcactgaaactgatgtctgcgaccggttttctctggagtctgcaacaattccctaaggacaccattaacgaggaaaccgtagaactgttgcaaccgtatttcaacatggatgattacacgttcgaaagcgctaaaaaagtctgcgggaacgtggcgggtctgctttcttggactctggctatggcgatattctatggcatcaatagagaagtactgcccttgaaggccaacctagctaaacaggaggggaggctggccgtagccaacgccgagcttggcaaggcccaggccctgctggatgaaaagcaggctgagctggataaggtgcaagcgaaatttgacgccgctatgaacgagaaaatggacctgctgaatgacgctgacacatgccgtaaaaaaatgcaggccgcaagcacccttattgatggattgtccggcgagaagattcggtggacacagcagagcaaggagtttaaggcccagatcaatcggctggtcggtgacattcttttgtgtacgggtttcctgtcctacctagggcctttcaaccaaatttttcgaaactatctgcttaaagatcaatgggaaatggaattgcgcgctcggaaaataccattcaccgagaatctcaatcttattagcatgctggtcgaccctccaacgattggcgaatggggcctgcagggactccccggagacgacctcagcattcagaacggaattatcgtaaccaaggccaccagataccctctgctgatcgatcctcagacgcaaggcaagacttggattaaatcaaaggagaaagagaacgacctgcaagtcaccagtctaaatcataagtacttccgcactcacttggaagatagtctttctcttggtaggcctctgctcatcgaagatattcacgaggaattagatccagctcttgataatgtgctggaaaaaaattttatcaagagcgggacaacatttaaagttaaagttggcgacaaagaatgtgacatcatggacacctttaaactctatattaccaccaagttgcccaacccggcttttacccctgagatcaacgctaagacttcagtgattgactttacagtgacgatgaagggactcgaaaatcagctcctgaggcgggtcattctgacggagaagcaggaacttgaagccgagcgcgtgaagttgctggaggacgtgaccttcaacaaaaggaaaatgaaggagctcgaggataacttgctctataagctcagtgctacaaagggatcccttgtcgacgatgagtccctgattggtgtgctgaggacaacaaaacaaaccgctgcagaggtgagtgagaaactgcatgttgccgctgagactgaaattaagatcaacgccgcacaggaagagtttcgccctgcagcaactcgtggctcaattttatacttcctaattacggagatgagcatggtcaacataatgtatcaaacgagtctcgcacagttccttaaactctttgaccagtctatggccagatcagagaaatctcctctcccacagaagcgaattacaaacatcattgaatacctgacatacgaggtgttcacctatagcgtccgaggactgtacgaaaaccataagttcctttttgtgctgctgatgaccctcaaaatcgacttgcagaggggaaccgtaaagcatcgcgaattccaggccctgattaaaggtggcgcagccttagaccttaaggcttgtcctcccaagccgtaccggtggattctggacatgacgtggctcaatctggtggagctgtccaagctcccacaattcgcagagattatgaatcagatttcaagaaacgagaagggctggaagtcctggtttgataaggatgccccagaggaggaaatcattccggacgggtacaatgacagcctggatacatgccacaagttacttctgatccgcagttggtgtcctgaccggactgtctttcaggccagaaaatacatcgccgattctctcgaggagaagtataccgaacctgtcatcttaaacctggaaaaaacctgggaagaaagcgataccagaacccccttaatctgctttttgagcatgggcagcgacccaaccaatcagattgacgcactggcgaaaaaactgaaactggaatgtcgcacaattagtatgggtcaggggcaggaggtgcacgcacgtaagcttatccagatgtctatgcaacaggtttgcgacaagcgtctattactgcttcaacattattgctag

SEQ ID NO: 221447 - DNA, 13461 bp, Artificial Sequence
  Description of Artificial Sequence: Synthetic coding sequence
atgcgtcttgccgaagaaagagcagcactggcggctgaaaacgctgacggggaaccgggagccgaccgacgactgcgattgctaggcacgtacgtcgcgatgtctctccggcctgcggcaggagcctgggagcgttgcgccggatccgccgaggcagaacagctgctccaggcttttctgggccgagacgctgcagagggcccacgcccactactggttgtaaggcccggaccacgcggtcttgcaattagaccaggcttggaagtcggacccgagtctggactggccggagctaaggccctatttttcttaagaaccggccctgaaccgccaggtcctgattcgtttagaggtgcggtggtttgtggggacttacctgcagcacctctggaacacttggctgctttattttctgaagtcgtactccctgttctggcaaatgagaaaaatcgcctgaactggcctcatatgatctgtgaggacgtgcgccgacatgcacacagtctgcaatgtgacctatcagtgattctggaacaggtgaaggggaaaacactgctccctctgcctgccggttctgagaaaatggagttcgcggattccaagtctgagactgttttagactcaatcgacaaatcagtaatctacgccatcgagtccgccgtgatcaagtggtcctaccaagtgcaagtggtgctcaaaagggagtctagccagcccctgttgcagggggaaaatcctacaccaaaagtggagcttgaattttggaagtccaggtacgaagacttgaaatacatctacaaccagctccgcactattacagtgcgcggaatggccaaactcctggacaagctgcagagttcttacttccctgcatttaaggctatgtacagggatgtcgttgctgccctggcggaagcacaggatattcacgtgcatctgatccctctacaacgacatctggaggcactggagaatgctgagttccccgaggtgaagccacagcttaggcccctgctacacgttgtgtgcctgatctgggcaacctgtaaaagttaccgttctccaggaaggctcaccgtgcttctgcaggagatctgcaatctgctgatacaacaggctagcaattacctgtctcccgaggatctcctgaggagcgaggtagaggaatctcaaaggaagctgcaggtcgtgtccgatacactgagtttcttcaagcaagaattccaggatcgccgagaaaatttgcatacctacttcaaagagaaccaagaggtgaaggagtgggactttcaatctagcctggtcttcgtacggttagatggatttctgggacagttacatgtggtggagggcctactcaagaccgcacttgacttccacaaactggggaaggtggaattctccggtgtgcgagggaacgcacttagccagcaggtccagcaaatgcacgaggaattccaggagatgtatcgcctcttatccgggagttccagcgattgcctgtacctccagtctactgacttcgagaatgatgtctctgagtttaatcagaaagtggaagatctcgacagaagactcggcactatcttcatccaagccttcgacgatgcccctggtcttgagcatgctttcaaactactggacattgccggaaacctcttagagcggccactggtcgccagggacacttctgataagtacctcgtgttgatccagatgttcaataaggatctggatgccgtgcgcatgatttattcacagcacgtgcaagaggaagctgagctgggtttctctccagttcataagaacatgcctaccgtggctggaggcttgcgctgggcccaagaactccggcaaagaattcagggcccattctctaacttcgggaggattacccacccttgcatggaatccgcggaggggaaaaggatgcaacagaaatacgaagacatgctgtctcttcttgagaagtacgagactagactctatgaggactggtgtagaactgtgtctgagaaaagtcaatacaatctttcccagcccctcctgaaaagagaccctgaaactaaggaaattacgattaacttcaacccacagctgattagcgtgttgaaggaaatgtcctacctggagcctcgggagatgaagcacatgcctgaaacagcagcggcaatgtttagctctagggacttctaccgacagctggttgctaatctagagctcatggcaaactggtacaacaaagtgatgaagaccctgctggaggttgagtttcctttggtagaagaggaactgcagaatattgatctgcgactaagagcggcagaagagactttgaactggaagacagagggcatatgtgattatgtgactgagataacctcctctatacacgacctggagcagcggatccaaaagacaaaggataacgtggaagaaattcagaacattatgaagacttgggtgaccccaattttcaagactaaggacggcaagagggagtcactgctgagcctcgacgaccgccacgataggatggaaaaatattataatctgatcaaggaatcagggcttaagattcacgcacttgtccaggagaatctgggcctgttttccgccgatcccacaagtaatatctggaaaacatacgtgaattctatagacaacttgctgctgaacggatttttcctagccattgaatgctccctcaagtacttattggagaacactgagtgtaaagctggccttacccccatctttgaggcccagctttcccttgccattccagagctagtgttctatccaagtctcgagagtggcgtcaaagggggattctgtgacattgtcgagggccttattacatccatcttcaggatccctagtctggtcccccgactgtcaccacagaatggatccccccactaccaagttgatctcgacggcattcctgatctggccaacatgagacgaaccctgatggaacgcgtgcaaagaatgatgggactttgctgtgggtatcaatccacatttagtcagtattcatacttatatgtggaggaccggaaagaagtactgggccaatttcttctctatggtcacattctgaccccggaggagatcgaggatcacgtagaagatggaatccctgaaaatccgccactcctgtcacagttcaaggtgcagatcgattcatacgagaccctctatgaggaagtgtgcaggctggagccaattaaagtctttgatggttggatgaaaattgacatcagaccattcaaggcctccctcttaaatattattaagagatggtcactgctgtttaagcagcacctggtcgaccatgtgactcactctttggctaatctcgacgctttcataaaaaaatccgaatccggactgctgaaaaaagtcgaaaagggggatttccaggggctggtggaaatcatgggccacctaatggcagtgaaagaaaggcagtccaacacagacgaaatgtttgaacctttgaagcaaacaatagagttactgaaaacatatgagcaagagctccctgagaccgtatttaagcagctcgaagagctacccgagaaatggaataatatcaaaaaagtcgccattacagtgaagcagcaagttgctccccttcaggctaacgaggtaaccctgcttcggcaacgttgcaccgcattcgatgctgaacagcagcagttctgggagcagttccacaaagaagctccttttagatttgatagtatccatccacatcaaatgctcgacgccaggcatattgagatccagcagatggagagtaccatggcttccataagtgagtccgccagcctgttcgaagtgaatgtgcccgattacaagcagctgaggcaatgtcgcaaagaagtgtgtcagttgaaggaactttgggacactatcgggatggtaacctcgtctatccatgcttgggaaaccactccttggagaaatattaacgtagaggctatggagctggagtgcaagcaatttgcgcgacacatcagaaaccttgataaggaggttcgcgcatgggacgctttcaccggattggagagtacagtgtggaacactttgagctctcttcgtgccgtggctgagttacaaaaccccgcaataagggagagacattggagacagcttatgcaggccaccggcgtctctttcactatggaccaggataccaccctcgcccacctactgcagctgcagctgcatcactacgaggatgaggtgagggggattgtcgataaagctgccaaagagatggggatggagaaaactcttaaagagctgcagactacctgggctggcatggagttccaatacgagccccaccccaggactaacgtgccgctgttgtgttctgatgaagatctgattgaggtcctcgaagacaaccaggtgcaacttcaaaatctcgtcatgtctaaatacgtggccttcttcttagaagaagtatctgggtggcagaaaaagctcagcacagtagatgccgtaatcagtatttggtttgaggttcaaagaacatggactcacctggagagcatcttcacgggatccgaggacattagggcccagctacctcaagatagcaagcgattcgagggaattgatattgactttaaagaactcgcctacgatgctcagaaaattccaaacgtggttcaaactaccaacaagcccggactttatgaaaaacttgaggacatccaaggcagactgtgtctgtgcgagaaagcactggctgaataccttgatacaaaaaggctggccttcccccgtttctatttcctgagcagtagtgatctcctggacatcctctcaaatgggactgcgcctcagcaggtgcagaggcatctgtcgaagctttttgataatatggccaagatgaggttccagctggatgccagcggagagcctaccaaaacatcccttgggatgtacagcaaagaggaggaatacgtcgctttcagcgagccgtgcgactgttcaggacaggtcgagatttggctaaatcatgtgttaggccatatgaaggcaactgtccgccacgagatgactgagggagtgacagcctacgaggaaaaaccgcgagagcagtggttgtttgatcatcccgctcaggtggccctcacatgtacccagatctggtggaccaccgaggtggggatggcttttgccaggctggaggaaggatatgagagcgcaatgaaagattattataagaagcaggtggcacagttgaagactttaataacaatgctcatcggccagctgtctaaaggagaccggcagaaaatcatgacaatctgcactatcgatgtgcacgcacgagacgtcgtagccaagatgatagcccagaaagtagataatgcacaagcctttctatggcttagtcagctccgccatagatgggacgacgaagtgaagcactgtttcgccaatatttgcgatgcacaattcctttattcttacgaatatttgggaaacaccccaaggctcgtaattactccactgacggacaggtgctacatcactttgacacagagcttgcacctcaccatgtcaggtgcccctgccggtccggcaggtacaggaaagactgaaacgacgaaagatctgggcagggcattaggtatcctggtttacgtgtttaattgctccgagcaaatggattataagagttgtggaaacatctacaaaggcctggcccaaaccggagcgtggggatgctttgacgaattcaacagaataagtgtggaagtactttcagtcgttgctgtccaggtcaaatctatacaagacgccatacgcgacaaaaaacagtggttttctttcctgggcgaggagatcagcctgaatcccagtgtgggcatttttattaccatgaaccccggatacgccggacgcaccgagctgcccgagaatctaaagtcgctgtttcgcccttgcgccatggtggtccccgacttcgaactcatttgtgagattatgctcgtcgccgagggcttcattgaagctcagtccctggcccgaaagttcattacgctgtatcaactgtgtaaggagctgctgtctaagcaggaccattatgactgggggctgcgtgccataaagagcgttctcgtggtggcgggtagcttgaaacggggagatccagacagacccgaggaccaagtgctgatgaggtcacttagagacttcaacattcccaaaatcgtgactgacgacatgccaatctttatgggattgatcggggaccttttcccggctctggacgtacctcgacgccgagatcctaatttcgaggcactggtgcgtaaagcaatcgtcgacctgaaactccaagcagaggataacttcgtcttgaaagtggttcaactcgaggaattgctggccgttcggcacagcgtattcgtcgtaggaggagccggaactgggaaatctcaggtcctgaggagtctgcacaagacatatcaaataatgaagcgaagacccgtgtggacggacctgaatcccaaggcagttactaatgatgagctgtttgggatcattaaccccgctacaggcgagtggaaggatggactgttttcaagcatcatgcgagagctagccaacatcactcacgacgggccaaaatggattttgctcgacggcgacatagatcccatgtggattgagtcactcaacacggtgatggatgataacaaggttttgacactggcttccaatgagaggattccattgaatcctactatgaaactgctgtttgaaatctcgcatctgagaacagctaccccagctacggtgtcacgcgctggtatcctgtacatcaaccctgccgacctggggtggaaccctccagtctctagttggatcgaaaaaagagagatccagacagagcgcgctaacctgacaatactattcgataagtatctccccacatgcctcgatacactgagaaccagattcaaaaaaatcatccccattcctgagcagagcatggtacagatggtctgtcatctcctagaatgcttactcacaacggaagatatccctgctgactgtccaaaggaaatctatgagcactacttcgtattcgctgcaatctgggcatttggcggagcgatggtgcaggaccagctggtcgactacagagcagaattctctaaatggtggcttaccgaattcaagactgttaagtttccttcacaggggacaatcttcgattattacattgatcccgaaaccaagaagttcgagccctggagcaaactcgttccacagttcgaattcgatcctgagatgccccttcaggcctgtctggtgcacacaagtgaaaccattcgcgtctgctacttcatggaaaggttgatggccagacagagaccagttatgctggtgggaacagccggtacggggaagagcgtgctcgtgggtgccaagcttgcttctcttgatcctgaagcctatcttgtaaagaacgttccctttaattactacacaaccagcgccatgcttcaggccgtgcttgagaagcctctggaaaaaaaagccggacggaactacggccctcctggaaataaaaagctgatctatttcatagatgacatgaacatgccagaggttgacgcctatgggacagtgcaaccccacaccatcattcggcagcatctggactacggtcattggtatgacaggagcaagctgagtctgaaggaaattaccaatgtccagtacgtgagctgcatgaatcccacggccggaagctttacgatcaacccacgcctgcagcgacacttctccgtattcgttctgagtttcccaggcgcagacgctcttagttctatttatagcataatattgacacagcatcttaagttgggaaatttccccgcttcactccagaaatcaataccacctctgatcgatttggcgctggcctttcaccagaaaatcgccacaacattcctgccaactggcattaaatttcactatatctttaatctgagggattttgccaatatattccagggcatcctgttcagtagcgtcgaatgtgtgaagagcacctgggatcttataaggctctatctgcacgagtcaaatcgggtgtatagagataagatggtggaagaaaaggatttcgatctgttcgacaaaatacagaccgaggttttgaagaaaaccttcgatgatattgaggatccagtagagcagacacagtcacctaatctgtactgccactttgctaacggaatcggagagccaaagtacatgcctgtgcagagttgggagctgctgacacagacactggtcgaagccctcgaaaaccacaacgaagtgaatacagtcatggatttggtgctgttcgaggacgcgatgcgtcacgtgtgtcatatcaatcgtatcctggagagtcctcgtgggaacgccctgctcgtgggagttggaggctctggcaaacagagtttaaccaggcttgctgccttcatcagctccatggacgttttccagattaccctgcggaaagggtaccagatccaggatttcaagatggatctcgcatcactctgtctcaaagccggagtgaagaatctcaacacagtctttctgatgactgatgctcaggtcgctgatgaaagatttctggtcctgatcaatgatctgctggcctccggcgagatcccagatctttattctgatgacgaggtggaaaacattattagtaacgtacggaacgaagtgaaatcccaggggctcgtggacaatcgggaaaactgttggaaattctttatcgataggattaggcgccagctaaaggtgacactgtgttttagtcccgtgggcaataagctgcgtgttcgttctcgcaagttccccgctatagtgaactgcacggcgattcactggtttcacgaatggccacagcaggcccttgagtcagtgtccttgaggttcctgcagaacaccgaggggatcgagcctaccgtgaagcaaagcatctccaaatttatggccttcgttcatacgtccgtgaaccagaccagccagagctatctgtctaatgagcagaggtacaattatacaactcctaagagtttcttagagttcattagactgtaccagagcttactacatcggcatcggaaagaactgaagtgcaaaaccgaaagactcgagaatgggctgttaaagttgcatagcacctccgctcaagtcgatgacctgaaggccaaactggctgcccaggaggtggagctgaagcagaagaacgaggacgcagataagctgatccaggtggtgggtgtggagaccgataaagtcagccgggaaaaggctatggcagatgaggaagaacagaaggttgccgtgatcatgctcgaggttaagcagaagcagaaggactgcgaggaagatctcgccaaggccgagcctgcattaacagccgctcaggcagctctcaatacccttaataaaaccaacctgactgagttaaagtcatttggatctccgcctcttgccgtcagtaatgtctccgctgcggtcatggtcctgatggctcccagaggcagagtgcctaaagatagatcgtggaaagccgctaaagtaacaatggcaaaggtcgacggatttctggattcacttattaactttaataaagagaatatccacgaaaattgtctgaaagcaatccgaccttaccttcaggacccagaattcaaccctgaattcgtcgcaaccaaatcatacgccgcagccggattgtgcagttgggtcatcaacattgtgcgattttatgaagttttctgtgatgttgaacctaagcgtcaggcactgaataaagcaaccgcagatttaactgccgcacaggaaaagctggcagctatcaaagctaagatcgcccatctgaatgagaatcttgctaagctgacagctcggttcgaaaaggccacagccgataaacttaagtgccagcaagaagcagaggtgacggcagtgactatctccttagcgaaccgactcgtcggcggactcgccagcgaaaacgtgcggtgggccgacgccgttcaaaacttcaagcagcaagaaaggactctttgcggggatatccttctgatcactgcatttatctcatacctaggattttttaccaagaagtatagacagtcacttctggaccgaacatggcgtccataccttagccaattaaaaacgcctattccagtcacaccggcactcgacccacttcggatgcttatggacgacgccgatgtggccgcatggcagaacgaaggcctgcccgcagataggatgtctgtcgagaacgctacgatcttgatcaattgtgaaagatggcctctgatggtagatccacagctccaaggtataaaatggatcaagaacaagtatggagaagatctgagggtcacacaaattggacagaaaggctatctacagatcattgagcaagccctcgaagcaggtgccgtggtcttaattgagaacttggaggaatccattgatcctgtgcttgggcctctgctcggcagagaggtcataaaaaaaggaagattcattaaaatcggagataaggagtgcgagtacaatcccaagttcagactgatcctccacaccaagctggcgaacccccattatcaaccagagttacaagctcaggccaccttaataaacttcactgtgacgcgcgacgggcttgaagaccagctgctggccgcagtcgtgtcaatggagcggcctgatctggaacaactgaaatccgacctgactaagcagcagaatgggttcaaaattactttaaagaccctcgaagattctctgctttcgcggctgtcctcggctagtggaaattttctcggagagacggttctcgtcgagaacctcgaaatcacaaagcagacggccgctgaggtggagaaaaaagtacaggaggccaaggtgaccgaggtcaagataaacgaagcccgagaacactacaggcccgctgcagctagggcttccttgctgtacttcataatgaatgacctttcaaaaattcatccgatgtaccagttctctctcaaagccttttcaatagtctttcagaaagccgtggaaagggctgcccctgatgaatctttgagagaaagagttgcaaaccttatagactctattaccttcagcgtctaccagtatacaatcagaggtctgttcgagtgtgacaagttgacctatctcgcccaactgacctttcagatactgttgatgaatcgggaggtgaatgccgtcgagctagactttcttctcagaagtcctgtgcagactgggaccgctagccccgtggaatttctgagtcatcaggcctggggtgccgttaaagtactctctagcatggaggaatttagcaatctagatcgcgacatcgagggatccgccaaatcgtggaaaaagttcgtcgagtccgagtgccctgaaaaagaaaaactcccacaggaatggaagaataaaacagcccttcagcgactgtgcatgttgcgggctatgcgtcctgacagaatgacttacgccctgcgtgacttcgttgaggagaagcttggctcaaagtatgtcgtaggacgcgctcttgatttcgccaccagctttgaagagagcggacctgcaactccaatgttcttcatactgtcacctggagtggaccctctgaaggatgtggagagccagggacgcaagctcggctacaccttcaataaccagaatttccataacgtttcgttgggacagggacaggaagtggtggccgaggcggcactcgatctcgctgcaaaaaaggggcattgggtcattctgcaaaacattcacctggttgcaaaatggctgagtacccttgaaaaaaagctggaggaacacagtgagaattcccatcccgagtttagggtgtttatgtccgctgaaccggctccctcccccgaagggcacatcatccctcaggggatcctggagaacagcatcaaaatcaccaatgaacccccaacaggtatgcacgccaatctccacaaggcactcgacaacttcactcaggatactttagagatgtgctccagagaaactgaattcaagagcatcctatttgccctgtgctactttcacgcagtggttgccgaacggaggaagtttggtcctcaggggtggaatcgatcttatcctttcaacaccggggatctgactatctcagtcaacgtgctttacaacttccttgaagctaatgccaaggtgccgtacgacgatttaaggtacttattcggcgaaattatgtacggcggacacattactgatgattgggacagaaggctgtgtcgcacctacttaggggagtttataagaccagagatgttggagggcgaactgtcactagctccaggctttcccctaccagggaatatggattataacggctaccaccagtacattgacgctgagttgccacccgagtctccatatctctatggactccaccccaacgctgagattggattcctgacccagacatccgaaaagctgttcaggacagtgcttgagctgcagcctcgggacagccaggcccgtgacggtgcaggtgccacacgggaggagaaggtgaaggccctcctggaagagatcctcgagagagtcacagatgagtttaacattccagagcttatggccaaagttgaagagcgtaccccttacattgtggtggcattccaagagtgcggaaggatgaacattcttacacgcgaaatccagaggtcccttcgagaactcgagcttggtctcaaaggcgagttgaccatgaccagtcacatggagaaccttcagaacgcactctattttgacatggttcctgaatcatgggcgcgaagagcctacccgagcaccgctggactggccgcatggttcccagatttactgaatcggattaaggagctggaagcctggacgggggacttcactatgccgtctacagtctggctgactggattttttaaccctcagagctttctaacagctatcatgcagagcacagccagaaagaacgagtggcctctggaccagatggctctgcagtgcgatatgacgaagaagaatagggaagagtttcggagcccaccacgggaaggcgcatatatccacgggctttttatggagggagcctgttgggacacccaggcgggaatcattaccgaggccaaactgaaagatctcaccccaccaatgccagttatgttcatcaaagctattcccgcagacaagcaggattgccgctccgtgtactcatgccctgtatacaaaaccagccagagaggtccgacatacgtctggactttcaatctaaagacaaaggagaacccttcaaaatgggtgctggccggagtggccttactgcttcagatttag

SEQ ID NO: 221448 - DNA, 1002 bp, Artificial Sequence
  Description of Artificial Sequence: Synthetic coding sequence
atgaaggactttgtcctaggacgcgacaaggtccaggaagccaaggtgacagaagtcaagataaatgaagctcgcgagcattatcgcccagccgcagcaagggctagcctgctgtactttattatgaatgatctctcaaaaatccacccgatgtatcagttcagcctgaaagcattctccatcgtgttccagaaggccgtagaacgagccgcacccgacgagtctttacgcgaacgggtcgcaaatctgatagactcgattactttttcagtataccagtacacgatcaggggactctttgagtgcgataaacttacttatctggctcaactgacctttcagattctgcttatgaacagggaggtgaacgcggtggaactcgatttcttgctgcggtctccagtccaaactggaactgcctccccagtggaattcctgagtcatcaggcgtggggcgcagttaaggtgctttcgtctatggaagaattttccaacctagatagggatatcgagggcagcgcaaagtcctggaaaaagttcgtggaatctgaatgcccggaaaaagagaagcttcctcaggaatggaagaataaaaccgctctgcagcgactgtgcatgttgagagccatgcgcccagatagaatgacttacgccctccgggacttcgtcgaggagaagctggggtcaaaatacgtcgtcggacgggcactcgattttgccacgtctttcgaagaatcgggccctgcgacacccatgttctttatcttgtccccaggagttgaccctttgaaggacgtggaaagccaggggaggaagctcggctatacattcaacaaccagaactttcataatgttagcctggggcagggccaggaggtcgttgcggaagccgctctagacctggccgcaaaaaaaggccactgggtgattctgcaagttaagagatgctcattcttcacattttatcaccctgcccactgtcttgagcattcaagacactag

SEQ ID NO: 221449 - DNA, 2397 bp, Artificial Sequence
  Description of Artificial Sequence: Synthetic coding sequence
atgaacgatctcagcaaaatccaccccatgtaccagtttagtctgaaagccttttctatagtcttccagaaagccgtggagcgggctgcacccgatgaatctctcagagaacgcgtggctaatctaatcgacagcatcacgttttcagtgtaccagtatactatccgaggtctgtttgagtgcgataagctcacttatctagcccagctgacttttcagatattgttgatgaacagagaggtgaacgctgtagagctggatttcctgctccggtcgccagtgcagacgggtaccgcgtcccccgtcgaatttctgtcacatcaggcgtggggggcagttaaggttttgtcgagcatggaagaattctcgaatctagaccgggatattgagggctctgccaaatcttggaaaaaatttgtcgagagcgaatgtcctgaaaaagagaagctccctcaggagtggaagaacaagaccgccctgcaacgcctgtgtatgcttagggctatgaggccagatagaatgacatacgctttgagggactttgtggaggaaaagttgggatcaaagtacgtggtggggcgagcgttggactttgccacatcttttgaggagagcggccctgctactcctatgttctttatcctgagtcccggtgtggatccattgaaggacgttgagtctcagggccgaaaacttggatacacttttaacaatcaaaacttccataatgtgtctttagggcagggccaggaggtggtggccgaagcagctctcgatttggccgcaaaaaaaggacattgggtgatccttcagaatattcacctggtcgccaagtggttgagtaccctggaaaaaaagttagaggaacactccgagaactcacatcccgagtttagggtcttcatgtcagcagagcctgctccttcaccagaaggccacatcatcccccagggaatcctggaaaactctattaagattacgaatgagccacctacgggaatgcatgctaatcttcacaaggccctggacaactttacccaagacactctggaaatgtgcagtagggaaaccgaattcaaatccatcctgttcgcactgtgctatttccatgccgtcgtcgccgagaggcgcaaatttggccctcagggttggaatcgttcctacccattcaacacaggcgacctgacaattagcgttaatgttttgtacaacttcctagaggcgaacgcaaaggtcccttacgacgacctgagatacctcttcggggaaataatgtacgggggtcatattaccgacgattgggaccgtaggctgtgtagaacctacctcggtgaattcattcgccctgaaatgctggaaggagaactgtcgctggcgccaggattccccctgccagggaatatggactacaacgggtatcatcagtatattgatgccgaactgccacccgagagcccctatctttacggtttgcatccgaatgcagagattggattcctgactcagaccagcgaaaagttattccgcacagtactggagctccaacctcgggacagccaagcgagggatggggcaggtgccactagggaggaaaaagtaaaggccttgctagaagagattttagaaagagtgactgatgagtttaatatccccgagcttatggccaaggtggaggagcggactccctacatcgtggtggctttccaggagtgtggccgaatgaacattctcacacgcgaaattcaacgatccctgcgagagctcgagctcggtttaaagggtgaactaacaatgacctcacacatggaaaatctgcagaacgcgctgtacttcgatatggtacccgagtcatgggcacggagggcctaccccagtacagcgggtctcgctgcatggtttccggatttgcttaatagaattaaggaattagaggcatggaccggagattttaccatgcctagcacagtatggctaaccggattctttaacccccaaagctttctcacagccatcatgcagtcaacagcaagaaagaacgagtggcccctcgaccagatggcactccagtgtgacatgacaaagaagaatcgtgaagagtttcgttctcctccacgggagggcgcttacattcacggactttttatggaaggcgcatgttgggacacacaggccggtattatcaccgaggctaagttgaaagacctcacccctcccatgcccgtgatgtttattaaggctatacccgcagataagcaggactgtagatccgtctattcatgccccgtgtataagacatctcagcggggacccacgtacgtgtggacttttaacctcaagacaaaagaaaatccctctaagtgggtcctggcaggcgtagccctgcttctgcaaatttag

SEQ ID NO: 221450 - DNA, 8978 bp, Artificial Sequence
  Description of Artificial Sequence: Synthetic coding sequence
gaggtccgcggaatcgtcgataaggctgctaaagagatgggaatggagaagacgctgaaggagctgcagactacatgggctggcatggagtttcagtacgagccccacccccgaaccaacgtcccacttttgtgctcagacgaagaccttatcgaggtgctggaagataatcaggttcagttgcagaatctcgtcatgagtaagtacgtggctttctttctggaagaagtgagtggttggcaaaagaagctgagcacagtggacgctgtaatctctatttggtttgaggtgcaacgaacttggacccatctcgagagcattttcaccggatcggaggacatccgcgcacagttgccacaggacagcaagagatttgaaggcatcgacatcgactttaaagaacttgcctacgacgcgcaaaaaatcccgaatgttgtacagacaaccaataagcccggtctgtatgaaaaactggaagacatccaggggcgtttgtgtctgtgtgagaaggcactggccgagtacctggacacaaaacggctggcgttccctcgattttacttcctgtcctcttcggatctgttggacattctctctaatggcaccgctccacagcaagttcagagacatctctccaagctgttcgacaatatggccaaaatgaggtttcagctcgacgcatctggagaaccgacaaaaacttccttggggatgtactcgaaggaggaagaatacgtcgcgttctctgagccttgcgactgctctggtcaggtcgagatttggttgaaccacgtcctgggtcatatgaaggctaccgtcaggcatgaaatgactgagggcgtgacggcttatgaggaaaagccccgagaacagtggctgtttgatcacccggcacaagtggccttaacctgtactcagatctggtggaccaccgaggtgggtatggcgtttgcacggctggaggagggttatgagagcgctatgaaggactattataagaagcaggtggcccagttgaaaacactgatcactatgctcattggacagttgtcaaagggagaccgacagaagattatgacgatctgtacgattgatgtccacgccagagatgtcgtcgcgaagatgatcgcccagaaggtcgacaacgcccaagccttcctctggctgtctcaactaagacaccggtgggatgacgaggtgaaacactgcttcgccaacatctgtgatgctcagtttctttacagctatgagtatttgggcaacacccccaggctagtgatcactcccctaacagatcgctgctatatcaccctcacccagtccctacatcttaccatgagcggcgctcccgcagggccagcaggtacgggaaaaaccgaaaccacaaaggacctgggcagggctctcggtattcttgtgtatgtcttcaattgtagcgaacaaatggactacaagagttgtgggaatatatacaaaggactggctcagactggggcatgggggtgttttgatgaattcaatcggatttctgtggaagtgctcagtgttgtcgcagtacaggttaagtcaatccaagatgccataagggataaaaagcagtggtttagctttctgggcgaagagatttcccttaacccttccgtggggatatttattacaatgaatcccggttacgcaggaagaaccgaactgccagaaaacctgaaatccctgttccggccatgtgccatggtggtgccggattttgagttaatctgcgagatcatgctggtagctgagggattcattgaggcccagtctctcgcaaggaaatttattacactataccagctatgtaaggagctgttgtcaaaacaggaccactatgattggggtctgcgagccattaagtccgtgttagtagtcgcgggatccttaaaacgaggcgatccagatcgcccagaagaccaggtgctaatgaggtccctccgggactttaatattcccaagattgtgacagatgacatgcccattttcatgggcctaattggagatctgttccctgctctagatgtcccacgaaggagagatccgaatttcgaagcactcgtccgcaaagctattgtggacctgaaactgcaggcagaggacaattttgtgctgaaagtcgtgcagctggaagaactgctcgccgtacgacattccgtgttcgtagttggaggagcagggactgggaaatctcaggtgttaagaagcttgcacaagacttaccagattatgaagaggaggcccgtttggaccgatcttaatcctaaggccgtcaccaatgacgagctgttcggcattataaacccggcaacaggcgagtggaaggatggcctttttagctctattatgcgagagttagccaacattacgcacgatgggccaaaatggatactgctggacggggatatcgacccaatgtggattgagagcctcaatacggtgatggatgataataaagtgctgactctcgcctcaaatgaacgtataccattaaaccctacaatgaagttgctgttcgagatttcccatctacgtacggccactcctgctacagtctcgcgcgctggcattttgtatatcaacccagcagatctaggatggaaccctcccgtgagcagctggattgaaaagcgagagatccaaacagagagggccaatctgactatcctgtttgacaaatatctgccgacctgccttgacacccttcggacaaggtttaaaaaaatcatccctataccagagcagagcatggtccaaatggtgtgccatctgttggagtgtttgctgaccactgaagacattcctgccgactgtccgaaagagatatatgaacactattttgtgttcgcagcaatttgggcctttggaggggctatggtgcaagaccagttggtggactatcgcgctgagttttcaaagtggtggctcaccgagtttaaaaccgtcaagttccctagccaggggacaatcttcgactattacatcgaccccgaaacaaagaaatttgagccttggtctaagctggtaccccagtttgagttcgatcctgagatgcctttacaagcctgtcttgttcatacctctgaaaccatccgggtgtgctattttatggagcgcttgatggctcgtcagcgaccagtgatgttggtggggacggccggaaccgggaaatccgttctcgtgggagcaaaactcgcctctctggacccagaggcatacctggtcaaaaacgtgccgttcaattattacaccacctctgccatgcttcaggccgtcttggagaagcctctggaaaagaaggccggacgcaactatggccctccaggaaataagaaactgatttacttcattgatgatatgaacatgcccgaagtggacgcctacgggaccgtgcagccccacaccattatcaggcaacacttagattatggccattggtatgatagaagcaaactgagtctgaaagagatcactaatgtccagtacgttagctgtatgaacccaaccgccggatcattcacgataaatccacgattacaacgacatttctctgtgtttgtgctgtccttccccggagcggacgcgctgtccagcatctactccattatacttacccagcaccttaagctgggtaattttccagcatcacttcagaaatcaatcccacctctgatagacctagctctcgccttccaccaaaagatagccacaacattcttgccaaccggcattaagtttcactatatcttcaacctgcgggattttgcaaacattttccaaggcatcctcttcagctcggtggaatgcgtcaagtccacgtgggatctgattcggctgtatctacatgagtctaaccgtgtttatagggacaagatggttgaggaaaaggatttcgacctgtttgacaaaatccagacagaggtgctgaagaaaacatttgacgatatcgaggacccagtggagcagacgcagtcacccaacctctattgtcactttgctaacgggattggtgaacctaagtacatgcccgtccagtcttgggaattgctgacacagactctggtcgaggccctcgagaatcacaacgaagtgaacacagtgatggaccttgtgctgttcgaggatgcgatgaggcatgtatgccatattaatcggatcctggaaagtccgagaggcaatgcgctcttagtgggggtgggaggatcagggaagcagagcctgacccgcctggccgctttcattagttcaatggacgtgttccagatcacactcaggaagggctaccaaatccaagactttaaaatggatttggccagcttgtgcttgaaagctggcgtgaagaatctaaataccgttttccttatgaccgatgctcaggtggcagatgaacgatttctcgtgctcataaatgatttactagcgagcggcgaaatccccgatctgtactccgacgacgaggtggagaatattatttctaatgtccggaacgaagtcaagagtcagggccttgtggacaacagggaaaattgctggaaattcttcatcgaccggattcgaaggcagctgaaggtgacgctctgtttctcgcctgttggcaataagctgcgcgtgagaagtcgaaaatttcctgcgattgtaaactgtaccgccatccattggtttcatgagtggcctcagcaggcacttgagagtgtgagtctccggtttcttcaaaacactgaagggattgaaccgacagtcaaacagtccatatcaaagttcatggcctttgtgcacaccagcgtgaaccagaccagtcagtcctacctttccaatgagcagcgatacaattacactactccaaagagctttcttgagttcattaggttgtatcagagtctactccaccgccatagaaaggagttaaagtgtaagacagagcgtctggagaatggcctcctcaaactacatagcactagcgcgcaagtcgacgacctgaaggccaagttggccgctcaggaagtggagctcaagcagaaaaacgaggatgctgataagctgattcaggtggttggtgtggaaaccgataaggtatcccgcgagaaagcaatggcggacgaggaagaacagaaagtggcagttattatgttggaagtgaagcagaaacagaaagattgcgaagaggatctggccaaggccgaacccgcactgacagccgctcaggcggcactcaacacactgaacaagaccaacctgactgagcttaagagttttggctctccacctcttgcggtgtcaaatgtgtcggcagctgtgatggtgcttatggcgcctcgaggtagggtgccaaaggacagaagctggaaggccgcaaaggtgaccatggcaaaggtggacggcttcttggacagccttatcaatttcaataaagagaacattcatgaaaattgcctcaaggccatacggccatacctccaggatcccgagttcaaccctgagttcgtcgcaaccaagtcctacgccgctgcaggtctttgcagttgggtcataaatatcgtgcgcttctatgaggttttctgcgacgtggagcctaaaagacaggccctgaataaggccacagccgacctcacagctgcgcaggagaagctggctgccatcaaagcaaaaattgcacacctgaatgaaaatctcgctaaattaaccgctaggttcgaaaaagccacggcagacaaactgaaatgtcagcaagaggcagaagtaaccgccgtgaccatctccttggccaatcggctggttggtggcctcgctagtgaaaatgtacggtgggcagatgccgtccagaactttaaacagcaggaacgaaccctgtgtggagatatcctgctcattaccgccttcatttcttacctgggttttttcaccaagaaatatcggcagtccctcctggatcgaacctggcgcccatacctgtctcaacttaagacccctattccagtaacacctgccctggacccactgagaatgttaatggatgatgccgacgtagctgcatggcaaaacgagggcctccccgcagatcggatgtcagtcgaaaacgccactatcctgatcaactgcgagagatggcccttgatggttgatccacaactgcagggcattaagtggatcaagaataaatacggcgaagaccttagagtgacccagatcggacagaaagggtatctgcagattatcgagcaggcattggaggctggcgctgtggttctcatcgagaatctcgaggaatccatcgatccagtactggggcctctcctcggcagagaggtcatcaagaaaggcagatttatcaaaattggagataaggaatgcgagtacaatccaaagtttcgcttgatccttcacacaaagcttgcaaaccctcattatcagccagaattacaggctcaggcaacccttatcaacttcactgtaaccagagatggcctcgaggaccaattgctcgccgctgtggtgtcaatggaacggcctgatctggagcagttaaagagtgacctgaccaaacagcagaatggcttcaaaatcacactgaaaacattagaggattcactgctttccaggctgagtagtgcttctggaaattttctgggcgaaaccgtcttggtggagaatctcgaaatcacaaagcagacggctgctgaagtcgagaagaaggtgcaggaagccaaggtgactgaggtgaaaattaatgaagccagagaacactaccgaccggcagccgctagggccagtctgttgtactttatcatgaatgacctcagtaagattcacccaatgtatcaattttcgttaaaggcgttctccatcgtgttccagaaggcagtcgagagggccgctccagatgagagcttgcgggagagggttgctaacttgattgatagcatcaccttttccgtttaccagtacactattcgtggactcttcgagtgcgataaactcacttacttagcccagctcactttccaaatactgttgatgaaccgagaagtgaacgctgtcgagctggacttcttactacgcagccctgttcagactggcaccgcgtcgcccgtggaattcttaagtcatcaagcctggggggcagtcaaagtgctctcgtctatggaagagttttcaaaccttgaccgggatatagagggttcagccaagagttggaaaaagttcgtggagtcagagtgccctgaaaaagagaagctgccccaggagtggaagaataaaaccgctctgcaaagactgtgtatgctgcgggctatgcgcccagatcggatgacatacgcactgagagatttcgtggaagagaaattagggagtaaatacgtagtgggaagggctctggattttgccaccagctttgaggagtccggtcccgcaactcccatgttctttatcctgagccccggagtggaccctctgaaggacgtagagagtcaggggaggaaactcggatataccttcaacaatcagaacttccacaacgtgtctttaggccagggccaggaggtagtggcagaagcagctcttgacctggcagcaaaaaaaggccattgggtaatcctccaggatacactcgagatgtgctcacgagagactgaatttaaatccattcttttcgccctgtgttattttcatgccgtggtcgcagaacgtaggaaattcggaccccaaggttggaatagaagctacccatttaacacaggcgaccttaccatttctgttaacgtgctgtataactttctagaagcaaacgcaaaggtgccctacgatgacctccggtaccttttcggggaaattatgtatgggggtcacataacggatgactgggaccgacgcttgtgccgaacctatctgggggaattcatcaggcccgagatgctggagggcgagctcagcctggcacctgggttccccctgcctggtaatatggactacaatgggtaccaccagtatatcgatgctgagttgccaccagagtccccatacctgtacggtctgcatccgaacgccgaaatcggcttcctgacacagaccagcgagaaattgttcagaaccgttttagagctgcaacctcgggacagccaggctcgtgatggggctggagctacacgggaggagaaggttaaagctttattagaggagatcctggaaagagtcaccgatgagttcaacattcccgagctgatggcaaaagtggaagagcggacaccttacatcgttgtagcctttcaagagtgtggcaggatgaatatcctaactagagagatacagagaagtttaagggaacttgagttggggctgaagggagaactcaccatgacctcccatatggagaatctgcagaatgcgttatatttcgacatggttcctgagtcctgggccagacgggcatatccctccacagcaggcctagcagcctggttccctgatctgctaaaccggattaaggaacttgaagcctggaccggtgacttcactatgcccagcactgtgtggcttactggcttctttaacccccaatccttccttacagctataatgcagagtaccgctagaaagaacgaatggcccctggatcagatggcgctgcagtgcgacatgactaaaaaaaatagggaggaattccgatcgccacccagagaaggagcgtacatacacggcctatttatggaaggcgcatgctgggacacgcaggctggaatcatcactgaagctaaactcaaagaccttaccccccctatgccggttatgttcatcaaggccatacccgctgataaacaagactgccgcagcgtgtattcctgccccgtatataagacttcacagcgtggtccaacttacgtatggacattcaatcttaaaacaaaggaaaacccaagcaaatgggttctggcaggtgtcgcactgctcttacagattta

SEQ ID NO: 221451 - DNA, 13233 bp, Artificial Sequence
  Description of Artificial Sequence: Synthetic coding sequence
atgaggctagcagaggaaagggcggcattggctgcagagaacgccgacggcgagcccggagccgaccggagactgaggttgctgggcacctacgtcgctatgagcttgaggccagctgcgggtgcatgggagagatgtgctggaagcgccgaggctgagcaattgttacaggcctttcttggcagagatgccgctgagggccctcgacccctgctggtcgtccgccctggccctagggggctggccataaggccagggttggaagtcgggcctgaatccggtttggcaggagccaaggcgctgtttttccttagaaccgggcctgagcccccaggacctgacagctttaggggcgctgtggtctgcggtgatttacccgctgcacctcttgagcatcttgccgctctgttctccgaagtggtacttccagtcctggctaatgagaagaataggctgaactggccacatatgatttgtgaggacgtgaggaggcacgcccacagcttgcagtgcgacctgagcgtgatcttggaacaggtgaagggcaagaccctgttacctttacccgctggatccgagaaaatggaatttgctgacagtaagagtgagacagtgctggactcaatcgacaagagtgtgatatacgctatcgaatctgccgtcattaagtggagttatcaggtgcaggttgtcttaaaaagggagagctctcagccactgcttcagggcgaaaatcctaccccgaaagtggagctcgagttttggaagtcgcggtacgaagatctgaagtatatctataaccagctgcggaccatcaccgtgcgcggtatggccaaactgctggataaacttcagtcatcatatttccccgctttcaaggcaatgtaccgcgatgtcgtggcggctctcgccgaggcccaggatattcatgtccatctcataccactccagcgccacttagaggcgctggaaaacgcagagttccctgaggtaaagccccagctgaggccattacttcatgtcgtgtgcctcatttgggccacttgcaagtcataccgctcacctggcaggctaaccgtcctgctgcaggagatctgcaacctgttgatacaacaggcctccaattatctctcgccagaggacctgcttagaagcgaagtggaggaaagtcagcggaagctgcaggttgtgtctgacacactgtcttttttcaaacaagagttccaagacaggagagaaaaccttcatacctacttcaaggagaaccaggaggttaaggagtgggatttccaaagtagtttggtttttgtaaggctcgacggctttctgggacagcttcatgtggtggaagggctgctcaagaccgctctggacttccacaagctgggcaaggtggaattctcgggagttaggggtaatgctctcagccagcaggttcagcagatgcacgaggaatttcaggagatgtatagattattgtctggctctagcagcgattgcctttatctccagtcaacagatttcgaaaacgacgtgagcgagttcaatcaaaaggtggaagacttggatcggagactgggtaccattttcattcaggcattcgacgacgctcctgggctggagcacgcgtttaagctcctggacatcgccggtaaccttttggaaaggcccctcgtcgcgcgagacacctctgataagtacttggtgctcatccagatgttcaacaaggacctggacgccgtgcgtatgatttactcacagcacgtgcaggaagaggcagagctagggttttcaccagtgcacaaaaatatgcccaccgtcgccggtggcttgcgttgggcccaggaattacgtcaacggattcagggtccattctccaactttgggcgaattacgcacccatgcatggaatccgccgagggcaagagaatgcaacagaagtatgaggatatgctatcgttgcttgagaagtatgagactcgactgtatgaagattggtgtagaactgtctccgagaagtcgcagtacaatttgagccagcctctactcaagcgtgatcccgagaccaaagaaattactatcaatttcaatcctcagctcatttcggttctcaaggagatgagttatttggagccgagggagatgaagcacatgcctgaaactgccgctgctatgttcagctctagagacttttataggcagttggtagccaatttggagctgatggctaactggtacaacaaagtgatgaagaccctgctggaggtggagtttccgctggtagaagaagaactccagaatattgatcttaggcttagggccgcagaagagactctcaattggaagacagagggaatctgtgattacgtcaccgagatcacatctagcattcatgacctagagcagcgcattcaaaagacaaaagataatgtggaggaaattcagaacattatgaaaacatgggttaccccaatattcaagacaaaagacggcaagcgcgaaagcttgctctcattggatgatcgccacgaccggatggaaaaatattataaccttattaaggaaagtggcttaaagatacacgctctggtccaagagaacctggggctcttttctgcagacccaacctccaatatttggaagacctatgttaacagcatagataatcttctgctcaacgggttcttcctggctatcgagtgttccctgaagtacctcctggagaataccgagtgtaaggctggtttaacgcccatctttgaggctcagctctccctggcaattcctgagttggtcttctaccctagtcttgagtctggcgtgaagggtgggttctgcgatatcgtcgaagggctcatcacttctatttttagaatcccctcattggtgccgagactcagcccccagaatggctccccacactaccaggtggatctcgatggcatcccagacctggccaatatgcggagaactctgatggagcgagtccagcgcatgatggggctgtgctgcggttaccaatcaacattcagccagtattcttatctctatgtggaggaccggaaagaagtactggggcagtttttgctctacggccacatcctgacccccgaagaaatcgaggatcacgttgaggacggcattcctgagaatccacccttactttcccagtttaaggtgcaaatcgactcctatgaaactttgtacgaggaggtgtgccgcctggagcctattaaggtgttcgacggttggatgaaaatcgacatcaggcccttcaaagcctctctcctgaacattattaaacgctggtctctgttgttcaaacagcatctcgtcgaccacgtaacacacagcctcgccaaccttgacgctttcattaagaaaagcgagagcgggttgctgaagaaggtggagaaaggcgactttcagggattggtggagatcatgggtcacctgatggcagtgaaggagcgtcagtccaatacggatgagatgtttgaacccctcaaacagacaatcgagctcctgaaaacatacgaacaagagttgccggaaaccgtgttcaagcagttggaagagctgccagagaaatggaataacatcaagaaggtagccattactgtgaaacagcaggttgcaccgctgcaagctaacgaggtcacactgctgcgtcagaggtgtactgcctttgacgctgaacagcagcaattttgggagcaattccacaaggaggcacctttcaggtttgacagcatacaccctcatcaaatgctggatgcacggcatattgaaattcagcagatggagagcactatggcctcaataagcgaaagtgcatctctgtttgaagtaaacgtccccgattataagcagctgcgacagtgccggaaagaagtgtgtcagctgaaggagttgtgggacaccattggcatggtgacttcaagcatccacgcgtgggaaaccacgccttggcgcaacattaacgtggaagctatggagctcgaatgtaagcagtttgctagacatatccgcaacctggacaaagaggtgcgggcttgggacgcattcaccggcctcgagtctaccgtgtggaacacattatcaagcttaagggccgttgccgagctacaaaaccccgcaatccgggaaaggcactggagacaattgatgcaagctactggggtgagcttcaccatggaccaagacacaaccctggcgcatttactccagcttcagctgcatcactacgaggatgaagtaaggggaatcgtggataaagccgctaaagagatggggatggagaagactcttaaggagctgcagactacttgggcagggatggaattccaatatgaacctcacccacgcacgaatgtgcctctgttgtgttcagacgaggatctgatcgaagttctggaggacaatcaagtccagcttcaaaatctagtaatgagtaagtacgtggcctttttccttgaggaagtcagtgggtggcagaagaagctgagtactgtggacgccgttatctctatctggtttgaggtccagagaacgtggacccatctcgagtcaatttttaccgggagtgaggatattcgagcacagttaccacaagacagcaagcgattcgaagggatagacatagacttcaaggagctggcctatgatgcacaaaaaattccaaacgtggtgcagacaactaataagcccggactctatgaaaaactggaggatattcaaggtcgcttatgtttgtgtgaaaaagctctcgccgaatatttggatactaaaagattagcctttccccgattttacttcctctcctctagcgacctgctggacattctgagcaatgggactgctccccagcaagtacagaggcatctgtcaaagctgttcgacaacatggctaagatgaggtttcagctagatgctagcggcgagcccactaaaacctcactgggtatgtacagcaaggaggaggagtacgtggctttctcagagccctgtgactgttccggacaagtggagatctggcttaaccacgtgcttggtcacatgaaggccaccgtccgtcacgagatgaccgagggtgtgacagcctacgaggaaaaaccaagggagcagtggctatttgatcatcccgctcaagtggccttgacctgtactcagatctggtggacaacagaagtgggaatggcatttgccaggctcgaagagggctacgagtcagctatgaaagattattacaaaaaacaggtggcccaactgaaaactctcattactatgctcattggacagctctccaaaggcgatcgccagaaaatcatgacaatctgtacaatagatgtccatgcacgcgacgtggtggccaaaatgatcgcacaaaaagtagacaacgcccaagcttttctttggctgagccagctgcgacatcgatgggatgacgaggtaaaacactgttttgccaatatttgtgatgcccagttcctttattcgtacgagtatctcggtaacactcccagactagtgataacaccactgaccgatcggtgctatattactctgacacagtctttgcacctgactatgtcgggcgctccagccggaccagcagggaccggtaaaacggagactaccaaagatcttgggcgagcccttggaatcctggtctacgtattcaactgcagcgaacagatggattataagagctgcggaaacatctacaagggcctggcccaaaccggggcttggggttgttttgacgagttcaaccggatatcggtcgaggtattgagcgttgttgctgtgcaggtcaaatcgatccaagatgcaattagggataaaaagcagtggttttctttcctgggggaggagatttccttgaacccatcagtgggcatatttataaccatgaatcctggatacgccggtcggaccgaactcccagaaaatcttaagagcctgttcagaccctgcgccatggtggtccctgattttgagcttatctgtgaaatcatgctagttgcagagggattcatcgaggcccaaagcttggcccgaaagttcatcacactgtaccagctgtgtaaagaactcctatccaagcaggatcattacgattggggccttcgcgcaataaaaagcgtcctagtggttgccggaagcctgaaaagaggagaccctgatagacccgaagatcaggtcttgatgagatctttacgcgattttaatatccccaagatcgtaacagatgatatgcctatttttatggggctgatcggcgacctgtttccagccctggatgtgcctcgccgacgcgatcccaactttgaggccctggtcaggaaagcaattgtcgatttgaaactgcaagctgaagacaattttgtgctaaaagttgttcagcttgaggagctgctggccgtccgccactccgtattcgtcgtggggggagccggaaccggcaaatcgcaagtgctacgtagcctgcataaaacttaccagattatgaagcgacggccagtgtggaccgacctaaatccaaaagcagttacaaatgacgaactattcgggatcataaatcccgctactggagaatggaaggatgggttattttccagcattatgcgcgagctggctaatattactcatgacgggcctaagtggattctgctcgatggggatatagaccctatgtggatcgaaagcttaaatacagtcatggatgataacaaggtgctcactctcgcaagcaacgagcgcattccccttaatccaactatgaaactcctgttcgagatttcccatctccggacggctaccccagctactgtttccagagccggtattctgtacataaatccggctgaccttgggtggaacccccctgtctcatcttggattgaaaagcgagaaattcagacagaacgggcaaatctcaccatcctgttcgataaatatcttccgacgtgtctggatacgctccgaacacgatttaagaagatcatccctatccccgagcaaagcatggtgcaaatggtatgccacctgctggagtgtctgctcaccaccgaggatatccctgctgactgtccaaaggaaatatacgagcactacttcgtgtttgccgctatttgggccttcggtggtgctatggtccaggaccaattagtcgactatagagcagagttttcaaagtggtggctgacggaatttaagacggtgaagtttccttcccaaggcaccattttcgactactacatagatccagagacaaagaaatttgagccatggagtaaactagtgccacagttcgaatttgatccagagatgcccctccaagcttgcttggtacacacttcagagaccatcagggtgtgctatttcatggaacggctcatggctcgccagagacccgtaatgcttgtggggacggcaggaactggtaaaagtgtgctcgtcggcgctaagctggcgagtctggatcctgaggcttatcttgtcaaaaatgtgccatttaactactacacaacatctgccatgttacaagcagtgctagaaaagccactggaaaaaaaagcgggaagaaattatggccctccaggaaataagaagctgatctacttcattgacgatatgaacatgccagaggtcgacgcttacggcaccgtacagcctcacaccattatccggcagcatctggattatggacactggtacgatcgctcgaagttaagcctcaaggagatcactaacgtccaatacgtgtcctgcatgaatcctacagctgggagcttcactattaaccccagactgcaaaggcacttttcagtgttcgtactctctttccctggcgctgatgcgctttcctcgatttactcaataattctgacccagcacctgaagttggggaacttccccgcatcgttacagaagtctattcctcccttaatcgatcttgccctggcgtttcaccagaagattgccaccactttcttgccgacaggaatcaaattccactatatctttaacctcagagattttgctaacatttttcaaggaatcttgttctcttccgtcgagtgtgttaagtcgacctgggacttaatccggttgtatcttcatgagtccaaccgggtgtaccgggacaaaatggttgaggagaaggattttgacctgttcgacaagattcagaccgaggtactgaagaagaccttcgatgacattgaggatcctgtggaacagacacagagccctaatctgtactgccattttgctaacggaatcggtgagcccaagtacatgcccgtgcagtcctgggaactgcttacccagactctcgtggaagctttggaaaatcacaacgaggtgaacacagtcatggatttagtattgtttgaggacgccatgaggcacgtgtgccacatcaatcgaatcctcgagagtccgagaggcaatgcactgttagtgggggttggcggttctgggaaacagagcctgacccgactagccgcttttatttcttcaatggatgtcttccagattacattacgaaaaggttatcagatccaggatttcaagatggacctcgcctctttgtgtctgaaagccggagtgaagaatctgaataccgtctttttaatgactgatgcacaggttgctgacgaaagatttctggtcttaatcaacgatctgttagcaagcggagaaatcccagacctgtatagcgacgatgaagtagagaatataatctccaatgtgaggaacgaggtcaagagtcaggggctggtggataaccgggaaaactgctggaagtttttcatagatagaatccgtagacagctaaaggtgaccctttgttttagccctgtaggaaacaagctccgagtgcgaagccggaagttccctgccatcgtgaattgtaccgcaatccattggtttcacgagtggccccagcaggcccttgagagtgtatcactcagattccttcagaatacagagggaatcgaacccacagtgaagcagagtatcagcaagttcatggccttcgtccacacttccgtgaaccagacttcccagtcgtacctgtctaatgagcagcgctataattatacaactcctaagtcctttttagaattcatccggctttatcagtctctgctgcacagacatcggaaagaattgaagtgcaaaaccgagcggttagagaatggtttgttgaaactgcacagtaccagcgcccaggtcgatgacctcaaagcgaagttagctgcgcaggaagtcgagcttaaacaaaagaacgaggacgccgataagctcatccaggtagtcggcgttgagacagacaaagtcagtcgggaaaaggcaatggcagacgaggaagaacaaaaagtggcagtgattatgctcgaggttaagcagaagcaaaaggactgcgaagaggacctagcgaaagccgaacctgccctcaccgcggcacaggctgcgttgaataccctgaacaaaaccaacctcaccgagcttaaatcctttgggagtcccccattagctgtttccaacgtcagtgccgcagtgatggtactcatggccccaaggggtcgcgtccctaaggacagaagctggaaagcagccaaggttactatggccaaagtcgacggcttcctggattctctgatcaacttcaacaaggaaaacattcatgaaaattgcctgaaggcgatcagaccctatctccaagatcctgagtttaatccagaattcgtggccacaaaatcctacgcagctgctgggttgtgttcctgggtgattaatatcgttaggttttatgaggtgttctgtgacgtggaacctaaacggcaggccttgaataaggcaaccgctgacttgacagctgcccaggagaaactggcagccattaaggccaaaatagcacatctgaacgagaatttagctaaattgaccgctagatttgaaaaagcaacggcagacaaactgaaatgtcagcaggaggccgaggtcactgccgtcacgattagcttggcaaatagactcgtaggcggactcgctagtgaaaatgtaaggtgggccgatgctgtgcagaatttcaagcaacaagaacgcactctgtgcggagacatcctgctgatcaccgcctttataagctatctggggttctttacaaagaagtacaggcagtccctgctggataggacttggcggccttatctgtctcagctgaaaacccccatcccagtgacccctgctttggacccactgagaatgctcatggacgacgctgacgtcgccgcatggcagaatgaaggacttcctgcagatagaatgtcggtcgaaaacgcaacgatcctgatcaattgcgaaaggtggcctctcatggtcgatccccagttacagggcatcaaatggataaagaacaagtatggagaggatttaagggttacgcaaatcgggcagaaaggatacttacagattatagaacaggcccttgaggcaggggctgtggtgcttatcgagaacctggaagagagcatcgaccccgtgctgggtccactgttgggtcgggaggtgatcaaaaaggggagatttattaagatcggcgacaaggagtgcgaatacaacccaaagtttcgactgatcttacacactaagctggccaacccccattatcagccagagcttcaggctcaagctaccctgatcaattttaccgtaacgcgtgacgggctggaggatcagttactagctgccgttgtgagcatggaacggcctgatctggagcagctgaagtccgatctcactaagcagcaaaacggcttcaaaatcacactcaagaccctggaggattcactcctttcacgtctcagtagcgccagtggcaatttccttggagagactgtgctggtcgagaaccttgagatcaccaaacagacagctgcagaggtcgaaaaaaaggtgcaagaggccaaagttaccgaggtgaaaatcaatgaagctcgggagcattatcggccagctgctgctcgcgctagcttgttgtacttcattatgaacgacctgtctaaaatccacccaatgtatcaattcagcctcaaggctttcagcatcgtgtttcagaaggcagtcgagcgagctgccccagatgaatcattgcgagagagagtcgccaatctcatagacagcattacatttagtgtgtatcagtatacgatcagagggctgttcgagtgcgacaaactgacttaccttgcccagctcacattccagatcttactcatgaatagggaggtgaacgcagtcgaactcgatttcttgctgagatcgcctgtgcagaccgggacggcttcacctgtggagttcctaagccaccaggcctggggagcggttaaggtgctatcgtccatggaggaattttcgaacttagatagggatatcgaaggctctgccaaatcatggaaaaagttcgttgagagcgagtgccccgagaaagagaaattgccacaagagtggaagaacaaaacagctctccagcgattgtgcatgctgagggccatgaggcccgacagaatgacctacgcgctcagagactttgtcgaggaaaagctgggaagcaagtacgtggtaggacgcgcactggattttgctacttcttttgaggagagtggccctgcaacacctatgttttttatattgtctccaggtgttgacccattaaaagacgtggagtctcaaggaagaaaactgggatacactttcaacaatcagaatttccacaacgtgagcctggggcaaggacaggaagtggtggctgaggccgctctggatctggccgcaaagaaaggacattgggtgatcctgcaggatactctggagatgtgcagccgtgagacggaattcaaaagtatccttttcgcattatgctatttccatgcagtggtcgcagagcgtaggaaattcggccctcaagggtggaacagatcctatcccttcaacacgggggaccttacaattagtgtgaatgtgctgtacaactttctggaggcaaacgctaaggtcccctatgatgatctgcgttacctctttggagagattatgtacggagggcacattaccgatgattgggacagaagactgtgtcgcacatatctgggcgaatttattaggcccgaaatgctggagggggaactatccttggctccagggttcccattgcccggaaacatggattacaatgggtatcaccagtatattgacgccgaactgcctcccgagagcccctatctatacgggctgcacccaaatgctgaaattgggttcctcacccagacctccgagaaacttttccgcactgtactggaacttcagccacgggattcccaggctagggatggtgcaggggctactagagaggagaaggtgaaggcattattagaggagatccttgagagagtgacagatgaattcaatatcccagagctgatggctaaagtggaagaacggaccccgtatatagtggtcgccttccaagaatgcggacgaatgaacattctcaccagagagatccaacgtagtctgagagaacttgagctaggacttaagggcgaattgacgatgacatcgcacatggaaaatctccagaacgctttgtatttcgatatggtgcccgaaagttgggcaagaagagcatacccttccactgccggtcttgccgcatggtttcctgacctcctgaacaggattaaggagcttgaggcctggactggtgactttactatgccaagcacggtatggttgactggcttttttaacccgcaaagctttctgacggccattatgcaatccactgcccgaaaaaacgagtggcccctcgaccagatggcactgcagtgtgatatgacaaagaaaaatagggaagagttcaggtcaccacctcgggagggcgcatatatacacggccttttcatggaaggtgcttgctgggatacacaagccggtattatcaccgaggcaaagcttaaggatctgacccccccaatgcccgttatgttcataaaagctattccagctgataaacaggactgcagatctgtgtatagctgtccggtctacaagacatctcaacgcggaccaacctacgtctggacttttaaccttaaaaccaaggagaatccctccaagtgggtcctggccggagttgctctcctgcttcagatttaa

SEQ ID NO: 221452 - DNA, 2100 bp, Artificial Sequence
  Description of Artificial Sequence: Synthetic coding sequence
atgatacccgctagcgccaaagctccacataagcagccccacaaacagtctatttccatcggtaggggaaccaggaagcgggatgaggattcaggcactgaggtaggcgagggtactgacgagtgggcgcagagcaaggcaaccgtgcgtcctccggatcagctcgagctcacggacgccgagttgaaggaagagttcacacgtatcttgacggctaacaatccacatgcccctcaaaatattgttaggtattcatttaaggaaggaacttataaacctatcggttttgttaaccaactggcagttcactatactcaggtaggaaacctcatccccaaggattctgacgagggacgacggcagcattatagagatgagttggtggctggctcacaggagtccgtcaaagttattagcgagaccggtaatctggaagaggacgaggagcctaaggagctggaaaccgaacctgggagccagaccgatgtcccagccgctggcgctgctgagaaagtgactgaggaggagctaatgaccccaaagcagcccaaagaacgtaaactcactaaccagttcaatttctctgagagagcatcccagacttacaataatccagtacgggacagagagtgccagactgaacccccaccaaggactaacttttctgcaaccgctaatcagtgggaaatctatgacgcctacgtcgaggagctggagaagcaggagaagactaaagagaaggagaaggcaaagactcccgtcgcaaagaaatctgggaaaatggcaatgcgcaagttgaccagcatggagtcacaaactgacgacttgatcaagctgtctcaggccgctaagatcatggaacgcatggtgaaccaaaatacctacgatgatattgctcaggactttaagtactatgacgatgcagctgatgagtatagggatcaagtgggaaccctgctgcctttatggaaatttcagaacgacaaggctaagagactgtctgtcaccgcgctttgctggaaccctaagtacagggatttgtttgctgtcggctatggatcttatgacttcatgaagcaatcccggggaatgttgctgctgtacagcctgaaaaatccaagcttcccagaatatatgttttccagcaactccggtgtcatgtgtctggacatacacgtggatcatccctaccttgtcgctgttggacactatgacggtaacgtcgctatctataatctgaaaaagcctcattcacagcccagtttttgctcctccgctaaatcaggaaaacattccgaccctgtctggcaggttaagtggcaaaaagatgacatggaccaaaacctgaacttcttttctgttagcagcgatggcaggattgtctcttggacactagtcaaaagaaagctagttcatatcgacgtaattaagctcaaggtggagggctcaacaactgaagtacccgaggggctccagttgcaccccgtgggctgcggcacggcatttgattttcataaggaaattgattatatgtttttggttggcaccgaagagggtaaaatctataagtgctctaaaagttattcttcccagtttttggatacttacgatgcccataatatgagcgtggataccgtctcatggaacccttaccatacaaaagtctttatgtcatgctcctctgattggaccgttaaaatatgggatcacacaattaagacacctatgttcatttacgacctaaatagcgctgtcggggacgtggcctgggctccctactcctcaactgtgttcgccgctgtgaccaccgatggaaaggcccacattttcgatctggctatcaataaatacgaggcaatctgtaatcagccagtggcagccaaaaagaatcggcttacgcacgtgcagttcaatctgatccatccaatcattatcgtcggggatgacagggggcacataatctctctgaaactgagtccgaacctacggaaaatgcccaaagagaaaaagggtcaagaggtgcaaaagggtccggcagttgaaatagcaaagctggacaagctgcttaacctcgtcagggaggttaagattaaaacctag

SEQ ID NO: 221453 - DNA, 585 bp, Artificial Sequence
  Description of Artificial Sequence: Synthetic coding sequence
atggaccagaaccttaactttttcagcgtctcatccgacggcaggatagtgtcctggacgctggtcaaacggaaactggttcatatcgacgtgattaagctcaaagtcgaaggatcaacgactgaggtcccagagggactgcagcttcatccagtcggttgcggaactgctttcgacttccataaggagatcgactatatgtttttagtggggaccgaagaaggcaagatctataagtgttctaagtcctacagctcccaattcctggacacgtatgatgcccacaatatgtcagtggatactgtgagctggaatccatatcatactaaagtttttatgagctgctcttctgattggaccgtaaaaatttgggaccataccattaagaccccgatgttcatctacgacttgaactccgccgtgggcgatgtggcttgggccccttatagtagcacggtgtttgcagccgtcaccacagacggcaaagaaaaaaagggccaggaagtgcaaaaggggccagcggtggagattgccaagctggacaaactgctgaacctggtcagagaggtgaaaatcaagacatag

SEQ ID NO: 221454 - DNA, 870 bp, Artificial Sequence
  Description of Artificial Sequence: Synthetic coding sequence
atgatccccgcatctgccaaggcaccgcacaaacagccccacaagcaggatgaggatagcggaacagaggtgggggaagggaccgatgaatgggcacagtccaaggccactgttcgacctcctgaccagcttgagttgacagacgcagagctcaaggaggagttcacacggatactaactgctaacaacccgcacgccccacagaatatcgttcgatattcattcaaagaaggcacttataaacctatcggctttgtgaaccagcttgccgttcattatacacaggttggcaatctgattcctaaagattctgacgaaggacggagacaacattatagagatgagctggtggctgggtcccaagagtcagtaaaggtgattagcgagaccggcaatctggaagaagatgaagaacccaaggagttggaaaccgaacctggatcacagaccgatgtccctgccgcaggcgctgctgagaaggtgactgaagaagagctaatgacgccgaagcagccaaaagagcggaaacttaccaaccaattcaatttctcagaaagagcttctcagacgtacaataatcccgtgcgcgatcgcgagtgccaaacagagcccccacccagaacaaatttcagtgccacagcgaaccagtgggaaatttacgatgcatacgtggaggaattggagaagcaggagaagaccaaagaaaaagagaaagccaagaccccggtcgctaagaagtcaggaaaaatggcgatgaggaaactgacttccatggaaagtcagaccgatgatctgattaagctctcccaggccgcaaagatcatggaacgtatggtgaaccagaatacctatgacgatatagcacagtag

SEQ ID NO: 221455 - DNA, 870 bp, Artificial Sequence
  Description of Artificial Sequence: Synthetic coding sequence
atgatccctgcttccgccaaagccccacataaacagcctcacaaacaggacgaggacagcgggacggaggtcggcgaggggactgatgaatgggcccagtccaaagccacagtgagaccgcctgatcaattagaactgacagacgccgagcttaaggaggagttcacacggatcctgaccgccaacaacccacacgcccctcagaacatcgtgcgatatagcttcaaggaaggcacatataagccgatcgggtttgtgaaccagttggccgttcactatactcaggtgggcaatctgatccccaaagattccgatgagggcaggaggcagcattatcgggacgagctggtggcaggatctcaggagtcagtcaaggttatcagtgagaccggaaacctcgaggaagacgaggagcccaaagagctcgaaaccgaacctggatcccagacagacgtccctgctgccggtgctgccgaaaaagtgacagaggaagagctcatgaccccgaagcagccaaaagaacgtaaactaactaatcaatttaacttctctgaacgtgcatcccaaacttataataaccccgtcagagatcgtgaatgccagacagaacccccaccaaggacaaactttagtgccacagcgaaccagtgggagatctacgacgcctatgtagaggagctggagaagcaggaaaagactaaggagaaagaaaaggcgaaaacaccggtagcaaagaaaagtggcaagatggctatgcgcaaactgacttctatggagtcccagaccgacgatctgattaagctgtcccaggccgctaaaatcatggaaaggatggttaatcagaatacttatgacgacatagcccagtag

SEQ ID NO: 221456 - DNA, 429 bp, Artificial Sequence
  Description of Artificial Sequence: Synthetic coding sequence
tagtgcggaacagccttcgacttccacaaggagatcgactacatgttcttagtcggtacggaggaaggaaaaatatacaaatgtagtaaaagttactcctcccagttcctggatacatatgacgctcacaatatgagtgtcgacaccgtcagttggaacccgtatcatactaaggtctttatgagctgctcctctgactggacagtaaagatctgggaccataccatcaagacacctatgttcatctacgatctgaatagcgcggttggggacgtggcttgggccccatactctagtaccgttttcgcggctgtcacaaccgacggtaaggagaaaaagggccaggaggtgcagaagggccctgccgtggagattgcaaagctggacaaactcttaaacttagtgcgcgaggtgaagatcaaaacctag

SEQ ID NO: 221457 - DNA, 507 bp, Artificial Sequence
  Description of Artificial Sequence: Synthetic coding sequence
atgattcccgcaagcgccaaagcgccacataagcagccccataagcaaagtattagtatcgggagggggacccgtaagagggacgaagattcaggcactgaagtgggcgaaggcaccgatgagtgggcccaaagcaaggccaccgtcaggcccccagaccagctggaattaacagatgccgaactcaaagaggagtttactcggatactcaccgccaataaccctcacgctcctcagaacattgtgcgctatagcttcaagaagcagtggtccctcggcttcatcccaaagcttaagcggaaaatcccggtgaattattggggccaggatgaaggagaaatcagtaatgaaacggtccgtgtgatctactcactggggattttcattatgaaaatcgtgaccatcctcctgaacataaatatcgaacaccttttgtgcgtgcgccactgtgtgaatcgactgtttctgttgttcctgattttgattataatcatgcaaattcggtag

SEQ ID NO: 221458 - DNA, 1209 bp, Artificial Sequence
  Description of Artificial Sequence: Synthetic coding sequence
atgcgaacaactcttacaccctcatgctcctccgccctggacccccaggagataaaacgagcagcaactcacctatcctggcatccagacgggaaccggaaactggcagttgcctactcctgtctggactttcaacgagcaccagtggggatgtccagtgactcttacatctgggaccttgagaatcccaataagcctgagctggctcttaaaccatcctctcccctagtaacactggagtttaaccctaaagattctcacgtgctcctgggaggatgttacaacggccagatcgcttgctgggacaccaggaaaggtagcctggtggctgagctctctaccatcgaatccagccaccgagacccagtgtatggcactatctggctgcagtccaaaacagggacagaatgtttcagcgcctccacagacggtcaggtcatgtggtgggacattaggaaaatgagcgaaccaactgaggtggtgattctcgacattacaaagaaggaacagttggagaatgcgcttggtgccatcagcctggagtttgagtctactctgcccacaaagtttatggtggggaccgagcagggcatcgtcatatcatgcaaccggaaagccaaaactagtgcggagaagatcgtgtgcacatttccgggacaccacgggcctatctacgccttgcagaggaatccattttacccaaagaacttcctcaccgtgggagattggaccgccaggatctggtctgaagactcccgggaatcatccataatgtggactaagtatcacatggcgtacctgacggacgccgcttggtcccctgtgaggcccaccgtgttttttaccactagaatggatggaacgctggatatctgggactttatgtttgaacagtgtgacccgacactctcactcaaggtctgcgatgaagcattgttttgcctccgagtgcaggataatggatgcctgattgcttgcggttcacagctggggactaccacactccttgaggtgtcccctgggctgtctactctccagcggaacgaaaagaacgttgccagctccatgtttgaacgcgaaacaaggagggaaaagatcttggaagccaggcacagggagatgagactgaaggagaaggcggctaccaaatcccggagaaggccgggagggggtgggggacggggaagttcaggtgggcgtagaggctag

SEQ ID NO: 221459 - DNA, 1818 bp, Artificial Sequence
  Description of Artificial Sequence: Synthetic coding sequence
atggagattgtttacgtttatgtgaaaaagaggtccgagttcggcaaacaatgtaacttcagcgacaggcaggctgagctgaatatcgatataatgccaaaccccgaactggctgagcagtttgtggagcgcaaccccgtggacaccggaatacaatgctccatcagtatgtccgaacacgaggctaattcagagagatttgagatggaaacacggggtgtcaatcacgtggaggggggttggcctaaggacgtgaaccctctggagctggagcagaccatacgtttccggaagaaggtagagaaagacgagaattacgtgaacgccatcatgcagctgggttccatcatggagcattgcatcaaacagaacaacgccattgacatctatgaggaatatttcaacgatgaggaagcgatggaggtgatggaggaagacccctcagctaagactattaatgttttccgtgatccacaggagattaaaagggctgccacccatctgagttggcacccagacggcaatcgaaagctcgcagtagcctacagctgcttggactttcagcgggctcctgtcggtatgtccagcgacagttatatctgggatctggagaacccaaacaagccggagctggctctcaagcctagctcaccccttgttactttagagtttaaccctaaagatagccatgttctgctcggcggttgctataatggccagatcgcttgctgggatacacgaaaaggctcactcgtcgcagagctgtctacgattgagtccagccacagagatccagtgtatggtacaatctggttacagagcaagactggaacggaatgcttttctgcatccacagacggtcaggtcatgtggtgggatattcgcaagatgagcgagcctaccgaggttgtcattcttgatatcaccaagaaagagcagctggaaaacgctctgggggcaatctcccttgaatttgaatcaacgctgcccacgaagtttatggtaggcaccgagcagggcatcgttatcagttgcaaccgtaaagcgaagactagcgcagaaaagatagtctgtactttccctggccaccacggcccaatctatgccctccagcgcaatccgttctaccccaaaaacttcctaacagtaggagattggacggctcgaatttggagtgaggatagcagggagagctcaatcatgtggacgaagtaccatatggcttatctgactgatgccgcatggtctcccgttcgccctacggtgtttttcactaccagaatggatgggacactggacatatgggatttcatgtttgagcagtgcgatcccaccctgagcttgaaagtttgtgatgaagccctgttttgcctcagagttcaggacaatggttgtctcatcgcttgtggcagccagctcggcactactactctcctcgaggtttcacctggtcttagcacactccagagaaatgagaaaaacgtggcatcatccatgtttgagcgcgaaacccgtcgtgaaaagatcctggaagctaggcacagagagatgcggttaaaggagaagggcaaggccgagggacgtgacgaggaacagacagacgaagagctcgctgtggacttagaggccctggtgagcaaagcagaggaggagttctttgatattatattcgccgaactgaagaagaaagaagccgacgccattaagctaacccccgtgccccagcagccttccccggaggaggaccaggtggtcgaagagggagaggaggccgcaggcgaggagggcgatgaggaagtggaagaggatcttgcttag

SEQ ID NO: 221460 - DNA, 1818 bp, Artificial Sequence
  Description of Artificial Sequence: Synthetic coding sequence
atggagatcgtgtacgtgtacgtcaagaaaagaagtgagtttggaaagcagtgtaactttagtgatcgccaggcagaactgaacatcgacatcatgcctaatcccgagctggctgagcaattcgtcgagagaaacccagtcgacacagggatacagtgtagcatcagtatgtctgaacatgaagccaactccgagaggtttgagatggaaacacgaggagtgaaccatgtggaaggtggttggcccaaggacgtaaacccactggagctggaacagaccatcagattccgcaaaaaggttgagaaggatgagaattacgttaatgccatcatgcagctgggcagcatcatggagcactgtataaaacagaacaacgcaatcgatatatacgaggaatattttaacgatgaggaggcgatggaagtgatggaggaagacccctccgccaaaactattaacgtctttcgggacccccaggaaataaaacgagccgcaacacacctgtcatggcacccggacgggaacaggaaattggcagtggcctattcctgtcttgatttccaaagagcaccagttggtatgtccagcgactcttacatttgggacctggaaaacccaaataagcctgaactcgccctgaaaccatccagtcctcttgtcacacttgaattcaacccgaaggattcacacgtactgctgggcggatgctataatgggcagatagcctgttgggacacacggaaagggtccctagtggcagaactgagtacaattgagagcagtcatagggaccctgtctacggtacgatttggctgcaaagcaaaaccgggaccgaatgcttcagcgcttctaccgacggccaggtgatgtggtgggacatcagaaaaatgtccgaacccacagaggttgtcattttggacattactaagaaggagcaactggagaatgctctgggggctatctcacttgaattcgaaagtacccttcctacgaagtttatggtcggcacggaacaggggatcgtcatctcttgcaacagaaaagctaaaacaagcgctgagaaaatcgtatgcacgtttccgggtcaccatggccctatttacgcactgcagcggaaccctttttatccaaagaattttcttacagtgggtgactggaccgctcgtatatggtctgaagatagtcgcgaatcatctattatgtggacaaaatatcatatggcctacctgaccgacgctgcatggtcaccagtcaggccaacagtatttttcacaacccggatggatggaaccttggacatctgggattttatgtttgagcagtgcgacccgactctgtctctcaaggtgtgtgatgaggccctcttttgtctgagggtgcaggataacggttgcctgattgcatgtggttcacaactcgggacgaccacactgttggaagtctccccaggtctgagtaccctccaacggaacgagaaaaacgtggcgtcgtcaatgttcgaacgagagaccaggcgggagaaaatactggaagcaaggcatcgcgagatgcggctcaaggaaaaggggaaggctgagggacgagatgaggaacagaccgacgaggagctagctgtcgacttggaggcgctggtgtccaaagccgaagaggaatttttcgacatcatctttgccgagctgaagaagaaggaggctgatgcgatcaaactgacacccgtgccccagcaaccctcacctgaagaggatcaggtggtggaagaaggcgaagaggcagctggcgaagagggcgacgaagaagtagaggaggatctagcatag

SEQ ID NO: 221461 - DNA, 234 bp, Artificial Sequence
  Description of Artificial Sequence: Synthetic coding sequence
atgaagaagctgaagattctatacatgtccaacaaccttgtcaaagactgggctgaattcgtgaagctggccgaattaccttgcctggaagatctcgtctttgtggggaaccccctggaagaaaaacattctgccgagaacaactggattgaagaggccactaaacgggtacctaagctgaagaaactagacgggacacccgtaattaagggagatgaggaggaagacaattag

SEQ ID NO: 221462 - DNA, 456 bp, Artificial Sequence
  Description of Artificial Sequence: Synthetic coding sequence
atggatgcctccctttctatgctcgccaactgcgaaaagctaagcctgtccactaattgtattgaaaaaattgctaacctcaacggtctgaagaatcttcggatcctgtccttgggcaggaacaacataaaaaatctaaatgggctggaagccgtcggagataccctggaggagctctggattagctataattttatagagaagctcaagggaattcacatcatgaaaaagctcaaaattctttatatgagcaacaatcttgtcaaggattgggccgaattcgtcaaactggctgaactgccttgcctcgaagatctggtgttcgtggggaaccccctagaggagaaacattcagcagaaaataattggatcgaagaggcaaccaagcgggttcccaaactgaagaaactggacgggacaccggtaattaaaggtgacgaagaggaagataactag

SEQ ID NO: 221463 - DNA, 573 bp, Artificial Sequence
  Description of Artificial Sequence: Synthetic coding sequence
atggccaaggctactacgatcaaggaggcacttgcacgctgggaggaaaaaacaggccagcggccttcagaggccaaggaaattaagctatacgcacagatacctcctattgaaaaaatggatgcgagcctctccatgttagccaactgcgagaaactcagcctaagcactaattgcattgagaagatcgcaaacctcaacgggcttaaaaacctgcgcatcctcagcctgggaaggaataacataaaaaacctcaacgggctggaagccgtaggggacacattggaagaactttggatttcgtacaatttcatagaaaagctgaaggggatccacattatgaaaaaattgaagattctgtatatgtcaaataatctggtgaaagattgggcggagttcgtcaaactggccgaattgccttgtctggaagatctggttttcgttggaaaccccctagaagaaaagcactccgcagagaacaactggattgaagaagcaactaagagagtccctaagctgaaaaagctggatggcactcctgtgattaaaggggatgaagaggaggacaactag

SEQ ID NO: 221464 - DNA, 174 bp, Artificial Sequence
  Description of Artificial Sequence: Synthetic coding sequence
atgaagaaactgaagatcctgtatatgtctaataatttagtaaaagattgggccgagtttgtgaagctggccgagcttccctgcctggaagatttagttttcgtcggcaaccccctagaggagaaacattcagctgaaaacaactggatagaggaggccaccaagagagtatag

SEQ ID NO: 221465 - DNA, 456 bp, Artificial Sequence
  Description of Artificial Sequence: Synthetic coding sequence
atggatgccagcctcagtatgctggctaattgcgaaaagctctcgttgtctactaactgtattgagaaaatcgcgaatctgaacgggctaaaaaaccttcgtatactttcccttggcaggaacaatataaaaaacttaaatggcctcgaagccgtaggcgatactctcgaggagctttggatcagttataacttcattgagaaactcaaggggattcatatcatgaagaaattaaaaatcttatatatgagcaacaaccttgtcaaggactgggcggaatttgtcaagttagcagagcttccttgtctggaggacctcgtgttcgtaggcaatcctctggaggaaaagcattccgccgagaataactggatagaggaggccactaagagagtcccaaagctgaagaagctggacggtactcccgtgataaaaggagacgaggaggaagacaactag

SEQ ID NO: 221466 - DNA, 195 bp, Artificial Sequence
  Description of Artificial Sequence: Synthetic coding sequence
atgaagaagctgaagatcctttacatgagtaataatctcgtcaaagactgggcggagttcgttaaactcgcagaactgccctgcctggaagacctggtttttgtgggtaacccactcgaggagaagcattccgccgagaacaactggatagaggaggcaaccaagagggtcccaaaattgaagaagttagactag

SEQ ID NO: 221467 - DNA, 159 bp, Artificial Sequence
  Description of Artificial Sequence: Synthetic coding sequence
atggacgccagtctgagcatgctggccaattgtgagaagctcagcctctctaccaactgtatagagaagattgcaaatctcaatggcctcaaaaacctgcgtattctcagtctggggcgaaacaatatcaaaaatttgaacggactggaggcggtgtag

SEQ ID NO: 221468 - DNA, 198 bp, Artificial Sequence
  Description of Artificial Sequence: Synthetic coding sequence
atgaaaaaactgaagattttgtacatgtccaacaacctggttaaggactgggccgaattcgtaaagctggcagagctgccatgtctggaggatttggtgttcgtggggaacccgctagaagagaagcattccgccgaaaataactggatagaggaggctactaaacgagtgcccaagcttaagaagctagacggttag

SEQ ID NO: 221469 - DNA, 843 bp, Artificial Sequence
  Description of Artificial Sequence: Synthetic coding sequence
atggtcacggctaacaaagctcacacaggacaaggttcttgctgggtggctacattggcatccgcaatgatccctccagcagatagcttgctgaagtatgatactcccgtgttagtcagtcggaatacagagaaaagatcaccgaaggctaggcttcttaaagtttcaccccagcagccaggaccttctggaagcgctccacagccccctaaaactaagcttccgtccactccgtgtgtgcctgaccccaccaagcaggcagaagaaatcctgaatgcaattcttcctccccgagaatgggtggaggatactcagctgtggatccagcaagtgtctagcacaccttccacacgcatggatgtcgtacaccttcaagagcagttggatctaaaactccagcaacggcaagccagggaaactggcatttgccctgtgcgaagggaactttacagtcagtgctttgatgagctgatccgagaagtgaccattaactgtgcagagcgcggactgctactgctccgcgtgcgggatgagatccgcatgacaattgcagcttatcagacactgtacgagagcagcgtggcctttggaatgagaaaggctctgcaagctgagcagggaaaatcggatatggagcggaaaatcgctgagctcgagaccgagaaaagagacctcgaaaggcaggtaaacgaacagaaagccaagtgtgaagccactgagaagagagaatcagaacggcgacaagtggaagagaaaaaacataatgaggaaatacagtttctcaagcgtacgaaccagcagctgaaagcacagctggagggaatcattgctcccaaaaaatag

SEQ ID NO: 221470 - DNA, 399 bp, Artificial Sequence
  Description of Artificial Sequence: Synthetic coding sequence
atgccgtattatccccaggacgagctgattcgcgaagttacgattaactgcgccgaacgcggacttcttctcctccgggtgcgcgacgagattcgtatgacaatcgccgcttaccagactttgtatgagagcagtgtagccttcggaatgagaaaagcgctgcaggccgaacagggtaaaagcgacatggaacggaaaattgcagagctggaaaccgaaaaacgggatctagaacgacaggttaacgagcagaaggccaagtgcgaagccaccgaaaagcgagagtcagagcgtcgacaggtcgaggagaaaaagcacaacgaagaaattcagttcttgaaaaggacaaatcagcagctgaaagctcagttggagggcataatcgctcccaaaaagtag

SEQ ID NO: 221471 - DNA, 13941 bp, Artificial Sequence
  Description of Artificial Sequence: Synthetic coding sequence
atgagcgagcctggtggtggtgggggagaagacggtagcgctggtcttgaagtgtctgccgtccagaacgtagctgacgtcagcgtcctgcagaaacatctacggaagctggtgccactgctccttgaggatggcggtgaagcccctgcagctctcgaagcagccctagaagagaagtccgccctcgaacagatgcgaaaattcttgagcgatccacaggtacacacagtactggtagagagatcaaccttgaaagaggacgtgggagacgagggggaagaagagaaggaatttatttcttataacattaacatcgatatccattacggcgtcaaaagtaatagtttggcattcattaagagaacaccagtgattgatgccgacaagccggtaagttcccagctgcgcgttctgactctgagcgaagattccccatatgagactctccacagcttcattagcaatgctgtagcaccattctttaaaagttacatcagagagagcggaaaggccgacagggacggcgacaagatggcacctagcgtggaaaaaaaaattgcagaactggagatgggtctcctccatctccaacagaatatcgaaatccccgagatatccctgcccatacacccgatgattacgaatgtggctaagcaatgctacgagcgcggtgaaaagcctaaggtgactgacttcggcgataaagtggaagaccccactttcctgaaccagctccaatccggagtaaatcggtggattcgagaaatccagaaggtaaccaaactggatcgagatcccgcaagtggcacagcccttcaagagatatcgttttggctcaatctcgaaagggccctataccggattcaagaaaaacgcgagagcccagaggtcctgctaacacttgatatcctgaaacacggaaagcgttttcacgccactgtctccttcgatacggacacaggtctaaagcaggctctcgagacagtgaatgactacaacccccttatgaaggacttccctctaaatgatctattatccgctaccgaactggataagattagacaagctctggttgcaatcttcacccacctgcggaagatcagaaatactaaatatcccatccagagggccctgcggttggtggaagctatttcgcgggatctgtctagccagttgctcaaggtgctagggacgaggaagttaatgcacgtggcatacgaggagtttgagaaggtcatggtggcttgcttcgaggtgtttcagacctgggatgacgaatacgagaaactgcaggttctcctgcgcgatatcgtaaaaagaaaaagggaggaaaatttgaagatggtatggagaatcaatccagctcaccggaagctgcaagctcgattggatcagatgcgcaagttcaggcgccagcatgaacagctgagagcagtcattgtgagagtgctgcgacctcaggtcacggcagtggcccagcagaaccagggagaggtgcccgagcctcaggatatgaaggtagcagaggtactttttgatgcggctgatgccaatgcaattgaggaagtgaacctggcctacgaaaatgtgaaagaggtggacggactggatgtttccaaggagggaactgaggcgtgggaagcagctatgaagcgctacgatgaacggattgaccgcgttgaaacccgcattaccgctcgactccgggatcagctaggtacggctaagaatgctaatgaaatgttccgaatcttctctcgcttcaatgccttatttgtgaggccgcacatcaggggggctatacgagaatatcagacccaactaatccagcgggtgaaagacgatatcgagtctttgcacgataagttcaaggtccaatatccacagagccaggcgtgcaagatgagccatgtacgcgatctgcctcccgtttctggttccatcatttgggccaagcagatcgaccgtcagctgacagcttacatgaaacgcgtggaggacgttctgggcaagggttgggagaaccacgtggaaggccagaaactgaaacaggacggcgacagcttccggatgaaattgaatacccaggagatttttgacgactgggctcgcaaagttcagcagaggaacctgggcgtttcaggcagaattttcactatcgaaagtaccagggtgcggggacgtactggaaacgttctgaagctcaaggtcaactttctgccagaaattatcactctgtctaaggaagtgcgaaacctcaaatggctcggctttagagtacctctggccattgtgaacaaggcccaccaggccaatcaactttatccattcgctatttctttaatcgaatccgttagaacttacgaaagaacttgcgagaaggtggaagagcgaaacaccatcagcctgttagtggctggactgaaaaaggaggtccaggcactgatcgcagaaggaatcgccctggtgtgggagtcgtacaaacttgatccatacgtccaacgactcgctgagacggtgtttaacttccaggagaaggttgacgatcttctcataatcgaggagaagatagacctggaggtccgatctctggaaacgtgcatgtatgaccacaaaacattctcagagatattgaaccgggtccagaaagccgtcgatgatctgaatttgcactcctattccaacctgcctatttgggtaaacaaattggacatggagatagagaggatcctgggggtcagactacaggccggactgagggcctggactcaagtgctgctcgggcaagcagaagacaaagccgaggtggacatggataccgatgcgccacaagtgtcccacaaaccagggggagaaccaaagattaaaaacgtcgtccacgagctccgaattacaaatcaagtcatttatctcaatccgccaatagaggaatgtagatataaactctatcaagagatgttcgcctggaagatggtagtgctttctcttccccgtatccagagtcaaagataccaggtgggtgtgcactacgagcttacagaagaagagaaattctacagaaatgctctgactagaatgcccgacgggccagtggccctggaagagtcttactcggcagtgatgggtatcgtgagcgaagtggagcagtatgtcaaggtgtggctccagtatcagtgcctgtgggatatgcaggcagagaacatatacaaccgacttggcgaggatcttaacaaatggcaggccctcttggtccaaatacgaaaagccagaggaaccttcgataacgccgagaccaagaaagaattcggacccgtcgtaatagactatgggaaagtccagagcaaggttaatctcaaatacgatagctggcacaaggaagtcctgtctaagttcggacagatgttgggcagcaacatgaccgaatttcatagtcagatctcaaagtcgcggcaggagctagaacagcacagtgtcgatactgcttctacctcggatgccgtgacttttatcacatacgtccagtccctcaagcgcaagataaagcagttcgagaaacaagtggaattgtaccgaaatgggcagcgcctgctagagaaacaaagattccagttccctccatcctggttatacattgacaatatcgagggggagtggggcgcttttaacgacattatgcgaaggaaagattccgctatccaacagcaggtggctaacctacagatgaagatcgtccaggaagatcgcgctgtggagtcaaggaccactgatctgttgactgattgggagaaaacaaaaccagtcacagggaacttacgccctgaagaggccctgcaagcactgacgatctatgaaggcaagttcggccgtctaaaagacgatcgcgagaagtgcgccaaggccaaagaggcattggaacttactgacaccggcctactgagcggtagcgaagagcgagtgcaagtcgctcttgaagagcttcaggatctgaagggtgtgtggtctgagctgtcaaaggtgtgggagcagatcgaccaaatgaaggaacagccatgggtgtcagtgcagcctcggaagcttagacagaacctcgatgccctgttgaatcagctcaagtccttccccgctcggctgcgacagtacgcaagttacgaattcgtacagcggctcctgaaagggtatatgaaaattaacatgctggtgatcgagctgaagtcagaagccctgaaggaccggcactggaagcagctcatgaagaggttgcatgtcaactgggtcgtgtcagagctcacattagggcagatttgggacgtggacctacaaaagaacgaagccattgtgaaagatgtgcttctggtggcgcagggtgaaatggctctagaagagttcctcaagcagataagagaagtctggaacacctatgaactggacttggtcaattatcagaacaagtgcaggttgatacggggatgggatgacctctttaacaaggtaaaggaacacatcaattctgtgagcgctatgaagctgtccccctactacaaggtttttgaagaagatgccctgtcttgggaggataagctcaatcggattatggccctgttcgacgtctggattgatgtacagaggaggtgggtttatctggaaggcatttttaccgggtcggccgacatcaagcacctgttgcccgtggagacgcagcgtttccagtctatctccactgagttcctggctttgatgaagaaagtcagcaagagtcccctggtcatggatgtgcttaacatccaaggggttcaaaggtccttggagaggttagcagacctgctcggcaaaattcaaaaagccctgggcgaatatctagaacgggagcgctcaagttttcccaggttctatttcgttggtgacgaagacctgctcgaaattatcggcaatagtaagaatgttgctaagctgcagaagcactttaagaaaatgttcgcaggtgtgtctagcattatcctgaatgaggacaactccgtggtccttggtatcagttcacgggaaggggaagaggttatgtttaagacgccggtatctatcaccgagcatcccaaaatcaacgaatggctcaccctagtcgagaaagaaatgcgtgtgactctggctaagctgctagccgaatcggtcactgaagtggagatcttcgggaaggctacttctatagaccccaatacttacataacttggatagacaagtaccaggcgcaattggtggtgctgagcgcccagatagcctggagcgagaatgttgagaccgctctgagtagcatgggaggcggtggagatgccgcacctctgcactctgtgctgtccaatgtagaggtaaccctcaatgtgttggccgattccgtgttgatggagcaaccgccactaaggagacgtaagctcgagcatcttattacagagctcgtgcaccagcgtgatgttactcggagcctgatcaagtctaaaattgacaatgccaaatctttcgaatggctgtcacagatgcgcttctatttcgatcccaaacagacagatgttctgcagcagctcagcattcagatggctaacgccaagttcaactacggatttgaataccttggagtgcaagataagctggtgcagacccccctcaccgatcgctgctatttaacaatgacccaggcactggaggccaggttaggcggatctccatttggcccagctggcactgggaagactgaaagcgtcaaagccttgggacaccagctcggccgttttgtcctcgtgtttaattgcgacgagaccttcgacttccaggcaatgggcagaatattcgttggactgtgccaagtgggtgcttgggggtgtttcgatgagttcaatcggctggaggagcgtatgctctccgctgtgtcccaacaagtccagtgtattcaggaggcactccgcgagcactctaatcctaactacgacaaaacctccgctcctatcacctgcgagttacttaataagcaggtcaaggttagtccagacatggctatattcataacaatgaacccagggtatgcaggtcggagtaatctgcccgataatctgaagaagctctttaggtctcttgccatgacaaagcccgataggcagctaatcgcacaagtgatgctgtactcccaggggttcagaaccgctgaagttctggctaataagatcgtcccattctttaagctttgcgacgagcagttgagctctcagagtcactacgacttcggcttgcgtgctctcaaatccgttctggtgtccgcagggaacgtgaagagagagcggatccagaaaataaagcgggagaaggaagaaagaggagaggccgtagacgagggcgagattgctgagaacctgccagaacaggaaattctcattcagagcgtgtgtgagacaatggtgccaaagctcgtagcagaagacatccccttactgttctccctgctgtcagatgtatttcccggagttcagtaccacagaggcgaaatgaccgcccttagagaagagctcaagaaggtgtgtcaggagatgtatcttacttatggggacggcgaggaggttggcggtatgtgggttgaaaaagttttgcagctgtatcaaattacccaaatcaaccatggcctgatgatggtagggccttctggctccggcaagtcaatggcgtggcgagtgctcctaaaggcgctagaacggcttgaaggggtcgaaggggttgctcatatcatagacccaaaagccatctcaaaggaccacctctatggaacactggatcccaataccagagaatggaccgacggtctcttcacccacgtgctgcgcaagatcattgatagcgtgaggggcgagctccaaaagaggcagtggatcgtgtttgatggcgatgttgatccagagtgggtggagaatcttaatagtgtcttggacgacaataagctgctgaccttacctaacggcgagagattatcgctcccaccaaatgttaggatcatgttcgaggtacaggacctcaaatatgccaccctcgcaacagtgtcgcgatgtggcatggtatggtttagtgaagacgtgctgtctactgacatgatcttcaataactttctcgcacgcctgcggtccattccactggacgagggggaagacgaggctcagcgcaggcgaaagggcaaggaagatgagggagaagaagccgcttcaccaatgctccagatacagagggacgctgctaccattatgcagccctactttacaagcaacgggctggtgaccaaggcgctcgagcatgcctttcagttggaacacattatggatttgacacggctgaggtgcctgggatccctcttcagtatgttacaccaggcctgccgaaacgtggcccaatacaatgccaaccacccggacttccctatgcagatcgaacagctcgaaaggtatatccagcgctacctggtttacgctatcctttggtccctgagcggcgacagtcggttgaaaatgagagccgagctgggtgagtatattcgacgaattaccacagttcccctgcccaccgcaccaaacataccaattatcgattatgaagtctccatctcgggcgagtggtccccctggcaggctaaggtaccccagattgaggtagagacacacaaagttgccgctcctgatgtggtggtgccaaccctggacactgtacgtcatgaagcgctgctatatacttggctggcagaacataagccactggtcctttgcggtccccctgggtccggtaaaaccatgactctgttcagcgctctgagggctctccccgatatggaagtggtcggcctgaacttcagcagcgctaccacacctgagctgttgctgaaaacttttgaccactattgtgagtataggcgcacgcccaatggcgtggtgctcgctccagtgcagttagggaagtggcttgtgctgttctgtgacgagattaatttgccagacatggacaaatacggcactcagagagtcatctcctttatccggcagatggttgaacatgggggtttctatcggacctctgaccagacttgggtgaagctcgagcgcatccagttcgtcggtgcatgtaaccccccaacagatcctgggaggaagcctttgagccaccggtttctcaggcacgtgcccgtggtatatgtagattatcccggacccgcatcattgactcaaatctacggcacattcaacagggccatgttgcggctgattccctctctgagaacttatgcagagccactgacggctgctatggtggagttttatacaatgtcccaggagcgcttcactcaggatactcagccacattacatttattcccccagggaaatgacacggtgggtcagaggtatttttgaagcactgaggcctctggagacattgcccgtggaaggcttgattcggatttgggctcatgaggctctacgcctgtttcaagacagactggttgaagatgaggagagaaggtggacggacgaaaacatcgacaccgtagctctcaagcatttccccaacatcgacagggaaaaagccatgtcacgccctattttgtactccaactggcttagcaaagactatatcccagtcgatcaggaggagctgcgcgactacgtgaaggctcgtttgaaggtcttctatgaagaagagcttgatgtccctcttgtgcttttcaatgaggtattagaccacgttttgcggatagaccggatttttaggcagccccagggacacctgctactaatcggggtcagcggtgctggaaaaactactctctctcgcttcgtagcctggatgaacggcctctcggtgtaccagattaaagttcatcgcaagtatacgggggaagatttcgatgaagacctgaggaccgtgctgcgcagaagcggctgcaagaatgaaaagatcgcgtttatcatggatgagtctaacgtgttagattcaggtttcctggaacgcatgaacacgctgctggctaacggtgaagtccccggattgtttgaaggtgatgaatacgcgacactgatgactcaatgtaaggagggggcacagaaagaaggcctgatgctcgattcacacgaggagttgtataaatggttcacaagtcaggtgatacgtaatctacacgtcgttttcaccatgaatccaagctctgagggactgaaagacagagcggcaacctcgcctgccttattcaaccggtgtgtactgaattggttcggcgactggtcaaccgaagccctgtatcaagttggaaaagaattcacttcaaaaatggatctcgagaagccgaactacatcgttcctgactatatgccggtagtgtacgacaagcttcctcaacccccaagccaccgagaagccatcgtcaatagttgcgtgtttgttcaccaaacactccaccaggccaacgcgaggctcgccaaaagaggcggacggactatggccattaccccaaggcattatctggactttatcaatcattatgctaacctcttccacgagaagaggagcgagctggaagaacaacagatgcacctgaacgtcgggctccgcaagattaaggaaaccgtggaccaagttgaagaactgaggcgggatctccggatcaagagtcaggaattggaggttaagaatgctgctgccaacgataagcttaagaaaatggtaaaagatcagcaggaggccgaaaaaaagaaggttatgagtcaggaaattcaggagcagttgcataagcagcaagaggtcattgctgataaacaaatgtcggttaaagaagacctggacaaggtggagccggctgtgatcgaggcccagaatgccgtcaaatccatcaagaagcagcatttagtcgaggtgagatctatggcaaaccccccagcagctgtgaaactggccctcgagtctatctgtctcttactgggtgagagtacgacagactggaagcagattcgttctattataatgcgggaaaatttcatcccaacaatagtaaatttctcagctgaagagatttccgacgccattcgcgagaaaatgaagaagaactacatgagcaatccatcatacaattacgaaatagtgaacagggcttccctggcctgcggccctatggtcaaatgggccatagctcaattgaattatgcagacatgctcaagagggtcgaaccacttaggaatgaactgcagaagctagaagacgacgccaaggacaaccagcagaaagccaatgaagtggagcagatgattcgcgacctggaggcctccatcgccaggtacaaggaagaatatgctgtgttgatctctgaagcacaggccatcaaggccgacctcgctgccgtcgaagcaaaggtaaatagaagcacagccctgctgaaatcgctgtccgcagagagggagcgctgggagaagacatctgagacgttcaaaaatcagatgtcaactatcgctggggactgccttttgtccgcagcattcattgcgtatgccggatactttgatcagcaaatgcgccaaaacttgttcactacctggtcacatcatcttcaacaggcaaacattcagtttagaacggatattgcgaggacagagtatctgtccaacgccgacgagcgcctaagatggcaggccagctctctgccggctgacgacctctgtaccgagaacgccatcatgctcaagaggtttaataggtaccctctcattattgacccatcaggccaggccacggagtttatcatgaacgagtataaagaccgcaagattacaagaactagtttcctagacgacgcgttccgaaaaaatctcgagagcgctctgcgctttggtaaccctttacttgtccaggatgtcgagtcttacgatccagtactgaaccctgtgctgaatcgcgaggtgagaaggacaggcggaagggtcttaatcaccctgggagaccaggatattgacttgagccccagctttgttattttcctaagcactcgagatccgacagtggagtttcctccggacctttgctctcgggttacatttgtgaattttaccgtgactaggtctagtctccagtcacagtgcctgaacgaggttttgaaggcggagcgacccgatgtcgatgagaagcgctccgacctgctgaagctacagggagagtttcagttgagactccggcagctcgagaaatccctcctgcaagctctgaacgaggtgaaggggagaatcctggacgacgacaccattattaccaccctggagaaccttaagcgagaggccgctgaggtaacacggaaagtagaagaaaccgacattgttatgcaggaggtggaaaccgtctcacagcagtatctgcccctttccactgcctgttccagcatttactttacaatggaatcactcaaacagatccattttctttaccagtactcccttcagttctttctggatatttaccacaacgtcctgtacgagaacccgaacctgaagggcgtcacagatcacactcaacggctgagcatcatcacaaaggacttgttccaggtggcttttaatcgagtcgcaaggggaatgttacaccaagatcacattacctttgccatgcttctcgcacggattaaactgaaagggacagttggtgaaccaacctacgacgctgagttccagcacttcctccggggaaatgagattgtgctttcggctggttctacaccgcgtatccaaggcctgaccgtggagcaagcggaggccgtggtgaggcttagttgtctaccagcgttcaaagacctgatcgctaaggttcaggccgacgagcaatttggtatttggctggactcctctagcccagaacagaccgttccgtatctttggagtgaggagaccccagcaacacccatagggcaagccatccatcgcctgctcctgatccaagcattcaggcccgaccgccttttggccatggcacatatgttcgtatccactaatctcggcgagagctttatgtctatcatggaacagccccttgatttgacacacatcgtagggaccgaagtgaaacctaatacccccgttttgatgtgttcggtccccggttacgacgcctcaggtcacgtggaagatctcgctgccgaacagaatactcagattacaagtatagcaataggaagcgccgaaggtttcaatcaggccgacaaagcgatcaatacagccgtgaaaagcgggaggtgggtgatgctgaagaatgttcacctggcccctgggtggttgatgcaactggagaaaaaactccactccctgcaaccccatgcctgcttcagactcttcctgaccatggagatcaatccaaaggtcccagtgaacctgttacgcgctgggagaatttttgtgttcgaacccccaccaggcgtgaaggccaacatgcttaggactttctcctctataccagtgtcaaggatatgcaaatcccccaacgagcgagcccgtctctacttcttgttggcctggtttcatgcaattatccaagagcgcctacgatatgctccgctgggatggtcaaaaaaatacgagttcggcgagtccgacctgcgttctgcgtgcgacaccgtggacacatggctagatgatacagccaaaggcagacagaacatctcaccagacaaaatcccatggagtgcactgaagacactcatggcacagtcgatctatggcggtcgcgtcgacaacgagtttgaccagagacttctcaacacatttctggaacgcttgtttacaacaaggtccttcgatagcgagtttaagctcgcgtgtaaagtagacggacacaaagacatccaaatgcccgatggtattagaagggaagagtttgtgcaatgggttgaactcttgcccgacacccagactccgtcttggctgggcctcccaaataacgcggaacgcgtccttctgacgacccagggggtggacatgatttccaagatgctgaaaatgcagatgctggaggacgaggacgatctggcttatgccgaaacagaaaaaaaaaccagaacagatagcactagcgatggaaggcctgcttggatgaggactctgcacacgaccgcctcaaattggctgcatctgattcctcagacattgtctcacctgaaacgcaccgttgagaatatcaaagatccactgtttcgattctttgaaagagaggtgaagatgggcgctaaattgctacaggatgtcagacaggacctggcagatgtcgttcaagtctgcgagggtaagaagaagcaaacgaactatctccggactctgatcaacgaactagtcaagggcatcctgcccaggagttggagtcattacacagttcccgctggcatgactgtcattcagtgggtatctgacttttctgagcgcatcaagcaactgcagaatatttctttagccgcagcctcaggcggtgctaaggagttgaagaatatccacgtgtgcctgggagggcttttcgtccccgaggcttacatcacagccacacgacagtacgtggctcaggcgaatagttggagcctagaggagctgtgtttagaagtgaatgtgaccactagccagggtgctactctggatgcctgttccttcggagtaactggactgaaactgcaaggtgccacatgcaacaacaataaattgagtttatctaacgcaatatctacagcgctccctctcacccagctgagatgggttaagcagacaaacactgagaaaaaagcatccgtagttacgctgcccgtgtacctgaattttactcgtgccgacctgattttcacggttgattttgagatcgccaccaaggaagaccccaggtccttctatgaaaggggtgtagccgtgttatgtactgaatag

SEQ ID NO: 221472 - DNA, 1899 bp, Artificial Sequence
  Description of Artificial Sequence: Synthetic coding sequence
atgagcgacaagagcgaactgaaagcagaactggaacgcaaaaagcagcgtctggcacaaatccgagaggaaaagaaaaggaaagaggaggaacgaaaaaaaaaagaaactgaccagaaaaaggaggccgtggcacctgtgcaggaggagtccgacctggaaaagaagagacgggaggcagaagcccttctccagagtatgggactgacgccagaatcccctatagtgccacctccgatgtctccctcgtccaagtcagtgtcaacaccatctgaggctggatcccaggattctggcgacggtgctgtcgggtccagaacattgcactgggacactgatccctcagtcctccaattgcactcggactccgacctggggaggggtccaatcaagctgggcatggctaagatcactcaggtggactttccccctcgagaaattgttacctacaccaaagagacacaaactcctgtgatggcccaacccaaggaagatgaggaggaggatgacgacgtggtagcacccaaacccccaattgagcctgaggaagaaaagacgctcaaaaaggatgaggagaatgattctaaagccccaccgcacgaattaactgaagaggaaaaacagcagatcctgcacagtgaggagttcctcagtttctttgatcatagtacgcggattgtcgaaagagcccttagtgagcagatcaatatcttttttgactacagcggacgcgaccttgaagataaggaaggtgagatccaggccggagccaagctctccctaaataggcaattctttgacgagcggtggagtaagcatcgtgtggtatcctgtttagattggtcaagccaataccccgagctgctcgtggcaagctataacaacaatgaggatgcaccacatgaaccagatggagttgctctcgtttggaatatgaagtacaaaaagaccactccggaatatgtattccattgtcaaagcgcggttatgtccgccacgttcgctaaattccaccctaatctcgtggtgggagggacatacagcggtcagattgtgctttgggacaaccggtccaacaaaaggacccctgtccaaagaactccactgtcagcagccgctcacactcaccccgtgtactgcgtaaatgttgtgggtacgcagaacgcacacaatctcatctcaatctctacggatggtaagatttgctcttggtctctggacatgctctctcacccccaggactccatggaattggtacacaagcaatctaaggccgtggctgttacatcaatgtcctttccggtgggagatgtgaataactttgtcgttggctccgaagaagggtccgtatacaccgcttgtagacacggaagtaaggccggaatttctgagatgttcgaagggcaccaggggcctataacgggtatccactgccacgccgctgtgggagccgtggattttagccacctttttgtcacctcctcattcgattggaccgtgaagctctggactacaaagaacaacaaacctctgtattcgttcgaggataacgccgactatgtgtatgatgttatgtggagtcccactcacccagcattgtttgcatgtgtggatggaatgggccgactcgatctctggaatttgaataacgacaccgaggtaccgaccgcctccatctctgtggaaggaaacccggcacttaaccgagtgcggtggacacactcggggagagagatagccgtcggtgacagcgagggacagattgtcatatacgacgtaggtgagcaaatagctgttccacgaaacgacgagtgggctcggtttgggcgaacgcttgccgagattaatgcaaacagggccgacgctgaagaagaggcggctactagaattcctgcttag

SEQ ID NO: 221473 - DNA, 1839 bp, Artificial Sequence
  Description of Artificial Sequence: Synthetic coding sequence
atgtcggacaagagcgagctgaaagccgagttggagcggaaaaaacagaggctggcacagatccgggaggagaagaagagaaaggaggaagagcggaagaaaaaagaaacagatcagaagaaagaggcagtggcccctgtgcaggaggagagcgacttagaaaagaagcggcgtgaggctgaggccctgctgcagtccatgggtctgacaccagaatcacccatcgtgccccctccaatgtcaccttccagcaagagtgtgagcacgcctagcgaggctggctctcaggattccggagatggtgccgtcggatctcgcagggggcctatcaaactgggtatggcgaaaattacgcaagttgattttccgcctcgcgagattgtgacttatacaaaggagacccagacacctgtgatggcccagcctaaggaagacgaagaagaagatgatgacgtagtcgcgccaaagccgccaatcgagccggaggaggaaaagactctcaagaaggacgaagaaaatgactcgaaagcccctccgcacgagcttacagaagaggaaaagcagcagatcctgcatagtgaggagttcctctcctttttcgaccattccacgaggatcgtcgaaagagccctctcagagcaaataaatatttttttcgattactctggacgcgatttagaagataaggagggggaaattcaagcaggggcaaaactgtcactgaacagacagttcttcgatgaacggtggagtaaacatagagttgtgtcctgtctggattggagctcacagtacccggaactgctcgtggctagttataacaataacgaggacgctcctcatgaacccgacggtgtggccctggtgtggaacatgaaatacaaaaaaacaacaccagagtatgtatttcattgccagtcagctgttatgagcgccacctttgcaaaatttcaccctaaccttgtggtcggcggtacttattctggacagatagtcctgtgggacaaccgaagcaacaagcgtacacctgtgcagagaacccctctttcggccgctgcccatacacaccctgtttactgcgtgaatgtcgtgggaacacagaatgcccacaatttgatctccattagtacagatggtaaaatctgtagctggagtctcgacatgttgtcgcaccctcaagattcaatggaattggtgcataagcagtccaaagccgtggcagtgaccagcatgagctttccggtgggagatgttaacaactttgtcgttgggtccgaagagggctctgtttatacggcttgtagacatggcagtaaagcaggaataagtgagatgtttgaaggacaccaagggcctatcacaggtattcattgccatgcggctgtgggcgcagtcgactttagccacctgttcgtaacatcctcttttgactggacagtaaaactatggaccactaaaaacaacaagcctctctactcctttgaagacaacgcggactacgtgtacgacgtaatgtggagcccgactcaccctgccctgtttgcctgcgtagatgggatgggcagactggatctctggaatctcaataacgataccgaagttccgactgcgtctatatccgtcgaagggaaccctgcgttgaatcgagtgcgttggacccatagcgggagagagatcgcagtgggggatagcgaagggcagatagtgatctatgatgtgggggagcagatagcagtccctcggaacgacgaatgggcgaggtttgggcgaacacttgccgagataaacgccaatagagcagacgcagaggaggaggccgcaactaggatccctgcctag

SEQ ID NO: 221474 - DNA, 1893 bp, Artificial Sequence
  Description of Artificial Sequence: Synthetic coding sequence
atgtctgataaaagtgagctgaaggcagagctcgagagaaaaaagcagagactggctcagatccgcgaggagaagaaaagaaaggaagaggagaggaaaaaaaaggagacggaccagaagaaggaagcagtggctcctgttcaggaggagagcgacctcgaaaagaaaaggcgtgaagctgaggctttgcttcagagtatggggctcacacctgaatcgcctatagctgaacagccactacgggtggtgacagctgatacctgtctgtttcactatcttgtgccccctccgatgagcccgagctccaaatctgtgagcacaccctccgaagcgggttcacaggattctggagacggagccgtgggctcaaggagaggtccgattaaactgggtatggcaaagattactcaagtggacttcccaccacgggagatagtgacttatactaaagaaacacagactccggttatggcccagcctaaggaagatgaagaagaggatgacgacgtcgtcgcacccaaacctcccattgaacctgaagaggagaaaaccctcaagaaagatgaagagaatgacagtaaggccccaccgcatgaactgaccgaagaggaaaaacagcaaattctccactctgaggagttcctgagcttctttgaccacagcaccagaatcgttgagcgggcattgagcgagcagattaacatattttttgattatagcgggagagacctggaggataaagagggcgagatccaggctggggctaaactgtcattaaaccgccaattttttgacgagcgctggtccaagcatcgggttgtgtcttgccttgactggtccagccagtacccagagctgctcgtggcgagctataacaacaacgaggatgcacctcacgagcccgatggagtggcattagtgtggaatatgaagtacaaaaaaaccacccctgagtacgtgtttcattgtcaaagtgcggttatgagcgcgactttcgcgaagttccaccccaacctcgtagtcggtggtacttactcaggccaaatcgtattgtgggacaaccgatcgaacaagcgcacgcctgttcagcgaactcctctgagcgctgccgcacacacccaccctgtctattgtgtgaacgttgtggggactcagaacgctcacaacctcattagcatcagtactgacggtaagatttgcagctggtcgcttgacatgctgagccacccccaagattccatggaacttgtccacaagcagtcaaaggcagtcgccgtgacaagtatgtctttccctgtgggcgacgtcaacaatttcgtcgtcggttccgaggaagggagcgtatacacagcctgcaggcacggctccaaagcgggtatttcagaaatgttcgagggccatcagggcccaatcactggcatacactgccatgctgccgtgggggcagtggatttctcccacctgttcgttaccagctccttcgactggacagtcaagctgtggaccaccaaaaataataagcctttatattcatttgaagacaacgccgattacgtgtacgacgtaatgtggtcacccacacatccggctctcttcgcatgcgtggacggaatgggcagattggacctatggaacctgaacaacgatacggaagtgccgactgcatcaattagcgtagaaggaaatccagccctcaatcgcgtcagatggactcacagcggaagggagattgccgtgggtgacagtgaaggacaaattgttatctatgatgtaggagaacagattgctgtccccagaaacgatgagtgggccaggttcgggaggactcttgctgagataaacgccaatcgtgccgacgcagaagaggaggccgctactagaatacccgcatag

SEQ ID NO: 221475 - DNA, 1917 bp, Artificial Sequence
  Description of Artificial Sequence: Synthetic coding sequence
atgtccgacaaatctgaactgaaagccgagctcgaaagaaaaaagcagcgacttgctcagatcagggaagagaagaagaggaaggaagaggaacggaaaaaaaaagagactgaccagaagaaggaggctgtggcaccagttcaggaagagtcggacctggagaagaaaagaagggaggcagaagcgctgctgcagtcaatgggcctgacacctgaatccccaattgtgtttagtgaatactgggtccccccaccaatgtccccttcctccaagagcgtttctacaccgtctgaagcaggctcgcaagatagtggtgatggagcggttggtagccgtactctccattgggacacggatccttctgtcttacagttacacagtgattccgatcttggcagaggaccaataaagctggggatggctaagattacccaggtggacttcccacccagagagatagtcacgtacactaaagaaactcagacacccgtcatggcacagcctaaagaggatgaagaggaagacgatgatgtcgtggcccctaagccccctatcgaacctgaggaagagaagactctgaaaaaagacgaagaaaatgatagcaaagctccacctcatgagctcactgaagaagagaaacaacagatactgcattctgaagagtttctctctttttttgatcattctactcgcattgtggagagggcactgagcgagcagatcaacattttcttcgattactccggacgcgacctcgaggataaagagggagaaattcaggccggtgccaagctcagtttgaacaggcagttttttgacgaacgctggtcaaagcaccgtgtcgtaagttgcttagattggtctagtcaatatcctgagctcctggtcgcatcatataataataacgaggatgcaccacacgaaccggacggggtcgccctggtgtggaatatgaagtacaagaagaccacacctgagtatgtgttccattgccagagcgcggtgatgtccgctacattcgccaaattccatcccaatctggttgtaggcggtacatacagcgggcagatcgtgctatgggataatcgatccaataagcgcaccccagtgcagcggacaccactttcggccgcagcccatacccaccctgtgtactgtgttaacgtggtagggacgcaaaacgcacacaatcttatatcaatatcgaccgacggcaaaatctgtagttggtcacttgacatgctgagtcacccgcaggacagcatggaactggtgcataagcaaagcaaagcagtagctgtcacctcgatgtccttccctgtaggcgatgtgaataattttgtggtaggcagcgaagagggcagtgtgtacaccgcctgtcgacacgggtcgaaggcgggtatatccgagatgtttgagggccaccagggcccaattactggcattcactgtcacgccgctgtgggagccgtagactttagtcacctgttcgtgacctcatcctttgactggaccgtcaagctgtggaccaccaagaataataagcccttgtattcctttgaagacaatgccgactacgtctatgatgtcatgtggagccctacccaccctgcactctttgcttgcgtggatgggatgggaagactagatttatggaacctaaacaatgacaccgaggtgccaacagccagtatctctgtggagggtaaccccgcactgaatagggtcagatggacgcatagcgggagagagattgccgtcggcgattcagagggccagattgtgatttatgacgtgggggaacagatcgctgttcccaggaacgatgagtgggcccgttttggcaggaccctggctgagatcaacgcaaaccgtgctgatgctgaggaggaagccgctacccgcatcccggcttag

SEQ ID NO: 221476 - DNA, 1839 bp, Artificial Sequence
  Description of Artificial Sequence: Synthetic coding sequence
atgagcgacaaatccgagctgaaggccgagctagagcgcaagaagcaacgacttgcacagatcagagaagaaaaaaagcgcaaagaagaagagagaaaaaaaaaagagacagaccagaagaaggaagccgttgcaccagtccaggaagaaagcgatttggagaaaaagcgcagggaggcagaagccctcctccagagcatgggcttaactcccgaaagccccatcgttcctcctcctatgtctccgagcagcaagtctgtgagcacaccatctgaggctggctcccaggactcgggcgacggagcagtggggtcacgaagggggcctatcaaattgggaatggcgaaaatcacacaggtggatttcccacccagagagatcgtgacctacaccaaggagacccagacacctgtcatggctcagcccaaagaggacgaagaagaagacgatgatgtcgtggcccctaagcccccaattgaacctgaggaggagaagaccctcaaaaaagatgaggagaacgattcaaaagcacctcctcatgagctgactgaggaggagaagcagcagattctgcactccgaagagttccttagtttttttgatcactctactaggatcgtggagagggctctcagcgaacaaattaacatttttttcgattactccgggagggatctcgaagacaaggaaggtgaaattcaagccggagcgaagctgagcctgaaccgacagttctttgatgagcgatggagtaagcacagggttgtgagttgtctagactggtcgtcgcagtacccagagctattggtagccagctacaacaacaacgaggatgccccacacgagcctgatggtgttgctttagtttggaacatgaagtacaaaaagactacccccgaatacgtcttccattgtcagtccgccgtgatgtccgctactttcgccaagttccatccaaacctggtggtcggcggtacttattctggacaaatcgtgctgtgggacaatcgatctaacaagaggacccctgtgcagcgaactcctctgtcagccgctgcccatacccatcctgtctattgcgtgaatgtagtgggcacacaaaacgcccataatctgatctcaatcagcaccgacggtaaaatctgttcctggtcccttgatatgttgtcccacccccaagactcgatggagctcgtgcacaaacagagtaaagcagtcgctgttactagcatgagcttccctgtgggcgacgtcaataattttgtggtgggatctgaggagggcagcgtttacactgcttgtcggcacggcagtaaagccggaatcagcgaaatgttcgaaggtcaccaagggcctatcacaggcattcactgtcacgccgcagtcggcgcagtggacttttcacatctcttcgtgacctcgtccttcgactggacagtgaaactgtggacgactaaaaataacaaacctctgtattcctttgaagacaacgctgactacgtatacgatgtcatgtggtcgccaacccatcccgctctgttcgcctgtgtcgatggcatgggcaggctggatctgtggaaccttaacaatgacactgaagttcctactgccagtatttccgtcgagggtaatccagcactgaaccgagtaaggtggacccattcgggaagggagatcgccgtgggcgacagcgaggggcagattgttatatatgacgtcggcgagcagatcgccgtgcccaggaacgacgagtgggcacggttcggcagaacacttgctgagattaacgccaatagggctgacgctgaggaagaagcagccactcgtattccagcttag

SEQ ID NO: 221477 - DNA, 1899 bp, Artificial Sequence
  Description of Artificial Sequence: Synthetic coding sequence
atgagcgacaagtctgagcttaaggcggagcttgagcggaagaaacaaagattggctcagataagagaggagaagaagcgaaaggaagaggaacggaaaaaaaaggagacagaccagaagaaggaggctgtggccccagtgcaagaggagtccgacctcgagaagaaacgcagggaggctgaagctctgctgcagagcatgggtctgactcctgagagccccatagtgcctcctcccatgtctccaagcagcaagtcggtctcaaccccctcagaagccggtagtcaggatagcggtgatggcgctgtggggtccaggaccctccattgggatacggacccttcagtcttgcagctccactcagattccgacctaggtcgaggccctatcaagctggggatggctaagatcacccaggttgatttcccccctagagagatcgtgacgtacactaaagagacccagacaccagtgatggcccagcccaaggaggatgaagaggaagacgacgacgtggttgcacccaaacccccaatagaacccgaagaagaaaaaactctcaaaaaggatgaagaaaacgatagcaaagccccacctcacgaactgacagaggaagaaaaacaacagatcttgcacagcgaggagtttctcagtttctttgaccatagcacaagaatcgttgagagagctctgtctgagcaaatcaacattttcttcgactattccggaagggatctcgaggataaagagggggagatccaggctggcgctaaattatcccttaacaggcaattcttcgacgagagatggtctaaacaccgagttgtgtcctgcctcgactggagctcgcaataccctgagctgctggtggccagctacaacaataatgaagacgctccccatgagcctgatggagtggcactggtgtggaatatgaagtacaaaaaaacgacacccgagtacgtcttccattgtcagtcggctgtcatgagcgctaccttcgcgaaatttcacccaaatctcgtcgtgggaggaacctattctggtcaaatcgttctctgggataaccgatcaaataaaaggaccccggtgcaaaggacccccctcagcgctgccgctcacactcaccctgtgtactgtgtaaatgtagtgggcacccagaacgctcacaacttaatctcaatcagcacagacggaaaaatctgttcctggagtctggatatgctgtctcatccacaagattccatggagctggttcataaacagtccaaggcagtggcagtgaccagtatgtcttttccagtgggggatgttaataactttgtggttggtagtgaagaagggtccgtgtacacggcatgtcggcacggaagtaaagccggaatttccgagatgtttgaggggcaccagggacccataacaggcatacattgccacgccgctgtcggtgcagttgacttttcccacctgttcgtgacatccagtttcgactggacagtcaagctgtggacaacgaagaataacaaaccactctactccttcgaggataatgctgattatgtgtacgacgttatgtggagcccaacacaccctgcactcttcgcgtgcgtggatggaatgggcagattagatctgtggaacctgaataatgataccgaagttccaaccgcctcaatctcggtagagggtaatcccgcactgaatagggtgcggtggacccatagcgggagagaaattgcggtcggggacagcgagggccagattgtcatttatgacgtgggtgaacagattgcagtcccacgtaatgacgaatgggcaagattcggaagaacattggcagagattaacgctaacagagcagacgctgaggaggaggcagcaactagaattcccgcatag

SEQ ID NO: 221478 - DNA, 1914 bp, Artificial Sequence
  Description of Artificial Sequence: Synthetic coding sequence
atgtctgacaagagcgagctcaaggcggagcttgagcgaaagaaacagcgacttgcacagataagagaagaaaagaagcgcaaggaggaggagagaaaaaagaaagagacagaccagaaaaaggaagccgtcgcaccagtgcaggaggagtcagatctggaaaaaaagcgaagggaggcagaagccctgttacagagcatgggtctgactcctgagtcaccgatagttttctctgagtattgggtgcctccaccgatgagcccctcaagtaagtccgtgagcaccccaagcgaggctggatcccaggactccggggacggcgctgtgggctcaaggacgctgcattgggacactgacccctctgtcctgcagttgcatagcgattccgacttgggacggggtcccataaagttggggatggccaagattacccaagtggacttcccaccgcgtgagatcgtaacatacaccaaggagacccagacacccgttatggcacagcccaaggaggatgaggaggaggatgacgacgttgtagctcccaagcctccaatcgagccagaagaggagaagaccctgaagaaggatgaggaaaacgacagcaaggcacctccccatgagttgaccgaagaggagaagcagcaaatcctgcactctgaggaatttctgagcttcttcgaccactctacccggatcgttgagcgagcgctctctgaacagatcaacattttcttcgactattctggacgcgacctggaagacaaagaaggcgaaatccaggctggcgcaaaactttctttgaacaggcaattctttgacgagcggtggtcaaaacatcgggttgtgtcgtgtctggactggtctagtcagtaccccgaactcctcgtggcttcatacaacaacaacgaggacgcccctcacgaaccagatggcgtggctcttgtgtggaatatgaagtataagaaaactaccccagagtacgtttttcactgtcagagcgcagttatgagcgctacgtttgcaaagttccaccccaatctcgtggtggggggaacatatagcggtcagatcgtgctttgggacaatcgtagcaacaagaggacccctgtccagaggaccccgctcagtgcagcagcacatacacatcctgtgtactgcgtgaacgtggttggcacccagaatgcccataacctcatatccatcagtacagatggcaaaatatgttcttggtcgttagacatgctaagtcaccctcaggattctatggaactagtccacaagcagtccaaggctgtagccgtaacctccatgtcctttccggtcggcgacgtcaataacttcgtagttggttctgaggaaggctcagtgtacacagcctgccgccacggctctaaagcagggatcagcgagatgttcgaaggtcatcagggtccgatcacaggtatccattgtcatgccgcagtgggcgcagtagacttttcccacctgttcgtcacttccagtttcgactggactgtaaagctgtggacgaccaaaaacaacaagcccctgtattccttcgaggataacgcagactatgtgtatgacgtgatgtggagccctactcaccccgcactatttgcctgtgtggatggtatgggaaggctggacctttggaatctgaataatgacactgaggtgccgaccgctagcatctccgtggagggcaacccggctcttaatcgtgtcaggtggacccactctggtagagagatagctgtcggtgatagcgagggtcagatagtgatatacgacgtaggagaaatcgccgtgccacgaaacgatgagtgggcgcgtttcggccgtactctggcagagataaacgccaatcgcgcagacgcggaggaggaggcggcaacgagaatccctgcttag

SEQ ID NO: 221479 - DNA, 1917 bp, Artificial Sequence
  Description of Artificial Sequence: Synthetic coding sequence
atgagcgataaatctgaactcaaggccgagttggagcgcaagaagcagagactagcacaaattagggaggagaagaaacgaaaagaggaggagcggaagaaaaaagaaactgaccagaaaaaagaggccgtggcccctgtgcaggaggagtcagacctagagaagaagagacgcgaagccgaagcccttctccagtcaatggggctcacccctgaaagtcctattgtgttttccgagtactgggtgccaccaccaatgagtccatcatctaagagcgtttccacacctagtgaggctgggtcacaggactcgggggacggcgcagtgggtagtagaacattacactgggacaccgatccctctgtgctacaattgcatagcgacagcgacctgggcagggggcctataaagttaggcatggccaaaatcactcaggttgattttcccccacgagagatagtgacatataccaaggagacgcaaacccccgtgatggctcagcctaaagaggacgaggaggaggacgatgacgtggtggcccctaagcccccaatcgagccggaagaggagaaaacactcaaaaaagacgaggagaatgattcaaaggcgccacctcatgagctcacggaagaagagaagcaacagattctacactcagaagagttcctgtcattctttgaccacagcactagaatcgtcgagagagcccttagcgaacaaattaatatttttttcgactattccggaagggacctggaagataaagagggtgaaatacaggcaggagcgaaattaagtttaaaccggcagttttttgatgaaaggtggagcaagcatagggtggtctcatgtctcgactggagtagtcaatatcccgagctccttgtcgcgtcatataataataacgaggatgcccctcatgaacctgacggagtggccctagtttggaatatgaagtataaaaaaactacaccggaatacgtgtttcattgccagtctgctgttatgtccgcgaccttcgctaagttccatcccaacttggtggtgggcggaacgtactctggccagattgtgctgtgggataaccggtctaacaagaggacacccgtacagaggacccccctgagcgcagctgctcacacacatccggtgtattgcgtgaacgttgtgggaactcagaacgcacataatcttatttcaataagcaccgacggcaagatctgctcatggagcctagacatgctctctcatccccaggacagcatggagttagtgcataaacaaagcaaagcggttgccgtcacatcaatgagcttcccagtgggtgatgtgaacaactttgtcgttggttccgaggagggtagcgtgtacaccgcatgcaggcatggctccaaggcaggcatctctgagatgtttgagggacaccaaggacccataaccggaattcactgccacgccgcagtgggtgcagtggacttttctcatctctttgtgacaagtagctttgattggaccgtcaagctgtggacaactaagaataacaaacccttgtatagcttcgaagataacgccgactatgtctatgacgttatgtggtcccccactcatcctgcactctttgcctgtgtcgatggaatgggacgcttagacctgtggaacctgaacaatgacaccgaagtgcccactgcgtctatttccgtggaaggcaacccagctttaaaccgcgtgaggtggacacattccggaagagagatagcagtaggtgattccgagggacagatcgtaatttatgacgtcggagagcagatcgctgttcccaggaacgatgagtgggccagatttgggcgaaccttagcagaaattaacgcgaatagggctgacgccgaggaagaagcagctactcggattcccgcatag

SEQ ID NO: 221480 - DNA, 1836 bp, Artificial Sequence
  Description of Artificial Sequence: Synthetic coding sequence
atgtcagacaagagcgagctcaaagctgagttggagcggaaaaagcaaaggctggctcagatcagagaggagaagaagcggaaagaagaggaacggaagaaaaaggagactgaccaaaagaaagaggcggttgcaccagtgcaggaagagagcgacctcgaaaagaagagacgagaggcagaggctttgctgcagagcatgggtctgacaccagagtcccctatcgttccacccccaatgtcaccttcgtccaaatctgtatctacaccctccgaagctgggtcacaggacagcggggacggagccgtaggtagtcgcagagggccaatcaagctgggcatggccaagataactcaggtcgactttcctcccagagaaatcgtcacctatactaaggaaacccagacccctgtgatggcgcagccaaaagaagacgaagaggaagatgatgacgtcgtagcccctaagcctccgatagagcccgaagaggaaaaaacactgaaaaaagacgaagagaatgactccaaggcaccccctcacgaactcactgaggaggagaagcagcagatcctgcactctgaagagtttctgagcttttttgaccactctactcgtattgtcgagagggctttgagcgagcaaatcaacatcttctttgactactcgggcagagatctggaagacaaggagggggagatacaggccggtgcaaagctttcactgaatagacagtttttcgatgagagatggtcaaagcatagggtcgtctcctgcctggactggtccagccagtacccagaactgttggtggcctcctacaataataatgaggatgctcctcatgaaccagacggagtcgctctcgtttggaatatgaaatacaaaaaaacgactcctgaatacgtattccattgccaatcggctgtaatgtctgcaacatttgctaaatttcatcctaatctggtcgtaggcggaacttattctggtcagatcgtcctctgggacaatagaagcaataaacggacacctgtgcaaagaacccccttgagcgcagcagcccacacacatccagtctactgcgtaaatgttgtgggaactcaaaacgcccataatctcatcagcatatccacggacggcaagatctgttcttggtccctggacatgttgagtcatcctcaagattccatggagctggtgcacaagcaatcaaaagccgttgcagtcacatccatgtccttccccgtgggagatgtgaataatttcgtggtcggctcggaggaaggaagcgtttacactgcctgcagacacggttccaaggccggaatctcagaaatgttcgaaggacatcagggacccataactggcattcattgccatgccgctgtgggcgcagtggacttcagtcatctatttgttacgtccagcttcgactggacagtgaagctctggacaaccaagaacaataaacctctttatagtttcgaggacaacgccgattatgtatacgatgtcatgtggtcaccaacgcaccctgctctcttcgcttgtgtggacgggatggggagactggacctctggaacctgaataatgataccgaggtgcccaccgccagcataagtgtagaaggaaacccagcattgaatagggttcgctggacccatagcgggcgagagattgccgttggtgactctgaggggcagattgtgatctacgacgttggtgagattgccgtgcccagaaatgacgaatgggctcgcttcggcaggacgctcgccgaaattaatgctaaccgcgctgatgctgaggaagaagctgctacacgaatccctgcttag

SEQ ID NO: 221481 - DNA, 1917 bp, Artificial Sequence
  Description of Artificial Sequence: Synthetic coding sequence
atgagcgataagtctgaactgaaggccgagcttgagcgcaagaagcagaggctggctcaaatcagggaggagaaaaagcgcaaggaggaagaacgcaagaagaaggaaactgatcagaagaaagaagccgtggcacctgttcaggaggagtccgatttagagaagaagcggagagaagccgaggcattgttgcagagtatggggctgacaccagaaagtccaatcgacatcgcagagtacttagttccacccccaatgagtccaagttcaaaatctgtgtcgactccatccgaagctggctcccaggattctggggacggggctgttggtagccggactctccattgggataccgacccctctgtgttacagctgcattcagactccgatctcggccgagggccaatcaagctcggcatggccaagatcactcaggttgatttcccgcctcgtgagatcgtgacttatacaaaggaaacccagacacctgtgatggctcagcccaaagaagatgaagaagaagacgacgatgtcgtggctccaaaacccccaatcgaacccgaggaagaaaagaccttaaaaaaggatgaagagaacgatagcaaggctcctccccacgagttaactgaagaggaaaagcagcagatcctccatagtgaggaatttctgtcgttcttcgaccactcgacacggatagtggagagagcactatccgagcagatcaacatatttttcgactacagcggccgagacctcgaggacaaagaaggggagatccaagccggagccaaattgtccctgaatagacagttctttgacgaacggtggagtaagcacagagttgtctcctgcctggattggtcaagccagtaccctgagctcctggttgctagctacaataataacgaagatgcccctcatgaaccagatggggtggccttagtctggaacatgaagtacaagaaaactacccctgaatacgtgttccactgccaaagcgccgttatgtcagccacctttgccaaattccacccaaacctggtagttggtggaacatattcaggccagatcgtcctttgggataatcggagtaataaaaggaccccagtacagcgcacacccctatccgctgctgctcacactcacccggtgtattgcgttaacgttgtcggtacacagaacgcccacaatttgatatccatttctactgatgggaaaatatgttcctggtctttagacatgctttctcacccccaagacagtatggaactggtacacaaacagagcaaagcagtcgccgtaaccagcatgtcattccccgtgggagatgtgaacaatttcgtggtgggaagtgaggagggtagcgtgtacaccgcctgcaggcacggctcaaaagctggaataagcgagatgttcgaggggcatcagggacctatcaccggcatacattgccatgcggctgtgggcgctgttgatttctctcatctctttgttacttcttcctttgattggaccgtgaaattatggactaccaagaataacaaaccactgtacagttttgaggataatgccgattacgtttacgacgtgatgtggtcccctacacacccggcactgtttgcctgtgtcgatgggatggggagactcgacctgtggaatcttaacaacgataccgaggtgcccaccgcttctattagcgttgaaggaaaccctgcgctgaatcgggttcgctggactcactcaggtagggaaatagccgtcggcgattctgaaggtcagatcgttatctacgatgtgggcgagcagatcgccgtgcccagaaacgacgagtgggctaggtttggccgaacattggctgagattaacgctaatagggccgacgctgaagaagaagcagccaccagaatccccgcatag

SEQ ID NO: 221482 - DNA, 2763 bp, Artificial Sequence
  Description of Artificial Sequence: Synthetic coding sequence
atggccaacgggactgccgatgtgaggaaacttttcatctttacaacgacacaaaactattttggattgatgtcagagctgtgggaccagcctctgctatgtaactgcctagagattaacaacttcctggacgatggcaaccaaatgttactgcgcgttcagcgctctgatgcgggaattagtttttctaataccatcgaattcggtgatacaaaggacaaggttctggtgttcttcaagcttcgccctgaggtgattaccgacgagaatttacatgacaacatccttgtgagctctatgcttgagtctcctatctcatccctgtaccaggcagtcaggcaggtgttcgcccctatgctgctaaaggaccaggaatggtctagaaactttgaccctaagctccagaatctgttgagcgaattagaggccggacttgggatagttctgaggcgttccgacactaaccttacgaaactgaagttcaaagaagacgatacgaggggaattcttactccatctgatgagtttcagttttggattgaacaggcccaccggggaaacaagcagatcagcaaggagcgcgctaattacttcaaggagctgttcgaaaccattgcaagagaattttataaccttgactctttgagcctcctcgaagttgtggacctggtagagaccacccaagacgtggtagatgacgtttggcgtcagaccgaacacgaccactaccccgagtctaggatgttacatcttctcgacattataggtgggtctttcggaagattcgtgcaaaaaaagcttggaactctgaacctctgggaggacccctactacctggtaaaggaaagcctcaaagccggaatctcaatctgtgagcagtgggtgatagtgtgcaaccacttaaccggacaggtgtggcagagatacgtcccccatccctggaaaaatgagaaatacttccctgaaacgcttgataagctgggcaagaggctcgaagaggtcttggccatccgcacaattcatgaaaagtttttgtattttctgcccgcaagcgaggaaaaaattatttgcttgactagggtgtttgaacctttcaccgggttgaatcctgttcagtataacccatatacagagcctctgtggaaagcagctgtgtcacagtacgagaagataatcgctccagccgagcaaaaaatcgctgggaagttaaagaactatatctcagagatccaggacagcccacaacagttactgcaggcctttttaaaatataaggaactagttaaaagacccactatttccaaggagttgatgctagagcgagagaccctgcttgctaggctggtggatagtatcaaggactttagactggattttgaaaaccgctgcagagggattcccggtgatgcatcgggtcctctgagcggtaagaatctgtctgaggtggttaactcgattgtttgggtgcgacagctggagttgaaagtggatgataccatcaagatcgcagaggcactgctgtctgacctacccggattcaggtgtttccatcagagcgccaaagacctgctagaccagttgaagctgtacgagcaggagcagttcgacgattggagccgcgacatccagtccggactctcagattccagaagtggcctgtgtatcgaagcatcctcccgcattatggagttagactctaacgatggactgctgaaagtccattatagtgacaggctggtgattctacttcgagaagtccgacaactcagcgcactgggcttcgtgatccccgctaagatccagcaagtggcaaacatcgcgcagaagttctgcaagcaggctattattctgaagcaggtagctcatttttataatagcatcgaccagcagatgatccagagccagcggccaatgatgctgcaaagtgccctcgcttttgaacagatcataaaaaacagcaaggccggaagcggagggaagtctcaaataacttgggacaaccctaaggagctggagggatatattcagaagctgcagaacgcagccgagcggctcgccacagagaaccggaagctgcgcaagtggcacacgactttctgtgagaaagtcgtagtccttatgaacatcgatcttctgcgtcaacagcagcgctggaaggacggcctacaggaactgagaactgggctcgccacagtcgaagctcagtgccccctcgcctggcaaagcaagtgggagggtccggaggaccctctacagtacttacgcggattggtggcccgagccctggcgatccagaattgggtggacaaagctgagaaacaggctcttctatcggagaccctggacctgtctgaactgtttcatcctgacacttttttgaacgccttgaggcaagaaaccgccagagccgtggggagatccgtcgacagtctcaaattcgttgcttcctggaagggacgtctgcaggaggcaaaactacaaatcaagatttctgggctgctccttgaaggttgctcctttgacggaaatcagttaagtgagaatcagcttgatagtccaagcgtgtcctcagtgctgccctgtttcatggggtggatcccccaggatgcgtgcggaccatattcaccagacgagtgcatctcattgccagtttatacctccgcagaaagagaccgagtcgtgacaaatattgacgttccctgcggaggcaatcaagaccagtggatccagtgcggggctgccctgttcttaaaaaaccaatag

SEQ ID NO: 221483 - DNA, 12924 bp, Artificial Sequence
  Description of Artificial Sequence: Synthetic coding sequence
atggctaacggcacagcggatgtaaggaaactgttcattttcaccaccactcagaattacttcgggctcatgagtgagttgtgggatcagcctctgctctgtaattgcctggaaataaacaattttctcgatgatggtaaccagatgcttctcagggttcagagaagcgatgcagggatcagttttagcaatacaattgagttcggtgatactaaagataaagttttggtctttttcaagctgaggcctgaggtgatcactgacgaaaatctccacgacaatatcctagtcagctctatgttggagtctccaatttcttctctgtaccaagcggtgcggcaggtattcgcccctatgcttctcaaggatcaggaatggtcacggaactttgatccgaagctgcagaatctgttgagcgaactggaggccggactgggaatcgtgcttaggagatctgataccaatctcaccaaactgaagttcaaagaagacgatacccggggaattctaaccccatctgacgagttccagttctggattgaacaggcgcatcgtggcaataaacagatttctaaagagagggctaattacttcaaggaattattcgaaactatcgctcgcgagttctacaacctcgactctctgagtctgctggaagtggtggaccttgtggaaactacccaagatgtggtcgacgacgtgtggagacagactgagcatgaccactacccagagtcaagaatgcttcaccttctggacattattgggggtagttttggcaggtttgtccaaaagaagctcgggacacttaacctgtgggaagacccttactacctagttaaagaatcactaaaggctggcatcagtatctgcgagcagtgggtgattgtctgtaaccacctgacaggacaggtgtggcagcgttacgtgcctcacccttggaagaatgaaaagtattttccagaaactcttgataagctgggaaagcgactggaagaggttcttgccatccgcaccattcatgagaaattcctgtacttccttcccgcatctgaggagaaaattatttgtctcactcgggttttcgaaccgttcaccggcttgaatccagtccagtacaacccctatactgagcccctgtggaaagccgcagtctcacagtatgagaaaatcatagcgcctgctgagcagaaaattgcaggtaaactcaaaaattacatcagtgagatccaggactctcctcagcagctgctgcaggccttcctcaagtacaaagaattagtcaagcgtccaaccatatcaaaggagttgatgctggagcgcgaaaccctgctggctcggctggtggattctatcaaagactttaggctcgatttcgagaatagatgtaggggaatccccggtgatgcctctggacccctgtcgggtaagaatttgtccgaagtggtgaactctatcgtgtgggttcgacaactcgaacttaaagtcgatgacacaatcaaaatcgctgaggccctactgagcgatctgccaggctttcggtgctttcaccagtcagctaaggacctgttggatcagctgaagctttatgagcaggaacaatttgacgactggagccgggatatccagagcggcctaagtgatagccgctcgggcttgtgtattgaggcctcaagtagaatcatggagctggattcaaacgatggattgctcaaggtgcattacagcgaccgactggtgatcttgcttagggaggtccggcaactttctgccttagggtttgtgattcccgcaaaaatccagcaagtggccaatattgctcagaaattctgcaagcaggcaattatactgaagcaggtggcacacttttataacagcattgaccaacagatgatccagtcccagcgtccaatgatgctccaatccgccttagcattcgagcagatcataaaaaactctaaagcagggtctggcggtaaatcacagatcacgtgggataatcccaaggaactagaaggctacatacagaagttacagaatgccgcagagcggcttgcgaccgagaacaggaagctaagaaagtggcatactactttctgcgagaaggtagttgtcctcatgaacattgatcttctccgccaacagcaacgctggaaagatgggctccaggaattgcggacggggctcgcaacagtggaagcacagggctttcaagcctccgacatgcacgcatggaaacaacactggaatcatcaactatacaaggctctggagcaccagtaccagatggggttggaggcgctcaatgagaacttaccagagattaacatcgatctaacttataagcagggcagactgcagtttcgtcccccattcgaggagattagagccaagtattatcgtgagatgaagagattcatcggcattccaaatcaattcaaaggagtgggcgaagcaggggacgagagcatttttagtattatgattgacaggaatgcctcaggctttctgacaatcttctccaaagctgaagatcttttcaggaggttatccgcagtgcttcaccagcataaagagtggatcgtcattggtcaggtagacatggaagcactagtggagaagcacctcttcaccgtccacgactgggagaagaatttcaaagcactaaagatcaaaggcaaggaggttgagcggttgcctagtgccgtcaaagtcgattgcctgaatatcaactgtaatcctgtgaaaaccgttattgatgatttgatccagaagcttttcgatttactggtactgtcgctgaagaaatcaatacaagcccatctccatgaaattgataccttcgtgaccgaagctatggaggtgctaacaattatgccccagtcagtggaggagattggagatgctaacttacaatacagcaaattgcaggagcgcaagcctgagatcctcccgctcttccaggaggcagaggacaagaacaggttgcttaggacagtcgctggaggaggtctggagacaatcagtaacctaaaagctaaatgggacaaatttgaactgatgatggaatcccaccagttgatgataaaagatcaaattgaggtgatgaaaggtaatgtgaaaagccggctccaaatatattaccaggagctcgaaaagtttaaagccagatgggaccagctcaagcccggtgatgatgtgatagaaacggggcagcacaatactctggataagtcagccaagttgatcaaggaaaagaagatagaattcgatgatctcgaagtgacccggaagaagctcgtcgacgactgtcaccacttccggttggaggagccaaacttctcattggcctcttccatcagtaaggatattgaatcctgtgcccagatttgggccttttacgaagaattccagcagggtttccaggaaatggccaacgaggactggatcactttccggaccaaaacatacctcttcgaggagtttctgatgaattggcatgaccgactgaggaaggtggaggaacattccgtcatgaccgttaagttgcaaagcgaggttgacaagtataaaatcgtgattcccattttgaagtatgtacggggagagcacctctcccctgatcactggctcgatttgtttcgccttttgggactccccaggggcacgtccttggagaagttgctgtttggagacctgcttcgggtggccgatactattgtcgcaaaggcagcagatttaaaggatctgaactcacgtgcacagggagaggtgacaatccgcgaagcactgcgagagttagatttatggggggtgggtgccgtgttcacattgatcgattacgaagacagccagtctcgtacaatgaagcttatcaaggactggaaagacattgtcaaccaggtgggagacaatcgatgtcttctgcagtccttaaaagattcgccctattacaagggattcgaggataaagtctcaatttgggagaggaagctggccgagctggatgagtatctccagaacctcaatcatattcaacgcaagtgggtgtatctcgagcccatctttggacgaggggctctgcccaaggaacagaccaggtttaatcgggtcgatgaagatttcaggtctattatgaccgacatcaaaaaagataatagagtgactactttgaccacacacgccggtatacgcaactccctcctgaccatcctggatcagttgcagcgttgccagaagagcctgaatgaattcctggaagaaaagcgctcagcatttccgaggttctactttatcggggacgatgaccttcttgaaattcttggccaatccaccaatccctccgtcattcagagccacctgaagaagctgtttgcaggtatcaatagcgtgtgcttcgatgaaaaatccaagcacataacagccatgaagagcttagagggagaggtggtcccattcaaaaacaaagtgccactgagcaacaatgtagaaacctggctgaatgatctcgcactggaaatgaagaaaacactcgaacagttgttaaaagagtgtgtcacaacgggcaggagctcacagggcgcagtggacccgtcactcttcccctcgcagattctgtgcctggccgaacaaataaaatttaccgaggatgtggaaaacgccatcaaagatcactccctgcatcagatagagacccagctggtcaataaacttgagcagtatacaaacatcgacacctcttctgaagaccctggcaacactgaatccgggatcttggagctgaaactgaaggccctgattctggacattatccataatattgacgtggtgaaacagctgaaccagatccaggtccatacaactgaagattgggcctggaagaagcagcttcgattttatatgaagtccgaccacacgtgctgcgtgcaaatggtagattcagaatttcagtacacctacgagtaccaaggaaatgcttcaaaacttgtgtatacaccgctgactgacaagtgctatctgactctgacccaggctatgaaaatggggctgggcggtaatccttatggcccagccggaacagggaagactgagagcgtgaaggcccttggaggcctcttaggtaggcaagtgctggtgttcaactgtgacgagggcatcgacgtcaagtccatggggaggatttttgttggactggtgaagtgtggtgcatggggatgctttgacgagtttaatagactggaagaatccgtactcagtgctgtctcgatgcagatacagacaatccaggacgctttaaaaaaccatcgaaccgtgtgcgaactcctgggaaaggaagtcgaggtgaactctaactctggcatctttatcacaatgaacccagctggtaaagggtacggtgggagacagaaacttcctgataatctgaaacaattgtttcgcccagtggcaatgagtcatcctgataacgaattgatagcagaggtgatcctctattcagagggcttcaaagacgcaaaggttctgtcccggaagctcgtcgccatctttaatttatcacgtgaactccttaccccgcaacagcactacgactggggcctgcgagctcttaagacagttctgcgaggatccgggaatcttcttcggcaactcaacaaatctggaactacccagaacgctaacgaatcccacatagtcgtgcaggcccttagactgaacactatgtctaagtttaccttcaccgattgcacccgttttgatgcattgatcaaggacgtgtttcccggaatagagcttaaggaagttgagtatgatgagctgagcgcagcattaaagcaggtgtttgaagaagctaattacgagatcatcccaaatcagatcaagaaggccttggaactgtatgaacagctgtgccagcgtatgggtgttgtgatcgtgggacctagcggagccggaaaatcaaccctgtggaggatgctgagggccgcactgtgcaagactggtaaagttgtgaaacaatacacaatgaatcctaaggcaatgccccgttaccaactcctagggcatatcgacatggatacaagggagtggagcgatggagtcctgacgaacagcgcaagacaggtggttagagagccacaagacgtgtcatcatggattatctgtgatggtgacatcgatccagagtggattgagagtctcaattcagtgctggatgacaaccgactgctcactatgccctccggggagaggattcagttcgggcctaacgtgaatttcgtgttcgagacccacgacctgagttgcgcctctcccgcaacaatcagtcgcatgggcatgatatttctttccgacgaggagaccgatttaaactcacttattaagtcctggctgaggaaccaacctgcggaataccggaataatctggagaattggattggagactatttcgaaaaggctctgcagtgggtgctgaagcagaacgattacgtggtcgagacgagtctggttggcaccgtcatgaacggcctgtcgcatctgcacgggtgcagggatcatgatgaatttattattaacttgattaggggactgggtggtaacttgaatatgaaatcacgtctggagttcactaaagaggtctttcactgggcaagagagagccctccagatttccataaacctatggatacctactacgactcaacacggggacggctggctacttacgtgctgaaaaagccagaagacctgacggccgacgacttcagtaacggcttgactttgcccgtgatccagacgcccgatatgcagcggggtctcgactatttcaagccctggctgtcgtctgacaccaagcaaccgtttattcttgtgggacctgagggatgtggcaaaggtatgctcctgcgctacgcatttagtcaactgaggtccacgcagatcgccaccgttcactgttccgctcagactacatcacgacacctgctgcagaaactgagccagacatgcatggtcatcagcactaacaccggaagagtgtatcgtcccaaggattgtgagcggctggtcctctatctgaaagatatcaacctgccaaagcttgataaatggggaacctctactctcgtggctttcctccagcaagtcctcacatatcaaggattctacgacgagaatttggagtgggttggtctggaaaacattcagatagtggctagtatgtcagctggagggcgacttggcaggcacaagctgactacccggttcacatccatcgtgagattatgctccattgattacccagagcgtgagcagctccaaaccatctacggtgcctacttggaaccagtcctgcacaagaatctaaagaatcatagcatttggggctcttcatccaaaatctatttattggccggatctatggtgcaagtgtacgagcaagtccgagccaagttcacggtcgatgattacagtcattatttcttcacgccctgcatccttacccaatgggtcctgggcctgttcaggtatgatctggagggcggatcaagtaaccatcccctggactacgtgctggagattgtggcttacgaggctcggagactgtttcgcgacaagattgtgggagcgaaggagttgcacttgttcgatattatcctcacctcggtctttcagggagattgggggtctgacattcttgataatatgtccgattccttttatgttacttggggggctagacacaattcaggggcacgagccgcacctggtcagccactacctcctcatggcaagcccctggggaagctgaactctaccgacttgaaggacgtcatcaaaaaaggcctcattcactacggaagggataatcagaatttagatatcctgttgtttcacgaggtgcttgagtatatgtccagaattgacagggtgctgtcttttcccggaggttccctgctgctcgcaggcagatcgggggttggacgacgaaccattacatccctggtgagtcacatgcacggcgctgtgctgttttcgcccaagataagtcgtgggtatgagttgaagcagtttaaaaacgatctgaaacacgttctgcagctggccggaattgaagctcagcaggtggtgcttttacttgaggattaccagttcgtccatcccacgttcttggaaatgattaattcccttctgagctctggcgaagttccgggactatatactcttgaggaattagagccgcttctgctgcctcttaaggaccaggccagccaggacggcttttttggccctgtgtttaattactttacctaccgaatacagcaaaacttgcatatcgtcctgataatggattctgcaaatagcaacttcatgatcaactgtgagagtaatcctgcgctgcacaaaaaatgccaagtgctgtggatggaaggctggtcaaatagcagtatgaaaaaaataccagaaatgctgttttctgagaccggagggggagagaagtacaatgataaaaagaggaaagaagagaaaaagaagaactctgtcgacccggattttctgaagagcttcctgttgattcatgagtcctgtaaagcgtacggcgctacacccagtaggtacatgacattcttgcatgtctattcagccatcagttcttccaagaagaaagagcttctcaagcgacagtctcacttacaggcaggggtttccaagctgaacgaggcgaaagcactcgtagatgaactcaacagaaaagccggagagcaaagcgtcctgctcaaaactaaacaggacgaggccgatgccgctcttcagatgattaccgtgtccatgcaggacgcaagcgagcagaaaaccgagctcgagaggctcaaacatcgaatcgcagaggaagtcgttaaaatcgaagagaggaaaaataaaattgacgacgagcttaaggaggttcagccccttgtgaatgaagctaaactggcagtgggaaacattaagccagaatcgttgtccgagattcgcagcctccgaatgcctccagacgtgattagagatatcctggaaggtgtcttacgacttatgggaatctttgacacttcatgggtgtcaatgaagagttttcttgccaaaaggggcgtccgggaggacattgccactttcgacgccaggaatatcagtaaggaaatcagagaatctgttgaagagctgctgttcaagaacaagggctcttttgaccccaagaatgccaagagagcgtccactgcggctgccccacttgcagcatgggttaaggcaaatatccagtactctcacgttcttgaaagaatccaccctctggaaaccgagcaggctggtttggagagcaacctcaaaaagaccgaagatcgtaagaggaagctcgaagagttactgaactccgtgggacaaaaggtttcagaactcaaagaaaagtttcagtcacgtacgtctgaggccgcaaagcttgaggccgaggtgtccaaagctcaggagacaatcaaggcggctgaggtgctgattaatcagttagaccgagaacataagcggtggaatgctcaagtggtggaaattaccgaagagctcgctacacttccaaaacgtgcccagctcgcagcagcttttataacatacctgtcagctgcgccagagagccttcgcaagacttgtctggaggaatggacgaagtcagcaggattggagaaattcgacctcagaagattcttgtgtaccgagagcgagcaactgatctggaaatctgaggggctaccgagcgatgacctctccatcgagaatgccctggtcattttacaatcccgggtgtgccccttcctgatagacccctcctcgcaagccacggagtggttgaagacccacctgaaggactcaagactggaggtgattaatcaacaggatagtaactttattaccgctctggaactggccgtcagatttggcaaaactctcataatacaggagatggatggggtggaacctgtgctctaccccctactgcggagagatctggtcgcccaaggacccagatatgtcgtgcagatcggagacaaaatcattgactataatgaggagtttcggctttttctgagcactcgaaaccccaatcctttcatacccccagatgctgcctccattgtcacagaggtgaacttcaccactacaaggtccggccttagaggccaactgctcgcgttgacaatacaacacgagaaacccgacctcgaggagcagaagaccaagctgctgcagcaggaggaggacaaaaagattcagttggccaagttggaagagagcctgctcgaaaccctggctacgtcccagggaaacatcctggagaacaaagaccttattgagtctctgaatcagacgaaagcatcctctgcactcattcaagaatccctaaaggagagctacaagcttcagattagtctggaccaggagagagatgcctacctcccacttgccgaatcagcaagcaaaatgtactttattatttccgacctctcaaaaattaacaacatgtatcggttcagcttggccgcttttctgagacttttccagagagcactgcagaacaaacaggatagtgaaaatactgaacagcgtatccagtccttgatcagttccctccagcacatggtttatgagtacatctgcaggtgcctgttcaaggccgatcagttgatgttcgccctgcattttgtgaggggcatgcacccagaactatttcaagagaatgagtgggacacattcacaggcgtcgttgtcggagacatgcttaggaaggctgatagtcaacaaaaaattcgagaccagctgccaagctggatcgatcaagaacgtagttgggctgtggcaacactcaagatcgctctgccctctctgtatcagaccctgtgtttcgaagatgccgcactgtggcgcacatactataataattccatgtgcgagcaggagtttccttctattttggctaagaaggttagtctttttcagcagatcctggtcgtgcaggcactcagacctgatcgtctgcagagtgccatggccctgtttgcatgtaagaccctcggattgaaggaggtgagccccctgcctctcaacctcaagaggctgtacaaggaaactctggaaatcgaacccatcctgatcatcataagccctggggctgacccaagccaggagctacaagagctggcaaacgctgaacggtcaggggaatgctatcatcaagtagcgatgggacagggccaagccgatttggctattcaaatgttgaaggagtgtgctagaaacggcgattggctgtgtctgaagaaccttcatctcgtggtatcctggctgccagttttggagaaagaactgaacaccctgcagccaaaagatacatttagactgtggctgaccgccgaggtccacccaaattttactcctattctgctgcagtcaagcctcaaaatcacttacgagtcacctcccggactcaaaaaaaatctgatgcggacatatgagtcatggacacccgaacagatttcaaaaaaggacaatactcaccgcgctcatgccctgttcagtttggcatggtttcatgcggcttgccaggagcgtcgcaactatatccctcaaggttggactaagttttacgagttcagcttgagcgacctacgcgcaggatacaatatcatagatcggctgtttgacggcgctaaagacgtgcagtgggaatttgtccacggtctcctggaaaacgctatatacggtggcagaatcgataactactttgacttaagagtcctgcagagctacctcaaacagttctttaacagtagtgtgatcgatgtgttcaatcaaagaaacaagaaatctatttttccgtattccgtgagcctgccccagtcctgtagcatcctcgactaccgtgccgtgatagagaagattccagaagatgataagccatccttctttggcctgcccgcaaatatagcacgctcctcccagcggatgatctcctcacaggtgatttcgcagttgcgaatcctgggccgatctatcactgccggttctaaatttgaccgcgagatttggtctaacgaactgtcacccgttctcaacctctggaagaagctgaatcaaaactccaacctcatccaccaaaaggtgccccctcccaacgatcgccaggggtcacccattctgagctttattattctcgagcaattcaatgcaatccgcctcgtgcagtccgttcaccagtccctagctgctctatctaaagttatccgtgggacaactctgctctcttcagaagtacagaaactggcatctgccttgctgaatcagaagtgtcccttagcctggcagagcaagtgggaaggcccagaagatcccctgcagtatctaaggggtctggtcgctcgggcattggccatccaaaactgggtcgataaggccgagaaacaagcactccttagtgagacactagatctgtcggaactttttcacccagatacttttctgaatgccctgagacaggagacagcgagggctgtaggaaggtcagtggacagccttaagtttgtggcatcctggaagggacgcctccaagaggctaaactgcaaataaaaattagcggtctgctgctcgaaggttgcagttttgacggcaatcagctgtcagaaaatcagctggactctccttctgtaagcagcgtgctgccctgttttatgggatggatcccccaggatgcatgcggtccttattccccggacgaatgcatttctctgccggtgtatacgtctgcagaaagagatagagtggtcaccaatatagacgtgccctgtggaggaaaccaagatcaatggatccagtgcggcgcagccctatttctaaagaaccagtat

SEQ ID NO: 221484 - DNA, 12945 bp, Artificial Sequence
  Description of Artificial Sequence: Synthetic coding sequence
atggctaacggtactgccgacgtacgaaaacttttcattttcaccaccacacaaaattacttcggtctaatgtcagaactatgggatcagcccttactctgcaattgcctagagatcaataatttcctggatgacggaaatcaaatgctcctccgtgtccagaggtctgacgctgggatttcattttctaatactatcgagtttggagatactaaggataaagtgctagtttttttcaaactgagacctgaggtgattactgatgagaacttacacgacaacattttagtctccagtatgctcgagtctcccatcagcagcctatatcaggccgtgcgacaggtcttcgcccctatgcttcttaaagatcaggagtggtcccggaatttcgatccgaagctgcaaaacctattgagcgaactggaggctgggttggggatcgtcctacgccgatctgatactaatctgactaagttgaagtttaaggaagatgacacgcgagggatcctaacaccaagcgacgaatttcaattctggatcgagcaagcccaccgaggaaacaaacagatctctaaggagcgcgctaactattttaaagagttatttgaaacaatcgctcgggagttctacaacctggactcactgagccttctggaagtagttgacttggtggagacaacccaagacgtcgtggatgacgtctggaggcagactgaacacgaccactatcccgaatcccggatgctgcacctgctcgacattattggcggaagcttcggccgtttcgtgcaaaagaagctggggactttaaatctttgggaggatccttactatctggtcaaggagagcctgaaggccggtatctccatatgtgagcagtgggtgattgtatgcaaccacctgaccggacaagtgtggcagcgctatgtgcctcatccgtggaagaacgagaaatattttccagagactctcgataagctgggcaaaaggctggaggaagtgcttgcaatccgcaccatccacgaaaagttcctctatttcctgcccgcttcagaagagaagattatttgtctgacccgggtgtttgagccgtttactggcctgaaccctgtgcagtataacccctacaccgagcctctgtggaaggcagcagtctcacaatatgagaagattatcgcgcctgccgagcagaaaatcgcaggaaaactgaagaactacatcagtgagattcaagacagccctcagcagttacttcaggcctttctcaagtataaggagctcgtgaaaaggcccaccatcagcaaagaactcatgctcgaacgagagaccttactggctaggctggtggattccattaaggatttccgacttgactttgaaaatagatgtcggggtatacctggagatgcttctgggccactctctggcaaaaatctgagtgaggtggtgaattccatcgtgtgggttaggcagctggagctgaaggttgacgacacaatcaaaattgctgaagcactcctgtccgaccttcccggtttccggtgttttcaccagtcagccaaagacttgctggatcagttaaagctttatgaacaagagcagtttgacgactggagtcgtgatatccagagcggcctctccgattccaggagcggtctgtgtatcgaggcatctagtagaattatggagctggatagcaatgacggactgctgaaggtccactactccgaccgcttagtgatcctgctgcgggaggttcggcagctatcggctctaggctttgtcatcccagcgaaaattcaacaagtagctaacattgcccagaaattttgtaagcaggctattatcctcaaacaggtggctcacttctataacagtatcgaccaacagatgattcagagccagaggcctatgatgctgcagtctgcgctcgcgttcgaacagatcatcaaaaacagtaaagccggatccggagggaaatctcagatcacatgggataaccccaaggagctggagggatatatccagaaattacagaatgctgccgagcgactggccactgaaaaccggaagttgcgcaagtggcacacaacattctgcgagaaagttgttgtgctgatgaatatcgatttgctccggcagcaacaaaggtggaaggatgggcttcaggaactgagaactggtctggccactgtggaggcccagggatttcaagccagtgatatgcatgcatggaagcagcactggaatcatcagttatacaaagcactggaacatcaatatcagatgggcttggaagccctcaatgaaaaccttccagagatcaatattgacctgacctataagcaaggacggctccagttcagacccccatttgaggagattcgggctaaatattatcgggaaatgaagcgattcatcgggattcctaatcagttcaaaggtgtcggggaggccggagatgagtccatcttcagcatcatgatagacaggaacgccagtgggtttttgacaatcttctctaaggcagaggacctgttccgacgcctgagtgctgtcttacaccaacacaaagagtggattgtgattgggcaggtcgacatggaagctctggtcgagaagcatctgttcactgttcacgattgggaaaaaaacttcaaagctctcaagattaaggggaaggaggtggaaagactgccctccgccgtcaaggtagactgccttaacatcaattgtaatccagtgaaaaccgtgatcgacgatctcatccagaagttgtttgacctcctggtgctgtcattgaagaagagcattcaggcacacttgcacgagattgatacatttgtgacagaagccatggaggtgttgacgattatgcctcagagcgtggaagaaatcggcgatgcaaatctgcagtactccaaactccaggagagaaagcccgaaatcctcccattatttcaggaggcggaggacaagaatcgcctcctgcggacagtggcaggagggggactggagaccatcagcaacctcaaggcaaagtgggataaatttgaactgatgatggagagtcaccagctgatgatcaaggaccagatcgaggtcatgaaaggcaatgtgaagtctcggttgcaaatttattaccaggaattagaaaagtttaaagctcgatgggaccagctgaaaccaggcgatgacgtgattgagaccggacagcacaatactcttgacaagtccgcaaaacttatcaaggaaaaaaaaattgagtttgacgacttagaagtcacaagaaagaagctggtggatgattgtcatcactttagactcgaagaacctaacttctcactcgcctcgtcaatcagtaaagatattgaatcttgcgcccagatatgggccttttatgaagagtttcaacaggggttccaagaaatggctaatgaggattggattacgtttcgtaccaagacttacctttttgaggagtttttgatgaattggcatgatcgactccgaaaagtggaggagcattcggtgatgactgttaagctccagtcagaagtcgacaagtataagatcgtgattccgatcctgaaatatgttcggggtgagcatctgtctccagaccactggctggatcttttcaggctgctggggctgcctcgaggtaccagtttggagaagcttctgttcggagacctcctgcgcgtggcagacacgatcgtggcaaaggcagctgatctcaaagatctcaacagcagggcccaaggggaagtgacaatcagggaggcactgagggagctggacctgtggggggtgggagcagttttcacgctgatagattacgaagactcacagtcacgcaccatgaagctcatcaaggattggaaagacatagtgaatcaggtcggcgacaaccgttgtctcctccagtctctcaaggactcgccatactataaggggttcgaggataaggtgagcatctgggagagaaagctggccgagttggacgaatacctgcagaaccttaatcacattcagcgcaaatgggtatacttagaacctattttcggcagaggcgctctgcctaaagaacaaacacgatttaatagggtggatgaggactttcgatctatcatgactgacattaagaaggataaccgcgtgaccactctgaccacgcacgctgggattcgcaactcgctgctgaccatcttggaccagctgcagcgttgccagaagtccctcaacgaattcttagaagaaaagaggtcagccttccctagattttactttattggcgacgacgacctcctggaaatattaggacaaagcacaaatccatctgtcatccagtcccacctgaaaaagctattcgccggaattaacagcgtctgcttcgacgaaaagagcaagcatattacagcgatgaaatcactggaaggagaggtcgtacctttcaaaaacaaggttccgctgtcaaataacgtggagacctggctgaacgaccttgcattagaaatgaagaagactctggaacagctgctgaaggagtgtgtaaccaccggtcggagctcccagggcgctgttgaccccagtttatttccttctcagatcctctgcctcgcggagcagattaagtttactgaggacgtggagaatgctatcaaggaccatagcctgcatcagatcgagacacagctggtcaataagttggagcagtacacgaatatcgacacatcatctgaggaccccggtaatacagaatcaggcatcctggagctgaagctcaaggccttgattctcgatatcatccataacattgatgtcgtcaaacagttaaatcagatccaggtgcacaccactgaggattgggcttggaaaaagcagctcaggttctatatgaagtccgaccatacttgttgcgtgcaaatggttgactcagaattccaatacacatacgaataccaaggcaacgccagtaagctcgtctatacgcccctaacagataagtgctatctgaccctgacccaagctatgaagatggggctgggagggaacccctatggccctgccggtaccggtaagaccgagtcggtgaaagcactcggcggactgctgggacggcaggtgctagtcttcaattgcgacgaggggatcgacgtaaagagtatgggcaggatcttcgttggcctggttaaatgtggggcatggggctgttttgatgagtttaatagacttgaagaatctgtgttaagcgctgtaagcatgcaaatccaaacaattcaagatgctcttaaaaaccacaggactgtctgtgaactgctggggaaggaggtggaggtgaatagcaactcgggtatctttatcaccatgaaccctgcaggaaagggctacggcggaagacaaaagctccctgacaatttgaagcagctttttcgaccagtggcgatgagtcaccccgacaacgaactcatcgcagaggttattctgtactctgagggcttcaaagacgccaaagtgttatcgcgcaaattggtagccatctttaacttgagtcgtgaattgttgactccgcagcagcactacgattggggacttcgcgctctgaagacggttctgagaggttccgggaacctgctgcgacaattgaacaaatccggtactactcagaacgcaaacgagagtcacattgtcgtccaggccctgcggttaaacacgatgtctaaattcacattcaccgactgcacgagatttgatgccttgatcaaggatgtttttcccggtattgagctgaaggaggtggaatatgacgagctctccgccgctctgaagcaggtgtttgaggaggccaattacgagataatacccaatcagattaaaaaggccttggagctgtacgaacagctgtgccagaggatgggtgttgtgattgtgggacctagcggagcgggaaaaagtaccttatggaggatgctcagggcggctctgtgcaaaactgggaaggtggtgaaacagtacacaatgaatccaaaggccatgccgagataccagttgttgggccatattgacatggatactagggagtggagcgacggagtgttgactaactccgccaggcaggtagtcagggagcctcaggatgtgagttcctggatcatttgcgacggagatatagacccagaatggattgagagcctaaactcagtgctggacgacaatcgtctcttaacaatgcctagcggagaacggatccaatttggaccaaacgtgaatttcgtgtttgaaacccacgatctgtcttgcgcttcacccgctacaatttctcggatgggtatgatcttcttgagcgacgaagaaaccgacctgaatagtctgattaagagttggctgcggaatcagcccgctgaatatcggaataacctggaaaactggataggcgattattttgaaaaggccctacagtgggtactcaagcagaacgattacgttgttgaaacaagcctggttggaacagttatgaatggcctgtcacacctccacggttgtagggatcatgatgaattcatcatcaatttgatccgaggcttggggggtaacctcaacatgaaaagtagattggagttcacaaaagaagtctttcactgggccagggagagccccccagacttccataaacctatggacacatactacgattccacacgcggaaggctggcaacttatgtcttaaaaaaacctgaagatcttactgcagacgatttctccaatggccttacactgcccgtaatccagacacctgacatgcagaggggattggattatttcaagccttggttgtcttctgacactaagcagccctttatcttggttggcccagaaggatgcgggaaaggcatgctgcttaggtacgccttttctcagctgcgttcaacccaaattgccaccgtgcattgttcagcgcagacgaccagccgtcatcttcttcaaaagttatcccagacctgtatggtcatcagcaccaatactgggagggtctacaggccaaaagattgtgaaaggcttgttctgtatctcaaagatattaatctgccaaagctggacaagtggggcacaagtaccctagtggccttcctccaacaagtccttacctaccaggggttttacgatgaaaatctggagtgggtgggcctggagaatatacagatagtggcaagcatgtccgccggaggccgactaggacgccataagctaaccactagattcacttcaatcgtacggctctgcagcattgactatcccgagagagaacagctgcagactatctatggtgcttacttggagcctgtgctgcataaaaatctgaaaaatcacagcatctggggcagcagctctaagatctatctgctggccggatcgatggtccaggtgtacgagcaagtgcgggctaaattcaccgtggacgattactcacactactttttcacaccctgtatcctgacacagtgggtactcggcctgttccgctacgacttggagggcggaagtagtaaccacccgctggattacgtgttggaaattgtggcatacgaagcgcgacggctgttccgcgacaagatcgtgggggcaaaagagctgcatctctttgatatcatcctgaccagtgtctttcagggagattggggatccgacattttagacaatatgtcagacagcttttatgtcacttggggcgctaggcacaactcaggcgcaagagccgctcccggacagccccttccaccccatggcaagccactggggaaactcaattcaacagacctgaaggacgtcatcaagaaagggctgatacactacggcagggacaatcagaatctcgacatcttactattccatgaagtgctcgaatacatgtccagaattgatagggtgttgtcttttccgggtgggagcttgctgcttgcagggagatccggcgtagggaggcgaaccattaccagcctcgtaagccatatgcatggcgctgtcttgttctctcccaagattagccgcggttatgaactaaaacaatttaagaacgacctcaagcatgtgttgcagctggccggaatagaagcccagcaggtcgtgctcctcctcgaagactatcaattcgttcatccaacatttctcgagatgattaattctctgttaagttcaggagaggtgccaggcctctatacgttggaggaactagaaccgctgctccttcctttgaaggatcaggcctctcaggatggctttttcgggccagtgtttaactacttcacttatagaattcagcagaacctgcacattgtcctgatcatggatagcgctaactcgaatttcatgataaattgcgaaagtaatcctgccttgcacaaaaaatgtcaagtgctgtggatggaaggttggtccaattcctccatgaagaagatccctgagatgctcttttctgaaacaggcggaggtgagaaatacaacgataaaaagagaaaagaggaaaaaaagaaaaactccgtggatcccgacttcctgaaatcctttctgcttattcatgagagttgcaaggcttatggggcaaccccaagccggtacatgacctttctgcatgtgtactctgccattagcagttctaagaagaaggaactgctcaaaagacagagccacttgcaggctggcgtcagcaagctgaatgaagctaaagcactagttgacgagttgaaccgcaaggcgggtgagcagtctgtgcttttaaaaacaaagcaggatgaagccgatgccgcactgcagatgattacggtgagcatgcaagatgcgtctgaacagaagaccgaactcgaacgcctgaaacaccgaattgcagaagaagtggtgaaaattgaagagagaaagaacaaaattgatgacgaactgaaagaagttcagcctctcgtcaacgaggccaaacttgctgtgggcaatattaaacctgagtccctaagtgaaattcgcagtctacgtatgccacccgacgtcataagagatatcctggagggagttctccggctgatgggaatttttgacacctcttgggtgtccatgaagtcctttctggccaagcggggagtgagggaagacattgccaccttcgacgcaagaaacatcagcaaagaaatccgagaaagtgtggaagaactccttttcaaaaataaaggatcgttcgaccccaaaaacgccaaacgggcttctaccgctgcagctcccctcgcggcatgggtgaaagccaatatccaatattcgcatgttctggagcgcattcaccccctggaaacagaacaagcgggtctggagagtaatttaaaaaaaaccgaggaccgcaagcgcaagctcgaagaacttcttaatagcgtgggacagaaagttagcgagctaaaggagaaattccagtccaggacctctgaggccgctaagcttgaggccgaggtcagcaaagcccaggagaccatcaaagcagccgaggtgctgattaaccagttggaccgcgagcataaaaggtggaatgctcaagtggtcgaaattactgaggaactggccacgttacccaagcgcgctcagttagctgctgcgtttataacgtatcttagtgccgcacctgaaagccttcggaagacttgtctggaggagtggactaagagcgccggactagagaagtttgaccttcgtcgatttttgtgcacggaatctgagcaattgatttggaagagcgagggcttgccctccgacgatttatcgatcgaaaatgctcttgtaatattacagataataggacttaagagctggtcgcgtgtgtgtccgtttttgattgaccctagcagccaggccacggagtggctgaaaacccacttgaaagattcccgtttggaggtgattaaccagcaggactccaacttcatcaccgccctggaactggcagtacgttttgggaagacccttatcattcaggagatggacggcgtggaaccagtcttatatcccctgctgagacgggacttggtcgctcagggccctcgatatgtcgtacagattggcgacaaaatcatcgactacaacgaggaatttcggctgttcctgtctacccgtaaccctaatccgttcataccgccagatgcagccagcatcgtgactgaggtcaatttcacgaccacaaggtcggggctgcgtggacagctacttgctttaacgattcagcacgaaaagccagacctggaagaacagaaaactaaactgctgcagcaggaggaggataagaaaatccagcttgcgaaactggaagaatctctgctagagactctagccacttcccaggggaacatcctggagaacaaagatttgattgaaagtctgaatcagacaaaagcgagttccgcgctgatccaggagagtctaaaggaatcctacaagctccaaatttcgctggaccaggagcgcgacgcctatctgcctcttgcagaaagcgcctctaagatgtacttcatcatcagcgatctgtccaagatcaacaatatgtatcggtttagtctggccgcattcctgcggctcttccagcgggcactccagaacaaacaggactcagaaaatacggagcagcgtatccagtcactgatctcatcgctgcagcatatggtgtatgagtatatctgccgctgtctctttaaggctgatcagttgatgttcgccctgcactttgtgagaggcatgcatccagagttatttcaggagaacgaatgggatacctttactggagtcgtcgttggagacatgctgcggaaggcagactcccagcagaagattcgagatcagctcccaagctggatcgaccaggagaggtcatgggcagtggctactttgaagatcgccctccctagcctgtatcagaccctttgctttgaagatgccgctctctggcggacttattataataatagcatgtgtgaacaggagtttccttctattctcgcaaaaaaagtttctttgttccagcagatcctcgtggtgcaggccctgcggcctgaccggctgcaatctgccatggccctgttcgcctgcaagaccttgggcctgaaagaggtgtccccattgcctctgaacctgaagcgcctctacaaggaaacacttgagatcgagccgatcctcatcataatttctcctggggcagatccttcacaggagctacaggagctggcaaatgcagagcgcagtggtgaatgctatcaccaggtcgcaatgggccagggacaggccgatctcgctatacagatgctgaaagaatgtgcgagaaatggggattggctgtgtctgaagaacctgcatctggtggtatcgtggctgccagtgctagagaaggagctgaatacattgcagcctaaggatacgtttcggctgtggttaacagctgaggtgcatcctaactttacccccatcttgctccagtcttcactgaagatcacctatgagtcccctcctggtctcaagaaaaacttaatgagaacgtacgaaagttggaccccagagcagatatctaaaaaagacaatacacacagagctcacgctcttttctcacttgcatggttccacgcagcctgtcaggagaggaggaattatatcccacagggttggaccaagttttatgagttctcattgtccgacctcagggccggatataatatcatcgatagactatttgacggagccaaggatgttcagtgggaattcgttcacggcctgctcgagaacgctatatatggtggacgaatcgataactattttgacttacgagtgttgcagagttatctgaagcagtttttcaactcttcagtcattgatgtcttcaaccagcgaaacaaaaagagcatctttccctactcggttagtctccctcagtcctgttctattctggactacagagccgtgattgaaaagatacctgaggatgacaagccaagtttttttggactcccagcgaatattgccagatcctctcaaagaatgataagttctcaggttatttctcagttaaggattttaggtaggtcgattactgcaggctccaagtttgacagagaaatttggagtaacgaactctctcctgtgctaaatttatggaagaagctcaaccagaactcaaaccttatccaccagaaagtgccccctcccaatgatagacaagggtcccccatcctctctttcattatcctggaacagtttaatgctattaggctcgtccaatccgtgcatcaatctctggccgctttaagtaaagtgattcgcggaactacgctgctcagcagcgaggtccaaaaactggcatctgctcttttgaaccagaaatgcccgctggcatggcagtccaaatgggaaggccctgaagatccattacaatacttgcgcggactggtagccagggcacttgcaatccagaactgggtcgacaaagccgagaaacaggccctgctcagcgagaccctggatctgagcgaattgttccaccccgacacttttttaaatgcccttaggcaggagacggcgcgagcagtcggtaggtccgttgatagcttgaagtttgtggcttcttggaaaggcagactccaggaagccaaactgcaaattaagatttcaggacttctgcttgaaggatgctcctttgacggcaaccagcttagtgagaatcaattggattccccttccgtgtcatcggttctgccctgtttcatgggctggatcccccaagacgcttgcggaccttactcacccgacgaatgcatttctctgcctgtgtacacctccgccgagcgagatagggttgttaccaacatcgacgtcccctgtgggggaaaccaggaccagtggatccaatgtggggcagctctgtttcttaaaaatcagtaa

SEQ ID NO: 221485 - DNA, 1515 bp, Artificial Sequence
  Description of Artificial Sequence: Synthetic coding sequence
atgggccagggccaagccgacctggccattcagatgttgaaggaatgtgccaggaatggtgactggttatgcctcaagaacctgcacctcgtcgtttcctggctgcctgtactggagaaagaattgaataccttgcagccaaaagacaccttccggttgtggcttaccgccgaagtgcacccaaatttcacaccaatcctactgcaatccagcctgaagattacttacgaaagccctcccggtctcaagaagaatctgatgcgtacctacgaaagctggacacctgaacagatttccaaaaaagacaatacccatagagcacatgctcttttcagtcttgcttggtttcacgctgcctgtcaagagcgcagaaactatatcccccagggctggactaaattctacgagttcagccttagtgacctgagagctggatacaatattatcgacagactgtttgacggcgctaaggatgttcagtgggagttcgtacacgggctgctggagaatgcgatttacgggggtcgtattgacaactatttcgatctgagggtcctgcagtcctatcttaagcagttttttaactctagtgtaatcgatgtattcaatcaaagaaataaaaaaagcatcttcccttatagtgtcagcctgccacagtcttgcagcattttggattaccgcgcagtcatagagaagatacctgaggatgataagcctagcttctttggcctgccagccaatatcgccagatcctcccagaggatgatcagcagtcaggttatttcgcaactgaggatactcggacgctccattactgccggtagcaagttcgacagggaaatctggtctaatgagttgtccccggttttgaatctctggaagaagcttaatcaaaacagcaatctcattcaccagaaggttccgcctcctaatgaccggcaggggagccctattctctcctttatcattttggagcaatttaatgctatcagactagtacaaagcgtgcatcagagcctcgccgcactgtcaaaggtaataagaggcacaacgttgctgagctcggaagtgcaaaaactggcctcagccctcctgaatcaaaaatgtcccttggcctggcagtcaaaatgggaaggtcccgaggacccactccagtacttacgcggattggtagccagggctctggcaatccagaactgggtggataaagccgaaaaacaggctctgctgtcagagacattagacctgagcgagctcttccatcctgataccttcctgaacgctctccgccaggaaacagcccgagcagtgggcaggtccgtggattcactcaaattcgtggcaagttggaagggccgattgcaagaggctaagctgcagatcaagatctctggactcctgctggaggggtgttcattcgacggaaatcagctttctgaaaaccagcttgatagcccctccgtgagcagcgtactcccgtgtttcatgggctggattccacaggacttgctatag

SEQ ID NO: 221486 - DNA, 270 bp, Artificial Sequence
  Description of Artificial Sequence: Synthetic coding sequence
atgtgtgaccgcaaggccgtgattaagaatgcagacatgagcgaggagatgcagcaggactcagtcgagtgcgcaacgcaagctctcgagaagtataatatcgaaaaggacatcgcagcccatattaagaaggagtttgataagaagtacaatcctacttggcattgcatagttggtcgaaatttcggatcctacgtgacccatgagaccaaacatttcatctacttctatctggggcaggtggccatcctactcttcaaatctggctag

SEQ ID NO: 221487 - DNA, 270 bp, Artificial Sequence
  Description of Artificial Sequence: Synthetic coding sequence
atgtgtgatcgcaaagcagttatcaagaacgctgatatgtcagaagaaatgcaacaggattccgtggagtgtgctacacaggcactagagaaatacaacatcgaaaaagacatcgctgcgcacatcaaaaaagagtttgataaaaagtacaacccaacatggcactgtatagtcggacgcaatttcggctcctacgtgactcacgagacaaaacattttatttatttttatttgggccaagtcgccatcctgctcttcaaaagcggatag

SEQ ID NO: 221488 - DNA, 270 bp, Artificial Sequence
  Description of Artificial Sequence: Synthetic coding sequence
atgtgcgatcggaaagccgtcataaagaatgcggacatgagcgaggaaatgcagcaggatagcgtggaatgcgccacgcaggccttagagaagtataatatcgagaaggacatcgctgcgcacatcaagaaggaatttgataaaaagtataacccgacctggcattgcatcgttgggaggaactttggaagctacgtgactcacgaaactaagcactttatctacttctacctcggacaggtggcaatcctgctgttcaagtcaggatag

SEQ ID NO: 221489 - DNA, 270 bp, Artificial Sequence
  Description of Artificial Sequence: Synthetic coding sequence
atgtgtgacaggaaggccgtgatcaagaatgcagacatgagcgaagagatgcagcaggacagcgtcgaatgcgccacacaagcactagaaaagtacaacatcgaaaaggacatcgccgcacacatcaaaaaggaattcgacaaaaagtataatcccacatggcattgtattgtggggagaaatttcggatcatacgtcacccacgaaactaagcatttcatatacttctatctgggacaagtggctatcctgctcttcaagagcggttag

SEQ ID NO: 221490 - DNA, 129 bp, Artificial Sequence
  Description of Artificial Sequence: Synthetic coding sequence
atgtgcgaccgtaaggctgtgatcaaaaatgctgacatgtccgaggaaatgcaacaggactcggtggagtgcgctacgcaggccctggaaaaatacaacatcgagaaggatatcgccgcacacatctag

SEQ ID NO: 221491 - DNA, 270 bp, Artificial Sequence
  Description of Artificial Sequence: Synthetic coding sequence
atgtgcgacagaaaggcagtgattaaaaatgctgatatgtcagaggaaatgcagcaggactctgtggaatgtgcaacccaagccctggagaaatacaacatcgagaaggatatcgccgcacatatcaagaaagaatttgacaaaaagtacaatcccacgtggcactgtattgtcgggcgaaatttcggaagctacgtgacccacgagaccaaacatttcatttacttctacctgggccaggtcgctattctgctctttaaaagcgggtag

SEQ ID NO: 221492 - DNA, 270 bp, Artificial Sequence
  Description of Artificial Sequence: Synthetic coding sequence
atgtcggatcggaaagccgttatcaagaatgctgacatgagtgaggatatgcagcaggacgcagtggactgtgctacgcaggcgatggagaagtacaacattgaaaaggacattgcggcatatatcaagaaggagtttgacaaaaagtacaatcccacgtggcattgtatagttgggagaaatttcgggagttacgttacacatgaaacaaaacatttcatctacttctacctcggccaggttgccattctgctgttcaaatccggctag

SEQ ID NO: 221493 - DNA, 144 bp, Artificial Sequence
  Description of Artificial Sequence: Synthetic coding sequence
atggctgaagtggaggagacattgaagcggctgcagagtcagaagggtgtgcaaggcatcatcgtcgtaaacacagaagggggatgggaaccactggggcattgcggagaccggtcccggcctcccgctcagggttgtccgtag

SEQ ID NO: 221494 - DNA, 291 bp, Artificial Sequence
  Description of Artificial Sequence: Synthetic coding sequence
atggctgaggttgaagaaacattgaaacgcctgcagagccaaaaaggggtacaggggattatcgttgtgaacactgagggcatcccaatcaagtctaccatggacaatcctacaactacccagtatgcatcacttatgcactcatttattctcaaagcgaggtcaaccgttcgggatattgatccccaaaatgacctgacttttttgcgcatcaggtctaaaaagaacgagatcatggtggccccagacaaggactactttcttattgtcattcagaatccaacggagtag

SEQ ID NO: 221495 - DNA, 366 bp, Artificial Sequence
  Description of Artificial Sequence: Synthetic coding sequence
atggcagaggttgaggaaacgctgaagaggttacagtcacagaagggggtacagggaatcattgtggtgaacactgaggggatcccgatcaaatccactatggataatccaacgacaacgcagtacgctagccttatgcattcgtttatattgaaagctcgctctaccgtccgggacatagacccgcaaaatgatctgaccttcctgcgaattcgtagtaaaaagaatgaaatcatggtggcacccggtaaggggtcctctacttcaccatgcagaaaccggccacatggaacattttcagtcgcccatcaggaaagctggcacagtggtgtgtcccgaggctccaagcagggtccacgctcttag

SEQ ID NO: 221496 - DNA, 291 bp, Artificial Sequence
  Description of Artificial Sequence: Synthetic coding sequence
atggccgaggtggaggagacattgaaacgtattcagtctcacaaaggtgtgatagggactatggtggtgaacgcggagggtatccccatcagaaccaccctggataattccaccactgttcaatacgctggcctgctgcatcacctgaccatgaaagcaaagtcgacagtgagagatatagacccacagaatgacctgactttcctcaggatccgaagtaaaaagcatgaaatcatggtggcccctgataaagagtacttgctcatcgttattcagaacccttgcgaatag

SEQ ID NO: 221497 - DNA, 165 bp, Artificial Sequence
  Description of Artificial Sequence: Synthetic coding sequence
atggccgaggtcgaagaaactctgaagaggattcaaagtcataagggcgtaatcggcacaatggtggtcaacgccgaagacccgaggttcgttacgttcaagtatgctagacagctaaccgccttccagcgtaaaagcggccaacagatcacaatcaaggactag

SEQ ID NO: 221498 - DNA, 486 bp, Artificial Sequence
  Description of Artificial Sequence: Synthetic coding sequence
atggatcccaaccctcgcgcagccttggagcgccagcagctgcgactcagggaacgacagaaatttttcgaagacattctgcaaccagagaccgaatttgtctttcccctcagccacctgcatctggagagccagagacccccaataggcagcatctctagtatggaggtgaatgtggacacgctagagcaggtggaactgatcgacttaggtgaccctgacgcagctgacgtgtttctgccgtgtgaagatcctcctcccacaccacaatcatccggcatggacaatcatctggaagaactgtctctgccggttcctacttcggaccgtacaacgtctcgcaccagctcttccagcagttccgacagctccactaacctacactcacctaacccctctgatgacggtgctgatacgcccctggcccagtccgacgaggaggaagagcgcggagacggcggagcagaacccggagcctgttcctag

SEQ ID NO: 221499 - DNA, 486 bp, Artificial Sequence
  Description of Artificial Sequence: Synthetic coding sequence
atggatcctaacccgagagcagcactggaacgtcagcagctacggctcagagagagacaaaagttctttgaggacattctccagcccgaaaccgaattcgtgttccctttgagccatttgcaccttgagagccagcgtccacctattggatcaatctctagcatggaagtaaatgtggataccttggaacaagtcgagctgatagatttgggcgaccctgatgctgccgatgttttcctaccatgtgaagaccccccacctacacctcagtcatcagggatggacaaccacctcgaggagttgtctttacccgtgcccacatcagacagaaccacgtcaagaacctcgtcctcaagttcaagcgacagcagtacaaatcttcatagccccaacccctccgacgatggcgcagacacacccttagcgcagtctgatgaggaggaagagcgaggggatggcggagcagagccgggtgcctgcagttag

SEQ ID NO: 221500 - DNA, 792 bp, Artificial Sequence
  Description of Artificial Sequence: Synthetic coding sequence
atggagagttgggccttggcagttttccctgagtaccgcgttagtctattatggtgcctggaactggcaagtcctctgtggtccctgggccaggcgccaccactgcatgagacctggttcgtgggtcacacgtggttccagggtaggggaaaaagatcccctcgcgcagaggtgtcaagacccgaacccggtgcaccactcctgggatgctggctgcaatggggagcaccctcgcccggtccactgtgcttactctttcgtctttgctcttgtacatgctttgctcctttacccgctggggctgacatggaccccaaccctagagccgctctggaaagacagcagctgcgcctgcgcgagcgtcagaagttcttcgaggatatcctccagcctgagacagaattcgtctttccactgagtcatctgcacctggagagccagcggccaccaatcggatcaatttcttcaatggaggtgaatgtggacacattggagcaggtggagctgattgatctgggagatcccgacgccgcagatgtctttctaccatgcgaagatcctcctcctacccctcagtcgtccgggatggacaaccaccttgaggaactctcattgccagtcccaacctctgaccggactacctcccgcaccagctcttctagcagctccgactctagtaccaatctccatagtcctaacccttctgatgatggggcagatacacccttagctcagtccgacgaggaggaagagaggggagacggtggcgctgaacctggggcttgtagttag

SEQ ID NO: 221501 - DNA, 486 bp, Artificial Sequence
  Description of Artificial Sequence: Synthetic coding sequence
atggatccaaaccccagagccgctctagagcggcaacagcttcgcttgagagagcggcagaaatttttcgaggatattctccaaccggagactgaatttgtgttccccctaagccacctccatctggaatcacaacgacccccaatcggctccatctcgtccatggaggtcaacgtggataccctggagcaggttgagctgattgaccttggtgacccagacgcggcagatgtttttctgccatgcgaagatccacctccgacaccacagtcaagtggcatggataatcacctggaggaattgtcacttcccgtcccaaccagcgaccggactacctcaagaacatcaagcagttccagctcggactccagtaccaacctgcacagcccaaacccttccgacgatggcgcagatacgcctctcgctcaatccgatgaggaggaagagaggggcgatggaggtgctgagcccggagcttgttcttag

SEQ ID NO: 221502 - DNA, 339 bp, Artificial Sequence
  Description of Artificial Sequence: Synthetic coding sequence
atggacccaaatcctagggcagcactcgagagacagcaacttagattacgagaacgccaaaaatttttcgaggatatcctacagccagagaccgagtttgtgttcccactatcacacttgcatttagaaagccaacggccacctatcggctctataagcagcatggaggttaacgtggacacactggagcaagtggagcttatcgatttgggagatccggatgccgcagatgtctttttgccttgtgaggatcctcctcccacgcctcagagctcagggatgcctctctgcttcggggattttagcgcgagtcagcctgaacctgacgtaagactgtag

SEQ ID NO: 221503 - DNA, 780 bp, Artificial Sequence
  Description of Artificial Sequence: Synthetic coding sequence
atgggggcagggaacttcctgacagctctggaggtacctgtggccgcactggccggtgctgcatccgacagaagggcctcatgcgagagggtgtccccccctccccctcttccacacttcaggctgcccccactgcctcgaagtcgcctgcctggacctgtcagccggcctgaaccaggcgctccactgctagggtgttggctgcagtggggagcacctagtcccggacccctgtgccttctgtttcgactctgcagttgtacatgttttgcccctcttccggcaggcgcagatatggatccgaatcccagagcagcactcgagaggcagcagctccgcctccgagagagacagaagttctttgaggacatcttgcagcccgagaccgagttcgtcttcccactctcgcacttacatctggaatctcagcgccctcctataggctcaattagttcgatggaggtcaacgtggacacccttgagcaggttgaactaatcgacctgggggatccggatgccgctgatgtcttcctcccgtgtgaagatccccctccgactcctcagagctccggcatggataatcatctggaggaactatcactgcctgtcccaacaagtgatagaaccactagccgcacgtcaagttcaagcagcagcgacagttctaccaacctgcattcgcctaatcccagcgacgacggagccgatacaccactggcccagagcgatgaggaggaagagcgcggagacgggggagccgaacccggtgcctgctcgtag

SEQ ID NO: 221504 - DNA, 339 bp, Artificial Sequence
  Description of Artificial Sequence: Synthetic coding sequence
atggatcctaacccacgtgccgcattagaacgccaacagctgcgactccgagaaagacaaaagttttttgaggacattctccagcctgagactgagtttgtgttccctctcagtcacctacacctagagagccagaggcctcctattggctctattagttccatggaagtcaacgtggataccctcgagcaggtggagctgattgatcttggagacccagacgccgctgacgtgtttctgccgtgtgaggaccctcctcccactcctcaatcaagcggtatgcccctctgcttcggggacttctctgcttcacagccagaaccagatgttagactctag

SEQ ID NO: 221505 - DNA, 486 bp, Artificial Sequence
  Description of Artificial Sequence: Synthetic coding sequence
atggaccctaatccacgtgcagctctggagagacagcagctgaggctgcgcgaacgccagaagttttttgaagacatcttgcagcctgaaacagaatttgtgtttcctctgagtcatttgcacctcgagagtcagcgcccaccaatcgggagcatctccagcatggaagtaaacgtggacaccttagaacaagtggaactgatcgacctcggggatccagatgctgccgatgtatttctgccatgcgaggatcctccgcctacccctcagtctagtgggatggacaaccatctggaagaactatccctgcctgtgccaactagtgacagaacgacctcaagaacctctagttcatcgtcaagtgatagcagtaccaatctgcattcccctaacccttccgacgatggcgcagatacgcctctggcccagtcggatgaggaagaggagagaggagatggcggagctgagccgggagcatgcagttag

SEQ ID NO: 221506 - DNA, 519 bp, Artificial Sequence
  Description of Artificial Sequence: Synthetic coding sequence
taaacctggtttcagggacggggaaagcgatctcccagagctgaagtgagcaggccggagcccggtgctcccttgcttggatgctggttgcagtggggcgcaccaagccccggtcccttgtgtctcctcttccgcctgtgctcgtgtacctgcttcgcacccttgcccgcaggtgcagacatggatcccaacccaagggctgctcttgagagacagcagctccggctccgggagcggcagaagtttttcgaggatatcttgcagcctgagaccgagtttgtgttccccctatcacaccttcacctggaatcccaacggccaccaatcggctctatctcatcaatggaagtaaatgtggataccctcgagcaggtggagctgattgatcttggcgaccccgatgctgcggatgttttcttgccttgcgaggaccccccaccaactccccagtcttccggcatgccactgtgctttggcgattttagcgcctcacagcccgaaccagacgtacgattgtag
